United States Patent 7,745,391 (HUMAN THROMBOSPONDIN POLYPEPTIDE) - sequence listing, part 201

SEQ ID NO: 475091 - DNA, 645 bp, Homo sapiens
cacctgagctgagctatcctgccaacagaggcaggtatggctggaggccctggctgggaggacccaccccacaaggagcagtggattggggtcctgcttaaagaagcagtctggctacattctgggaaagcagctgtgctgtgctgggggcaccctacctcatcccgaccatttggactctccaaagcccacagaccgaaacagccgactgcagatgtccttgccagggatcccgaggccagaatatgtaaagctcctgggtctctgtacatgtttgagcagctgctctgtggagactccacacagctgtgtgcatcagatccaaggcgctggagacacgggcctataaggggacctcctgatccacagattgcaaagatccacgggagaagtgtggtttcccgggggcatgcaatcactcactgcttccctccaccggggtagcttcctgtccccaggatgctttggacccacacaacttttttcttccaggtagaaagaaacagaaaaatgtgtctatatgcccttagaagcacaaatatttagtcaaagcaattatgaaagaagctgctgccttcatctagatgagatcaatgacacagctggagaaagactttaaaatcgtcggtcaattcagcctagact

SEQ ID NO: 475092 - DNA, 675 bp, Homo sapiens
ggcgtgggtcacagacatcaagtactttacaaggcagcaaggttttgcaaaatgagtgagggacaggtagtaggagatgtggccacagaagtggctgatgaaggctttggcatttactctgagttagaacagataatagacaaagatgaaagtaagaagaacactttgcaggcagttacaattatccacgggaaagatgatggtggctccccttcctcaaccatattgatgcataattcacaaataaaaactggactgggaagtcgaagatcaaggcaccagcagatttggtgtctggaggagatgagacaacgcaagtctttcctgcctaggagcctgttaaaccaaaagcaagttagttacttcctagacacaatgagggtacagccattgggtaaatacagccattccaaatgggagaaattggctaaaacgaagggcctacaggccccatgcaagtttgaaatccagcaaggcagtcaaatcttaaagctccaaaatgatctcctttgactccatgtctcacatccaggtcacactgatgcaaaggatgggttcccgtggtcttgggcagctctacccctttggctttgtaggctagagcctccctccccatgctttcacgggctgatgttgaatgtctgcagctttttcatatgcatgttgcaaactgtc

SEQ ID NO: 475093 - DNA, 1483 bp, Homo sapiens
gggtggagccaagatggccgaacaggaacagctccggtctacagctcccagcgtgagtgacacagaagacgggtgatttctgcatttccatctaaggtaccaggttcatctcactaagggagtgccaaacagtgggtgcaggacagtgggtatagcccaccgtgtgggagccgaagctgggcgaggcattgcctcactcaggaagcacaaggggtcagggagttccctttcctagtcaaagaaaggggtgacagatggcacctggaaaatcgggtcactctcaccctaatactgcacttttccaacaggcttggaaaacggcacaccaggagattgtgtcctgcacctgtcttggagggtcttatgccaatggagacttgctgattgctagcatggcactctgagatcaaactgcaaggcggcagcgaggctggggcagtggggcccgccattgcccaggctttcttaggtaaacaaagcagccaggcagctggaactgggtggagcccaccacagctccaggaggcctgtctgcctctgtaggctccacctctgggggcagggcacagacaaacaaaaagtcagcagtaacctctgcagattaaatgtccctatctgacagctttgaagagagtagtggttctcccaacacgcaactggagatctgagactgggcagactgcctcctaaagtgggtcactgaaccccgagcagcctaactgggaggcactcccctgtagggacagactgacacctcactcgaccgggtagtcctctgagaccaaacttccagaggaatgatcagacagctgaatttgttgttcacgaaaatccgctgttctgcagccactgctgctgatacccaggcaaacagggtccggcaaggaaaactaacaaacagaacacccacaccaaaaacccatctgtacatcaccatcatcaaagaccaaaagttgataaaaccacaaagatggggagaaaacagagcagaaaaactggaaactctaaaaagcagagtgcctctccttctccaaaggaacgcagaggaaattcaaaccaatagcaaagaagttaaaaactttgaaaaacaattagacgaatgtataactggaataatcaatgcagagaaatgcttaaagtatctgatggagctgaaagccaagtttcgagaactacgtgaagaaggcagaagcctcaggagccgatgcaatcaactggaagaaagggtatcagtgatggaagatgaaatgaattaaatgaagggagaagggaagtttagagaaaaaagaataaaaagaaacgaacaaagcctccaagaaatatgggactatgtgaaaagatgaaacctacgtctgattggtgtacctgaaagtgatggggagaatggaactaagttggaaaacactctgcaagatattatccaggaggacttccccaatctagcaaggcaggccaacattcagattcaggaaacacagagaac

SEQ ID NO: 475094 - DNA, 512 bp, Homo sapiens
atatcccactagcaggtaacagtatgattccttttaacttttgccaatcagatggataccaagtacaggttgaggtcccttacccaaaatgcttggagccaaaagtgtttcagattttgttttggaatatttgcattaccctctgggcatcatgtgggccttctagacattttcaacaatatctttatgccacaagagagagaataagcagaaaaaactacagagatggtgatgtagcagaaccggccacagacaagaacccctcagacaccaagttgtggaacgaaagggctttattcagctgggagcatccgaggactcacgtctccaaaaaccgagctccccgaattcaggagctgacaccagctgggtgtcctcttattcaattcaattctaacactacatacctgaagatagtgtcagatcccatgggttaagggctcagtcccacaagactatctccaattcagatgccaatcaaaagccccacattgtagcctgtgcttctggct

SEQ ID NO: 475095 - DNA, 594 bp, Homo sapiens
tggaatcatcatggaatggaatggaatggaatcattgaatggacccgaatttagtcatgatcaattggaatcgaatggaatcttcgaatggactcaatttaaatcatcatggaatgcaagtgaatggaatcatcatcgaatggaatcgaatggaatcatcatcaaatggaatacaatggaatcgtcatcaaatggaatcaaatggattcatcatccaataatggaatcattcaatggaatcgaatggaatcatcatcgaatgaaatcacatggaatcatcgaatggactcaaatggaatcatcatcgaacagaatcaaatggaatcatcgaatggattcgaatggaataatcatcgaatggactcaaaaagaattatcaaatggactcgaatggaatcatcatcgaatggactcaaatggaatgatcgaaaggactcgaatggaatcatggattggactcaaatggaattatcgaatgggctcaaatggaatcatcgaatggactcaaatggaatcatcgaacgtaatcgatcacaatcatcatcgaatggaatcaaatgtaatcatcaaatggaattgaatgcagtcatcatc

SEQ ID NO: 475096 - DNA, 976 bp, Homo sapiens
tcgaacgaactcgaatggaatcaatcatcgaatggactcgaatgcaatcatcgaatggacacgaatggaatcatcatcaaatggaatagaatgcaataatcgaatggactcgaatggaattatcatggaatggaatcgaatggaatcattgaatgaactcgaatggaatcatcatcgaatggaatcgaatggagtcatcgaatgggttcgaatggaatcatcatcaaatggaatcatgtggaatccatcatcgaatggaatcaaatggaatcatctaatggacccgaatggaatcatcattgaatggaataaaatggaatcatcatcgaatggaataatcatcatagaatacaacagagtggaatcatcattgaatggaatggaatggaatcatctaatggacaggaatataatcatcatcgaattgaaacatctattgtacccaaatagaatcatcatagaatgcaatagaaatcagcatcgaatggaatcacatggaatcaccaaatggactcgaatggaatcatcattgaatggaatcgaatgtaatcatcaaatggactcgaatggaatcatcattgaatggaatcaaatggaatcactgaatggactcgaatggaatcatcatcaaatggaatcaaagggaatcatcgaatggactcgaatggaatcatcatcaaatggaattggatggaatcaaagaagggactcaaaaggaatcatcgaatggacacaaatggaatcatcactgaatggaatcgaatgggatcatcgaatggactcgactggaatcatcatcgaatggaatcgcataggatcatcatcaaatggaatagaatgggatcatcatcaaaagaaatccaatggaatcactgaatggactcaaggtaatgatcaaatggacgcgaatggaatcatcaaatggaatcgaatggaatcaccaaatggaatcgaatggagttattgaacagactct

SEQ ID NO: 475097 - DNA, 725 bp, Homo sapiens
tgcaattgtaaagaatcatcgaatggactcgaatgcaatcatcgaatggacacgaatggaatcatcatctaatttactcgaagggaatcatcatcaaatagaatcaagtggaatcatcaaatgtactcgaatgcatcgaatggaatcacatggaatcaccaaatggactcgaatggaatcatcattgaatggaatcgaatgtaatcatcaaatggactcgaatggaatcatcattgaatggaatcaaatggaatcactgaatggactcgaatggaatcatcatcaaatggaatcaaagggaatcatcgaatggactcgaatggaatcatcatcaaatggaattggatggaatcaaagaagggactcaaaaggaatcatcgaatggacacaaatggaatcatcactgaatggaatcgaatgggatcatcgaatggactcgactggaatcatcatcgaatggaatcgcataggatcatcatcaaatggaatagaatgggatcatcatcaaaagaaatccaatggaatcactgaatggactcaaggtaatgatcaaatggacgcgaatggaatcatcaaatggaatcgaatggaatcaccaaatggaatcgaatggagttattgaacagactctaatggaatcatcatgagatggaattgaatggaatcattaaatggactcgaatggaatcattgaatggactcgaatgaaatcatcgaatggactc

SEQ ID NO: 475098 - DNA, 800 bp, Homo sapiens
tggacccgaatggaatcatcatctaatggaattgaatgtaatcatcgaatggactcgaatggaatcatcatcaaatggaaccgaatggattcattgaatggaatcgaatggaatcatcatcgaatggaatcgcatgaaatcatcaaatggcatcaaacggaatcatcattgataagaatcaaatggtatcacctaatggacaagaatggaatcactatcgaatgcaatcgaatggatcctcatcgaatggaatcgaatggaatcatcgaatggacacaaattgaatcattgaccaaattgaatggaatcattgaatggacccgaatggaatcatcatcaaatggaattgaatggaatcattgtatggacttgaatggaatcatcatcaaatggaatcgaaaggaatcatggaatggaattgaaaggaatcatcatcaaatggaatggcatggaatcatcaaaaggcatcaaatggaatcatcatcgaaaagaatcaaacagaatcatccaatggacacgaatggaatcattatcaaaaggaatcgaatggagacatcgaatggaatagaatgcaatcatcacggaatggaatcgaatggaatcatcatcaaatggaatcgaaaggaaccatcgaatggaattgagttgaaccatcgatggaatcatcatcgaatggagtcgaatggaatcatcatcgaatggaatcgaatggaatcatcattgaatggagtcgaatggaatcatcatcaaatggaatctaattgaataatcaatgaagggaatcgaatggaatcatcatc

SEQ ID NO: 475099 - DNA, 902 bp, Homo sapiens
tcatcaaatgggattgaacggagtcatcgaatggaatcgaggagaatcatcgaatggattcgaatggaatcatcatcaaatggaatccagtggaatcattgaagggattcgaatggaatcatcatcaaatggaattgaatggaatcaccgaatagacacgaatggaatcatcactccaattgaatcaacaaatgaaatcgaatgcaatcatcgaatggactggaatggaatcatcatcaaatggaatcggatggaattaatgaagggactcgaaaggaatcatcaaaaggacacgaatggaatcatcattgaatggaatcaaatggaatcactgaatggactcgaatggaatcatcatcaaatggaatcaaatgagatcatcgtcaaatggaatcgaatgggaacatcatcaaaagtaatccaatggaatcaccgaatggacacgaaagtaacgatcaaacggacacgaatggaatcatcaaatggaatcgaatggaatcatctaatggactcgaatggaattatcaaatggactcaaatggaggattcaaatggaatcatcatcgaatggaatcgaatggaatcttcatcaagtatgatcaaaagcaatcatcaaatggattcgaatagaatcatcaaatggactcgaatggaatcatcatcgaatggaatcattgaatggactcgaatgaaatcaccgttgaatgaaatcaaatggaatcatcgaatggactcgaatggaatcatcatcgaatggaatcaaatggaatcatcgaatttactcgaatggaaacatcaagtggaattgaaaggaatcatcaaatggacttgaatttaatcattgcatggactcgagtggaatcatcgaatgaactcgaaaggaatcaacatcgaatgaaatc

SEQ ID NO: 475100 - DNA, 662 bp, Homo sapiens
tcctcttttttctttttttaaaggaataggctggatgactcgacctctcccgaggaaggatgtgctctgtccaagctcaagttcccaaggagctctggtcctcggtgaagatgcttttaccacaaactctcgttggccacaagccaccaggggagggagcatgccacaccactcagggtgggcaagcaccaggagaaggggtgtgctacactgctcagggccacatggggaagcaccaggaggcagggggagcaggaggaaaatgtggcagcagcctttggtttctgcaggaagaaatggtcaaggtgggtctctccacatcttcaggaaaatatagaccactcattaacgggatgttgttgaggatgcagctcagtgctggttctttctctgaggtgggcacagaatggggacagaggctgcccaagggagtcatccaggttcttggtgcattgaacaaagaattggacaaaacgcacaaacaaaccaacaaaagaatgaagcactgaaagtagcaaggaaagcacagatttattgaagcaaaagtacactccatggagtgggaggaggctctagtaagaggcttaagagccatgattacaatgttctttagggcttttattaagctaaaaaaaatttggcaacacccctaagtgcccttt

SEQ ID NO: 475101 - DNA, 541 bp, Homo sapiens
gcggaagaccggcaatgaacaataaatgtaagaaaatcatttaattatatagcaaactatgaagaaatgcctgagactgggtaatttataaagaaaaagaggtttaatggactcatacatctgcatgactgaggaggcttcacaatcatggcggaaggcgaaggaggaggaacggcacattttacatggtgacagtcaagagaacgtgtgcaggggaactgccctttataaatccatcaggtctagtgagacttattcactatcatacaaacagcatgggaaaacctgcctccttgattcaataacctcccaaagagaagaagaagtggaagtggaagtggaaatggaagaggaagcattagcagcagcagaagaaggagaaggagaaggagaggaagaagaagagaagaaggaggagaagaaggaagaagcagcagacactgcatggcaggattgaggacccaatcagaataaatttgtgtgagatgataaatttgtcttgttctgggccactaaatttgtgatactatgttacagtggt

SEQ ID NO: 475102 - DNA, 1220 bp, Homo sapiens
tgaaatgctattttgcttataaagggctcagcttattgagcagaatggtactcagtaaatgtttaccttggacaaaggtgaagatgatgatgctagagaatgcagaacaaacagtactaaggtctatcctgacacctgtttccactacctctcaaaaccatgatctcaggcagatgcaatggcaacttaacaggccctgtgaagcttcagagcagtgcctgaaacactctgaggacagaaactcagggaccaacacacctgtttccacagagctggcccctgcctctgcttcctggaagcactgcaagagtgcctgcagttatagccgggagatgaccacagtgagaagccagagaagaggtaaacagcaaccttgggcaagcaggaaggcagaagcagatgcttggaaccacccagaggttttctaccacagaatgtgtaactttgattttcacacacaaaatggtctcaacagtggttgaaatatacaaaaacagaaaccccaatccagcccttagcctgatgctctgcatgctgttaagaagggggtgttgaatgattccatttatttgaaatacccaggagagggagaaggttcatttgagaacttcccctgctgaagctttccctgaccctctgggaggggccggaccctccgtctgtggtcccacaacccctgaggaggaggaggcactcatcaggtcccttggcgccttgcagcccttttcttgggcctgccttttacctccatcctccactccactgatggctcagagcccagaatcctgtcttcatcctggcaacagtcccttcagggcccagcaggatgggggaatgaataaatgtgcctgtttctgaacataatcattaaattctttacctgtaatgtggacattaaaggtgaatcatttccccccttaaaccccctccatctttcaaacctgctacccccgaccctcactgagcaaaaaattggaaagctgctctcacggcattattgaaattgaaatagggaatagaacctggatgtccggagcaatcttctgacctggaattttctcctcgctttgctgcctcttgggaaaagcctgttccgcacaagctggcaaggtactgtggtcgcatcagacctgccttgtagcctcagggcatgtgggtcttggggcatctgacataggagcaccctgattccgtttcaacacttttgagaaaccaaattg

SEQ ID NO: 475103 - DNA, 852 bp, Homo sapiens
ctgaatacccgaagacccccgtactgtgaggaagcccgaccacatggagaggccacatgaaggttctcaaatcagaaccccagctgaggtcccagcctacaaccagtatcaaccaccagacatcaaaactgtttggaaaaggcttaatattttaggagaaaagttaaaagggaaaaaacagcggctgcagcctgcccagctaaagaagaaagtggaatcagcagaacaagtggcctgtgaagatgccagcttggctgcaggaacaaagcgccataagctcggtggctcaaaacattcagaaatggttctctcacagactcacggccacggaagctccaagtctgaactcaaggtgttggcagggctgtgttccctctggaggccctacgggagggcccttcctcgtctccagcttctggtggcttcaatggcaaatactattctggtgtttgctgctccaagaacccagatgtacacagtgttccagcagaggctgcacaaatacagtggccccgaggagcttggcatttttgaggagcatcaaggaggccagtgtggcattcatggaaaggacagagggagagtgggagatgagctgacacttagactacatctgcccttgaagctcaacctctttgccgtactcctgtggtgtttcttggcatctggtatcatttcaaaagggtaagaatggcatagagaaggtttctcattgctaagcatggagtaggaatattttagtgaaatgtgtataaggcctttgcactttctaaaccctctaacctggaacactgtttcttctatttatctcaataactccaaccccttctttgtaccatatttcaagcactg

SEQ ID NO: 475104 - DNA, 3441 bp, Homo sapiens
tagtacgtccacagtcagccttgtggttagcttgtgcgctcagaggaatccagggtaacaatggggcaaactgaaaaaccatttcaaatagaagaagatagcgtttcagtctttgatgcctctgaaagctgtgtaatagattgtgaagaagaggcaggaacagagtttaagaaaggaatggaaagtacacattgtaaaaatgcagtagagcctgtactggcttggtcaatgcagaatgttgactataatcaattacaggaggtaatatatcctgaatcatcaaaattgggagaaggaggtccagaattatttgggccatcagagtttagaccacgatggccaccaactccttctcccgcggttcagatgcctttgatgtcacaatctcaaatgccaatccaggcacagtatccgcaataccagccagtagaaaataaaacccaaccatcggtagtttatcaacacaagccgtcagccgtatttcagtatccgccgtctccagaggttcagtatggatctcaggcggtgcgtcctgtgccaaatagcaaggcactatatcaacaacccaaggcgatggcgtttgatcttacagtaccacctagtggacaaggtagtgcactgcatgagaccattgctacagccagaaaacagggagatcttgaggcatggcaatatccgggaatgttacaaacaatgccggccgggaaagggagtcaagcaagagcttcaatcagacaaggctctaaagagccatatccagacttcgtggcaaggttgcaagatgcggctcaaaaatccattgcagagccacctggcctgtgtccaagatgtggaaaaggaaaacactgggctaaggaatgtcgttctaaatttgataaaaatggacaaccattgtcgggaaacggggaagaggggtcagccccaggccccgcaacaaagtggggcattcccgattcagccatttgttcctcagggttttcagggacaacaacccccacagtaaataccaccatttcaggaaatcagccaattacaatacgacaattatcccctgccacagcaggcagtgctgccgtagatttatgttctactcaaatgatttctttactccctggagagccccctcaaaagattcctacaggggtatatgggccgctgccagaagggatggtaggccttattttaggaagatctagtctaaatttgaaaggagttcaaattcatactggggtaattgactcagattataaaggggaaattcagttagtgatcagctctactgttccctggagtgccaatccaggtgatagaattgctcaattactgctcttgccttatattaaaattggggatagcaaaacagaaacaggagtgtttggaagtaccaacactgctggaaaagctgtttattgggctagtcagctctcagagaatagacctgtgtgtacagttactattcagggaaaacagtttgaaggattagtggatactggggctgatgtttccatcattgccttaaatcaatggcaaaaaaatcagcctaaacaaaagcctgttacaggatttgttggtgtgggcactgcctcagaagtgtatcaaagcagatggcgcatgttaactgatttaagagctgttaatgcagtaattcaacccatggggtctctccaacctgggctgccctgtccagccatcatccccaaagattggcctttaattacagttgatctgaagtattgcttttttaccattcctctggcaaaacaggattttgaaaaatttgcttttactataccagccataaatattaaagaaccagccactagatttctgtggaaagtgttgccccagggaatgcttaatagtccaactatttgtcagacttttgtagctcaagttcttcaaccagttagagacaagttttcagactgttatatcattcattatgttgatgatattttgtgtgcttcagaaacaagagacaaattaattgactgttacacatttctgcagacagaggttgcaaacgcaggcctgacaatagcatctgataagattcagacctccactccttttcattatttgggaatgcaggtagaggagagaaaaattaaaccacaaaaagtagaaataagaaaagacacattaagaacattaaatgactttcaaaaattgctaggagatattaattggattcggccaactctaggcatccgtacttatcccatgtcaactttgttctctatcttgagaggggatccagacttaaatagtaaaagaacattaactccaggggcaactaaagaaattgaattagttgaagaaaaaattcagtcagcaaaatttttgaaattgactacttggattttacctaaaattaccagacaaaaacctctagaaaatgctctgacggtgtttactgatggttccagcaatggaaaagtggcttacactggaccaaaagaacaagttattgaaactcaatatcactcagctcaaagagcagaattggttgctgtcatttcagtgttacaagattttaatcagtctattaacattgtttcagattctgcatatgtagtacaggttacaaaggatgttgagacagccctaatcaaatatagtgtggatgatcagttaaatcagctgtttaaattgttacaacaaactgtaagaaaaagaaatttcccattttatatggctcatatccgagcacatactaatttaccagggcctttaactaaggcaaatgaacaagctgacttgctagtatcatctgccttcatggaagcacaagaacttcaggccctgactcatgtaaatgcaacaggattaaaaaacaaatttgatatcacatggaaacaagcaaaaaatgttgtacaacattatgctcagtgtcaagtcttacacctgcccgctcaagaggcaggagttaatcctagaggtttaagtcctgatgcattatggcaaatgaacgtcacacatgtaccttcatttggaaaattgtcacttgtccatgtgacagttgatacttattcacatttcatatgcgcaacctgccagacaggagaaagtacttcccatgttaaaagacatttattatcttgttttgcagtcagtggatttccagaaaaaattaaaacagataatgggccaggatactgtagtaaagcatttcaaaaattcttaaatcagtggaaaattacacatacaacaggaatccctaatttccaaggacaggctataatggaaacaactaatagaacactcgaagctcaattggttaaacaaaaaaaggaaaaagtaaggaatataacactccccagatgcaacttaatctagcactctatactttaaattttttaaatatatatagaaatcagaccattacttctgcagaacaacattttactggtaaaaagaacagcccacagagggaaaact

SEQ ID NO: 475105 - DNA, 1055 bp, Homo sapiens
ggactcgatggaatcttcattgcatggaatcgaatggaatcatcgaatggactcaaatggaattatcatcgaatggaatcgaatggaatcatcgattggacacaaatggaatcaccattgaatggaatcgaatggaatcttcgaatggaatcgaatgaaattattgaatggaatcgaatagaatcatcattgaatagaatcaaattggatcatcatcaaatggagtctaatgaaatcatcattgaatggaatctagtggagtcatcatctaatggaatggaatggaatcagcaaggaatggaatctaatggagaaatcgaatggaatccattggaatcatcatcaaatggaaccgaatgcagtcatcatagaacggaatcaaatgaaatcaacaaagggactcgaattgtgtcctcattgaatggaatcagatggaatcatcgaatggactcgaatggaatcatcgaatggactcgaatggaaacatcgtcgtatggaattgaatggaatcctcgaatggactctaatggaatcatcatcgaatggaatcgaatggaattgaattgaatcattgaatggactctaatggaatcatcgtcgaatggaatcgaatggaatcatcaaatggactcgaatggaatcattgaatggactcgaatggaatcatcatcgaatggaattgagtggaatcctctaatggaatcaaatggaatcatcaaatggaattgaagagatttataagaaacttacttgaaccaaaattagaaaaacaaacaaaccaaaagcccctaaaactgtgatgagcaaagtagacatcagaacaggaaatatcactggggatgaagaataacatttcaaaatgacaaaggggaaaatacatcaagaagtcatgtaaataagaaatatgtatgcacacaatagcattacttcaaaatacataatataaaacctattaaaactgaaaggtaaaatagtaaaaccacagtcatccatggggatttcaacagtctcctgccataaatatttaaattttgttaaacgaaaagttggtaagc

SEQ ID NO: 475106 - DNA, 665 bp, Homo sapiens
gtgagggctgccaccttgatggtttttgatggataatggggttgaccgctttgttccttccacatatttttatgtttgaccatttgctcagcagagcagggaaatgggaatcacatgacctgaaggatgatgtaggaactgaacagaaaccatccttgtttcctgaatctgaacatggcaccctcttttcacggtgtctgtatctgctcagtccagcggcccctcgaaaagagggaatcttgattttcaaacttaaaatttggcccaaagcccactgctgcccacaatgcccgccagacacgttcctcttaccttttagtttctatgggaatgctctctttgaagaacccatgaagcagtgtcaggctggtgtgaggatcagcagcaatttctttgaggaggagagcccgtttcatcgctcacaggccatgtctgagtggatcaagaagaacagagtgcccttttatgagattttgtctgcccatgcttatgggtatgacgtcgtatcgcattgtggttttgatttctgtttccctgatgatgaatttcattgagcatcttttcatgtgcttattggccacttatatgtcttccttggagatgtgccatattttcatattcaaaaatgaaagcacaggtccacacaaaaatttgtacataaataa

SEQ ID NO: 475107 - DNA, 824 bp, Homo sapiens
tggatcccacacaggaaccacaggtggagctgcctgccagtccctctccgtgctcccacactcctcatcccttgggtggtcgatgggactgggcgctgtggagcagggggcagtgcttgtcggggaggctccggccacacaggagcccatggagggaggaggctcaggaatgttgggctgcaggtcccaagccctgtccacggggaggcagctaaggcccagcgagaagtcgagcacagcagctgctggcccaggtgctaagcctctcacagcccggggccggcagggccagctggcagctcctagtgctgggccaccaagcccacgcccacccggaactccagccggcaggcaagaagcacgcagccccggttccggctcatgcctctccctccacacctccctgcaagctgagggagccagctctgaccttggcaagcccagaaagggcctcccaccgtgcagccgcgggttgaagggctcctcaagtgctgccaaagtgggagcccaggcagaggaggcaccaagagtgagcgagggctgtgatggctgccagcacgctgtcacctctcagaaggagtgattaatctgggcttctccagaaagtccattcctgtctctccttgcaactggctctcagcaggtggtaggaggaaatccttaacagaaccaatttacgtgactgtttggaggactctcgctagccgcaggaggtgtttgcatttttaaattggttagtagggtcagaatgtttcatgagtaagagcacagcctctacgttggatgccctgaatttgaatctcaacatggccactttgtatata

SEQ ID NO: 475108 - DNA, 858 bp, Homo sapiens
gcactgtgatgttagggataatatctccctgggatacgatgaataatgccacagggtgtacagaaactgtgatattagaggtaatatctctaatatcacagcaggatccagaactgcagcccatcctggctgggctgtccctgtccatgtatctggtcacggtgctgaggaacctgctcatcatcctggctgtcagctctgactcccacctccacactcccatgtgcttcttcctctccaacctgtgctgggctgacatcggtttcacctcggccacggttcctaagatgattgtggacatgcagtcgcatagcagagtcatctcttatgagggctgcctgacaaggatgtctttcttggtcctttttgcatgtacagaagacatgcttctgactgtgatggcctatgactgctttgtagccatctgtcgccctctgcactacccagtcatcgtgaatcctcacctctgtgtctttttcattttggtgtcctttttccttagcctgttggattcccagctgcacatcacattctttttgtggcttgacggcttttattcctttccgtatttcctttgtgaatattgctttcttcgttatgcctttcactggaatggcaaacactgtgaactgagtgaaaagataacccatggaataggaaaaagatttgcaaatcatatctctgaaaagaggctgatatgcatcataaacaaagaacagctacaaatgaacaatcagaaacccaaagcaccccattaacaatggtcagaagactcgagtagacttgttcctaaagaagatatagcaatggtcaataagcgtctaaaatgatgttcaaaatcactcatcatagggaagc

SEQ ID NO: 475109 - DNA, 2504 bp, Homo sapiens
ccgcctcctgcaggcgaggctcacatccagcactgtcccttacagtcgccatgcccctggcgacctcagacatgaagggagacagacgcaacatctggacaacagggtaccaaacagcccacaggatggctgtgatgcacccacaaatcccctcagaggtgggcaaactgagactggctggaggtgggccagaagctgtgaagccagggcaggggctaaggaaatacctgtcattgggcatggggcccccaaccctgcccagtctcaccttcatgtgcaggctcgagcccaggtacacggtgaagatggccacagcctgccaccagtgggttcaccggaggagatgggatatggagctgggcagaggggatgccatgaccagacagggcacaacatgggtccaagatacccaggatggactctgcccagaattgactatccttgggcaaaacggccaagagactgtggtgcagtatgaggctccagcccctgctacagacagagacaccgagccaccctctgccctgccaggagcaggcatgacctctgccactccacacccccaaggatgacgttcaaaactgttcttagtttcggcccatcagaacagacactgacatggatgccctgcaggactgtgcccatgtgtgctagctgtgtgtcactgcatgtgcccatctgtgggcagggagcatcctggagctgaacatgggcccacccgctgccttctgcaaacagggccctgttccccagcagcccagacctggggcctggactctggtactgagcagactgggttggggctgcaggcctgctcctctctatacaaaggcccatgtctgtatctatgccgtggatgtacaacaggccacttgctcctaccacatgctctgtgaggcagagaccaaaacatctgctccaagtgtcatgaaaaatatgccagggtaagccctgtcccctggtatgaaaaggaagaatccctgatgtgtttttcataccgtccctaaggggtgtccacagagccccacacctgccccctgtagccacgagatttcacactgatgctccagtgttgatggggccctgtgcccaccatggggtattaatggaatgtccatggcgtggaacccccacacctgtctccagggtgtccacgccctacccatctgcccccagtgtgtccatgagacttcccttccacccctggagtgtccacaggaagacccactggactctgtcatgtccacaggatgctatgtgaccatgggaccccatatctgtccctgggatgtctatgtctagccaaccacccacagatagccataaagccccctgccctgccctcccagtgcccacagctatactcactgctgagtccagttttgttcagggtgctgcccacaccccaaagggcggctgccacacagaggatccagctgtgttgaaggacccaaggcacaggggcccagaaaaagaggatgaaggtgagcagcaggtgcacccctgctccagccacgagggaaaccgggcgtgacagccacaagcccagcaggcccagtagtgaggcgactgaggcgtccaggctgtaagccacaaggaggtaagccagccgctccagccccgccgagcacacaccatagccctgcgtggggacaaggggtgagtgttgaagtccggaacagcccagaccccagtctcagccctccccgcatcgcggggggtgcctcacccccctgcgatgggtgtcctaagagccatggggggtgaggggctggcttgtactccccgcatcgcggggggtgcctcacccccctgcgatgtgtgtcctaagagccatggggggtgaggggctggcttgtactccccgcatcgcggggggtgaatcacccccctgcgatgtgggtcctaagagccagggagggaaagaggggctggctcttactccccgcattgcgggggtgcctcaccccactgcgatgggggtcctaagagccagtgggggaagagggactgtctcttactccccgcatggcggggggtgcctcagccccctgggatgggggtcctaagagctaggaggggaagaggggctggctcttactccccgcatcgcgagggatgcctcactcccctgcgatggaagtcctaagagccagggtgggaagaggggctggctcttactcctcgcatcacgggaggtgtgtacaacccctgcgatattggcagtaatatcatcctctccccctgaacctgagaaataatatctcaggagcatgtaagccccctgcgatattggaagtaacatcattttctccccctccagatattcggaaaaatatcacagtgggtgtgtacagcccttgcgacattgccgctagtatcttcctctccctcccaggatagaaggaacaatgtcacaagggggtgtacaccccctgcgatactcgtggtgatatcttcctctcccccgctgcctattaggaacaatgtcacacaaggggtgt

SEQ ID NO: 475110 - DNA, 630 bp, Homo sapiens
caaggctggcaagaagacagggctgtagatgaaaaggttcagcatgggggtgaccacagcgtacatcattgacgccactacaccattcctgggaggtggtgacacagctgaagtggagaaggctttatacttcccatctgaagatgaaatcctgagaatggagctgggaatccaacaggctaaggaaaaaggacatcaaaatgaagaagacacagaggtgaggattcacgatgactgggtaattcagagggcgacagatggctacaaagcagtcataggccatcacagtcaggatcatgccttctatacatgcaaaaaggaccaagaaaaacatctgtgtcaggcagccctcatgagagatgactctgctatgcgactgcatgtccacaatcatcttgggaaccatggccgaggtgaaaccgatgtcagcccagcacaggttggagaggaagaagtacatgggggtgtggaggggggagtcagagctgacagccaggatactgaggaggttcctcagcaccgtgaccagatacatggacagggacagggacagcaaagcgaggaccggctgcagttctggatcctctgagagtcccaggaggaggaattctcagacacctgtgagattcc

SEQ ID NO: 475111 - DNA, 629 bp, Homo sapiens
ggtatttctacatctcacctttgtcagcccttgcaaaaacggtgaggcagcggtgtgttacctgccgacagcatgatgcgaggcaaggtctagccgttccgcccggcatacgagcttatggagcagccccatttgaaggtctccagatggacttcaccgagatgcaaaagtgtggagatttcgaccgcccttacggatcggctgagacaacgggtctgcgtttttggctgccttggtacagaagacggcaaagatattaggaaaaaatgtcactggggatgtgaacagccctgcgatattgagagtagtatcatcctctccccccttgcatatggggaacaacatcacaggaagaatatcacaggggtgctgtacaattacttcggtcttgggagtaatatcatcctctattttcctggatattgggcacaaaaacacaaaagggtgtacaacccctgcgatattgggagtaatagcatgctctccttcactggatgttagaaaacaatatcatcagggctgaacaccccctgcgataatgggagtcatgtttactctttcacaggccatttggaacaatatcacggggggtgtttacaaacaggggtggtgtacaccccctgtgatat

SEQ ID NO: 475112 - DNA, 740 bp, Homo sapiens
gaagcatcgttgtctatgaattgatgggcatttgtaaggaaaaacgaaagaaagagaaaggaaggaaggaaggagagagagaaggaaggaaggaaagaaagaaagagaaagaaagaaagaaagaaaaagaaagaaagaagaaagaaagaaagagaagaaaggaagaaagaaagggagaaagaaagatggtggaggcaggaaagaaagcagataataaattttgctctgaggaagtagatgcccagagagagaatggagaacaaacagagaaggaagccaagaacaacctccaaggaaaacacaacattcaaggtacacgtaaaagaatagaagccagtaaagtagagaaagaaggacaaatcagagaggagaagagccatgagatacctctcagaagccatggtattaaacatctccagtgccccagttaagtcaaataaggtgggaagtggaaactgacgaagtttattggacttggcgctttcgaagtcactggaaattaccaccacagcaatttcagtagattagcaaggtgttgactagagtaccattaagagtgattgaaaggtaaagagatgaagacaacaaacaaaggctattcttctaagaaatttatcatgaagataagaagaaaagcaatgaaatgcagatcgacatcttcattttggacatctagtctctagaactctggaacaataaattcctgttgattatatcactcagactgtggtactttgtta

SEQ ID NO: 475113 - DNA, 572 bp, Homo sapiens
agagagggtcctgtagctgggccggcttggggcttggttctatgtccctgcgggtcggtgcgagggcgaagaggaacccgtgggtctcgggggatcccggggggccggaccagtgttccctagttgtgggagcagatgcgtgggcgcatcgcgggcgggcaaggcctgaagtgcaggtgcgggccgtggaccctggcgggggctgggatgacaggcgtgtggtcctggcagtgaagcgggttctagaggcgcaggaacggaatgcacaagatttgcaaagactaggtgatagcagaagaagagagcatgctgtgttcttgtgggacaggaaagcttctgtgcaccaagtcagaaccaccaccttcattggtgacatagattatgtgctggaacatatttcacaccggcctggcagtaaccacttgtagtgttgtgcagtggaaacggtcatcttccgctaaagcacggcgtttagtgcagtggaaatggtcatctgccagtaaagcacagcttccatcgtaagtttatttacaaggcaaacaaatttttcattttattattttatttttatt

SEQ ID NO: 475114 - DNA, 508 bp, Homo sapiens
aagcttgggagatggagccttcaatgagcctagatcgagccacttcactccagccaaggcgcaagacccccaaccacctctctctctcaagtcatttgcttatggggcatggtaaagctggaatacaaccattacatttggaagagtggaagtgtcccatcctggataccacattacctttagtcgtcatttgtcctaaggatccttttggctgtgacagtttttcagactttgcttttgctggccttgaaagtttcaaagagtactcatcaggtttctccatagtaagtaattctttacctcctcctactccccatactgtattctggagggaaatcactaagtccagcccatacttactggtggagagttatgctccacctttctgagggaggagtatcaacataaattatttagcattttttgcaaagatttttctattctcttatatttatttattcaatcattcatttatattgttatgaattaatggaattattttatattt

SEQ ID NO: 475115 - DNA, 665 bp, Homo sapiens
aaaagttactcacccaagatgtgtttatgttaggacttacaggaagccttcttgaaggagaatgggtgcacccattcttacttcttcctgctggctacagtaagagtgtgttgcctggaactccagcagccatctttgatgatgaattaaagaaggaaattcgaacacagatacacaggggagaaggctgtgtgagacggggcatcaagaagtccaggaaagccaaggattgccagcaaactgccaaggcggtaggaaagtggcatggagcagattctcccttgagctcacaggagcaaccaactttgctggcatcttgctgccagatactcttcccagtgtccacagtgcaaacagcactctctgaggttgtgcagtgtggtggccctggcccaaaagtccccaccagtctaccccagtgcccaattttcaatactctagagccttttcaataacagttgatgttgaaacacttagccaagtataaagaactctgcaaatctaagatatttgggggagtatggtactatttccagtagttaatgtatcaatgtgttacctagggggactaaattattaatatattaattcattttaataagttgatcaaatgacatgatatacttaaaagcacttagcaaactttaaagaagctctacaaatgt

SEQ ID NO: 475116 - DNA, 783 bp, Homo sapiens
tgtccacagggtgtttctctggtcgggggtgataaaaccttctaaaatggatggcgaattaaaattgaatgtgcacaaccacaggtatactaaaatccactcaattcatgacttttaatgggggagttttatgtggcacactcttatggagaccacggcagacatagtgagagagaaaaagaggaggtcacgggagaacacaatgacatgagtgactgtcctgcttggttaggaaagggaaacgtaaagttgtggaattctgttgatgacggatgtgagagtgctgaagccctgcgggatgatgtagaggacttccacatccctggtgaggagctgccccttgggtctgagtttctgggaggggagagggagaagctgggagaccccccgagagctgggggtgagctgctgggtgatggcagtaagaacatgtggtatattattgatgaacgtggggactctgaggaatcctcagaggaggacacgggagagcccaatggcttcattgattgcccatcacggttaaagaagtatccctctaataactgacttttataatgctatcaatatccactcccaatcagtctgccattgttaatggtgtacagcattactgaatacaatggaattgatgacgcccatatccacggacaaaccgtgacttatgatggtttgatttacgatttttcaacgttatgatgggtttactggaatattagatgcgtttctgagttacactgggtttatgagtatgcgaccctatactccagaaacagctgtata

SEQ ID NO: 475117 - DNA, 1009 bp, Homo sapiens
ctggccattttcacttcttttgtggtggaatatcaccagttaaggcaaggaccggccatttacacttcttatgtggtggcatgtcatcagttaaggtgggaaccggccatctggatatctaatgttgactctttcgtggctcctttactcatgccaagggtccatctcccctcatgcctaactccactatgcacaaccagacaatcattgcaagcactcacccagaacctggttggcactggcagagaagatcagcacagaaaactcacagcaatttcctagccttgttttctaagtgttgtgagcccttaagagggacagaaattgagcattcggggagcgcggattttgaggcagtagcttgccgatgctcccaggtgaataaagcccttccttccataactcggtgcctgagaggttttgtctgcagctcgtcctgctacattctcatttggactatccgcctcccagctgccacagaaaagggtgttagcttttccccacctgtgaagtctgcatatccgattcgcgccctcccccaagttctggccaggggggcttcttgcccctttcaaatcattacagagttcaccaagagaagtgcttctacctgtggagttttaccccctgctcctcaggccaccctcacgatggatccctgtggtgccaaccaggaatgggctgctggggacccagcaagctcccagggccttcctgctgcttcctctgcccctgtatttcactgggctctctaacttgactcagctccagtttcagttattgtggtccaaaatattacatagaaaattccagaaataaataattcataagttttaaattgtgcattttttctgagtattgttagaattgttctattttgctattatttatcaatctcttactgtgcctagtttaaattaaactttataataggtatgtctgtgtatatgtgtatatgcatatacgtatataggaaaaaaacccacacatatatagagtccatccagta

SEQ ID NO: 475118 - DNA, 622 bp, Homo sapiens
atatccaggccatcaccaataattctaaatgacaaatgtttcttctaacaaccccacaatatcaccccttaccacaaaatcttccttcagcttaatctctcccactctaggttcccacaccgcccctaatcctgctagaagcagccctgagaaacatctcccattatctctccataccatccccaaaaatttttgccgtcccaacacgttaccactatttcattttatttttcttattaatataagaagacaggaatttcaggcctctgagcccaagctaagccatcatatcccctgtgacctgcagcagagggatgactttgagttctggctgtcctttgaccacaaggaatttctttgtgggaaaactgtgagggaggcagcaatgtatgggagctccagttgctcaacaccttccagcatttggtgttattagttcttattttattattttactcattctaatatgtatatattggtagcttatcatggctttcatattgatttccctaatagccaatggcattgagcatattttcataggcttatttgtcctcattttggtgtttattaaagttttttctcaagtttttaaattctcctgttgttgactatttaaaaa

SEQ ID NO: 475119 - DNA, 627 bp, Homo sapiens
ttttcctattgtcttggatgtactacttgggtcccttttaaaacaataacaagagagtgacgagagacataggaagcagaaataataatgacgagagacatacaaatggccaaaagaacacatggggaaaagggcagttgtgggaacagcttcagcagacttaaacgtccctgcctgccagctctgaagagaacagcagatctcccagcacagcacttgagctctgctaaaggacagactgcctcctcatatgggtccctgacccctgtgcctcctgatggggagacaccttccaggagaggtcgacagacacctccaacaggagagctccggctggcatctggcaagtgcccctctgggatgaagtttccagaggaaggaacaggcagtaatctttgctcttctgcagcctctgctggtgatacccaggcaaaaagggtctggagtgtacctctggcaaactccagcagatctgcagcagaggggcctattagaaggaaaactaacaaacagaatgcaatagcatcaacatcaacaaaaaggacatccacataaaaaccccatccgaaggccaccaacatcaaagaccaaagggagataaatccaagaagttgaggaaaaaccagc

SEQ ID NO: 475120 - DNA, 2121 bp, Homo sapiens
agcgagcgagggcgcacgctgtcacctctcacagacaaagtcttgctctgtctcctagaatgggatgcaatggcaacagagattatgctcttttcaaaccttggcacctggtgcactgcatttcagctgcttcagctccagttgtggctaaaaagggccaaggtacatctcaagcttcaaagggtgcacgctccaagccttggcagctttcacatggtgttgagcccgcagatgcacagaagtcaagaattgaggtttgtgaacctctgcctatatttcagaggacgtatggaaatgcctggatgtcgagggtagtgcccaagggaaatgtggggaaggagcccccatgcagagtccttactggggcactgcctagtggagctgtgagaagaggacctccgttctccagaccccagatggtagatccactgatagcatgcaccatgtgcctggaaaagccacagacactcaacaccagcctgtccaagcacctggaaggaaaagagtgttaagtgatgaaaaggcatgtgaaatgcactgggaatggacaggactgcttgtgcagttttccatatactatattcaattgaatttgaataaggtgagtttcctgctctctttttatcttacaccacatacaactgaatttttgttcctgatcaactttcttgctgttctggtattctccctgttctttccttttcttatctctgcattatctaacaagtaatgataatagtgacaaataatggctaccccatattgagcatttactaggtggaacagaactgagaacaaatataaaataatataagttgtgtattattagtttccccatttcagagttctaaaaccaaagcttacagaggaaagtcaatcgcttaattttagagagagagtaaccaaggaagtaatgatctcacagtgtcattttgtaacattcaatactacttctgaattttatactgggttaataacaaatttcatttgttaattatttcttctaccctcatttatataaaagtcagtatctaaggtttattatgctttgccttaaaaatagttttgaaataacatttaaaatagatgttcttaatagtcatttacactgcaaaaacataattttcattgtattccattggtaacaagaaataaatatcaaagaaggagagaaagagtggagatgaaaaatgaaatcggagaagtgatggcatctgagaagtgaggaaacgtactaaaaataggtttccctgaaaaaacaagtgtgtatgtcagtatttcagcaatgaaatgaagtatttggctagtggataaggcagacgagcagtatctgaaatcttcagattaagccaaggcagatgcaaaggagataatgtggtcctggcttagtagttacttttgacttctaaaagaaacaaatgcaaaatccatgtagaggacagagtctgaaatttagaccctgaatttccacttataagatcagcctattaagagttcataaccaaaaggtatcaaagagtgaaggatggatcattagtgagaattagtagaacacaaatagtataattagtccttcaaagatgtcagatatcagaattatcagagagcataaaattagcatttagaatgaatgtttttaaagaataatgtaaaagaagacatattattgtaaaatgaaattattaaaaacaaacagtgagaaagaatagaaggcacaagaaagatttggcaaaaagccagatagatactattttaaaatttggaaaatgaattgaatgagttaaagaacagatttcagagagctgaggaggggtttagggaaatgaaaagaaaatgtgaagaagttatatagaaggtactccaggaacaccagaaaattgaaaatatgaaaaaatggtaaggagtatttagaaagcctcacattctctactctgagttccagaaggagaaaacaggaagatgacaagataaagaattaatgattgaggaatttccagactcaatgaaaagcattaataactaatacggaaatcacaatttgtaccaagtaggatgaatgaaaataaatttgtatgtagtaaaactgtgaaatgccaaaaacaaatatagaattatgaaagc

SEQ ID NO: 475121 - DNA, 3416 bp, Homo sapiens
ctcggattttccagtacctggaaaattctcacccagtcagtaggaacaagattgaggacccacttaaaaagttagtctagccatgtcccagggaggtgcaatgctgctaccagtgcctggctggaattttaagtcttatcctgtgaggcaccgtggaagcggggcctgcaaactatcactgctcatccccctaaattcaaactcttttctaggggtatgcacggggtctaaactcccactttgctggagttgcagctacttttgccagacagccagagtatctaaagctcctgggtctctacgtgtgcctgagtggctgttctgccaagactccactcagattgaaggccttagtggagtgggttcatgtcggcgggctcctgacccgagagttgcaaagatcagtgggactagtgtgggttcccagggttgcacattcactcaccacttcctagggcaggggaggtccccttggttccgtattgctgcctgaacttatgaattattcacatctctattcatattttggtaatattttcttcaagtctgtcacatatgttttgattttgttgattccatttgaaaactgttaccctacagattatttttaaataaactcctgcactgaaaaatgtgttaatacttatcattgtgactcatctttccaatactaatatatggagatatagataagagttacctttttctctaccctactatttttagcatagagcagtaacataatgattaatgatgtcgtattaaaatctgagtgctttagttcaaatcccagctctaccacttagcagctacacaacactggaaaagatactcatctctttgtgaagataatactccaatgtcataaaacagttgtaaatattaaatttgttacaatgttttacttaagttttttttgtttagagattacatttgttgtttaaaggagtataaggcaatgattggcacataccttagttgttacttaatttatcaataaattattttaaaatgagaaaatattttattatttttttccaacaattgataaaaaacatattacatatgtaaatacttaatcagtattaaattatagatggggtagaactgtgaattaaaaatattgcacaacattattggaagttttgactaagaaacaaaagaatactaactttaaaaataattggcaaaattgtctttatgttaaattgacataatttgcactttgggaactcatttaccctaaaataaaaatataaatgattacatggaaggcaaatatttttaaagatttattagtataaatgttttgtatatatgactcttttatatatactattaaacatatgtttcttgagagaggccctcttgtattgctactttgctaatattttaaattattgtcatatatttatctttcatttctttttccttcaaaatatttacatatttttaacaaggttgtaactttatagaatgaattggtgagttgtttattttattggttttctcttaatccataacaaattaccatgaagttaagtaatggaaaatatcccccattttttatgttcatttctgtgggtcaggaattcaggtaggggttagctgggtcccacaccagcctaaaatcaagtgttggccagaacagtagcatctccagaggcttgaagtcttctttcaacctcattaaagctgttagtaaaatttagtttcttgaggttgtaggactgaggttacaattttttgactggttgtcaatggaggactatcctcacccttcagaagctgcccacaggattctgcacctctttacaaggctgtttgcttcttcaaggttaacaagagaagctgctgcagctttaagtctctgtgacttctttcacctctgtactctaaatactctttaaaaggactcccttgaggacttccacaccaatgagtgtggggccatcttaaaattttgcttaggccatttatctatttctatcatttgggttattatgaataacttagatattctgcatctctttcatctatattgtcaaaattattggcataaaattattcttagttttgaaaactttttaatactataaataatctactgctgtcctttcttatattttcatcatttattttttactctttaaaattctgctcagttttgccaatgatatatttatttgccttttcaaataactagtatttgttgttatttatcactctagtgctacctcgtaagactcattagatgtatgattttttttatctcacccttcacatctcttaatttttttgtatttgtcattttaatacattattatgtagcaccttgtcctattgactttgacaggagttgaaccacctggagagggatagctgagctgccaggtgtcagattagcagattaaaaatggaagtaatggtaaagtttttaattacttattataatagtataagcaagaggctaaaccagagaaaatttagactcttccttgttttatttttcccccaccgaacagcataccagtggagggtcaagtgagggtcaagtgaagcttgaccctccaacacagatgtgaggttcatcccactgccacgagaaccttgaacaaaaggctcctgaagttttgtgggttatagggtggggaggggggataagggcaagaaaaatggggggaagggctaggagtagaaagctctgagtactatgtaagattgggaaacagtgtcttaaaggttctactcttcctcttccatagaaaggtcttatcagtggtggcaaagcctcaggtaaagagacctagagataaaggtgcctggctaggaatgtaaatgtgtataacagcatggctggcaagagaagcctgagtccttgactgcagctcccctctgagactgtcagtgttgactgtgcatcaagcctttgtaattagccataattcagcctgaaaaatcacacgtggtttttttggtcaggacacagattcctcagaattagatatgattttcaatttcttacttttctttttatgtattactagtctattttaacctatttattgaatgtttatcttattttaatgattattttaattttcacacatttaattttctgtctagatgatttgtagttttattattatttattaatattatctattaatcatctgttattgtcattatcttttaatgatttattttttgcattctatttgctctagtctttaaaaaaacttaacctagttttataatgccctctgtatttttaatattattttcatttactctagtataattgtgcttcttcttttatccactgactaaatggaaccttagaggatttactcatatctgtatgtatgtatgtgtatgaatgtccatgtgtgtgtttaacagaacattagcaagat

SEQ ID NO: 475122 - DNA, 735 bp, Homo sapiens
caccgtgagggtcaaccgcttcattcttgaagtcagccagaccaagaacccaccaattccgtaatggtggatgcccctccccccacaaagctccagtgtcccaggtcaactttggactgctgtgctgtcagtgcgaatttcaagccagtggatcttagcttgtttggtttcatgggggtgggatccactgagcaagaccacttggctccctggcttcagccccctttccaggggagtgaactgttctgtcttgctggcattccaggcaacaataggaaaaaaaaaaaaatcctgcagctagctcaatgtctgcccaaatggccgcccagccccagtgacatcagggcatgcgatggggctgtggctggcttcttcattcagtgccccgatgctcacacctcgagggggagcattcagatgggcagactgtggggctctgaccccatagcagcggctagggatgaatgtttacagctgcagtacccagcaaaagctttaaaggatgttatactatgtgttataatgctttccccaccaaaatgatagtgttaggatgcatgaggatggcctgcatcagcctggatctttaaaggacaatcgcaagcattttccccaaatccattgcagacatatcacatggataagaaataaacattacttattttaagacagttattttagaattgtcgtaactgcagcaaatctagtctattttgaattatgtattaccaaagg

SEQ ID NO: 475123 - DNA, 961 bp, Homo sapiens
cttcgctgcccaatctccagtctcatatccaggtcatgctgatgcaagaggaggattccaatggtcttgggcagttcagtccctgtggccttgcagggtacagcctccaccctggctgctttcatgggctggcaatgagtgtctatggcttttccagttgcatggcccaagatgtttgtgcatgtatcattctggggtctggaggatggtggccttcttcttgctgctccaataagcagtgccctgagtggcacaagccaggggagtcccaacccccagccaaaggaggtatctttactggtgatacctccaggtgtgtgagagaccgaggctgttgctgtcagttgctatgggattgggtgaagggagatgaatggagaaatgaagacaaagacaaaaagatctgttttaaaagaaggtgtcaggggctccttgctcctagtgaacaaaggctttgggcttctacaacccttcatatttattaggtaaaaagggcagggagggagaggttctgcagctctcaattgccatttggtggtccacctgattttgaagactatgaaaaaaaacagaaacataataacattaatccaatagtaacaacaaagacattgagttgctgtttgcggtaggtccaagggttaaggctctctaaaccttgttggaattctgcccaagcttttaaacagggctgaaacacttgagtttgcttatcgaagttaaggattttactttgtaaatcattaatatcaaaagtaacattggatgtgaaagctccctgtaaatgggcctttacaaggctccaggaatattcactttggttatattccaaattggtcacacaaatatgagtatgattaaaatgacaatgcaattgctgatgcaactgcaaactttgtatttgttctcctagccaaagaacagtagcctttaacattgccacctctgtttatgtttcagc

SEQ ID NO: 475124 - DNA, 957 bp, Homo sapiens
aattagcaacaggaggcttagtaagcttaaagggggtggtagatgtcctctaggccagggctgagagaaccgctgctgtactctagccttctgtccctacttgccatcaaaggagatacatgtgcagaacgtgcaggtttgttacatagaaaactgaaactggacaccttcctcacaccttatacaaaaattaacccaaggaagattaaagacttaaatgtaaaacccaaaaccataaaagtcatagaagaaaatctaggcaataccattcaggacgtagatatgggcaaagacttcatcatgaaaacacaagaaacaattgcaacgaaagccaaagttgacaaatgggatccaattaaactaatgagcttctgcacagcaaaagaaactaccatcagagtgaacaggcaacctacagaatgggagaaaaattttgcaatctacccagctgacaaaggtctattatctacaattaaatttatttaatttacaaggaacttaaataaatttacaagaaaaaacaaaaccattaagtactggtcgaagaatataaagagccacttctcaaaagatgacatttatgcagccaacaaacatacggaaaaaagctcaacatcacttatcattagagaaatgcaaatcaaagccaaaatgagataccatcccatgtcagtcagaatgatgattattaaaatgtcaagaaacaataaatgctgaatttctatttggttcttttctatactttttatgtctttgttgatactcttattttatatatgcattattttcctgatttttaaaaacttgtctgtgtttttttaggattttgtaatattttacttcacctgttgtcattctgtagtaataatgcagctgttcttgtactgccctaaacagccacactgcctttattcccaggcattcaaatgctggggtttctataagtgatttaagttc

SEQ ID NO: 475125 - DNA, 688 bp, Homo sapiens
taattgaatcatgggggcgggtctttcctatgctgttcttgtgatacctgacaatgcaatagaaatgaaaaccccattttctggggagaaattcaagctggctgcagaaatttacacaagtaatgaggagccaaatgttaatcaccaagacaatgggaaaaatgtctccaggccatgtcagggaccttcacagaagcccctcccattacagataatgtatggaaatgcctggatgtccaggcagaagtttgctgcaggggtggagccttcaaggagaacctctactagggcagcgtggaagggaaatgtggggttggagccctcacacagagtcccaaatgggactccacctagtggagctgtgagaagagggccatcgtcctccagaccccagaatggtagatacactgacagcttgcactgtgctcctggaaaatctgaagacagtcaatgccagtctgtgaaagcagccaggaggaggggtgtgccctgcaaagccacagaggcagagctgctcaaaaccatgggaacccacctcttgtatcagcgtgaccatgatgtgagacatggagtcaaaggagattattttgaagctttaaaatttgactaccccactggattttggacttgcatggggcctgtagcccctttgttttggtaatttccctcatttggaatggctgtattt

SEQ ID NO: 475126 - DNA, 658 bp, Homo sapiens
tgctgttcttgtgatacctgacaatgcaatagaaatgaaaaccccattttctggggagaaattcaagctggctgcagaaatttacacaagtaatgaggagccaaatgttaatcaccaagacaatgggaaaaatgtctccaggccatgtcagggaccttcacagaagcccctcccattacagataatgtatggaaatgcctggatgtccaggcagaagtttgctgcaggggtggagccttcaaggagaacctctactagggcagcgtggaagggaaatgtggggttggagccctcacacagagtcccaaatgggactccacctagtggagctgtgagaagagggccatcgtcctccagaccccagaatggtagatacactgacagcttgcactgtgctcctggaaaatctgaagacagtcaatgccagtctgtgaaagcagccaggaggaggggtgtgccctgcaaagccacagaggcagagctgctcaaaaccatgggaacccacctcttgtatcagcgtgaccatgatgtgagacatggagtcaaaggagattattttgaagctttaaaatttgactaccccactggattttggacttgcatggggcctgtagcccctttgttttggtaatttccctcatttggaatggctgtattt

SEQ ID NO: 475127 - DNA, 2531 bp, Homo sapiens
gtgtaggcttgcacacgtctaggctggccgcacgtctaggctggcacacatctaggctggccacacgtctaggcttgcacacgtctaggctggccacaagtctaggctggcacacgtctaggctggccgcacgtctaggctggcacacatctaggctggccacacgtctaggcttgcacacgtctaggctggctgcacgtctaggctggcacacatctaggctggccatgcgtctaggcttgcacacatctaggctggcacacatctaggctggcacacatctaggctggccacgcgtctaggcttgcacacatctaggctgggcacacgtctaggctggcacacgtctaggctggcacacgtctaggctggccacgcttctaggctgggacacatctaggctggccacgtgtctaggcttgcacatgtctaggctggctgcacgtctaggctggcacacatctaggctggccacgcatctaggcttgcacatgtctaggctggccgcacgtctaggctggcacacatctaggctggccacgcgtctaggctggcacatgtctaggcttgcacacatctcggcttgcacacgtctaggctggcacacatctaggctggccacgcatctaggcttgcacacatctaggctgggcacacgtctaggctggcacacgtctaggctgaccatgcgtctaggcttgcacatgtcagcccccggttatattcccactctccatttttcctcaaaagggccatggggactggtctgtctgctcctcttttcactgctgccatctgaagctcccagccgtgacttctctactcctcggcccactggagaaaatgatttaggcctaggggaggggaatatgggagagttgcttaatgagtgtagcatttcagttttccaagatgaaaaattctggagattggttttacaacaatgtgcatgtactcaccagtactcaactgtacactcaataaggaacacctctaatcaccacagcccacctacccgggtgagggtcagccacagcccacctacaacaccgagggtcagccacagcccacccacaccaccgagggtcagccacagcccacccacaccagtgagggtcagccacagcccacccacaccagtgagggtgagccacagcccacccacaccaccgagggtcagccacagcccacccacaccagtgagggtcagccacagcccacccacaccaccgagggtcagccacagcccacccacaccagtgagggtcagccacagcccacctacaccagtgagggctagccacagcccacctacaccagtgagggtcagccacagcccacctataccaccgagggtcagccacagcccacctacaccagtgagggtcagccacagcccacccacaccaccgagggtcagccacagcccacccacaccagtgagggtcagccacagcccacccacaccaccgagggtcagccacagcccacccacaccagtgagggtcagccacagcccacccacaccaccgagggtcagccacagcccacccacaccagtgagggtcagccacagcccacccacaccaccgagggtcagccacagcccacccacaccagtgagggtcagccacagcccacctacaccagtgagggctagccacagcccacctacaccagtgagggtcagccacagcccacctataccaccgagggtcagccacagcccacccacaccagtgagggtcagccacagcccacccacaccaccgagggtcagccacagcccacccacaccagtgagggtcagccacagcccacccacaccatcgagggtcagccacagcccacctataccaccgagggtcagccacagcccacccacaccagtgagggtcagccacagcccagctacaccagtgagggtcagccacagcccacccacaccatcgagggtcagccacagcccacctataccaccgagggtcagccacagcccacccacaccagtgagggtcagccacagcccagctacaccaccgagggtcagccacagcccacccacaccagtgagggtcagccacagctcacccacaccaccgagggtcagccacagcccacccacaccaccgagggtcagccacagcccacccacaccagtgagggcgagccacagcccacccacaccagtgagggccagccacagcccacccacaccagtgagggtcagccacagcccacctacaccaccgagggtcagccacagcccacctacaccagtgagggccagccacagcccagctacaccagtgagggtcagccacagcccacccacaccggtgagggtcagccacagcccacctacaccaccgagggtcagccacagcccacctacaccagtgagggtcagccacagcccagctacaccagtgagggtcagccacagcccacccacaccaccgagggtcagccacagcccacccacaccaccgagggtcagcagggcagacgcaggttgaatgggagtagtc

SEQ ID NO: 475128 - DNA, 2426 bp, Homo sapiens
aagcagcctgggggtggagctaagcagcctggaggtggaggtaagcagcctgggggtggagctaagcagcctgggggtggagctaagcagcctggaggtggagctaagcagcctggaggtggagctaagcatcctgggggtgaagctaagcatcctgggggtggagctaagcatcctgggggtggagctaagcatcctgggggtgaaggtaagcatcctggaggtggagctaagcagcctgggggtggagctaagcatcctggaggtggagctaagcatcctgggggtggagctaagcatcctgggggtggagctaagcagcctggaggtggaggtaagcagcctgggggtggaggtaagcagcctgggggtggaggtaagcagcctgggggtggagctaagcatcctggaggtggagctaagcatcctgggggtggagctaagcatcctggaggtggagctaagcatcctgggggtggagctaagcagcctggaggtggagctaagcatcctggaggtggagctaagcatcctgggggtgaagctaagcatcctggaggtggagctaagcatcctgggggtggagctaagcatcctggaggtggagctaagcatcctgggggtgaagctaagcatcctggaggtggagctaagcagcctgggggtggagctaagcatcctggaggtggagctaagcatcctgggggtggagctaagcatcctggaggtgaagctaagcagcctgggggtggagcttagcagcctgggggtggagctatgcagcctggggttggagctaagcagccgggaggtcccatctttggttcaaatacgatgactgtgggttctctgcttgttccctccatgctgtggggttgccatcgcctccctgggatggtttttaagttgcacaggtcatcttactccatattgcaatgtcgctgtttgcacggatcccctcccattgctgaaagcttgacggatcccagtaaattagactctgggaaagagccgcatattagccttataccaaacaaacaagatcgaacactcactattgtggatactggaattggaatgaccaaggctgacttgatcaacaaccttggaactatcaccaagtctgagaccaaagtgttcatggaagttttgcaggctggtgcagatatctctatgattggccagttcagtgttggtttttattctgcttattcagttgctgagaaagtaacagtgatcaccaaacataacaatgatgaacagtatgcctgggagtcctcattaaggggatcattcacaaagaaacatgataaagaagtcagcaatgatgaggccgaagaaaaggaagataaagaagaagaaaaggaaaaagaagagaaagagtccgaagacaaacctgaaattgaagatgactactgcaccagaatgaaggaaaaccagaaacatatctattatatcacaggtgagaccaaggaccaggtagctaactcaaccattgtgcaacgtctttggaaacatggcttggaagtgatctatacgatcgagcccattgatgagtactgtgtccagcagctgaaggaatttgaggggaagactttagtgtcagtcaccaaagaggacttggaacttccagaggatgaagaagagaaaaagaaacaggaagagggaaaacaaaaaacgaaacaaaaaaaaaaccaaagtttgagaacctctgcaaaatccacatatggctggacagcaaacatggagagaatcatgaaagctcaagccctaagagacaactcaacaacaggttacatggcagcaaagaaacacctggagataaaccccgaccattcctttattgacaccttaaggcaaaaggcagagactgataagaatgacaagtctgtgaaggatctggtcatcttgctttatgaaactgcgctcctgtcttctgacttcgggctggaaggtccccagacacatgctaacaggatctacaggatgaacaaacttggtctgggtactgatgaagatgaccctactgctgatgataccagtgcagctgtaactgaagaaatgccacccctcgaaggagatgacgacacatcacgcatggaaaagaatgccagagtccatggaatttttccagacaattatatatagagagcattatttattttatcaagaaaaaaggagaactatttctagcattctttatgctgattaacaaaccagctgctgtgtatttagatgagaaccgacctacttgccatagatagatctagagtgtgaagtctttgttaacatacttcaattgcaaacaagtaatttctggaatatgaattaaacttaatttacacatgtggaaggctaaggcatttttaaataaattatcttgcaacaaatataagaaataattagtggttgttctttgaaaatgt

SEQ ID NO: 475129 - DNA, 682 bp, Homo sapiens
aggagacctggtcaggtgtattcagagctgggaatgtcccacctgacttctacaaatagaggcctggaggccagtgaaggggcggtcaatctgcttctgactagagggctcctccctggtttgatgtgtcacgtgagtaaagtcactctttacagacattgtaaccaatggtcagtatcttggactctgttatgtgtcactgacacagaggaaatcccctgtggaaacccagattccggtaatggacagcatttgggctggcgggagtcgaacatgacttcatacttaatgaaaaaagttaagtgtaaacagttaactgtaaaatgtcacatccttcaggaggtatgcaaaagaagcgttgctatcacaggagatggcagctccatgcgtgttgtggctcctgaagaccctccagtgggacaagatgtggaggtggaagacagtgactggatggtggaagaaaattgttcatttgctcatgttatctaccaaggaaagaccattttcattaagaaagcaaaatttaaatatgacagagactttccttttagttctgccaatggtccttgtgagaacaacttgaaaagcccaataaattataaaaatgtgtctctttgacagcaccagagtgcctctgagacagctagattttgaggaatgaagatccagatagagggagaga

SEQ ID NO: 475130 - DNA, 650 bp, Homo sapiens
actgtgctctccctccccaacatgcacagactctccatgccacacagctgctgccaggagatggggagaaggggaaccagcgagtcaagactgtctcccctaatgtcctccatacctttttcagcaattccattttgggcagctgtaaaggaatacctgaagctgagtatttttgtacacatttctgcaggatacacaagaagcatggtgctagcatctgctgctggcgagggcttcagggagcttccaatcatggtgaaagaggaaggggaattggcattttatgtggtgagggagagagcaagagagagctgccaggctctttccaacaaccagctctcatacgaactaacagagcactcattactatggggagggtccaaagccatccatgagggattcaccctttatgaccaaaacagtatagagctctagacagctgttctttttcatctctttaaaataacatctatttcatttctattgagagatcaactgtcagtgttattgctgttcttttgattatattactttttttctctggctgtttgttaaaactttcttgcctttgcttttcagtagttcattcgtgttttaagtagtagtgttcttaataattatctttgcgattcatagaattgcttgaatcc

SEQ ID NO: 475131 - DNA, 909 bp, Homo sapiens
gttagaggctttttaaaaccaggttgcaaagttatcattctctcttgcctgctgccatgtaagacatgcctttcgtcttctgccataattgtgaggcctcctcagccatgtggaactgtgagtccattaaacctctttctctttacaaattacccagtctcaggtgcgtgtgcttgcaggtgtgcgtgcttgcagctgtgtgtgcttgcaggtgtgtgtgcttgctgctgtgcgcttgcagctgtgtgtgcttgcaggtgtgtgtgcttgctggtgtgtgcttgcagctgtgtgtgcttgcaggtgtgcgtgcttgcagctgtgtgtgcttgcaggtgcgtgtgcttgcagctgtgtgtgcttgcaggtgtgtgtgcttgcaggtgcgtgtgcttgcagctgtgtgtgcttgcagctgtgtgtgcttgcagctgtgtgtgcttgctggtgcgtgtgcttgcagctgtgtgtgcttgcaggtgtgtgtgcttgcagctgtgtgtgcttgcaggtgcgtgtgcttgcagctgtgcgtgcttgcagctgtgcgtgcttgcagctgtgtgtgcttgcaggtgtgtgtgcttgcaggtgcgtgtgcttgcagctgtgcgtgcttgcagctgtgcgtgcttgcagctgtgtgtgcttgcagctgtgtgtgcttgctggttataaatatcacagaatatgataagatatgctaatagattaataaagtaagtcatactttatactatgaagatatcactaaggcttttattaatatgtttcttattccttaatttaagaatttaaatataaatgaaaaaaaatctgataaatcccaccttcaacagcgttggctgaaaatgttaatcagtctgacactcctcacagtgtaactttaaaatgcctttagaagctctg

SEQ ID NO: 475132 - DNA, 6527 bp, Homo sapiens
attagttcagaggggcacatccttcactaatggcttagcaccatccccttggtgataagaaacttgcaatcatggtgaaaggtgaagaggaaccaaagacctttttcacatggcagcaagagagagacgtgcaagcagggaaaataccagacacttataaaaccatcagattttgtgagaattcactatcacgagaacagcatggggaaaactgctcccatgatctaatcacctcactccctggacatgtgggtgttacaggtccctcccttgacacctggggattacaatttgagataagatttgggtggggacacagagccaaaccagattatctgtgctatcatcagcatgtaaaccacttctcttcatggaatatcttagacactggacctaagagagcatttaacttgccctctgggaccttggggttgcaggcatccccgactggatgctgctacagggcctgcatggagtttactcctactggcacgaaagccgctggccagctttaaaagtctttatgtgtgggaatagtctttcagcttggttctttctcatcattttgggtacactggtcatttatatattcaaataaatatcacaatccccatgtcaatgatggaattgtggtgctaattttgtggacactttagagtaatttaactgccaattcaataaatctttaaaacatcatctattattctatcagagagtctacttcagcatgatgatgaacttgctaccactgctaattctgtgatcataagtcaatagctgcagttcattttttgtaaaataagattttttttcagaagcaatgctatatagaatcttgtcattgctgagcatctaaaagacgatgtgaatttgagtcatttgtgtgtagtacttataacgttaggtgttacagaaataaatgatgaattttctagaatacactgaagagttgctccttttatgtggtggaggggctggtgtaaagatttcaatgtctcttgaatgtcctattccagttaatgaagtgagcataacaaagagtggtgttttgttataactaaacaggaatggggtggtttgaaataataatacaaagattttacttcatgtagtggaaggtcttttgtagattcctactcttcatggaacttgtccttccaaactgaagatttcatgacacagtaattctccttctcacatgaagagataagagaatttctcattttaaggcgggagacaatctgtaacagaatattagtatgaatttgtctaaacagttttaagaggacgtcattatatgaaatcagcatatcaagcagaaatcttccaaatcaaattggcaaagcacttataaaggtagaaaagtgaatggacagatgtcagataaaaattaatgtattatttttctgcatagagaacaatatactgaatatataattacttgatggcatgatgtcagtcttcattcagctaatcattaatatatcttctactggtagtctaactctttgtattcttgaaagaatacagcatctttctgtttactatacatcttgctaggttttgcagcagtaagaaagacatctaacatctacaaatgtcatagtttaaagacagtacccaggggttgtcaaggactgattgtcataaatatatttgtcatagaaatttctctataaattgatattaaatgactatagaacatatgttcttcaaggttgctgagaatgttaaatgaccactatttccctgttggttttgtcaaatttgaaagtacatgacatagcaagataaaaagaaaatcatgatcttttgacctggtggaaagttttaaaatgagaaagaaaagcacgcaaaataattcctctctttttcagttcagggggaaaaataaaacccaaacaaacaaaaaaaatcattattactgggtatgcagcaaaatgtacaaaaaatttacttcacacctttaatttctcagttatcttgaaataatttttaagcttagacaattgtggtaacacaaggatagcctgaaaaatgtcacttaatttcaaataatattttttgtgtttcattttaattctattttttcttatattcatttctggcagttcagagtttagataatactacattgtgatcttatagaagctactcaaattaaaataatgacctataatgtaatatgacagataatttgagcctcacatgtgaaataaagtttggaaacaattaaccaagttcacagaaggaaaaatgaatcaataataagctttataccttgattctgtaatcaaatattatatggatgtgctttgggttttgttttgatagctgaactttgagccaatcaaggtagcacaagcagagatgaataattactctcaaagctgcactgttagatttatgtctaaaatattgccagaaaaaagaggaaatctctcccactaccactgtgcactacgctctgcaatttgtactattagcatttctgtgtcaggaacttgaatttgctacatgcagtagtaccccctgcaccatattaccttttgtttgcaggtattacttatgtatgttttcttcatagctactgttatgactccaagacatcagtcaaactctggtcaggactctttgaattgatgtatctttggccacagcctttgccctagctacgaaaaaggtgggaaaataagtatgtcaaagagaggcaatattttcacagacaaatgggggaaatctcaaaatttggagacctcaaatactggaagaagaaaatgtaaattttctttgttttctttcttggtgttttgttggtattgttgttttgtggtgttagtggcagtggtgatggtgatatttatatttatttgattggttttggttattttcaatcaactgaggaagggtataattttaaattgcaatgtgaggaatttagatgtattattaggaaaatattgagttgtaaattgttgaaatttttgaaattgttgaaaaactgtcctcctagttatatgccaatagcttccattctacttctgctagaaatgaagtcttttgcaacacaatatttgtgtgatgtttgtccagattctacttcttattgaacacaaagttttattctaaatctagttactaacttacaaatacagtattttcccctaaatccctcccaatattctgtataagattattaattttgtggcatgccttagcgtccaatccttgaaaaacacatgtaactctgtgcttccacaatccttaaaattgtacagtttaccataagatcctataaccctgtttcccatttatcattaagttaaatgtgttttcaaaaagtaccctgtaataaaaaagaacaataatatactcatgggctatgtttttattcccttcagctgtttcaaaataagagctcaataaacaactgttgaataaaatttgtcatttcagaaaagacttaaacaaatatttagaatagttatttaattccaaaactacagagtacatttctattaccacattttttatttagaatagaaggaagaggtttttgctatttaagaggcatgcaattgataaagcagtatcaagactatgaaaataattattatctgctgtttcagattccatacacaatttgagttggaattatataaaacatgcttgatatatgtaaatggaaaacaaaaatagactgtgcttatctcatttgattttaaataacaaggttttgtagctgaaaatctagatattagttattcagcttatagatctattgtgagtatcaaattagataatgcctttccaaatacattgtaaactctgaaacattaaaataaatatttagagttactgttttcaaagattaaagtaaatgaaggagagcaagcaaactaaatctaattaagaaaatatttatgccaactttagaacaaaataagtgtcctcatcaacttgttgcattttatcttcacatattgctaattattttataaaataaatattgtaaacagtatagattctctagctattcttaagcaaatgctaccaactcaggttgataaaaagagaccataaaatttactaaagcaaagcaaaacaaagaattactttatgcccacaacttataggttttatatgaaatgtaactattttatgttaaccttaatgtaaagcgtaacacagcagtattgcaaatgaagttccataaaccctgaaatatataggcctggacattcttaacacagagttaattctgagaaacatattattttaaatagcctgtcatctttgaataccccaacggcagcaaggaggaagcattgccaatcagccacttaattatctgcactgtatatgcaaataccaagagtttgatgaggtctttacatttggactttaagtaccctattagtaaccataaatccactactaatgtttctgtggcacttaggcaacagtgaaaaattaagcagtaatgacttcaaaggtggaagaatcacacaataattctgtacctttgaggtcatttttacaatttgaacacgaattatatgagcgtacttcattgccttcagcatttaagaagcattgctaatgagcagggaggttatttaggaaatagagtgcaagaggtggatatagatagaacactgaagcttaacagaattgattccaaatataaaaagaaacacatttattgcttttaaatggcctaaaatgcaaaacccacagatgaaacagactttcagaaaatcctgggaatgcaccaaagttgttcaatcagcatgatcagcttcaggtacttgcttttcatgaatcttccttgggtcaatgtgggcccgtaagtaatgaagtataaaagtctctttgctttatacagccattgtttttgaaaatgcagtcatataagatgaattttcctctccttagacctgcttaaaagcaattttcctctagctgactaaatcatacctaatttcatcgtgttaaagaatgttaaaaacagcctagtaaagcaaggttcagccttaaatataaaatatcagaataatataaatgataagagaaatattaatttgcaaatatctagtgttttaaagccctggaaaccattatgcaaaattaaatgtactaaatacaaaacaatatattttgaaaatttctgaaccatttattttagtagtcacctgatgatctgatacagattatccttttgataaggttcatctttatagtttgcctcattacctacatttgtatggcataaaaaaattacatcagcaaataaacagtgcctagtgacgaattattttcaaatattataatcatatttgattcttcaaaaatatcagatgaaagctataaaaaatgattcatttttcacaatatatctaacatgatttctactcatcagggcaacacaatataaatcaatttaatataataaacttagatttatatcaagtttaatattcttgaccgatgttttaatatgattaatatgatgtataagcaagtctgcaaagaaagattacctaaagctaatgataccctgaaaatatgtactgtaatcattttaaaagtgtgttttacatacatgtatctttacaaagtagagtatgtatttaaaagggtaaatatactaaaatttattccatactacaaatacaatttttttgaagttgaaaatattaaacatacagaaataccaaaagaattatataataaactatttttattgagaagtcccttttgacatgattcttcattattactaaatgctgcagtatatattgcctacaagcaaggttcatattttggtattataaccatataaattagaaaattaacactaatacaataataccatgtaattctcagtacccgcactgattttgacaattagctcagtaatgtcttttatagaaagataatttaatccagtattgctcattttatttgtcattcatctatttagtccttttccatctggaatgttttcttagttttttcttgaaatctctgttcttaacactttaaatgtttacaggccagttattttgtaatttgcccttccatttgggtacatctaatattttcatatattaaatttaggtgatataattttagctaagatatcacagaagaatcttcttcttttcttactgcatcccataaggtattacccagtgtagaattgtcctaccatttgtgatgttaattttgatcatttgaaaaaggtgctatttctccactgcagaggtattcttacttttctcttattgttaataatatttcatgggaccatactttgacattccataactattcttccttacctaaatattatgtactattgttagcaattattgatgtttcttgcctcaattaactgtaactatgagggttgcaaaatagtaatttatctaatttcttttttacttcaaaattactagttggcattattacataaactatacctccctagtggtccaatatattcattcagcttatttgta

SEQ ID NO: 475133 - DNA, 861 bp, Homo sapiens
ctaccttgggatcccatcccatggggtcacatctcttgcatcagtgtgacctggttgtgagacttggagtcaaaggagatcattttggagctttaagattttactgccctgttggattttggacgtccacggggcctttagcccctttgttttggccaatttttcccatttggaatggctgtatttacccaatgcctgtacccccctggtatccaggaaatatgtctttatcagcagcaggaaaacagactaacacaggtatcaaaattgaagagttcagcgcatcgctagagcaaaccaaggtttccaagagagaagccaaatctgtctcggcccgtggaggccttcctgatcacacattgaataggatgtggaattcagagtacctgtgttccaagcttagaaatcatccacaatttacacaaatgaagtccacagtttagccataaacaatcacactttcagtattagttatatgtgccaaatcaaaatgtagcaaggaaggacataacttcaaacagaaaatctgaatttataccaaaaaaatgtgaaacaggtttaccattaccctagcctttcaccagagaaaacttacttcttgaactatttggtttagcttaagctataggcttacatttcaaaaacacgtatatcaaacgtgaaagactgacagaggtattcaaacaaaaggaataatttgcagtcattgctctattatgccatttcctttttaatgcctgaaataatattacaaagaaagagaagattttataaaataatcatttatttaggcaatatcatccttagtttatattaattatcctttcaatacatcttatttatattctagttaaaattccc

SEQ ID NO: 475134 - DNA, 785 bp, Homo sapiens
ggaacgcgcggctctcagggcgctatgtggagcagctctgcaccccctttctaccccataccaccattgccagtggcacggactgtgaatgaaggccatcagccctgcgcctgcatgcacccggcccctggtgttgacattgccagcagccctgccccttgccctacccccagccctgtgctgccacagctgctgctgcaaacaccatcatggaagccagcatttccacgcctgccagtgtcccaacccagttgatgagcatgtaccctgctatgtgctgctgccactttcacgtgtgaacaagcatggatcctgctgctaccacccaacaaagtgctttgactggcaccgcttatcaaaatattgtagactacggtcttggaaccgcttgttccctccagcacagcagaatcctaacatcaaggggccagagaacaaagctgggagcccattaatagcctcccagagtcagagcatgcagcccaggaatgctgagctgagctttggccccctgaactcttccagaaacaaagctagtttactgaacccttatagtacaatcaaaccccccaaggacatcaaagaagatgaaagaaaaaacacatctaaaggacagcaagctcaaagactaaatgaagatcagcccacaaagatgagagagaaccagtgcaagaactctggcagctcaaaaatccagagagacttctatttgtttatttatttaaatagagatgacatctcactatgttgcccaggctagtctcagactactgagctcaagtgat

SEQ ID NO: 475135 - DNA, 796 bp, Homo sapiens
ccagcacaggaaaaagaaggaaaccagaaaattcagctagcaaggttatcccaccttctccacctgctctgttctacccgtgctggcagcagattgcatggtgcccatatacattgaggatgtttacttcttttatttcctggattgctttacaaatttctttgtgttgattttcaatcttatcttggatcttattgagttttcctgcaatccatgcattgaattgaattctccatctgtcatctctatgcctccattttggctacagatctttgttgggagtcagagtaagcctttggtgatgtcacaacatttatttttcattacggcagaattcttttctgattccttctcatctcgagaaggctgtgttgggcagggatttttttgctttgtttctatagtcctgtgtatttctgtcaacaggttttctattgagctgtgtggttcaccctatgggccaaaagatggtgtttatagatattttggagaaaaaactacttgcaccaaatgaaataatgagaggctattttaaatcaaaatatcagagatattttaaatactaaattttaaaagttactaatatttttctattttttatttattacactttaagttcagggatatgtgtgcagaacgtgcggtttgttacatagaagaaaaaaatgtctactaacatcaagtgccaaatatacatttcctaatcaatgggtctgaccaaataaacttagttctaatataaatacatctttataatgatttttttgaactctggttatttttggcatcatctcat

SEQ ID NO: 475136 - DNA, 1589 bp, Homo sapiens
agctgattcactatacgtctgtctgcttcttaagacttcgcctctggtcactacactacaatgggtggtttagcgaaagcctttgacagtgtggtggaaataggtttggtccttggtagcatgtgccagcagcagcacgagcagcagcatggcagggtgcaggctcatttgttgcagcagggtgctaatgggtgccagggccagggtgcctgattccatgcaggtattcaccacagtggccgagacagcacagctgtgggggtggctctttggtgactatgtgtgccaccgtgctggtggtggtgttagcaaaagggcaggatgcttgcaggcacagatttctttgccctttctgtgggccataggcaggggtggttactcagggtgggaacaagtccactgttctctatgcagagtttcattctggcagcagtgttggttcaagggcagggcactggtgaaagcaggtctagcttgccctatgcctgccaaggctccagctgcaatggcagtcatacaggaggtgcagggcagactatactcccacagcagcagtggcggggcagggtacatgtacacacattcgtgcactggtggggcaaggaaagcaaaatctgccttgcacaaacatgcaggcaaagcaatgtgggggtgaaggcatggtccaccagtgcaatagctatcatgcaggcctccagggaatccaaggctgccctgcaagcagatgttcgttttggctgttaaattgcattatattgctctgggacagataatttttctttgatgacactaaataagattctttattttttcagctgttcttttataataattttaataaagattgtgaaacaatttcagtccaaggaggcagctgacccaatgagagaacaatagtgtgccaaaaatgcttttctctgacctctcagatgggtgctatcactgagaagagctttcatttcagtcaacgtgaccgtgataaagtatgagcgctgtggctgtgaactccctttggataatgcttcatgacatatggaaaatgtttcctgacttatgaaaactaatatggggacagaatttactaaaaggttcaggtcacttgggtgaaggaagcattaacacaatccttaactacagtctttaagtcataaatatctgactcatgaaagaaatatatttatttcaccctttctgagttttaagaacctgtagggaaaataaagatatgatcatattcctaatagtgagtggggaaacactttagtgagtatctaaatgaaatgttttattttctttaaaataagtgcacatacttaatatgacaatacatttaatactctgttttgataattttggggttttgtacagtaaatgaaaaactttaattcggttatcttattaggtaaaagtgtagtatgttttcaaataaatgccagttgaaaaaatgaaatggctatttgatttgataaatgttgtacctctagtgttgtttaaaacaagctaattagcaactctaggtgcctacagtatgtcagaaattcaaggcatctgccactagagagttgtagtgccttatttaccaacaaagc

SEQ ID NO: 475137 - DNA, 740 bp, Homo sapiens
tgaaataaacagacttgttgctcacacaaagcctttttcttgtataatggcccctgcttttgctagaatgtgtctccctaacaagggagtggggctttcaggcataattagaaaagcatgtgaaaagagtaaagctccccactcacaacttagtggctgggagaagtatctagtgactggctgtcctaggacccctcggatagtgacagatctggaggacagttgtctgggacaggaaagtaagactgagaaggctacaccagtgtcccagagacagttaacctcctggccttcaatggtcaagcatacccggggctctgtgagggtgatggcatgggctggcgcttgccccgggcaccctcagtcctgctgctggatcatctggaaaacatacgaatggacaacttatgaaaaggtgctcaacgtcactaatcatcaggaaaatgcaaatcaaaaccacaatgagacatcacctcacacctgtttaggatagctattatcaaaaagaaccaagactatcttgaacttactctctttgagcaggatttttctcttcatcatttaacacggaaagaaaaaagggatggaacagggtgaattgaagctcacaaggacatgcttgaagaattatgggtgtacaagcaaacttcagggtaggagaaaaaagaatcatgggcgaatgcttcctttaacattttactaagtggggtttggaaggcaagagagaggtgaggaaaaga

SEQ ID NO: 475138 - DNA, 1958 bp, Homo sapiens
ggggtggagccaagatggctgaacaggaacagctccagtctacagctcccagtgtgagcgacacagaagacgggtgatttctgcatttccaactgaggtaccaggttcatctcactggggagtgtcggaaagtgggtgcaggacagtgggtgcagtgcaccagcatgagccaaagcagggcgaggcatcacctcacctgggaagcacaagggttcagggaattccctttccaagtccaagaaaggggtgacggatggcacctggaaaatcgggtcactcccaccctaatactgcacttttccaacggtcttagcaaatggcacaccaggtgattatatcctgcacatggctgagagggtcctatgcccacggagcctcgctcattactagcacagcagtctgagatcaaactgcaaggcggcagcaaggctggggaaggggcacctgccattgccgaggcttgagtaggtaaacaaagtggccaggaagctcgaacttggtggagcccaccacagctctgcctgcctgcctctgtagactccacctctgggggcagggcatagccaaacaaaaggcagcagaaacctctgcagacttaaatgtccctgtctgacagctttgaagagagtagtggttctcccagcatgcagctgcagatctgagaatggacagactgcctcttcaagtgggtccctgactcctaagtagcctaactgggaggcatcccccagtaggggcaaactgacacctcacatggccagatactcctctgagacaaaacttccagaggaacgatcaggcagcaatatttgctgttcaccaatatccgctgttctgcagcctccactgttaatacccaggcaaacagggtctggagtggacctccagcaaactccaacagacctgcagctgagggtcctctctgttagaaggaaaactaacaaacagaaaggacatccacaccaaaactccatctgtacttcaccatcatcaaagaccaaaggtagataaaaccatgaagatggggaaaaaacagagcagaaaaactggaaactctgaaaatcagagcacctctcctcctccaaaggaacacagctcctcaccagcaatggaacaaagctggatggagaatgactttgacgagttgagagaagaaggcttcagaagatcaaactactctgagctaaaggaagaagttcaaacccatggcaaagaagttaaaaaccttgaaaaaaaattagacaaatggctaactagaataaccaatgcagagaagtccttaaaggacctgatggatttgaaaaccacagaacgagaactatgtgatgaatgcacaagcctcagtagccgactcaaccaactggaagaaagggtatcagtgatggaagatcaaaagaatgaaatgaagcgagaagagaagtttagagaaaaaagaatacaaagaaatgaacacagcctccaagaaatatgggactatgtgaaaagaacaaatctacatctgattggtgtacctgaaagtgatggggagagtggaaccaagttggaaaacactctgcaggatattatccaggagaacttccccaatctagcaaggcaggccaacattcaaattcaggaaatacagagaacaccacaaaatactcctcgagaagagcaactccaagacacataattgtcagattcaccaaagttgaaatgaaggaaaaaatgttaagggcagccagagagaaaggttgggttacccacaaagggaagcccatcagactaacagctgatctctcggcagaaactctacaagccagaagagagtgggggccaatattcaatattcttagagaaaagaattttcaacccagaatttcatatccagccaaactaagcttcataagtgaaggagaaataaaatactttacagacaagcaaatgctgagagattttgtcaccaccaggcctgccct

SEQ ID NO: 475139 - DNA, 586 bp, Homo sapiens
tttcctgcttcactgttaccaaagtccagggaccaccactctctctcacatcacctgttaccagaaaagtcccctagagtaatggttttcaactggagggaattttgccatcaggggacatttggcaatgtctggagacatttttggttgccacaacttggaggatgctatgggaatcagagaccagagatgctgctaaacatccttcaatacacagggcagccccacaacaaaaatgatccttctcaaaatgtcgacagccaaacagaatgtgctggacccagatccagacccagacccactcccagacccaaccactggagtggagctggaggcaagggctgcaggcagcaggcccggctgcaggctacagaaagaactctagctaggagaaactcagtgattggatcaagaaagaagctccaaagtcccaaagccaaacttgtaccaaaaaaggtcatggtcactgggatctgctgccggttatgatcctctacagctttctgaatcccagtgaaaccattacatctgagaagcatgctcagcaaatcgatgagatgcactgaaaaccgcaatgcctgcagcc

SEQ ID NO: 475140 - DNA, 686 bp, Homo sapiens
caacccatctaaaggacagcaactttaaagattgaaggaatatcagcccacaaagatgagaaagaatgagcacaaaaactcggacaattcgggaaggcagaaaaccttctttcctccaaacaactgcactaatgaccacacaattggacataaaacaatcctcagcaaatgcaaaagaactgaaatcacaccagccactctcttggaccacagtgcaataaaaatagaaatgaagactaagaaaattgctcaaaaccatacgattacatggaaattaaacaaactgctcctgaatgacttttgggtaaataatgaaattaaggcacaaatcaagaagttctttgaaactagtgagaacaatgatacaacataccaggatatctggggcacagccaaggcaatattaagagggaaatttatagcactaaacactcatatgaaaaagttagaaagttctcaatttaaaaacctaacatcacaacagaaagaactagagaagtaagaagacaagtgaacatttatttttgtgcctttctccctacgtgtatttcaagtctttttcaaaacaaggccccaggaatctccagattcaattatgtccctgggcttggtaagctaggaggctttcacataaatattcacttaattccattgacaacctggaaagagggctttgtttctcattc

SEQ ID NO: 475141 - DNA, 1193 bp, Homo sapiens
acacttcctgcaagctgagggagccggctctggctctggcctcggccagcccagaaaggggctcccataatgcagcagtgggctgaagggctcctcaagtgtggctagagtgggcgccaaggctgaggaggcaccaagagcgagtgagggctgccagcacgctgtcacctctcactaccttctccctcacttgtggatgtccatggacaatgctacccaccacagagagtatattcaatatgctaccttctccctcacttgtggatgcccatggacaatactacccaccacagagagtatattcaatatgctaccttctccctcacttgaggatgcctgtggacaatactacccaccacagagagtacattcaatatgctgccttctccctcacttgtggatgcccatggacaatatactacccaccacagggaacatattcaatgtgctaccttctccctcacttgtggatgcccgtggacaatactacccaccacagagagtatattcaatatgctaccttctccctcacttgaggatgcctgtggacaatactacccaccacagagagtatattcaatatgctgccttctccctcacttgtggatgcccatggacaatatactacccaccacagggaacatattcaatgtgctaccttctccctcacttgtggatgcccatgcctgtggacaatatactacccatcacagagagtatattcaatatgctgccttctacctcacttgcagatgcctgtggacaatatactacccaccacagagagtatattcaatttctgaaagcccaatttgaagaggaggttcatcgagaaatcagtcagccagcatccaaatggatagtcagcaagttaaagaagggtagaaggtttagaaagcagacacagcaaaacagagccaaaggttttcaaccatccctgggaaaggagctgctgatatatctatgggaaacggtaaatacatgactttgcttctatccctgtaaagttgtacctggttgatctccccctctattctaacctaaaaatctcattctgaatatctacctcttcagctgtcattatccaataagcatactgctcatattttatataaattgttcattttctttttcaatatgtattgagtagtttctctttttttattatactttaagttctagggcacatgtgt

SEQ ID NO: 475142 - DNA, 756 bp, Homo sapiens
ctacaagcagcagggtactgtactgaatactgtaggcagttgtaacacaatgctagaacccaccgtgcccacggagacactggctgtttcctggcattctctttggtggtgggaagcatcttttcccagactcacctatggtgacacagactcaagtttgaaagcatcagcactgtttctgtcccaacacctgcctttttcgggaatcacacatattcatctagtaaattttgggcagtcctatttagcaaaagagaatgaatccaatcagcatgtctcagaaggcacttctctctcctacccctttgtgaagaaggacgtgcttgcttccccttcagccatgattgtaactaatattcacgaagcacatattgatcacactggcaagcattgtgtttgggatggagagtcacagatgagaagaaatggcctttggggaacatggagtctcatgggagcaggagaggtgaaagcagttgcagccgatgaaattcggggcttgacaccacaaaatccagaaacagcatagctctgctgtgaaggagttgattcagcagagcaacgaaactagcctgtttctgataatacggaacttagaaataacttttattttatttattccaaataatttataatttattatttccaagtgtatttatggtcctggttatcagatgcaaaaataaaaatggataaacaaaatttagctacctgaaaccaagtctatgtgttcatatattagaaaatcgtatgcat

SEQ ID NO: 475143 - DNA, 625 bp, Homo sapiens
tgctttcatcactcagtgcattgaaaaatgtatttgagttttgtgaaaattatggtataccagagagcagaagcccaggagcctgcctccttagaggatcttggaggtggacaggctattgtagtgctcttcctggccctcgagcaggctgaggtaggtggcgagctcctgctccagccacaacttgatgtccatgagcagctggtactcctgattctgcctctcactgtcagctcgcacatcgcccagctgagcttcaatactgctgatcagcgcctggatctgcgccagctgccagctcttccttcagcccttcggtctgcatctccaggtcggtcctggccagggtcagctcaaccagcaccccgtgcaggccattatgtcagcctccacactcacgagcagagtctgctccctctcatacttagttcagaagtcatctgcagccagacaggcattgttgatctgcaggacaatcctggaattctcaatgatgtcaccaagaatcttgtagcacaggtactcgatggtcccgtagtagtggctgtagtcatgggagggcctggggcacatgattttaaaatgggaaaacaacaagagacagacatccagcttccctagcatt

SEQ ID NO: 475144 - DNA, 723 bp, Homo sapiens
aagcttttgtcaaagaacacggtgtaacaaaaaggaggacagcatggctataaatggcaggttgaatggagagatgaaaatgctaccttatcctttagataggaggcatgattatctggcagaaatatctcaactccagtgcctctgccacattcagtcactgactgagggtatcccagggaaaatgtggtttcggtgtgaacactgcgatagatcccagggagaatgtctggtgattcttttggatatctgccttatttctgctttggcttcttcccaagactgtcactcaaatcatagtcccaacttggctcagccacttaagccaactgtcaccattcatgtgacccacattcccattcccaaatccagctcagttatttacaacaagtggatgcgcagagatacagaagagaaacacaaagaagaaggccatgtgaagatagagacagagattgatgatgctgctacaaaccaagggagccaaagattgcaggagtcaccaacagctaggaagaggctaaaatcctgtctaccatgatagcattgggagatatacctaatgctagatgacgagttggtgggtgcagcgcaccagcatggcacatgtatacatatgtaactaacctgcacaatgtgcacatgtaccctaaaactttaataaaaaaaaagaaaaaaaaagaaaataacattcttagatattaaaaaaaaaaaaaaagaaat

SEQ ID NO: 475145 - DNA, 978 bp, Homo sapiens
atgctgtcctcagggaccagctggacagggacgcggggacatgcttctctatgtgcggggagaggtgggcgtaggcggctggcgctggatccccgacggcaaaccaaggagcttaaaggccaggcagggacaaggggttgctgaggaaacttccggggcttctcaggtccaggctgaccaggtttacacaccagaaagcacacggcatcctgacggtgggacaagaagaagatgcctggagaagagcacagagcacgtgagagccccggaaacccgcgcagagcacgcgagagtcctggaaaccaacccacacagagcacgcgagagccccgcacacccgcgcagagcacgcgagagtcctggaaaccgactcacagagcacgtgagagccccggaaacccgcgcagagcacgcgagagtcccggaaaccaacccacacagagcatgcgagagccccgcacacccgcgcagagcacgcgagagtcctggaaaccgacccacgccgagcaagcgagagccccggaaacggaccaacgcggagcaagtgagagccccggaaatcgaccaacgcagagcacgcgggagtcccaggaaaccgacctgcgcagagcacgccagagtccccgaaacccgcgcagagcacgcggtagtcctggaaaccgacccgcgcagagcacgcgagagccccggaaaccgaccaacgcggagcacgcgagagccccggaaaccgacccgcacgaagcacgcgggagccaccgcttcattccacgcaccacccacttgctgggcgtcttcagagttctaaaaacccaagaaagaaaaagattggaagaggagcttactttattgtaagaacacagaatataatacatgtaacagacaaaatatgtgttcatcaactgtgcatgttaacgagctgaatctcccgggggtcctccacctggagccccgtgcccacaaacctcagctttcctgatc

SEQ ID NO: 475146 - DNA, 484 bp, Homo sapiens
ggacagcacctcttaagccatggtcagccttatcctgattgccctggggtcattagtggcctgccacccctcacctgcccttctcaccccgggtgcctccccctccagcctgtcctccaagtggctgggagcccaggaccctgcaaaggactttgctctaaaaccagcttctgctaaagtcattgatcacctcaatttcctgagtgagctgcaggccacgccctcgcctcatgtccctgggacctcacatcgcagccccgggacagctgcacctgccacaggccaggtcaggactggcctcattcccccgaccctcggtgtcaggcctccagggtgggagcatgaggctgtgctggacccagaactgcagctgttggtggggccaggtggagagagggagccccaggcagccaagcctcctctctgtaccccgaacatatgagatccccagggctgccataaagagtgccacagactggggcct

SEQ ID NO: 475147 - DNA, 789 bp, Homo sapiens
cccagactcgggtatgtatttattagcagttgatattgcgtcccatctgggtcaccaaaatgtgtccagaatttgttccttccagtgggttcttggtctcgctgacttcaagaatgaagccacagaccttagcgttcgtggtctcgctgacttcaagaatgaagccgcggaacttggcaagaaaattaatgaatatgtgaatcagtttgatgagagaaccttggagactggaatgttccatgaaactaatcaacaaaggggttatcattccttttggcaaccacaatccataccaggaacatggatgcgaataggagagattctatgtccagctacagtgaagaagcttcactccaatgtttgtgtatgcatgtatgtatgcatcattacaccaaccttatcaaactcttcatttcccaacatttgtttcaacttccatactcagctcatataacactcccccctcagaaagtagttttcattgactcattttcctccccaagattttatgcatggaacagtcaatgactccccactacttcataaccaaactctgtatttattattcagtgctcttcaagatcagttcccatgctacttggctacctttacctctcattacgttcttcatgcatgaaatccttcaataaaattaattcctcaatcttcattatttgtcctatctctgaatgtttatccagtttatttctcagaattaactgtcttctccattagccttctgctttcctcagcttgagtctcagttagaagtaattttcctttctccat

SEQ ID NO: 475148 - DNA, 566 bp, Homo sapiens
gaccaatttctctcacttttggaatgggaataccttcccagtccttgtacccccattgtatctttggagtctcctgggtgtcatgcactaaccttgaggggctggaccaagttccacagctttgtcttctggtcacacgaggtcaagcacctgctgcactggaggggttgaagtgttcccagtctgcaggtgttgtgatgggagctgttgataaaagtgctatggcatggcaagtcgtgggccacaagacagtgtgccacagcgagggggtcacaggcaaatgtgcatggtatatgccagcgaggtgccatctgaaaaagagttcaaatggaaaggcgagggcttctggtgaaaaatctgcagtggtgctcgctggaaagtatttcagcaggacaactaaggctctgctgcaagcagatgtggccaggcagggacagtaagagggactgtatacaggggagtattcagatcagactcatcccatctgacagaaaagacagccctgttctctccacttctggcagctaataaatgctaaagccacctagaggagtatggtgggtctt

SEQ ID NO: 475149 - DNA, 1833 bp, Homo sapiens
gacactgccttgagtttatcaggccatttgaacctaaggactaagaccctgagggctcagaatacatgaagacgtgggaaagtttggaacttcctagagatttgtctaatggctttgaccaaaaggcagatagtggtatggacaataacgtccaggttgaggtagtctccagtggagatgaggaacttgttgggaactggaataaaggtcactcttgctatgcaaagagactggctgcatttttcccctgccctagagatctatggaactttgaacttgacagagatgatttagggtatttgggggaagaaatttctaagcagcaaagcattcaaaaggaagcagagcatgaaagcttggaagatttgcaggctgacaatactatagaaaagaaaaatccattttctggagagaaattgaagcctgctgcagaaatttgcataagtaccaagaagccaaatgttaatcaccaagacaatggggaaaatgtctccagagatgtcagagatcttcagggcagctcctcccatcacaggccatgaggccaaggatgaaaccattgttttcttggccaggcccagctccccactgcctcatactgcctagggacttggtgccctacatctcagctgctccagccatggctaaaaggggccaagaaagccagtctccaaactcttagattcttctctcagcttgttctagtctgttattaatacttgtgatggcattaataaattcttttagtgtgtttttcagctctatcaggaggatataactatccaaaaatttggtgaataaaatgagtattagtcccatgaaaatgttagtgtttaaatatttgtttgcttcttctcgattttccttttttaaatttactattaatgttatttttgattgacaagtcataattgtatgctttcacaggacacaatgtaatgattaatgcatactgtcttaattgaattttatttctaggaaaatctaatacctactcagtattcgccattagtcaacttattatttttattattaacaagtgattgttttcattcacaacctgtttttaaatgttttattattcattttactttaaatactgttattttcttagaaaatgatttgttatcattattcagctttggtaatattaaacaatatggatattaacatatctcaaaaagcaaactgactgaaaatcagcaattactcatgtattcatcatatttagaattgtggaaatgtaaatgcaagactgataacataaaaagtctggttcagttcatggtaaatgaaattagtacaatttagacctgaattataaaaaattgtgaaacaaaatgaactcattaaatatgacttctaaaaaagtattacatgggagcctattttcagtacctttaaggaaacaaaattcttacgtagaattttatacctggccaaactaagttccataagtgaaggagaaataaaataatttccagataagcaatcattaaaggaatttgttagcaattgtacagcatctttacaaaatatccttaagtgagttccaaatatagaaacaaaagaacaatacctgttactacaaagacaatcttaagtacatagtccattgaccctataaagcaaccacacaatagaaactacaaagcaaccaggtaacaacttgataacaggatcaaaacaccacatatcaatattaatctgaaatgtcagtggtctaaatgcttcacttaaaaggcactgatgggcaagttggatttaaaaaaaaaaaagaccatttttttttgctgttaccaaaccacccatctgacgtgtaatgacacccat

SEQ ID NO: 475150 - DNA, 931 bp, Homo sapiens
gagctgagcagcagtaaagctgccgtatgcccatgtatttgaaaggaattgggcattgtgatctaagccataactgcattaggaggcacctcatgagcagtaatgctgtggttcttgcagactcagaggcagaggagcctcaccccatggccactaccaccacaggcccactgagagtaatgccaggtgaacgtgagagtatgtcagagtcaagaattaccaatggttctaaaatccaactacaagaatgctcctatctaattacacatgccactcatgtcactggttttgacctatcctctctgaagtccaatactcatcccaagggccccgatttttttgtttctaaaagcactaccaatcaggacttaacattcgtactgaatagctattctcaaattagaatcttctcttgtcacccacctagctcagttgtcctttggggtgtaagcttagctctgttcagatgaaatagaatatatgccagggagaacaaaagaacaaagactccctcattctctgggttcccacctatgtaaccattagcaaaaaaggactcagcacaacaccccaggtctaggactcaggtgtttcataccaagatgcatgtgtgcgtgtgtgtgtggggggggggcgcgggggggtggaatagataatttctgtaagaacaaagaaaaattgatgaatgtcatggacaaaagaaataacattgcaagttaaattcaattttagtaaaacacagcagaagttatatttgcaagatattttccaagttgcagttgatggctcatatttttaaaacaatatttaatataataaaattccaagtcaatagcggaattggaatagtgctttggaatttgtacagttaactaagtacaaatttggcttgtagtagttaatttagttggtgttttaaagtttttccctt

SEQ ID NO: 475151 - DNA, 1184 bp, Homo sapiens
tgcaagcaactgggctttacgacttgcactttttggaggatctgacccctaccctggagagaattgaagcgacaccaagaaagagagcctataaatggacctgcaagtagggaagatctcactgaattcttttcctggcaaggaatattaataattaagaccctgggaaaggaatgcattcctggggggaggtctataaacagccgagcagccagagcagacctgttaaaacacaagtcaggtcatgtcactcctctgctgaaaacactaatcgcttcctatctctttcaatagagaaaacagtcttcatcatgacctgtggggacttttgtgatctgcccttttatttcttatcttcacatgcccagcatcattggcccctttgctgttccttgaacttcctgactcagggtctttgcacatgcttccactattgtctaggatgcttttccctcagatatctgcatgacttacattatcactttccatctttactcaaaagttaccttcccaggagctctcccctggttaccctatctgtatttttaactccctttcaacatttaataccctcttcctgctttgaatttatcttaggcacttaccattaacatattatatcctttacttacctgttgtctatcttttgtccactccaactagaaactaagttccagaaaagtaggagtttttgtcttgtttgctctctactgtatccccagtgcctagaatacatagcaaatattccatgaatgaattgaatggggtagcactgcatgtgtgtgatcaaaggagcatattttgagaaacattggcaaaatattgtcactgtcacagtcataaaacattcattgattgccttctctatacaacgcactgtgctaaataaaaattggttatttttccagatttagcttagatactgctccaaaattttatttcatattgactttagaacatagcaacagaattagttggtttgttgattcaagttttgtgttcttgtcactattgagtgaaggaggtccattatagttagatgaggctgcttacttgcaaagaaatatcctcattctgcccctctcataaatatattttgtcaaattgacaaatcaattcagtacacctttcccaaatgcatgctattggtttgtcaaagatcagataattgtaggtatgcggcg

SEQ ID NO: 475152 - DNA, 737 bp, Homo sapiens
tggcttgtgccctgtggtgtagcagtgtgagctgatacaagatggcagtctgcaacccagaagaggcccctcaccaggaaccgaccatggtggcacctgtatctcagacttctggcctccagaacttgtttcatcgttcacagttcttcgcccaatgccttgtccctggcaaaggtggctcttggggtcctggtcttatgttcttgaggcaatggcgggaaggagaggggactgtgatctgtgagtggatctttgtgctccctggcttctgccaaaataatggcccccttccatcttgtcactgctcctcctgctggctcccattgctgaagtttactgacgaagcaggcaaccttgtggtctatcccctccctccacacagttggatacgtggggctcactgcctgtggagggagcagactttacagcaagacttgaggttacacagagggaagtgccccggtggggccacgtcaggagagaggaacacgaggaagccgcaaaaaatcatcagccattgactccagttgctgatgtggcagtgtgacatgaggcaaggaacgcgttgagagaaagtattcagtctttcaccatcaagtgttatattacctataggctttttgtagatgcaccttatacttttttggaagtttcctttaactcctagttgctgggaattcaaatttaattcctagcttgttcattaaaaaaaatcgtgaatggatattgaattttat

SEQ ID NO: 475153 - DNA, 572 bp, Homo sapiens
aaggagggtggctttacaaccttttctacaagacaagtaaatataatgggcagacaggaggtcactcaaattggactggccctgtctcataggcaagcctgccctgctctgtccaggtctgacagtcacccaaaggctaaagccacctacaagatcttggcaagccttggggaaagggtatccctggctgtgttccactgcagccattcccatgccaaaccctctgggctctacacaggctggagtcctgcccctgccaccactctaaacggctttgcttgccagctcaagtgggggttgtgttgtctcctgcagctaggattccggaggtccataacgacagtgggccactccttaacaattccacttaccccttccccaggagtttctgggggccaggagtggatcctggtgttcagcagccagggttcatgcagggttcccagattcctctcctttcagtttagcatctgtgtcctccctccatctactctcaatgcctttcctttgaagatctcagtcttcctaatgtcccgttctctcattgagagatgttcctcttagctgtgtct

SEQ ID NO: 475154 - DNA, 601 bp, Homo sapiens
gatgtggagataaacaaagaccacccaatgagaacaagcaaaggctattcagggcttgctgtagaaaaggaggcggctgccattcctagtgcttggcagagacttgaaggcaggcagaggagtggaaagcttcatagtggaggaggagaggctccaggggagcatgttgggctttctctggtcctaagttggaagcagcaggaaaaagtagggaagccagtggttattgatgatgtcctgactgttctgggcagattgctgtggacgttgtggtttggcttcctggactggctgctgcagattgtgggtcacacttctgctgtcatctatgggctggctgctgtctgtatattctgtctctctatgcagcagttgggcaggtcaagaaagaggtccctaccatctatcaatgaggagatggggccctttgcagtgtagggacacagctgtgagggctaccccaggagaagcaggacatgaagcctcacaggaaggaaggcataacaatgcccttttctgtttggggaatacagacaagaagaaaggtctatacatgtttagtacagatgaaccagtccttgatccacagttggttgaagtc

SEQ ID NO: 475155 - DNA, 2496 bp, Homo sapiens
agggcctcttgcgccagggcagaggtggagggggcgtggaggtggggagccaggagcaagctcagtgactttggaaagcagctgtgtggacccacacgtgcacacacaggcacatatgtgcacgcacgtgcccacacacagccataagggaaagtatgtggttgtctcagctcagtagtgagcagggtcccccacctctggcccagtccctgacagccacaggtctgttctctgtaacatccttcggcctggctcctttgacagacacaagaccatggaaattggcctctgtcatcgcgagctttgtaaagggcctactgtgtgcagggtaccatgtggggtcccctggaggatgcgtgaatgatggagacacgatgccaaccttccatcaggagaagcacagaaagaatttagccaagaagccagcagggtggagggatgccaggaggaccctgaaggccctgctaaggattaaggcaattatattttacattcctccaaccggagactctggaagtagacgaagtgagcccctgcagtgcatagtgactttcctccaaagagcacagcataggaacggggagggcaaagagcaacactgccatgggaagacctgaccatcgccgcctgtcacatggtcaagcgtgcgtgtcggcgtgttagcgtgcgtgtcggcatgtgttagcgtgcgtgtcggcatgttagcgtgtgtgtcggcatgtgttagtgcgtgtgtcggcatgttagcatgtgtgtcggcatgtgttagcgtgtgcgttggcatgtgttagtgcatgtcggcatgtgttagcatgtgtgtcggcatgtgttagcatgtgtgtcggcatgtgttagcatgtgtgtcggcatgtgttagtgcatgttggcatgtgttagcatgtgtgttggcatgtgttagcgtgcgtgtcggcatgtgttagcacatgtgtcggcatgttagcatgtgtgtcagcatgtgttagcacacgtgtcggcatgtgttagcacgcgtgtcagcatgtgttagcgtgcgtgtcggcatgtgttggtgtgcgtgtcggcatgtgttggtgtgcgtgtcggcatgtgttggtgtgcgtgtcagcatgttagcatgtgtgtctgcgttagcgtgcgtgtcggcatgtgttagcacatgtgtcggcatgtgttagtgtgcgtgtcggcatgtgttggtgtgcgtgtcggcatgtgttggtgtgcgtgtcggcatgtgttagtgtgcgtgttggcatgtgttagcgtgcgtgtcggcatgtgttggtgtgcgtgtcggcatgtgttagcacgtgtcggcatgttagtgtgcgtgtcggcatgtgttggtgtgcgtgtcggcatgttagcatgtgtgtcggcatgtgttagcgtgcgtgtcggcatgtgttggtgtgcgtgtcggcatgttagcctgtgtgtcggcatgtgttagtgcatgtcggcatgtgttagtgcatgtcggcatgtgttagcatgtgtgttggtttgctagggctgccataaccaagtcacagaaaccaggtgcctgtgtgacccccaggaggcactatccagggtgccgtctggctatgcctctttaagcttgatgggaaccctgggtgtgagggggccagccagggctgaagtgtcttttacaccaacattttaactttaccttcagtgccttttactgcttagtggcaaatgttcctagatgaccatgggaatcaatgagcagaaagcactgtattgatgactggaaatccttactgagagacacactcatcttcactggagagcttgtgtatgtatatgcatgtgtatgagtgtgtgtgtgtgtgtgtgtgtgcatgcaggtgtgctgggtggagggtggggggcacttgttgtgatttcatattgtgccaataaaagcagattttacgctggactccctcaactggccttgtaaatccaaccacatttattctgttgaataaaaggttccattggcaaaagacccaaggccttttgtccttagagtaggcatggattttctagtgataccccactattgctaatcccatgcagagcaggaaaaaggtggcagaactggcagttaagtgcacacatgcatttacttctagacatttaatcacaaagaaaacttccttaaaagaagctgaagttccgaaatggttacatgaattgagattgtaataggagggatctaggtgctgtcaattgaatggagtgaggcccaaacagcaactaatctctttaatagggagatccagaaatacacagagacctttctttatattcctaaactgatgagaaaggtaatctggcctagtgattccacagattgacttcaggacactctaggttgctcccacgagtgtgggaatcaactcagagaaatttgcaaaaactccaaaacaaatcattttggtttttaaaaacatgagtgttttaaaactgttttttaaaaaatgagtgactaagagatgtccc

SEQ ID NO: 475156 - DNA, 650 bp, Homo sapiens
gtgacaaactttcaccttatttttcaaagcaatgacgaaaatgtctaccagtaggatatgtgagcatctagcacatagtaagtgtccaataaatgtgaggaggaggatgataatgatgatcatgatggtggtgatagtggtggtggtggtgatggttatgatcatggtggtggtggtgatagtgatgacaaatgatggtggtggtaatgatggtgataatagcaatgatggtaatgatggtggtaatgatggtgataatgatgatgaaggtggtgatggtgagagtgatgataatggtaatgatgatggtgatggtaattatggtgatggtgatgatggtaatgatgatggtgatgatggcaatgatgatgatgagggtgatgatggtgatggtagttacggtgatggtgatgatggtgatgatggtgatgatggtggtgatggtggtgatggtggtgatggtggtgatgatggtgatgatggtgatgatggtgatgagggtgatgataatggtaattatggtaatggtaatgcaatgatggcaatgatggtgatgatggtgctggtgatgatggtggtgatgatggtgatggagatcacgacggtggtgatttaggaccagaatctccttcagtgggaaatctgtctac

SEQ ID NO: 475157 - DNA, 983 bp, Homo sapiens
tgctgttctgcagcctctgctggtgatactcaagcaaacaggatctggaatagacatccagcaaactccagcagacctgtagcagagaagcctgactgttagaaggaaaattaacaaacagaaaggaatagcatgaacatcaacaaaacggacaaccacacaaaaactccatctgaaggtcaccaaaatccaagaccaaaggtagataaatccatgaaaataaggaaaagacagtgcaaaaaggctgaaaattccaaaaaacagaaagccacttctcctccaaaggatcacaactcctcaccaggaagggaacaaaactggacagagaatgagtttgaaaaattgacagaagtagacttcagaaggtgggtaataacaaactcccccgagctgaaggagcatcttctaacccaatgcaaggaagctaagaaccttgaaaaaagcatcaaaagccaaatcaatcaagcagaagaaagaatatcagagattgaagatcaacttaatgaaagaaagcatgaagacatgattagagaaaaaagaatgaaaaggaatgaacaaagcctccaagaaataggggactatgtgaatagaccaaacctgcgtttgattggtgtatctgaaagtgatgagcagaatggaaccaagttagaaaacacgtttcaggatattatccaggagaacttgtccaacctagcaagacaggccaacattcaaattcaggaaatacagagaacctcacaaagatattcctcgagaagaacaaccccaagacacacaatcatcagattcaccaaggctgaaatgaaagaaacaatgttaagggcagccagacagtaaggtcgggtcacctataaagggaagcccatcagacaaacagcagatctctctgcagaaaccctacaagccagaagagagtggggtccaatatgcaatactcttaaagaaaagaattttcaacccagaatttcacatccagccaaact

SEQ ID NO: 475158 - DNA, 2428 bp, Homo sapiens
tgtggcgcgccgcgcggagaacagagctttagcccgcagaacgcccatatgtatgccacccgcctcatccaaatgagatcctacctggagaaccgggcccagcagcactggggcagtggagcggtagtgaagaagctgcgcgagctgcagcccggggagaagcgctgtgtggtgggcactttgttcaagtccatgccgctgcagccctccatcctgcaggagatcagtgaggagcacaacctgctcccgcagcctgctcggagcaaatacatccacccagatgacgtgctggtcttggaagatgaactgcagcgtatcaaactaaaaggcaccattgacgtgtcaaagttggttacagggatcatcctggccgtgtttggctccgtgagggacgacgggaagttcctgctgctggtgtctggcctgggcctggggggaggtggaggcgagagcctgctgggcacccagctgctggtgggcgtggtgacggggcagcttagggacgaaggggagcagttcagcgcggcccatgtctcccgagttgtccttgaaggcaacctcctcagccacagcacccagagcagagattctatcaataaggccaagtacctcaccaagaaaacccaggcagccagcgtggaggccgtgaagatgctggatgagatcctcctgcagctgagctcctcagtgcccgtggacctagtcatcaaaccttaccaggccaccattgatggagtcagattcctggggacatcaggacagaacatgagtgacattttccgatacagcagcatggaggatcacttggagatcctggagtggacactgcggcatccccagctttggctgttggtgaccatccctgacttaagtgccatgcagaccgcctgcctcgtgaacctgcccagcctggcctgccagcccatcagcttctcgggcttcggggcagaggacgatgatctgggaggcctgggcctgggcctctgactcaaaaaggtggttttgaccagagaggcccagatggaggctgttcattccctgcagtgtcggcattgtaaataaagcctgagcacttgctgatgcggaaaaaaaaaaaagaatatcccatagttttagcttttaccttacttgatctctctggagtctaatattgttgctaaatccttcactgaaacactgtcctctcatggtttctaacatgaaaccctcttttttctcttcctctctctctatggctattgctctctagcatccttttaagctcagcatctcctaccctccttttaagttctgaagcttctccaaattctatccttgtctctcttttcttctcatcctacatacacttatcaagcagtgttatcatctaccaccagctctcttctacctctccaacttaaattgatcatagcactattctgatcttcagactcttaactctaatttctcagattatattcatctgaaaatgccaaaggatactgaatcatcatcttcctttcaaaactgtatttggtctacatgttctgtctcccatccattgcaaaacctgaaacctggtgtttatttatatttattctataagtatttttctcctttaaccttatatcaaatcagtgaataaaatattttattctctccatcttcactgcttctgccagtcatgtgggtaagtaattgaatcaatgccattcactcagtttaagattccccactcccacttgcacatgtagaaaacaccttctcatcctcagcgctccactgaaagtttactctgtgaagaaatttctctggttcccacaggccaaattcaggattccttccctgtgatctttatatacatctcagttgtagaagttaccacattttattgaaatgattgtgtatttgactcttcgagtaacctaattaatacagctgggcaaaaaagaagataactttagagcatctaagaaaagaaaaaaaattctctaaactaccttctactagtttactagttcctagtggagaaaaattaaattaatctcaaatattcagaatacacgcacacacgcacacacacacacacacattcttgtgtcttgtgtagggtctattttattcaattaaggttttcaactctctttataattgtgcaattttatagccctttcaaatattgtttcagctagctatctgagctaggtggacacaaattatgatggaaatcaaggttctgatgcccaaggtggcaagaaaaagaaaagataaccctaaagaattgactgctcggttcttaatcctggctacatatgttacaagttacacaagcacagctgcttctctatatttgtttccaatgagcggctgtaaagggaaataaaactacaacaacctacctctccaactcctattcgacttcctcctcccatgggagggggtagaaaaa

SEQ ID NO: 475159 - DNA, 502 bp, Homo sapiens
tctggaggcatcacactacctgatttcaaactatactctaagtctataatgatcaatggtttgaatgatgcctactcacattatggttttggccccattgtaactgctgcagctctgatgagtggaggaacaccagggttcttggtcctcgcgctgggcaccaaaaactttattgccagtggtagttctggcaaggcctgtgtccaaatagcaggtaaaggcacctggctggccatcaatgctttccacattgtattcattgccagtcacctccacttggccttcatagatcttgtccacgccaaatctattgagaagcctgtgggccagcagcacgcctgtccaatacactgcagcataatttgtcaggccaacttcacaccatattttggcagtttgtgtgcatatgatgcgcagactatcatatcccccatgtccaagcacagaaatcagttttaccctctcatcatcttctaaatttcacttagtatctttcaaagta

SEQ ID NO: 475160 - DNA, 452 bp, Homo sapiens
accagccattacacttaagtgccatctactaataaaatggctgaaatgacaggcatagaattaagaatttggatgtcaacaaagatcattgagattcaagagaaagttaaaacccaatccaaggaacctaaggaattcagtaaaaagtatcaagagatgaaagacaaaatagccattttaagaaagaacaaaactgatttgatcgagctgaaaaactcactacaagaatttcataatacaattataagcattaacagcagaatagatcaagttgaggaaagaatttccgagcttgaagagcagttctttgaatcaactgaattcttcaaggttaaaacaaaagaaaaattattaaaggcagctagagagaagggacaggtcacctacaaagggaaccccatcaggctaacattggacctttcagcagaaagcctacaatccagatgagatta

SEQ ID NO: 475161 - DNA, 1451 bp, Homo sapiens
ccagtcaaataagatgagctggaggctactccagtgccacccttgctgtggtctgaacctcctgctgtctcttgtaaccactggctgggcccctctcagctccttcttggcttcctccaaggtggagcgcattgagagtggccctcaaggggtggcccacctcccctcagaggtcgagggaggcttccccggctggaaactgcagcccacaatggtgtcccggtgtctccacagggacttcccctcactcattgagtcactcatcccttcactctgtaggacctgttgtatgctgggtgtggtcaacgaggatgaagtgaaggcagcggtgggtccgtgggacctgcacagcccgagagggccatcggggacagaggccgagagtgggggcagcttggttgagaagcagcagcaggcggatgtgacgtggggactcagggccgggtggccgaggcccgaggctggccattcacatgtggccgtgggccgtgtggagcttctggtggtcaatgaggtggaccatccaggggaaggccttcccgcagacgctacactggaagggtcttttggggctgcgaggggccactgggccctgggctccatccctgggtgggacggactcccgggggcccttgctccggggggctttcttcctcggtggctccagcaggtggatcttgccatgctcagtgaggacggagttgtgcaggaagaccttgccacactcggggcacggaaagggcccttcctcgcgatgggtcttctggtgctcgatgaagtgggtgacccaggtgaagaccatcccacagtcggcacactggaagggccgcccacctcggggcccacgcggcactaccgagatgcctgcaacagcctcttgggtaccacctttggtgtgcttgagggatggctggtggcggccgctctggctgcactgtccttgcccacaagcccagaggaagtgggcgacttcacagacttcacatcccacctgcgacctatgacctctgatgcacctaaccgtgtcccgcccaaagcggggatcaccacttcctgggaggagactgagctgtggttgaagagcaagaattcgaaacagaggggcttggcttggtgtccaggctccagccctgcttgttgtgtggccctggatgaggagctttagctctctgggtttccagtgaggatgtgggtgctacgtgcccagagcctggtaccatcaagggctcggcaaactgcaacggagtcgtgtcaaaggaaaacacagtgacacttatcaatgcaaatcaggttgttggaggaggctcttccctacttcacccaccttggcgtctgtgactaatcaagggcagcagaggggctgcgtggagagaagagtgggtggcatgtatgtgtggagagaggggcatgcttagttcccctgactctcagggggcatcagaggagctatc

SEQ ID NO: 475162 - DNA, 528 bp, Homo sapiens
cgcttttgtggatgggttggtggagctcagcacacaacattgaaggaactcatctcacagacgatgatctgctgggcccaggaggaccagatccaggattcagagctggtccgaatgatgttcaacctcctccggaggcagtatgacagcattggggagctgctgcaggcgctgcggaagacctacaccatcagccacacctctgtaagcgacaccatcaacctgctggctgccctgggccaaatccgctccctcctcagtgtcaggatgggcaaggaagaggagttgctcatgatcaatgggctgggccttcgtagtagacatagcagaagtaaaaactggcaattggaggtggtgtttcctgcaaccctcaagagaaggggaatgggcagccagaaagtaaccacccagcaagggagtacacagcaaattaccaggctgtttctgtattttgatttgcatgcagctttactctgtgaatttatattggatgacttaaagatgtaattgttcttacatcttaatgtc

SEQ ID NO: 475163 - DNA, 669 bp, Homo sapiens
gtgtcgcatagtgaacgtggggtggctcaaagaagacaggaatagcatgatcgtggatacctacaaggaaaaggatatcctttccattgcttcttatctgaaaatagggggttggtggctggcaagagaaatcttagggagaatcacaggtgtttggtggctggcaagagaaatctcagaatcaggccagacaaggataaagaaattaacacggagttactgtaggagtaaagcaaatttgtgggtgtatgaaatggatattaagaatttatacagctcgccaaattatgtaaatagattgtttgcagacaaatctgatcaaggcagaaccaatttattcatcttggtcaccttcacagtcaagatcaagagctttttgagtcattttatgagaccatctacctggatcgtgaaggtaaaggaatcgactggctcttcttctacccggattgctaaattctaacacttgcttttgtgggttaggagatacaatcatgctagagtgataagaaggtagaatataaggtacatttgagatatggctagttgcagctggattcttaacatctatgttacacctttgtactaactgtaaggtatcttagtccatttatactgcagcaacaaaatacctgagactggataatttataaagacagaaatttattt

SEQ ID NO: 475164 - DNA, 568 bp, Homo sapiens
cttcttcgcacctttgcagaaaatgagttcactgtacatgtgtgggtttgtttttgggatctctattcgtatcttgccagatagaaggcagttacatgctatagagagggtacaggaggcttccatgctgaggaacaagcaagatgagttggtgaaatccagtcaatggagaaaaaaaggaggatgtccacagaagtcttcactgagtgagttaaactggaacgagaattacaacagtcatcatctaaagaaagcaagagaaaaaagcctaatcaagagcaaggccctatttctcttcaattctctgaaagctgagagggatgaggaagctgtagaagaaacgtttggagttagcagtgattggttcatgaagtttaaaaagagaagccatctccataacataaaagttcaaggtgaagcaaagtttctttgtcttgattatcaaccttgtcctggatctgattgagttcagtgcaacccatgctttgaattctttgtaacttctgagttcccatttttgttatagactgttctaagtgaactagtgtggccctttgatggtatcact

SEQ ID NO: 475165 - DNA, 492 bp, Homo sapiens
gcacaacagcagtagagctgcagcggataaactgtcctttgatgaaagcatcccagtgcctccttaattacatccctgagaattcgcatatcttacgaatggccacattgaatggccacattggtcatggccatgtggaaaaggagttagaagaatcagacaccagcagactaaatcactcagggactgtggttctcagggctctaacccaagttgcagaggaagaacagtttgagttcctgaaagatcaagaaacgttgaaactgaatttatgggatatggcactcaaccctcagtttggtccaggaagaagatggtgcccagacactgaccctggaattctagatgtctgccagggctgtggatgtgggagccctactgctgggtttatcctctccttagggaaaactcgtcacccctgggggtagcattcagagagaaacacgttaaaggtcatgcaggacttccggagtctttactgtgaccatttct

SEQ ID NO: 475166 - DNA, 725 bp, Homo sapiens
aacaggatctggagtggacccccagcgaactccagcagacctacagcagaggggcctgattgttagaaggaaaactaacaaacagaaaggaatagcatcaacatcaacaaaaacccacagaaaccccatctgaaggttaccaataccaaagaccaaaggtagataaatcctcaaagatgaggaaaaaccattgcaaaaagcctgaaaattcccaaaaccagaatgcctcttctcctttgaaggatcacaactcctcaccagcaagggaacaaaactggatagagaatgagtttgatgaattggcagaagtagccttcagacggtgggtaataacaaactcctccaagctaaaggagcatgttctagcccaattcaaggaagctaagaaccttgaaaaaaggttagaggaattgctaactagaataacccttttagacaagaacaaaaataacctgatggagctgaaaaacacagcacaagaacttcatgaagcatacgaaagtatcaataacggaattgatcaagcagaagaaaggatatcagagattgaaaatcaacttaatgaaataaagaaatacagagaacacaacaaagattcacctcgagaaggtcaaccacaagacacataatcgtcagattcaccaaggttgaaatgaaagaaaaaaatgttaagagcagccaagagagcaaggtcgggttacccacaaagggaagcccatcagact

SEQ ID NO: 475167 - DNA, 940 bp, Homo sapiens
cgggaacgcgggaggcaggcagacaggtaaagaagggaggtgaggctgctggggtggtggtgggatgacttgagatggaggagtctccgcaaaggccggggagagctcggcaagttcaggcaactgcaggtgattttgactggctgtcaacatcttggacaaatctgagtgtgaaatgccgggaaagcggtaagacggaagggtttctgaagccattccagaaacaggtttatatgaatggggacaatgtcgctacaattacgcctttcccttcacctggtgaggataaggaccaacctttcactggagaagagtcagcagggctgggtgtgctgaccaatcgcctaagggaaaagaaaggagggtggaagctgacttggcccaatctggagcttttctatgtgaaaggagcagaaatccatcaagctagttccgaatccaaattctacatcgtgttctgcattgagctggacctgcagggagagtttgctgctttacccaagcaggccaggcatggtctgctgctgccagaccacaaggtagaatgtccaggcaaaggcaagaccgttgctcgttctgacaatcctcagaatgtgtgtggagtgctccatggatttctgggtggatgttcccagaagtccatgcctctatgggctcaggcacttcccatggcagctcctccaccttcctttcctggtatccagcagcccggactggaggggctgtcactgacacatggggctgtctttgttcaacaacgcttggaagcacaagtgagctctgtattaccgccctttcggcaagggcggctggagtgcctggaagcgactagttccagccctgctgggccacagggaccgaccccaagcaccagccatcagctttgttcctcgagcttctggagaaaacctttgatttcacggggatgattatttttatt

SEQ ID NO: 475168 - DNA, 841 bp, Homo sapiens
tccgaggaaccttcctgccaactctgagctcctgcgacactcgaggatgtgggccaggctcttgtgggtggcaaagtcctaagacctgtcgcaatggctttaatctttagaacagcaatgcaatctgttggacttttactatctctcctgggatggattttatccattattacaacttatttgccacactggaagaacctcaacctggacttaaatgaaatggaaaactggaccatgggactctggcaaacctgtgtcatccaagaggaagtggggatgcaatgcaaggactttgactccttcctggctttgcctgctgaactcagggtctccaggatcttaatgtttctgtcaaatgggctgggatttctgggcctgctggtctctgggtttggcctggactgtttgagaattggagagagtcagagagatctcaagaggcgactgctcattctgggaggaattctgtcctgggcctcgggaatcacagccctggttcccgtctcttgggttgcccacaagacggttcaggagttctgggatgagaacgtcccagactttgtccccaggtgggagtttggggaggccctgtttctgggctggtttgctggactttctcttctgctaggagggtgtctgctcaactgcgcagcctgctccagccacgctcccctagctttgggccactatgcagtggcgcaaatgcaaactcagtgtccctacctggaagatgggacagcagatcctcaagtgtaagactccgacaaggccagagatgtatcctgtatcaactgtgatgacaaagacctctttgttttgtagctaaacctgtgatgctcac

SEQ ID NO: 475169 - DNA, 531 bp, Homo sapiens
ggaggcaacagcatggcagaggcaatggcaaaattgggatctgagagaaaaaaagagcagggattaattcaggaactgaaacaaaatcagtctctggaactctggtatgagaacaggaaaggcaaaatcaagactggagaatcaggtgatggagagcctgatctactgagaattttaatgtgggagtacatctccaatcttttgagtcatgctgccactgactacctatgtgaacttggacagtttgcaaacttacatatgcctctgatttctatttgtaaaatgaggataaaacaatactacttccctcataatgttcctgtggctattcctggccgaagcatagtaaaacattatatatatgttagttgtgatgatggcgatgatgatgaagatggattgagaagcatggagagctatgaaatgatgttctagaaggctgaagaaatatcgaagtggttaaagttcaccttgtaccagaccaggaatgattggcacatgaagggaaaatgtcaataatccagacttaac

SEQ ID NO: 475170 - DNA, 2830 bp, Homo sapiens
tcctccaccagcaaaaagattatgactccctgaaggctcagacaattgttagcattctttaggaaaaatatatttttaattaagggctcacatgcactacacgtatttccctggctaaaaagggtcttgggggacagaagagtgtggaggctgaaattcaggccatgctttttgacaagcccaatgccctattagaagaaaagtacattgatcaagaagaactcaacaaaacaaagcccatctggaccagaaatccagatgatattactaatgaggagtacagagaattctacaagagcttgactaatgactgggaagatcacttgtcagtgaagcatttttcagttgaaggacaaaagaaaaagaacaatatcaaattgtatgtatgcagagttttcatcacggataactgtgaggagctaatccctgaatacctgaacttcattagagtgctggtagactcggaggatctccctctaaatatttcccataagatgttacaacaaagcaaaattttgaaagttatcaggaagaatttggtcaaaaaatgcttagaactctttactgaactggcagaagataaagagaactacaagaagttctatgagcagttctctgaaaacataaagcttggaatacatgaagactctcaaaatcagaagaagctttcagagctgttaaggtactacacatctgcctctggtgatgagatggtttctctcaaggactactgcaccagaataaggaaaactagaaatgaatcttaaagttgtcttttcagaagtggagactgacatcttattgacaggactgctccttattttcttaataaagtgaattgcctctatcagaaactaatgtgaagtcatttttgcattccatttcaattttattttttcttatatacaaccagtcattccaacagagtacactgaataatctattattattagaaaattgtctttacctttaatgaattttacccacatatagtttgattgaatattaccagtaaggtattttattatctgttaatgcaaatctcatatcatgtttcttcttttaaaaatgtcttagctatttttacctattatttctagcagccgattttggagtagttcagctggaatttttattgcaattgtattgtatttatatttatacttagttttagaaggaataaaatttttattatattcagtttgccttttaggaaaaaatacttctccttactaaatttcttttatgtatcttagtgatagcatatagctttcctcatacaagtcctgtacatttcttgttaaggtatttataggttgtttaaactattttctatgtttattactaagaatcttttttaatacattttctaaggggttattgctggcagataggaaagctattgatttttaaataattttcaactgagttactcacatttttgtgactgttaatttttcacacacttgcttcagattttctaggcatacaagtatattcctcaaaaatagtgcccacagagtacaaatgcctaaatacattcagttaggcataataagcctgtagattcaaactctaatcttcccttacatacatttcagcttcaaatttttctttgaaaagttaaataacatagcagatttattccaacaacgaaacaaaactcatacataaatgtgcaactgaaatttagacatatagtaaaaacagggctgatttcatataattgcttataaaagtcattgacaaataactcaagtttgcacaaaatattattttccagccttctcaggaccatttttgctcttcaaggctctcatgtaaacaaaggcctcacatctatcattggggattatatttcaacataagatttgggggacaaatatctgaattatgtcatcatgacagtcagctgtacattaaaaatataacaactagaaatttctgaatcatttatgttttttacgtctctgtccccaaaattacatggattcaaattattgcacgtgtgcaagaaatttgcttcttaaaaagagatttataaggaggggaaaaaccacaatctcttttgccaaagaaatctattcaactattatttttgaacttaagaagctctacctaacatataaccaaatgccatgaaagaccattttaaatgtttcaaaaatagaaatcaataaagtgtgtttgtttctaaaaagaaataaaatgtacagagtagtgacaaaagggaatacattgttgaagaatgatatcaaagatggctcttttaatttcaatgtgttatagtgacaaatagcctgtaacaaagcaaagacatataatttatcttgtaactttttccttgcacatttgcttggctaaacaaaggttgggtcaggaataaaaaatacatattgatttaatgtatgtcctaaaatacagatagagtctagtgaatattgtaggccagtgacagtatttttaatggcagacaatttttacttaatttctacttttctctataaatttatgtatcaatttgtttttaattctataaccatgtatctaatcctaaattcaatcagcaatattgaaagcacactatttacataggcaacagattagttgttaaagtacatacacaggatatttctgtttcagtgcttcaaaaacttgcatatcaagtaaatgtctacaaataaagatattttccaagtattttaaaattcatctttctcacatttttttggaagctttaaatatttaagaataaaatatttcacaattcaaacaaatttaaggatacatattaactttaccttcagtatgtgcaagacaatgattctgc

SEQ ID NO: 475171 - DNA, 1827 bp, Homo sapiens
tgcaactggcctgaatgtccaagaaaaatgtgggaaagtttggaacttcttagaaacttggaggactcagaagacaggaagatgtgggaaagtttggaacttccaagagacttgtcaaatggctttgaccaaaatgctgatagtgatgtagaaaatgaagttaagactgacaaggtctcagatggagaggaggaatttgttggcaactacagtaaaggttgttcttcctatacaaagagactggaggcattttgcccctgccctagagatctgtggaatgcggaacttgagggagatgatttaggatgtctggcagaagaaatttctaaccagcaaagcattcaagaggaagcagagcataaaagtttggaaaatttgcagcctgagaatacaatagaagagaaaaacccattttctggggagaaattcaagccagctgcagaaatttgcataagtaacgaggagctgaatgttcctcaccaaggcaatggggaaaatgtcttcagggcatgtcagagaccttaatggcagcccctcctatcacaggcccagaggcctaggagagaaaaatgtggattcatttatcttaaaatggtgggcaactgcagctgcggacttcaatctttcttgtgacgtcatgacttttctctgcttcttggaagtgcttccagcatcactaatggcatttggtagaggtcccatggtgttatttaaggcttatggtattgcattaaacaccatgaaaagaaagagagagaaatatgagagatcaccttttaactgcaatatgcaatttgctgaatagacaattggtcatgtatagatgattaaggtcacatgacattttaatcacatacttgtaacatttgaattcactaccatagcaacaagaagtggctatgaaattatgacagtagtatactatgtactacagttgattatatgcagttatgatttaatgctgcatttttacatttgttaattctattttaacctttgtattacttttgaaatgcattgtacttcaagaaatatttaaaatctctatgacactatttttttcagttttattcaattattatgtgtttatatttacacatatatgagcactttctcttcactatttcttgcacttttctggaatcactttcattcttctagaggaactgttatgtattttttattgccaacatgtttgaagattaattcattctaaaaaatcttttctaaaaagtgtgtttaatttgtgttcatttaaaataaattttcactggctataaaaatctagattgaagtgggtttttttcagcaatttaaatatgtcattctgtattatggtcagctcaataattactgagaaatcctttgaagatattgaaaattttttccctcattgctatttttcactcaatatttgcttggttggttaatctctggttgcttttattttttattatttcttttgaattttcaacaaatataattaaattatgatttccttaggtgtaaataacattcagttggagaaaagttatggcaggtccaaaacaaagacttgggttggatctgattttacttaggatgacagaaaaaatggaagaatgtattttaaataagataataaataatgtaaatataaaaatcatggttatatatacatgaattttattttacaataaggtatactttacaagagatttttgttaaaaaatgggaagatatcaaagaatattaaaatttggaaagaaaatagtaggtatatagagaaaatgggtagaattatttttcactttcttctgcattacttctaagaaaaagtaatttgga

SEQ ID NO: 475172 - DNA, 1227 bp, Homo sapiens
gccgttctaactggcatgaggtagtttctcattgtggttttggtttgcatttttctaatgatcagtgatgttgagctttttttcatatgttttttggccgcataaatgtcttcttttgagaagtgtctgtttaaatcctttacccaattgcgatggggttgtttgtttttttcttgcaaatttgttcaagttctttgtaaattctggatataagacctgtgacagatgggtagattgcaaacattttctcctattctgcatagaaaaagcatacctcaaaataagaagagacataagtaagaaactcacagctaatgtcatactgaagagggaaaagctaaaagcatttcccctaagaactggaacaagacaaggatgccctctctcatcagtcctatgtaacatagtattggaaatcttagccagagcaattggcaagattaaaagaagaaaatacagccacattggaaatgaggaagtcaaattatttctatttgctgataatatgaacttatacctacaaaatctggaagacttctccaaaagactcctaaatttggttaatgaattcagcaatgtttcagaatacaaaatacatgtacaaaatcagtagcatttttatagaccaataataatcaagctgagaaccaaatcaagaagtaaccactatttatcattactacacaaaataaaatacccagaaatacatttaatcaaggaggtgaaagatttctacaaggaaaactataaaacactgatgaaacaaattatagatgacacaaacaaatgaaaaaacatcccatgctcatggattgaaagaaacaatatcattaaaatgaacatactgtccaaagcaatctagacaagtaatgcaaatcctatcaaaataccaatgtcaattttcacagaattagcaaaaacaatcccaacattaatatgaagccaaaaaagtccaaataaccaaagcaatactaagaaaaaggaacaaagctggaagcgctacattatcagacttcaaatgatattacaaggcaatgtcttgctagcggtctatcaattttgttgatcctttcaaaaaaccagctgctggattcattaatttttgaagggttttttgtgtctctatttccttcagttctgctctgattttagttatttcttgccttctgctagcttttgaatgtgtttgctcttgctcttctagttcttttaattgtgatgttaggg

SEQ ID NO: 475173 - DNA, 963 bp, Homo sapiens
cttctaaaaacaactatgatacggtgttgttatgatgatcaccattattgttttgctggtacatgcgaacacatgtgtagcaggagccattggctgtatcatataccctagatgtgtagtaggagccattggctatatcatataccctagatgtgtagcaggagccattggctgtatcatataccctagatgtgtagtaggagccattggctatatcatataccctagatgtgtagtaggagccattggctatatcatataccctagatgtgtagtaggagccattggctatatcatataccctaggtgtgtagcaggagccattggctatatcatataccctagatgtgtagcaggagccattggctatatcatataccctagatgtgtagcaggagccattggctatatcatataccctagatgtgtagcaggagccattggctgtatcatataccttagatgtgtagcaggagccattggctgtatcatataccctagatgtgtagtaggagccattggctataccatatactctagatgtgtagtaggagccattggctatatcatataccctaggtgtgtagtaggagccattggctatatcatataccctagatgtgtagtaggagccattggctatatcatataccctaggtgtgtagtaggagcaattggctacatcgtataccctagatgtgtagcaggagcaattggctatatcatataccttagatgtgtagcaggagccattggcagtatcatataccctagatgtgtagtaggagccattggctatatcatataccctaggtgtgtagtaggagcaattggctatatcatataccctaggtatgtagtaggagccattggctgtatcatataccctaggtgtgtagtaggagccattggctatatcatataccctaagtgtgtagtaggctataccatgtaggtttgtgt

SEQ ID NO: 475174 - DNA, 831 bp, Homo sapiens
ttgttttgccttttcctgtatgtcgcgtattgggaagcaaacaaggttaacactcatcaggacaccctggctatggagaggagctaccctctacgggtctcctccaagctgttctattgctccataaagctcctcttcatcttgctcaccgtcaacttgtctgtgtacctcattcttcctggtcacaggacaagaacttgggaaccactgaaagtcaacaagaaggagagaagaatgaaggagagaagagctgcagcccttcagggaccccaacctaggaggtccctgagccagggttgtgacaccctctttagggggctgcagttcctggtgtctccgagattctgggcaaaactgcattccccacattccctggtgtcagctgtggaagctgcttatggtatgcctggtccagccacagtatcacagggagctagtgcctgtgccagcatggagctgcccaccccaccacagctggcatgcctggttgtgcacagtggctgcaccccatgctctctcacacaccccttgctgccacatgcatggctggcccttggcaggcacgggatccaggacagtagcatgagccaaatgcagccggccaggcctggtgctgccaatgtgataatattaagaggtgaaggctttaagacatgattaggccatgtgaactgcccccttgcaaatgtgattgagacccttataaaagaagtttaactccatatttagctctcttgctcttccatgttcaatatgtgaggatacaacatttgttcctgctgttgaacaaaataagacggctctcacctgaccacaaaatgctggcagctc

SEQ ID NO: 475175 - DNA, 1828 bp, Homo sapiens
ccctgacactcccacttcccttagctgcgggcaactcatgcatgttttatcctccatctggaccggcacggtacacaatagtgataaaagatgattttcccccttggatgttcacaggccatcatcgacacagtcctgatgaaatggccatgtatcccctagcagacttcccagtgccacccctctccaggtctggggctaatggagaaaagggccccaatgaaacacacaagttgcccgtatcggtcactgagaagcaaacatggaggtgtggaatggaatttggaaacgggacatgcgccttccagacaggaattgcatgtaggactggcaaaatcaaaaacagcaaaactgagattatgcatgtggaagccagatccgccttctttttattaattcacttctttgggtggagaggcgagtgggggaggggagcatcatgctttgcaataataaaccgccaatgaaagtgcaaagcaagctgcataaaaacgaagtgtgcatcccagcctccaaggttatataggattcaatatggctgaagcccaccacagctgcagactgcattctgggagaaagttctcaacctctgattgcaagtttattttgaccatttaccataacttcaacttcaatgctcgtcttgaagggcatgacttgtcatcctaatataattagcccctcttccagcagatcagacccacaatacgccccagcctctggaggacacagagagaatggaagtcgtggagaagaaaagagaaaagtctcagaggaccaggatataccctcaggactagcactgtgcctgccgtagaacggggcctgctcagtgttttttgggttgagctgcatcttagaatgaaatcctacaactgagatggctaaaggaattaaaaatggtatctgtaatgttaaatttcagactgctgcacaatatgtcagttttaggtactttttaaaagatgaacaagtacaagacttcaaagaagtctctcccttgtgaagggtcccttccggcttcactttagagtctctgcacttttagttcatctcatttgggtgtttcaagggaacagagaagccctggtttagatgatgcagggttttctgatgccaaagtgagaatgataaaatgtctgaaggaagaacacgatgctatgcattccaggcagaatctggacttgaaaacaatgaagcacaaatacttttagatgaactgattcacttttattttgtaaacatcctagaagaattccatttgcactgaactgtttgaatcactgcagagctcttgctccttctaatccccaaggaaagtcgatccatcgcgtcctgctacactgtatttcttcactttgccccttttctcaattctttgtgatcagcataaagtttgaaccgtgcctcttctcgccttcctgcctggccacctgtccagccctgcggtcagctgtaccgaccagcagacggtgcctctcttgccaagtggagccgatgctctgtgaccattgttcgtggggccacactgccatccccatcgttgccccttcaggacactcgtcaacagctgtaagaggcttcccatcctcgcccatataaaaggaaggcctgaaaacacttctcggagcatcagttcataggtcaccgcaaccggccgaacaatacgcgattattcaacgggctccaattcattttcctctgctcctcccccaccgttacccttgagagaaaactaatttgcagaaaaatagcccctgccagccaacttcttctcctaaatgtatgctgaccccgaactcttgtctcagtgggtccttattctcat

SEQ ID NO: 475176 - DNA, 486 bp, Homo sapiens
gacaaaagccaaccagcttctccccttgctatttccattgtgccatgggagtggaatccagacacaggagtccagtgaactccctgagaaaagatggaaatgagattcctggagaccaagacagccagagtttttgggatagagtactgaagaggagagagctgtacagagaaagaacgccagtgatctaccaaggctccctcttgaatattctgcagagtactgatcaacaaatgcatgtgaggaaactttccagcgaggaaaaaatccaggctaagacagttggtatcagatggctagtgggcattagaagtggttctagaaatcagatgctcagggtcaaatgctcaagatggaccattcaccagtatgacaggaagaaggagcccatttctggtcataagtgggatggcacaaagaagcattgcaccggagagtactggaaggagaagcaggtggaaggtggcacctatgccaattaagcag

SEQ ID NO: 475177 - DNA, 480 bp, Homo sapiens
gctgctaaggctccaggatattatccagcctcagctgccaggaggtgggaaggcacagagctcccgtatggcactggcccatgagcacccagtgatctggagggcaggtgtggcaaggatggccccagggagccagctctgcatctggcagcagtgtctctgggccaggccaggacaacaacctcgattgtccctctcaacagtagccttgctgatcccggagaaaagaaagccatggggccatttggaccaagcctctgcaggaagaatgctgccctttctctgtagcgctggatccgatagtcatggaatcaacagctcagaagctggcagccccctcggaggcctgggcaccctcccccatggtcacatggcccaagacactctgttctttgtgacagccacttggcagggtgggccgaggacctctgtagacaaagatgcttcaggtgcccctgaaccccctggaaattgatgaac

SEQ ID NO: 475178 - DNA, 668 bp, Homo sapiens
tccttgcttccccttcgctttccaccatgactggacagtgggagtcagatagcaaggatgtaagtgagaagaggaccagaagaccccagtgtggaagacaccagaggagacctgttggacagatgatttatgtgtgctcctcatttgacctcacatctctgccacttgctgtatcaagcaggggccagagaagatcctaccacccactgatgtaccccattgccacagattcagacaaaggaggggtagttgtgtcctctggaatgtggaatatgatgacagaagatctgtggaactttgaactagagagagatgacttagggtatctggtagaaaaaatttctaagcaacaaaacattcaagatgtgacccagctttttctaaaagcatacagtcatacgcattcacaaagagataatccgaaattgcaacttatgtttaaaacggaagcagaacatgaaagtttggaaaatttgcagcctaaccatgtggtagaaaagaaaaactcattttctggggagaaattcaagccagctgcagaaatttgcataagtaacaaggagccgaatgttagtagctgaaacaatggagaaaatgtctccagggcattccaaagatcttcatggaagctcccctcatcacaggcctggagacctaggagggaaaaa

SEQ ID NO: 475179 - DNA, 625 bp, Homo sapiens
gatcaatggggtgacaaatgtcgcagccagattgccctcacatcctgcagggacatggatgaagctggaaaccatcgttctcagcaaattaacacaggaacagaaaaatcaaacaccacgtgtggtaatgctcgcttgcccacaactcgcttccagatgtgcagcccagttcctagacaggacactgatgaaaactggacattaattcccttaaagttcccagcagcatctgtcacttcagcatcccagtgcactgaggacacagatgaggcattgaataagaaggctgctaataatattgcttctgatgctaacattctgtgctcctaccagcaagaagtgagtggtcagagtatctcatctttgtgttttaatttggatctcatggatggccaatgcacccacactattactcattacttccagaccagtgtgaatcttttcctgagttttgctgcaatatctgcatttgcttccaagccactctgctgcaggtctactggagttgctggaggtccactccagaccctgtttgcctgggtatcaccaatggaggctgcagaacagcaaagattgctgcctgctctttcctctggaagcttcgtcccataggggaacctgccag

SEQ ID NO: 475180 - DNA, 598 bp, Homo sapiens
ttattgtgagagcaccagggcctgaaaatcctgcgtgggaatgaactatgtcaaaaatgttctgggtcaaagttcaagtcaagtgggaagggctgcttccagcggtattaggggcagcttgggaacgtagagtgggagagattaagctgaaggaagattttgtggcttccgaggcaatcgggcagtctcagtcttcagctgctaagccgagaagatctgggaagaagtcagagaaccttgggccagagttccaggggctctgggagtggctgccagatgggacacggcttaggaggaatcctgggctgtgggcattccttggtccagtggccagatttccggcacatgtagcaagctcttgggggaggaggttctggaggaaccccttgcagctgcggttcaggcatttggaagttcttgtgtgctggagacatggctggggtatgtctcacagtggagacaaggaattgcaactcagaaatatgttgctacttggctgcctttactctattattgtacaccttgaaggtgaggttaattaagtcctgttgtggggtttgagggctggaatttaatttttggagaattatttaatgtc

SEQ ID NO: 475181 - DNA, 1864 bp, Homo sapiens
gtatgaagaaagcagccaatgggctaccctgagagtcagggacctggtatcaagaaaggagggggatctgccggcagctgcagggccaccattgaggtgtatttgctcccttccttcccccgacaccagcctgtctccctctgctgcccaggggccccaggcgacctccctcgcctcacactccccttgcaccctctatcctcccttcctgcccctccctcttccttccctctgcccctgccaccctcccagggccctgagcagtgcggggaggcatggaggggctgaggcctccccactgactcggcagccacggcgatgcagcgcccagcgtcttcacggtggaactagccacttcttcccctccctgtttcctcttccaaaaactggaaccagggtcacctccagtccttgtcagcaccaggcagccatcatggggagcgaactgctcagcactcaggaagtgtgagctgctcacgagcccctcacaccccaaggccaggtgtcctgttggagtccccccaacccatctgcctcctcccacagcctctccccttccccacctgagagcaggccacctgcagctggctgtggcccgtgggcctcctggggggctgtgtcctgtctcccaatctggggctggacgctcccccaggtggggctgggcagtgtggcccctggcgggcagcaacatggggcctgccggaccagcccagccctgcgcctagtaagcgctcagcacctatcggagaatgaggttgagttgatgtccttcaggcactgctagatcatgaaccatcagagaaagacgaagggtgtggagtgcaccttaactgcagtgtcaggaaagtggacatttttagccacaaagccagggccagctgctaaaacaaagtccccacaggctgggggcttcaacgacagaaatgcattctctcgcagacttcctggagaggggaagtctgagatccaggtgtgggcagggctggatcccgaggctgctgcttggcttgtagacatcatcttctccctgggtcctcacaggatctgtctcctctacgtgtgtctgaatttcctcttcctagagggacaccagtcctattggattaggccccaacctgattacctcattttaagccactgctgtcttgaaaatgccttgtcctggttgagcgagccccctgccctgttccctcgctctggtttggagcatcgcctcaccactgctaactgctcagggaagccggtcatcctccctggagctggagcaggggcgcggggtgggtgaagggatgctcctgctgtgtgcactggcctgaggacagagaaagagggcaaccggcaaagtgagagtgtggaggggtggagtcaggcaggcagtgcagacactcaggcgggacaacagacacgggctgactggtggatccttatttcaaacagccgcctggagcatcagtgaaacttgaaggtggctctccagtgaggagctgaggctgaaatgatcatggggaatcttttcattccattggatttgatgctgatgtaccaagttgatgctttttcttaatcaccattttcatcattttaaatgttttaccaaatttagatggaagatgctttctgaaagccttcaattctacttcttagaagaattttactcagttaacttatagttacttccggaaatgattattagttgttaattttattgatcaaattgtttgaaacaagcacctaccagagtgcttgtttgggggatacaccagaccagtcacaaggcgcatcagagaacagttatgttccatcatgtgcactttacgtgcattcttgttttactcagaagtagacaaattcactaaaatat

SEQ ID NO: 475182 - DNA, 639 bp, Homo sapiens
gagggcctactgtggaaggcactaaatcagatgttaaagggagctaagaagtaagtcatcaaaactgcccttttcctagtaatggaaaagttaatcccagatgctagaattgcctacatagaaaatcctaaaggctcagctatttttgaggaactggatttgttagagagcggtcctgtcaaggggcaaaacagaggggaggacgatgccaggtgtttgcggggaagtgtgtcgatcggccgcttccagaatgtcaaaggcattctggaagtttctggcaatacctcgagacaatccacataccgaggctcgtgctcttgtgagctcacagctgggtatcaagcccagaagatccacttgcagaaacagaatgggctcccatgggccttgcatggatggactggtgggatatcattaacctctccctacacctgagacaaaaagtgaaagtcacaatacaaatgtggtttacatgaacgtgtatgccagaatttattatgcatgtgtaaaaatgtgatagtttatatatacatccataactgatttgaacatacaatgaaaacaagatcctacctacggaatcagctaatattatgctcctgtatcaggcagcccttaagctgtcccaaaaggatttcc

SEQ ID NO: 475183 - DNA, 546 bp, Homo sapiens
actgagacttgtggcagcacctggtgacagcgtgctcctcgggggtggtgagcggcatgaggagtccaggctgattgctggggcttcactctgagacatgtacatggcaacactcccaaatcatgttcagccacgtctcccatcacagcatctggtccttgtgtccgcccccagcacctcaggctcaacggtccccaagggactcgccatccacctgaacatgtgtgcgctcattttgccttcctctgtgaaggtcaccacaacccactctccacccatgctggagtcctcgtcgctcccatacacacagccgacacccactcagtctcggcctttgatcctggaccaggacccaaggctgggcaccgccttctccaccacctccctgctccatttgccagggtttgacacaagtgattccattttgagtcttacaacttttacatttccccgttttgatgaagatctttctctgaaagtattgcagatcaactattctgtggttaggttttgattgtcctgctgtgccaggacagacctgtcctt

SEQ ID NO: 475184 - DNA, 1083 bp, Homo sapiens
ctctgctcctacgtctggagacttcacctcacaactgagcctcagcactgggccatctgagactcagtgcaggggtgactgagccctggggctgggatgactgagtcccaaacctgccccttcccttccctttccactccagctccctgcagtgcagacttcactgtatgcagcagccacgagcccttctcttccccactccaggccacctggggcacatggtccttccagcccagctcagccatttggtccctgaggaagctgagcactttttggtttgggcccaggctgaggaccatctcttcactctacaaacctccaggtggctgctacgtgcaggccccggtgcctcagtccttggagtgtgagaacaaactaatatgccagcctggccagacctctgctccaaagtgcatgagaaggaaacgagagacgagtgagagcttctactttcctgcctctcacaatatttctgtctgtggaagggggcagcgccaatgaatattgattactactgagcctttccaccccagtagcatcaaaggggatgttagagaaataagaagattatatcgaaaggaagttctgttttcccaggaagaaaagattttcacttcacttactgggctttgttcgtagctgcagtagggaaggaaaacttgcagtttggaaaatgttgggggaaaattccctgcatgttcctttaagagcctcgtttttaataaaagtattctctcttttcttctgcagctattctgtaaaatgtatcatcagagaggaacctatataaccttcacatcaccattttatcagcactcagcatttttcaaagacctgatggatataaatacttcacaacaacttttttattgcattctaagcacgaacaagtttccaaagaaatctatgatgtctgtgacctccaatgtagctagaagcgatgggtggaagatgaaatggcttgttccaagtcgtaaagcaagcagcaacaaagctggactggggctccgtcccttccaggccatttaatctactgccactttcaaggtgtattcctgcccaaatctagaaaacatctcacac

SEQ ID NO: 475185 - DNA, 593 bp, Homo sapiens
tgccaccagatgcctgcccaagctattgtaggttgggagcttcagcccaaggaccgtgatgcagctgatgccccctgagaacatccctgtctatttgtgcagcaccagtcatggaggaagtttggcagccaggagatctggcgttcctgggttcctctcccaccccctggatctgaaaaggagccaagctctccccaagtgtcttaggacgagccaggatgacagcatcactcagcccaaaggtgctggagggtttgagtctcgggaagatgagtgccttctctgcatttttggcaagtcctctgggatgacacttttcttaatgtttatttacgaactgtcatttactggcgggggagcagtggagagctgtgcggttccccgggtggtgacactgatcagaggtcatgaaaaccgctgatgcccaaagaccaatgatgatacccagagaaacctgctccacattggcatcccagagggtcaactctgccctgtgcagccctggacacaggtctggagtctcatgtgcactactctccccggacatcaaggtatatgcccaagagaaatgaaaatatatgtttgcacaaaaa

SEQ ID NO: 475186 - DNA, 2882 bp, Homo sapiens
tgtggttttaagtcactaagtttgaggtcttcttttgagagcttctttggaggttctagcaggggagcgcagctactcgtatacccttgactgaagaccagtcctcctctatcgggtatggtcgtcctcttcgaccgagcacacagcttcaggagggacgcacatggagcagtgagggaggaaggggacacccgcctagccagccagatcagccgaaccaaccctggcaatcaatggggtgacagatgtcgcagccagatcgccctcacatccaggtctccttttgagaaaggtggtgtggagctggcagctgctgtgggagcttctggagtcaatgggtggctgctgcaccctgcagctccctcaccattgcaggatggagctctcttggtgacctggtttccctatggctttgagcgtttttcttgtgtggtgggcgtgtgcatcaccttcctgtcctggggcagtgctggctccaactgccacttcctgaccctgaggaagtcctggacacaggacctgatacttgcagcagctgccaggaggggaccagtagcacagcttagcatgtggaagctatgatccagtagccctttagtttggcctcaggttctgttttctgggaaacctggcctgagacctgtcttgaactgcaatattctcctttccgtttttgacggatgcgttcgatccgtccaaacccttcagtcccctgtggacaggtcctccctcttcatcgtccagcctggtccagacggtcagctttatttttaggggctccggtatccacgcctgctgccactgcctgactcaagtttcctcccatctgtcataggcgtctgcccggacctcctgcctttaccagcttactcattgttgtaatgtcttcccactagcctgatgcatttttcatccccttacaattccttaatccaagccttgcagaatgagctcagggaatgtcattgggatctggcatgacctggccttgacctgtctcttcccagttgccacccatttgcttctacacgttgcagtcatttattcaacatctcctgagcatcttctaggtgcaggccctgtgggagacacttacaacatcaaggtcagcataaaaggcagtctctcagtttcctgtgctgccataactaattagcatgatcttggtggcttaaaacaatagaaacttgttctttcacagctctggagtctagaagttggttccttccagaagttctgagtgagaatctgtcccaggcccctctctcaactcctggtggctgccggccgtcctccacagtccctggtttttggctgcgtccctccaatttctgcctctgtgttcatgtgggctttcccctgtgtctctgtgttgaatctcctcttctttttcttataaggacacaggtcatttagggtgaaccctaaatccaggatgatctcatcccaatatccttaatttaattacatctgcaaagaccctatatctaaataaggtcatatcgttagatatggggtttaggacttggaactatcttttctgggggtgccattcaactcgttacaggcagaagatgatttttcattctcatgcaacttcctggggttggcatttaggagcgttagaggttagctgtgctgccttcgttcatcctgcatgctcctccctcccagaagagtatttccttctccgtctcctcctccttccaggcacaagttaaaggctgagtttccacggaggctgactgggcggcctccttccaagctgcttctacccctcaccttgtgtaccctgagtgtgcgctggagtcatctgtctagagtttccctccctttctgggttgtgacctgctggaggaccagggatgtctgtggtacagcgtcatttgggtgatgtttactctgaagaaaatggagactccttcctggaagatgactctttttggagttctttcattacagattttttttttagcctaataacgtagtttagacattggttgaaaacagttgcatgaatgacacttattatgtgtcttaacccttgaagatttccatgaaagataaagacataatagtcactgttactaagtaatgtatcatgcttcctttttagagttaatatctttgctcttaaatactgtttactcaattttgtagaccaaaaagccttgaatgtaatgcattttaaatgtttctttatcttatttggcttaacaatgttgatgaagaaagcccccaaagggaatatagatgaaagtaaattctggttcgtgcttctcactgccccatttctatttatttaaagtaaccatcagcaggtgaaatgacccacaagttatcatgctgtgaaaacataagcagcagattaccccattttttatactgaaagcagtcttgtgagctacacctattgctacaacttttactaaagcatttattgcttatttcatggattgctaactccttggcattggttgggatggctgtgaggatttatggataagtcttcatgggtctctctctggagaaaaaaccaaatgtctctctccctcagttgaacacaggacgttgggcactgtgctcagtctgtcaccaaggcaggcaggagggaagcatggacccatgaccactctttctagaagaaattaaagaggaaatatatctggcatattatcttttcttaaatggatattttccttcagtggtaactaaatgcacataatacaacattctaaaaatataaattggtcaatatactgaaaaatgtcttcttcccttcctgtctgccagctgctgagttcatatccccagaggcaatctgttattcgcttttgtctgttacatccttctggagacattccacctcttatagctaaatc

SEQ ID NO: 475187 - DNA, 709 bp, Homo sapiens
aagaaagaagttgataaagggacagcaccagacaaagagtggcagcaccaacaaccagtgcgagggctccgttcagaaggatctggatggtcgcctggacgtgctgccgtgtcatgtcttaggtggttagtcaatccacatgatggttttaagtcaaattcccagctttgggaccaaccctatcccccacggcaatccaagaaacccgatccaggactctttccactgggagttgtcagaactgtgtcttcatccaagacaattggaaacagcagatgaaatgcacagtgtgaaggacaaggattctgctgagagaattgctccgagggttgctcaagtgatcatgggaaataatgcatcaaaccattctttagagaaaatatccaaaatatttgacaaccatgagggcactggatcttcaaatgtccaaacacctgcccccataggatggacaccagctgtttacaccaacacaggagtcctggagcatcacccggaaggaccatccgttcggagacatcctgggagaacaagaggtttcttgtctgactctaaaatttattttatcagtgtatctaggattgggctgagtttaaacagaaaacctttaaataagcactatatgcctgctagacatattaatgcaataaaagaaccctgtgtcttgctaaactaaattctcaaaagttaacattaaaaaatgattcac

SEQ ID NO: 475188 - DNA, 534 bp, Homo sapiens
tgacacttggaggtgatgtcacggggaagagccatctctgaagccaagagaggcctggccacagcatcaggagccagtatggggcagtcagctggggacatggggtctggatggagtgccatggcttgtggccttttgaagacaagactggaagctggaggtacaagagaactgaacttgggcagtgttgggcaggatgagaacagctgccaaccagacaggagatcacctgggctttctagagcacaggagagactgggaactggggctccaacagttccattcactcttacacactgcagaggctctcagagtgtggttgggaaaagcctgggtttggagaagctccaggggcccgatgagctgaatattggatgtgaggaagtgattttggaggcttgtgaaaaatgattttcaatcaaatttgccccaaaacagaaaaatgtttgaaatgcatggtgttatagaaagtttatataaaaataaagaaaacacactactcatggaaccaggcactgtcactgattaaaactc

SEQ ID NO: 475189 - DNA, 716 bp, Homo sapiens
agtgtgtgtattcgtgtatgtgcatatgtgtttgagtgtgtatgagtacgtgaatgtggctaagtgtgtatgtgagagttgttctgctatacttacctcccttcttactcacgttctccaaagcttgaaatcatgctctgcctccaggtcctcacttcttatactaaaatctggctttgtttcctccacactattggaattcttcaacttaattgaaacacataatgagtctaactctgcttgggctgcccgtgacatctgccatcctacttcaccaaactactgtctgcatcctggacacctgtgctcttctctctgcactttacacatatgctttcctgtgcctagaaagactttccctccaccctggacttggaaagctctactggcctttctagatccagcattgatatctctgcttccaagacatcctcactttccagggtggattaggctcattactcctgttcctactacaccactctcactgctctctgctccatttttggaataaattatttattattcctattcagacttttccagaagattacaagctacttgacttcagggtcttcattgttgcttcttgcatagaatcaagtcaattctgtatgctcaataaatatttgttgaatatataagtggatgtgtgtatgggtgactgtttctgagcagtcatttcattatctagttcatgtactaaaatgtttgaa

SEQ ID NO: 475190 - DNA, 620 bp, Homo sapiens
gtactcagaaagagccagtgttgaaggcataagccgcagtcatctgtctccttatgccaggaggtcatggtagtgctattggtgggctctccagcctttgtccccagtgttccagaagagggaatgtggatgctgggaggacctgcctctggagaaacccaggccaccagcaggtggaccctgaagtgggaggacaaggacggatgggaaaccaaatttcctataggtgtgctctatgtgactaagttccagcccatgggatgtcagagaagtgtgcagagacggcttctcagggcattctgtaggaaagttggcatgcacatttgtgccttcctcaacctcttgctccatccgtccgctagcagcatggacaggatggccgaggcctctctccacactgactgttctcaagcccccttgcagcccttgagctgcccacagctagccctgctagccctggtccaggttcacaatagctctagaccttcctatacacagagaccgccccatccccacaaggtacatgtgaaggccaggtcttgagaagagcagctttcagtctcctgctgctgctgcttgaaaggacctaaaagtgagtcagtctggaaacatactctcat

SEQ ID NO: 475191 - DNA, 721 bp, Homo sapiens
agcaggcctgaagagtgtgtgcatgtgtgtgtgaatatgtgcatgaacactaacttttactgtgaggaaaacagaagccactggaagtttttcagcagaggagtggtagaattatctccatattttaacaggatctctgcagctgctgtggtgggagacttggctgtcatgggtcagggctgggagcaggggctcctggaaggaggaaattcaagaactctgaattgtcagaaaatagctctgcccttccaccagacccacgaggaacatgctgaagaccacatgagtgatgtcgacagaagcatttgtccttttcctgactctttcaaatcatttggtgagaggtgtttcgtttctgttcagacgcaagcttcttcccggagtggaggcttagaggcaggctctgtggcatgcactccccgactctacatggtgcattttgactgaagtgaataccctgagaaggttttgcagaaaaatcaaggagataaatgaaaggtttccctcagtggtgaatgtgcagaggctccctaaaatgcagaattaggacttgctcttaaccacatgtaaatgtaaattactttccagaccaaatacaaaccaccctttatcatcttcagttttgaattctttgtgcctctctacacaagcattagcagagataattgaaaatttgcagcatttaaatctatgttttaaaaaatgattcaggaagcttttc

SEQ ID NO: 475192 - DNA, 488 bp, Homo sapiens
atccttgcctttgaaactctgctccccttcatctggagcatttctgtaggtatttctcctaatgctatctctcccccagtcccccaacccccaagaggccctgaagtgtgatgttccctgccctgtgtccaagtgttctcattgttcaattcccacatatgactcagagaagtttgttattaccgaccttctgaagccatcttctgtcaacttgtcaaagtcgttctccatccagctttgttccgttgctggttcctcagctgcaggtctgttggagtttgctggaggtccactccagaccctgtttgcctgggtatcaccagtggaggctgcagaacagcaaatattgctgcctgatccttcctctggaagcttcatcccagaggggcacctgcctagctcaaacaccgtgctgggggaaccactgctctcttcagagctgtcagacaggaacgttcaagtctgaagaagtttctgctgccttttgt

SEQ ID NO: 475193 - DNA, 660 bp, Homo sapiens
ccatctgttcatccccatggaatctatcaccaggagagaaatatctgatcagcttctctcagcatctgaattcaaagctgccgtgaaccaactccggctgcacctgaggcccaggcccagtgcccagcaaaagcctgcaattctgtggaccaggttcatggagactgccatgcaggatggagcccaggggactaagcccccattgtgtgccactggcaactgctggctcgtaggcatggaggaggttgcagcctgtggcaacccagggtgggctggctgctggctggagaggagatgtgtcagggtgatgacaggagaacaaataagcccagtgctccttctccacgacaaatcacgaagatgcaatcttctattgagagaaaaatgcccaacaatcattctgactccctgcagaggcatgtctctcggatcttcagcatctaaccatagctcccaggctccaagggaacagaatcaggacaggcccctttccttcttcaccctgcatgaaagatcatgagaaccttgatatggtttggttgtgtccccacccaaatctcatcttgacttatagttcccataattcttatgtgttgtgtaagaggggcttttccccctttattcggcactcattgtgtcttctgccgccgtgtaaagaag

SEQ ID NO: 475194 - DNA, 825 bp, Homo sapiens
gtgaagagcattgaccacccattgactggggctcagctgcagggagctgcccacagctatgggctgagcatgaggaacccagagggtgtcctggctttggcttggtggggtgtggctgtctctggactgttaggaaggcactggggcagaagcaaaggcacgtgctctgcactggcagggcttcttactgattctaaggaagccactgaaaacctaggggaaaaacaaccaagggccgagggacgagaaatatccatttggctgcaatggaattcagagctggagtcagagttggtctttgcccaaggaggtcctcagcttgtagtgacagggccttctgggagggcttcatcttctcccttgagtcccacaaaacccttgaaggtgttcctggggcagtccgtgttcatccgaggacacaaaagcttcctggagcacttccccgccccagcgctgctgatggaggccacggggttccatgagcatgcaagcctctcctggtcatcaaccctaatgtcccacctggaggaagagctgagccacatggagagaatgtccacagtgcacgctcctctttttcctcgctcttgtttccagtagctgaaggacaaaattttgtcccttcctgcaaggacaaaatcaaaacaacaacaaaacactattgtttctcagaaatgactttctacttagcataagcccctccaggttcattcacattattgcaaatgacagaatgttctttgttttcaaggcagaatagcataacattgtgtatatgtaccatattttctttactcattttctcatgatgcacacttaggttga

SEQ ID NO: 475195 - DNA, 1906 bp, Homo sapiens
gtttgagggtcagggacctggtgttttgaacagtggcaatgtgtgcagggactggcatatgccctgtccctagaggtggaatctagagagacagtagccattgctgagctgcagtgggctctgcccagtttgagcttccctgctgctttgtttacactgtgagcatagaaccgcctactcaagcctcagcaatggtggacgcccctccccctaccaagctcccgcatcccaggtcgatgtcagaatgctgtgctagcagagagcatggctccttgggtgctctggtccatggggatccttcaggcagaagccatggttggcagacaggccatgccctttccaggctggttctgcagagggagggaaacacagggctgcacttaccacaaaattcaggcagaagcaggaccagtttcctggaagctgtcattgagccttgtctagtgagggtttgtggagcaatcttactgcttccaggcactgtcactgtggcctctatgggagctatggcactggcaccaggcttctccagatcccaaggcccatctgtacatatcaaagttttccacttgaatctgtcccagggcatgaagaacatcataaactgtggtatttgcaacatcatggatgatattcattatctctgaaaataatccagacttttcccatatgcttttgcaaagattaagactgggttgtcttctcctataatttttgtgaatctgatgggaagttttcccattcgttcaaggtacttacaaatgagatacgatatgggaaaaatgaatcagatttgtcacaacagatttgctgtgcagtttgtggtctttgggatgcaggaatgctaaattctgttcaagagctgcaatctttatcctggaaggatcactggaactatttcccatgtaaatcaaccagatttggaagcaacatttagagcaaagaaaatgttcatgttgatttttaatttggtctttactgatcggatactgccagctattttttcccatttgttttattttttaataatttgtattatttttcatttaaatgtattaaatttcatttatattaaagttttactaaacttacattgcagttcctatgttccaggtattgttctaagttctttacaaatattaatctattctattctcataacagccttctgagttggattgtatttttatcatgcccactacacagatggaaacatgaagacttttgaagctcaagaaatgcatccatgctcatatcctgttctccctgctatgtacttacctgaaaaaatattttaaattaatttaatattagtggaacaattaatttaattttatatttcagttttcatttgcagtatgtgtgtattttaagagtatattgttaatttcaattctttacaaaatctaagacattgttttgtaataaacaaatttaagctattgcgtataacagattaagtttttttggatattctattcatcttatgccttctaattttaatttttctattgctacagttggctttttttctaagtagccaatgtctatttacttctataatatattctgctcttttttatcaacaatatatttcttttgacttttcaaaaggattttagtttatttctgattttcagttatgaataaaacagtattccctcatctggaagacagaatttcatagaatttcacttcacttttccgccacttcttccctttctgatccttgaaattattgtgaacaatatgaagcataccatttttattaacctcatttagctaaagatacatatgcatatatagtttttagagtaattgtctttgtcattttatggtttcaacagttgtataaactctcagcttatctcttttaatgctagacactactcatttaatattatac

SEQ ID NO: 475196 - DNA, 1022 bp, Homo sapiens
tggcacagcagtcattgaaatcagccatgaggggaagatttacaccagggaaattggcaaatgccaaaatccagcctctcctcactcttttgatttcagaatatgacctggtctctgcctacgaggttgaccacaggggcgattacgtgtcccatgaaatcatgcaccatcagcggcggagaagagcagtggccgtgtccgaggttgagtctcttcaccttcggctgaaaggccccaggcacgacttccacatggatctgaggacttccagcagcctagtggctcctggctttattgtgcagacgttgggaaagacaggcactaagtctgtgcagactttaccgccagaggacttctgtttctatcaaggctctttgcgatcacacagaaactcctcagtggccctttcaacctgccaaggcttggaagcccactggggacaaacaggaagtccacccctgggaaaaacaggaagtgagggaacagacagaaagtccacaggagctgacaagaagtccacaggggacagacaggaagtgagggagccaacagaaagtccacaggggttagacaggaagcccactgggatggacaggaggtccacagggaacagacagaaagtgaggaggcagataggaagtccactggggctaaacaggaagcccaatgggacagacaagaagtccacaaggaacagacaggaagtgaggcgtagacagtccgcaggggctagacaggaaagagcaggttcttccaccttccttagactgtccgcattgtgtgggctgttggtggatgtgaatagagagcaggtggcaaagcagaaatgggatttgtatagttccaggttcacatcaggaaacagagtttaaagggagaactttgagttgagaggcgatttctttgtataatcaagctgcctactaccctaagtattgagagaataactaccagggatgtttgactttttcttgctttatccccaacactttcaatagtgcctggcatatagtaaagccctc

SEQ ID NO: 475197 - DNA, 585 bp, Homo sapiens
ctcgcttcatcaaagccggcagtaggctcctctctgacccagggctgaccctgaaatgccatccaagagccaaagcctggaattggtacctaagttgcaaggtctaggaaatgctcctccaggcctgcagttcacactgtacaaatgtctggactcatccaggacagcccagccccatgcagggcttcactacgtggacattaattcaggcatgatacgaacagaagaggcagattacttcctaaggccacttccttcacacctctcatggaaactcggcagagctgcccaaggcagctcgccatcccacgtactgtacaagagatccacagagccccatgctcctggggccagtgaggtcctggtgacctcaaggacatgggagctggcacatcaacccctgcacagcagcgaccttcgcctgggactgccacaaaagcagcatttctgtggaagacgcaagaaatgtatgtaagggcgaatctttgtgtgtatttagtgatgctgacatttatgtaagctgatggaagcttgtacattttcttcaaagcatgtctgcccacggggtgaaatctatggactgtc

SEQ ID NO: 475198 - DNA, 1477 bp, Homo sapiens
agctatttccgacactttcgaaggaaggggtaccaaatttctctatgacgagttacggccctgattttgtgtgtgacttgtgcttccatttgccctccatgtgtccctccatagacatgccccagcctcccaaggaagacctcttcatcttgccagatgagtataagtcttgcttacggcataagcgctctcttctgaggtcccatagaaatgaagaactgaacgtggagaccttggtggtggtcgacaaaaagatgatgcaaaaccatggccatgaaaatatcaccacctacgtgctcacgatactcaacatggtatctgctttattcaaagatggaacaataggaggaaacatcaacattgcaattgtaggtctgattcttctagaagatgaacagccaggactggtgataagtcaccacgcagaccacaccttaagtagcttctgccagtggcagtctggattgatggggaaagatgggactcgtcatgaccacgccatcttactgactggtctggatatatgttcctggaagaatgagccctgtgacactttgggatttgcacccataagtggaatgtgtagtaaatatcgcagctgcacgattaatgaagatacaggtcttggactggccttcaccattgcccatgagtctggacacaagggagactatgtggaatattcagcaaatgtgtatgaatggagtcggggaatgagtgacgcagggcgtgagcaagcaacagttccccgcaactgctgtcttcagctcagccttctatctttcatggagggtgagctgtgcttctccagatgcctgcatgaagcctgcgtcagggctctgggcagctcagtcttacctgtggtcgccatcattatgccaaaggttaagaagaagagacttgctgatgacggaggtagcagccctggaaaatgtgattctcacagctttggcatgattcatgatggagaagggaacatgtgcaaaaagtccgagggcaacatcatgtcccctacattggcaggacgcaatggagtcttctcctggtcaccctgcagccgccagtatctacacaaatttctaagcaccgctcaagctatctgccttgctgatcagccaaagcctgtgaaggaatacaagtatcctgagaaattgccaggagaattatatgatgcaaacacacagtgcaagtggcagttcggagagaaagccaagctctgcatgctggactttaaaaaggcaagtgattattggcacatgctcaatgcaacatgattcataagactgttttatttagtgtgatcatttgcaaaattatgcctgtttcttaaaagaccaacagcctttctgatgttgcctttgagctattgcctgcatgaaacacaaggtggtcctccaggcatcctgctttctgtgtggtcaggtgctacttttccctgggtaatgtagttgtgatgctttttcacaataacctgtac

SEQ ID NO: 475199 - DNA, 675 bp, Homo sapiens
cggagtgccaggctgtgcttctggatttcagctgcagcagggcgcatgaaagttatgacaacgggaaagcttatgtggtatgattatgtatctaggaagctcaagagaataggtgttaagatggatctgataactgattattggaagtggggaaaagaaaggactagaaacagggagagcaagatgaatgatcagagattcttgggtaacttgaaaaaaatcaagcctgaatgtaaaaagcccagagaagtctttgagggcaatcattttctcattgtgacttctgaatgccagagattccagaaatctctctgggggctccctggagtacaagccaaggactggagttcccaagtgatgctgaatctgctggcctggggtcctacgatgcagagagcatctcagttactcttccacaagatttctgaaacagtgatcttaccactgaagtgggctgttcatgctcatacctaaggagaaactctctgcaaatgaaggatacagatgacatagtgacatagaaaaagctgatcactaggaaggtatgcatttgcagagctgtgcatggagggagagaccgaatgggtgcaccaagatgcttacagtgatgtctttcaaggaggggtgtctcaggaatgatttgtgttctttactttccatttatttatgacattc

SEQ ID NO: 475200 - DNA, 556 bp, Homo sapiens
aggcattagcacattcagggcatgatgaggtcctgtttctgggatttgcgtcttcacatggtgaaaaaggctgtggccagattggatgcagtggtagtgtatgcaagtctgcaggtgcaacggcctgtgatggtagatgggcaaggatggcacccctgggctggagcagacaccaaaatacagctgccccctagacaattcgacaaccagggacaagtggacacaaggaaagccacagcaagtgttaggggttgccaggagaaccctgagattcaagagagactgtctattgcgggaaccatcaagaatcagcatcagaaccagggagcccatatgaccagactatttcttttctacttgaatattcagagtagattgcttgagtactgtcttccctacacaaagctcacccagtacattttacttttaaatcacttaattgattttggtcataattttggttaaagtgtagagaatctggatgtacatcagcttgcaggaagtggtttatcattgtgttacctcaaatctgaccagtagagcccgcgtcagccat

SEQ ID NO: 475201 - DNA, 991 bp, Homo sapiens
tgccacctccccagggctccacattcaggacccacctcaatggtgtcaggcgcactggtgtctgtcctcctctaggaggactcctgcccactggggcccacttctgttaattagacaagcaggtactttccttggagcagaaccaaccgggaaccctgcactgtttcaccccgagctgcctcacacgcctgggacagggtggacgccaacataggactgcagccctcatcagttttaatgggaaaaacagacacaggatattttaatgatgaaatcaatcaccggctttatgggttttctttggaagaggtcacacccactcaggactgtgccacaaccagcaggctcacctcacagcaccctgggggtggtcctgcctgtgtgtatccctgtgtgcgcccgtgcgtgtctgtgcccgtgtgtgcgcctgtgtgtgtctgtgcctgtgttcatgtgtgtgcgcctgtgcgtgtctgtgcctgtgtgtgcacctgtgtgtgtctgtgcctgtgtgtgcacctgtgcgtgtctgtgcccgtgtgtgcgcctgtgtgtgtctgtgcctgtgtgtccacctgtgcgtgtctgtgcccgtgtgtgcgcctgtgcatgtctgtgcctgtgtgtgcacctgtgggtgtctgtgcctgtgttcatgtgtgtgcgcctgtgtgtgtctgtgcctgtgtgtccgcctgtgcgtgtctgtgcctgtgtgtccgcctgtgcgtgtctgtgcctgtgttcatgtgtgtgcgcctgtgcgtgtctgtgcccgtgtgtgcacctgtgcgtgtctgtgcccgtgtgtgcgcctgtgcatgtctgtgcctgtgttcatgtgtgtgctcatgggcctatctgtaggtgagtaaaggcaggaggaggaggagaaatgagacttccaggtgaggacacaaagactctttccctctgcttagaccaggaacccaaggcccagctgtctgcaggcccctctgacacctctgcc

SEQ ID NO: 475202 - DNA, 741 bp, Homo sapiens
gggagtgctcccgtgacctgagacatggccgttccccgcccctttcctgcagttagcacaggacactgctggcagctcacccatctcacaggaatgaactgcgaggaagaaccagtgaaggctggaaagccttttgatcgtcatgaaagattgttgccagatggagaaacagaactgttagaatataacgaagctgcactcaagataatcgccatcttgttcaacttttccctgcaactccatattagaggagagatttgtcattcaagaggacgcgtgtgtaccagggagcaatggaacataaggaacacatttatggaaaatacccaccaatcgatctgtttattgccagatttggagaaaggagaaaggatttgagagtctttgtcccactttcctcacccttgatgccccaccccacacaaaactttctcctcttaatcctctggctgagtctacatggagtctctgagatttacatcataataaaaaatacacttaaattgatatgtttttaaatattcccaccccacactggtatttttctgactacagagaaaggtaaagcttatatagttgcatttgtatgacatggatacaattggaacagtatatatttatatttgacttaactgatcaaaaataaactttctcaaaaaagaagcttcatgaacttttaatcaaatatattacattttcaatgaaaacttttagatgaactttctaagtatgtattgaaac

SEQ ID NO: 475203 - DNA, 1088 bp, Homo sapiens
agacagagagagagttttgctaggcaagctaaactctttgaagacgttaatgtaccgaatgcgatgctccacctcctctcaccacatcactcacatcaccaagcttcagagaccttcacggtcacctttcttcagacttaaagagcagggcctttctcttcctttcactggagcgggacttcgctgttgtgaacaggatcaggggtccagtggggccgacctccgccctcggggcagtgagaagggggtcaccctggagactccctatcccatgcatttgaggggtccagtctacaagacagtgctctgttgctctgatgacgctgaagtcggcacccaagctgcatgcaacgggatggagaaggacctcctgagaacgctggcatttgctgccctgcggccactgcccttggcacccaaagacactgagagccaggctggtgggagacacatagacagaacctctcccagagctaccagtgagaggtctcaagagccttatgacgcgaatacacctaagcttaacaccccgagtacaagactaaaatcccagactgtagcactaagtcgaggaaaattttatacacaaagatggcccctgaaatgttccacgggattatcaggattttaaatgtcaaatcactaaaggatgctcttctatgttctggccaagttacctgaatgaacatttggcaagcaacaaaaacgtttcaatatgttggaaaatgcttgtgtgatataaccttaaaagcaaggcatgaagatacaaatgcaatagtataccacccatgtaaaacattatgtaagcatggaactattatgtaaaaaagaaaagtgattaaactattagtgcttatttctaagtgcggcgttatgaagtatgttttttaccttataattcttttttttttccaaatgacaatgagaatgataggaagacatacagcaagttttcccccaatggtagaaacacctatttttcctttttttcccggttcttttgaacttacacgataaaatcaccccttctgacgttttatgttttaattagtgtcatttcatttatacttatacccttaagctgtttt

SEQ ID NO: 475204 - DNA, 788 bp, Homo sapiens
tttttctagattgtgtttttgtagtatttctgccttctcttttgttaagtcacaacaagcttttcttgggttaaaaagagaggaaaaaagccagttgaatagtaatatggcaaacgccgggctacaacctctctggctgtttctgtacctcacttccgtgttctgtctatacatcttccaccacgtggccgcgctggactctgagtctactcaggctcggaggctgccggatcaggttgacattaccaccaagcagttccagagctggatctgtgccctggtccagaaggggagccaggccaccatgcccacagaaagcctgccctggagactaggctggcaggatactgagggcactgagagcccttctagaccgaagccagggttccgccaggatcacggctgttccccaggtgaggagacccatgaggaggacatccgagtcctgccctctgacctcaatcctgccactgaagaccctgaaggaggattttcccttggaccagtgtggaaggcagtgctgcgtgctggccccaagctgggttccactttcgcctatgcccgctgatcttgaaaaacattctgggctttgctggcccgaggtgttcactctctaaactaacatggttgggtgagagctgctcccacgttgcttgtagcgtctgtgctgtgacttgcatgctcttccaattatggagaaagaaaactctaccagaaaccaaaccattttattctggtgtttgggtgacaatgcctgagtcagcggttggaagcgtcccctctgtgta

SEQ ID NO: 475205 - DNA, 1608 bp, Homo sapiens
tctcttccagctgattgaaaatatacaaacacaggcctttgcagaagtccatcctgtctccataggcacaagcctaatttctttattggctaaagtgggtccactgcatgaggtggttttgtgcagtgtctccccagacccccagtaaggacggcgctggaaggttggatggcgagcaggatgacagctgtggtgccttcacctcacaccctccggtccggaagcctctgcccctgtgtggagctagagcaatgaggtcctctcagagagccctgcacctgcagcctgtcacctcttcctccaccttctccagcaatgaggtcctctcggagagccctgcacctgcagcctgtcacctcttcctccaccttctccagcaatgaggtcctctcggagagccctgcacctgcagcctgtcacctcttcctccaccttctccagcaatgaggtcctctcggagagccctgcacctgcagcctgtcacctcttcctccaccttctgcagcaatgaggtcctctcggagagccctgcacctgcagcctgtcacctcttcctccaccttctccagcaatgaggtcctctcggagagccctgcacctgcagcctgtcaccacttcctccaccttctccagcaatgaggtcctctcggagagccctgcaccctgcagcctgtcacctcttcctccaccttctccaccagtgcctccacctaacctctggagcaattcttgtgggcaagtggaagacaagtggaccacgcggtggagacatctgactggcacaaatcggcgtggggacccgcggcccacggccttgtctcgggacacgtggcccacagccccatgtcaggagctggcctggtcgtcttgcttgtttggcctctgggctcgggctgggtctggctctgctcattttgctctaatcccaggctcaacacgcttccctcaaactctaatttttgtgttcctcattcctggaaattcctcaccaaagcaaatcccatttcctccttttcccgtgaacgttaggtggttgatgcaggccacatcagcgttggtacacgtcacctaactttcaaaagtgacatcaacgtaatagaacgagtgtggcagttccatgctagcctctgactctgtaggcagataaatagatccaaaaaattcttggatgtcatcaaagcaaaattcagattcttgtttagtacatgacggcacttggaataaccttcacaagccattaaccacctaaataagaaggcactatgttcctcactcatcaacatacagaatgtaactactgacttctcagtgaagttctgttttaaagtcatgagataatgcctgggtaacagagcagatgagttggaaatgctcactgcccctcagtcaaattctctttctttctcatccacaggactctgactgtgtgctgggagcccggtgcagacctcgttccagcctcctttgcagctcgatgtggctgtctggctgatcctggccagtgaaatgcaagagcaggtgtgcgtaggctcctccaaagctgcctaatgccagtgcctccaccaggcatctcctgcaagcccactgccctctccctcctgcagcctg

SEQ ID NO: 475206 - DNA, 905 bp, Homo sapiens
gagaactccactttgggagccacttggttttctgggtgccagggctgtggtgagaaggtcagccaggtgctcctctcaaccacattcaccaccaagcttgtggaccgtgtgattctccctgggggcagctgatgatggcttcctctctggagaagactggctccagacctcccagtgactggctttggtgacctcagccatccactggtgcggtcctactgggtatcctgctgagaactcagaggttggcagacttttcatatctcctcgccagctcttggggacagcacccactgaggcactggccaggccaagaacacaccacggtgtgtgcctaggagcaagcccctcttttcctagccttctgagaagtcttcttccccaaccctcagctatgcgccaaggcagcagcagcttctcgtcattcaaattaacgcaacggttgcggctcaggccccaagacagcgagatcccgggaaagctggttcggcggaagggtgaacaatcaatttccgcggtttccaaattacccagtctgagacattttgttatggcagctgagcagactaagatggaagccagccaggtccagttgagaaagggcagcctgcaccagagggtgcgagttatggggcaggtgacgagagcactgcagacaggggaagctggacagctctgggatgaccgactgtgggccaccaccagccgcggagacaaagaagtatcagcagagcccaggagctgtgccctgcagccaacagaagggccacggagaggattcctcttagtgaggagcctgatgtgagctgcaaccacagagcagatggagccactcctgggaacgccacccatgaggggcagagacacagcctggactctcccatgccccccttctgtgccaccca

SEQ ID NO: 475207 - DNA, 1636 bp, Homo sapiens
ctccctggtgctgcttgctgttctgggaaagcccctccccgccgcacacctggatgaggctgcaggaggtttccccagtggatccccagtgcctgcacacagtaaggcccaagacctgcttgttgacctgaattgaatggccagccaccaatgccaacgtcagccaatgtggcacaggcgccctagcgtgcaggagagggctctgtgagcttagaggggacaaaggtcctatccggctgccctcaaggtctcgtgagagtttgctttggatgacagcctatggatgggaagagtttttgaccgaggagctggggcaggggagtttctgatgcggaaacgccacaagcagagcaaggggaagaaccagccctttgccaggcaggcgtctgggcagatgcaggccggcgcactgtgctcctggtcctggcgcgagcatctcctttccagcctgcccggcgctagggctccatggaaccccaagctctctggcttcagaactgctccaggcaaatgcgtggcatcattcataaggaggcagcgtcttgcggtgctgagaccgagcccctggctgcttccagatgagcgctcgggcgccttcactctgcttgcgcctctaaagcacacctgccccgcccacctggatctgctgtcaatagctgtcgggcgtgcggtgtgcaatttgggacttaggaagcgttgatacatggtcgttactctttacgatcattagaaatattgacttcaagggcaacttgtgataaactcaggagcatctcatttgaaagataaataagctgccagccacctccgatgtttcagcagaggcaggaggcccacttcgtgaggtgccgaaggtgaaacagccagagaacttcacttgcccgcaacaaccttagagtcagatgcaggtgggggaaaagccatatatcatcagtctgccctcatcccccgtttctgtcttctctctcttcatgcaaatatttcttggaaatttcaacaagggttacatgccttctagcatctgcctagacactcccaaaatatagtagaaagctgtttgaatgcatggctagatgtgcaatttcagaagtgcaccattcactaagtcttctgagggactgtgaagtgtgtgagccagccttgattcttcatttacatcttttctacctgcaaaaggacaccctaaaccattactgcaagcttgcagacagcattggggaaagtgtctacagcaacctttcaccagaatgcaatttacatattttaaggcatacatttcataattatggtatatatgtgtgtatagctatatattattgttatatatatggtatatgtacatattactctctctctccatatatatatatatatatatatatatatatatatatatatatatatataccaacttaccaacaataaaaatcccgttagtttctcatcattacctatgagaactataaacccaagtttgttgttgagggacctgtgaggtaggtgcacagctctgtatgcattcctctgtatagaaaagtttaaggaacagctgactgtatatggctcaattagttaatcatgatgaaaatgtttgcaaatgattagcatgtatggtgttctttctgttagctttgaa

SEQ ID NO: 475208 - DNA, 752 bp, Homo sapiens
ctaggagcatgagaatgcctctcgctggagcggttcttcagccaccttgaatctgtggatggtacctgtgactgattggaacacgatccacctaatcaagggacactttggagcagcagatgtggagcaccctttcccgccaccgtgcatgagtgacattcccactcgtgaaggctccctctccgtcttgcagccaagggagcatgcgtggtactggccatatgagctctcccttgaaaatggtcacatagggaaaaagaagcaagtaatgttctcccctgacttgtgctacagtttatacgatgtggaggtgaagagtagtgtggattattccattacttatacaaaaggcttatgcaccctcattggagtccgagagcccccgagcagcttcactggaatggattacattattgggaagattctggagatgcaaatatactccatagagttcaaatgagtctacagtgaacagtgggagtgaccactgtgtttaaaattgtgactcataccgtatttcattaacattatttttcagctttaacttagtcaatcttgattatcctagatcagaggtccctcaagttacacaatctataactaataaaggtaattcttaaaagaaatattatttctagaatcagaagtagaatgtcagcggtcaatacagaatgccctcttttcatccagagttggctctaaattgtagctacaaaaaaaaaaagaataatacaagacctgaagtaaaactc

SEQ ID NO: 475209 - DNA, 1111 bp, Homo sapiens
cgttcgactttattgctgtttcacagctcactgggcgtaccagagagcatgcagaggggtgggtgggtgggagcgcaggcccccgtgcccagaagcactgcctggcggctggcatctgggcttcctgggaagcatgcggagagggatggacccacagcctcaactgctccagggcaaggtgcaatgcggaaagacatggcagggtacatcgccataactcacaaaggaggggagtgcactcccaaatctgcaattctttggctgctattggttgttgttgctgctgcttgcattctctggattaaaatgaaacacacgttccaaaccgtgaaaggaatcctggaactcactgctagcttccagggaaaggacatttttcagccctcggagaatctgagtgcggacaactcactggcagaagatccgcattttgaagcatcatcgtgcatgcagccaagagcaaagcaaacagcgttttgccgcctaccagccttttgattctgcaatagagcccgatggattatggccctctcagcctgcaatgccataatactttatttcaacatgatatgacatcattaaagacactttatgttgtttttgtctgtggtttggaattatgtctgcttaatcaattccattatgcattcaacttccatgacacgtcaaaggctgataaggtttttattttttttaaactttgcttgcttaaaatgatttccctccagatcaagatgcagagcacaaaatattaatcagtttaaataaatatcaagactacccaaataatatgaataattggcacgggatcgtgcctactgcccagttcccagcagctggtcacgctggcacgaggctcctctcaacagtctctgagataatgactttggcatctgctgacgagtgcttgtgactgcccacagaatttacaactcacaagtggaaaacagaggctccgacagaactgttttatgcaaggtctttgaaatttattaatgtaatgcaaacacgagccttccaacccattaaattgttgatgttatgcgagcccactctggaattgcagatcctcattagcattatttgcatgttaatctgcatctttttaatt

SEQ ID NO: 475210 - DNA, 541 bp, Homo sapiens
gaagctcggccagctcatgaagaagcaagcagagtgggctccacttcacagaggctggtgcatccagatgagcactcaccagagctgctgcgggtctacaaaaaccacagaagcctctgcacgaggcagtttagaaagaatcacaagaaatacctcaagaaatagacaggctgttcctcgactccacagctgggatgatgggcagagacagaggcaagggctggccatggtggcggtgatcgtgccagccttggaggaagcagccttgcatagagatctggagatgaagggtgtgtacgctttcccagtgaacccaccctacggcagagagacatccaaacgccattcctatatcaaactatgttctatgcttgctggcttcattgatcagaaattccttggtcaattctgcatgatggtttaaagatcaattcaagaaaatgctatagttgtagcatttaaggcacaaggcatttaagattaaaactccatgagttgagaggaaataatgttcaaaattgaatacgtatggcagcatgga

SEQ ID NO: 475211 - DNA, 551 bp, Homo sapiens
tgtgcactgtcctcattgaaaagttgatgaaatggctgtgcactggaccgttaaatgtatatcagccgcatgtgtgtccccccgtgggtgctgccacgtggccaggacagaagggctccggggctctgcgggaagggggccagtggccctgccctccctcccatcacaccctcccacagaagaaatgcacacacctgcaatttgcttttgcattttctcactgtcgtgtacaagagaagatggtccctgaagctcatgagaggggacagaagagcctctgcccatggatgctgcctgtgccctgggagtccccagcccttccagggccctgggacagagtcaggaggcaccagggatggaggacttgaggcctgcagccgcctgtccttacttgttgaagaccccattcttcaggggccagtcccgtatgcacttccttctccagagtctcccagacagccaaggaagcatacagcatgggagcaggacccaccacggcctggctgagtgtgtgcaccctgccagctccttcactcctccaggggcatctg

SEQ ID NO: 475212 - DNA, 568 bp, Homo sapiens
tccatcctctgccctcttcttggtgcctgaccgccaccgaccccagggtacccaaagcttacgttacagatgatgaaaccactgctgcggaagatgccttggctaatcaagggcacagggaccttcagtagcagcgtggcccctgacatccccacaccaattcccagaagctggctcgacaccctgggcaaccccagagatgctgccaaagtcatggattcctgcagggctgaaggagctgcaggcaggcctggtgcttcatgcaggggcagcctgagcaccaggaaggcgtggagtgccagagttggcctgtgtctgtcccaagcatggggcctggaccggagttggcctgtgtctgtcctgagcgtggacactgggccgggagccgagtctgtcccgagtgtggacgccgggccgggagccgagtctgtcctgagcgtggacgctgggctgggagctgtctcactccatctcatgtggtctcaggggtctctcaccacatgtgccctgacatattagggtgtttagggagcagcaatgcttacctcagggccactggcccctggtc

SEQ ID NO: 475213 - DNA, 852 bp, Homo sapiens
gggcctggtgcatggtctggctgtggctgccctgcatggaaggtgctccccaagtgtctgcaggacacagcactgatgtaggaacttgctgcagagagcagagggccaggctgctgtgaatccctggggactgagagatgggaatgacacgtacccaggcaggccgtgggggcatggtgtgtctgcaggtttctccccgaatctctgggacctgcaagaggacaggcacagccgtcagcggctcagcccgacccgcaagaggacaggcatggctgtcagcggctcagcccaccgtggctctctgggcagctcatcaaggcaatcctgcttggggccgacatgattttatagaggagaaactaaaatgggtggcctgcatggagatggagtccccaggcacctttacagagagcgcctggtgtcggaagccaaacaggagagtcgggacctgcccactgcttcgttcggccttgaagccctgcagatgccagaagaaaacacacactggtgtgtttcactcactcatcttggaggcctccagaaccgacctgaatcacgcacaacacggtgaatccaagctgaagcgggcagctccccgctacccccagagcacacgagactggctccgctgccgggtctggcctgacacacctgccgagccggcctcttgctgccttttttaattttggaagcccaggtggattcccacatccccacatttacattttcttctaaaaatggaccgccgtaattatatgttaaatatgattcaaatctgcagggaactgtgactcaataagcatggaaaaattaatgaaaagcttaattattataataataccattaaaatct

SEQ ID NO: 475214 - DNA, 1572 bp, Homo sapiens
ctccctgtctcccctgctccaccatgaaaggacatgctgacatatacataaagagaatgttctggaatgaataccaggccgtgcaaggcaaaagagcatgtgcaggggaactgccctttataaaactatccgacttactcaccatcacgagaacagcatgggaaaacacgctcccacgattcaattttttccatctagtctctcccatgacatgtggggattattacaattcaagtcacctgcagcctcaaatcctggataatacccagaaggtgccccagcccttccagctgatatccttacattgctcaagagcagaagctgcagggaatgcaagccctgggtgcaaacaccgccacgtcgtgtgtggctcccagtgcctcttccagtggggaaactgatccagaccaggctgggcaacgccagggcctgtttggtctctgaccaccccatctcccgctcccgtgggcgctcggggttagcaccacattccttaggcttcctgtctcctcttcaaagggtgaaatgtggccacacactgatccatgtgacttcttaattctcctctggggcatccttttcttcaacagatgttttcaaaataattaagtgatggggatcatgcattattgaaaatgctggatgcctccctaatgttcttcacatttgtatatttgtcagcacaaaattgagtgcttggaaatgttgtgcttatttatttttcaaattactgaacactcaccctagccagctgaggagaggagaggggagcggtggctccacaagctctctggttcctgcagatgttccacaatcaatagtttagggaatcgtgaagtcctgtaggatttgggagctaagaatcctttaaaagactccagctgatcacccatccataaaataatccctagaattagggctatttatttcttttaaaagtttcaggaatttcacattctctattttccgatattaaaaaactcttggtctaggaaaatgtcctttttcctagatatatctgtccggtatctagaatctttaagtccggttcacctacggcccttactgtagccttggaacttgcttggggcaaatattacatttctggaggcgccccagttattttcatgggattctagattgccatctccctttgagagcatatttttggcattggcgtttattgttagaaaatatttgaactggatgcagcaagtctgggctgatgacctgcagtttttcacttcgtgtctcagatctgcttggtagacactctctgaggtcacaagtgactgaatgtgtcttatgataagatgctttcaacaaggtaggcagattctcatgcccataagagctgttcggataaaagcatatctttctaaaagggaattttctggaaaaatacattgttccagaatcccttggctttgaaggtgaaaagcttgcctatttattttttccacaaatatttacagaatagtcacctggtagcagggtctgtaaattcagccataaatatgacaaaagacaccccagctttcatggagcctgaacagatgggaaaaggcaatc

SEQ ID NO: 475215 - DNA, 1150 bp, Homo sapiens
ctccatcttctgtctctccagtgccaggacaccaggctccatgctgagagctgcaaatacagttgccaacagggtgcaaggagcctggcccccagggcccacattcctggataaggtgggagcaatccactggccccctatgcacagatacctattgaagcctgctggcactgtggctgtggctgtggctggcactgtggctggtgctgtgactatggctgtggctggttttgtggctggcactgtggctgtggctggtgctgtggctggcattgtggctgtggctggcactgtggctatggctggcactgtgactgtggctgtggctggctctgtggctctgactggttctgtggctgtggctgtagctggcactgtggctgtggctatgactgctggcactgtggctgtggctggcactgtgactgtggctgtggctggctctgtggctctgactggctctgtggctgtggctggcactgtggctgtgactgtggctgtggctggtgctgtggctctgactggccctgtggctgtggctgtggctggctctgtggctctgactggctctgtggctgtggctgtagctggcactgtggctgtgactgtgactgtggctgtggctgctgctgtggatgtagctggcactgtggctgtagctggtgctgtgactgtggctgtggctgctgctgtggatgtagctggctctgtggctatggctggcactgtgactgtggctgtggctggcactgtggctctgactggccctgtggctgtggcttggcactgtggctgtggctatgactggtactgtgtcttggctggtgctatggctgtagctggcactgtggctgtggctgtggctctgactggccctgtggctgtggctgctgctgtggatgtagctggcactgtggctgtagctggtgctgtgactgtggctgtggctggtgctgtggctctgactggccctgtggctgtggctatgactggcaccgtggccgtggctgtggctggtgctggtgtgatcgctgtcaggggaaggcaaggactggagtaggaagaaatggagttggaaatggtattttaggaacagtggctctggagtaacttccttaaggagccatgtgaaggaagggagggaggggca

SEQ ID NO: 475216 - DNA, 587 bp, Homo sapiens
ctatacctctgcatgtactgagaaccagagccaccacagccttcacaactggcacaccaaaaccagcatgcagatgaaagtctttttgtatgaaagccactctgtaaagtttacaagaccctcagctgcaggtctgttggagtttgctggaggtccactccagacgctgtttgcctgggtatcagcagcggaggctgcagaacagcagatattggtgaacagcaaatgttgctgcctgattgttcctctggaagttttgtctcagaggagtacctggccgtgtgaggtatctccagctgcgtgctgggagaaccactgctctcttcaaagctgtcagacagggacatttaagtctgcagaggtttctgctgccttttgtttggctgtgccctgcccgcagaggtggagtctacagaggcaggcaggccaccttgagctgtggtgggcttcatccagttcaagcttcctggccgctttgtttacctactcaagcctcggcaatggcgggtgcccctcccccagccttgctgctgccttgcagtttgatctcagactgctgtgctagccatgagtgaggctctgtggcc

SEQ ID NO: 475217 - DNA, 567 bp, Homo sapiens
cagaggattgggagttagagctgcccccaaaggatatcatgggtattcggcatctggtaaagctagcatttcaaactagtggcaaagacagaacagggacagctgggaagcattggggaaaaaatgaagttggattcaaaccacagcccttacaccaggatgaatgccagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgactcggctcttaagacgtgagtctgccgatgctcccggccgaataaaaacctcttccttctttaatccggtgtctgaggagttttgtctgcgacttgagaccagttatatcggattagggccctaaactactcactccagcatgacctcggcttaactaaatacatctgcaatgactctgtttccaaataaggtcacattaggaagtatctggggttaggacttcaacatac

SEQ ID NO: 475218 - DNA, 514 bp, Homo sapiens
gtgtaggctgcagcctgccacttctttcaaagagtttgtggtttctttcagttttccttccctcctggctctgagctaatctgactggatgcctcacttccccctctgtgctgccatctcaagctttcatgcctcagagtgtttcagttgcttcccttctggattccagcatttcttccctacacgctatattcaatgtgtgattacctacgtgctgttttggttcttccttgtggaggagtctttgcagactggatttgtctgggaaacattttcaccagtcatctcatctagagattttagcaagggtctctgtgatggtctgaggtcagcgttgctacaagagtcctttggcaggccagcctggtgcctgagtcagcagatccacagggatgacccggtgctggtgtgggccttgagcctgagtctgcaggggctggataggcacaacgatggctctggcatctggatccactggaatgggcctggaacctgagcccaaaaggactggcct

SEQ ID NO: 475219 - DNA, 552 bp, Homo sapiens
ctggacacaagatgaaaatgacttgtcagggattttcgtgctcctgcttaaaatggggaagaggaggagggggagagacagaagaggagggggagagacagaggaggagggagagagatagaggaggagggagagagacagaggaggagggggactttctccaccaggggtgggagcttgccattaagatcattcggcagttaatggaaaaatttaacttggatctaccaacagttacacaggccttcttaaaaaataatggtgagttggaggctacttcctccttcttagcggctggtcagagagctgatagataccccatttggtcccaacaaggtgacatagatctgcaaaaagatgatgaggataccagagatgcattggtcaaaaaacttagtgctcagaatgtagcttggaggattgagttttaaaagaaataattggcaagcacttttacagtttcaggccttatatttaagtctttattttgagtttatttttatacatggtgtgagggattctattgaatttgtacattgtttaaggatagta

SEQ ID NO: 475220 - DNA, 1405 bp, Homo sapiens
ccccatggctgatgcaacaagttaccacaaacctggtggctaacacaagtttattctctacagttctggaggccacaagtctaaagtcagttgtacggggtaaagtcaaggtgtcagcggggctggttccctctggaggctccagaggagaagctgctcctggcctctgccagctcctaagggctgccagcattccttggcttgtggccacaacctccagtctctgcctccctggtcactggatcttgcacaggggccgcaggtggagctgccggccagtcccgcgctgtgtgcccacactcctcagctcttgggcggtcgatgggaccgcgccccatggagcacggggtggcgctcgtcagggaggctcgggccgagcaggagcccacgggagtgggggtggggtgtgctcaggcacggcgggctgcaggtcccgagccctgccccgcggggaggcagctgaggcccgacgagaattcgagcacagcaccagcaggccggcactgctgggggacccggtgcaccctccgcagctgctggcccgggtgctaagcccctcactgcccggggccggtggcgccggccggctccaagtgtggggcccacccagcccgcgcccacccagaacttctgctggcccgcaagcgccgcacgcagccccggttcctgcccgcgcctctccctccacacctccccgcaagctgagggagccgtccggcctcggccggcccagagaggggctcccacagtgcagcggcgggctgaagggctcctcaagcacagccagagtgggcaccgagaccgaggaggcgccgagagcgagcgagggctgcgagggctgccagcacgctgtcacctctcaatagcttcctgcaggctcaaactgctgggctcaagcaatcctcccacatcagcctcccaaagtgctgagattacaggtgtgagccactgttagcagaacaccagcggttcactctgggacccactgctcaccgcacagagagccaacgactgggacgagtattgccaaggaagaaagctttaatcgggcgctgcagccagagagatgggagctcactctcaactccatctctgacctactaaaactaggggtctgtatattaggaagaaatgtaacaatgttcaagaaaataggaactgggatgaaatgtaacaatgtgtaagaaaacaggaacttgagagggtaagggagcaatcctgatggatgaggggcctggagtctcattgtctggatgtcatgatctgttctagccatgacagagaaacaagagttggattcagctttgtgttttaggcagcagtaatactgtagaaaatatatggagtaaaactacagaaatgtgactttgaaagaagagaaacacatgtgataagctccatatta

SEQ ID NO: 475221 - DNA, 611 bp, Homo sapiens
ttatcaaaggaaaaaaaggcagctagaaatgttgtacaatcttcttcttactttatttttcagcctgtcttttcagtccctttacactttcagaacgtacaatgttgatcacttcagaaatcccccacagttgggcactgagagtttgttggaagctctaaccaggaggctcggctgccgtttgccaccctcgcgggaagagcattcctcctccttccctggggaaagcctctcccagaaggttttgctgaggagcagggggaggacagggctacacagccaccccttctgccaaatctctctgaggaaacaagtggtgacagctcaggtcccccaaaacagcttctttcaatccaggactttctgtagaagaggtaaatgtgttcacttaggggacaagcaaccatacagaaaacaggaagatggatgcaactgctggaacattccacagatgagaacctcaggcagggagtcaggactcaaagctccatcttcaggcttttgtcttgaagtgtgattcaagtttttaaaatattttcatcccttatggaaatactcattaattttttgggaaaacttgttttaaccgtgagcactgaggagataagttc

SEQ ID NO: 475222 - DNA, 634 bp, Homo sapiens
ctggagggtgatcatctgaatagctccaagtttctctctctctccctttatctggctctctcctcttcaacattctgtcctatgaactctaataagagggactactgtaataatggtggtagtggtagtcgtagggatagtagtaacagttacatctgcagtagtagcagtagtagtgatactgacaataacaatagcagcagtaataatagtggtagtcattatagcgaagacagtagtggcagtaggagcaatggtagtaggaatagtggggatagcagtagcaggtgtagcagtagcagtaatagtagtagtaacagcagtagtagtaatagaaatagtggcaaggatagtagtaacagtgataatagtaatagcagcagcagcaacactagtagtatttgtagcagtagcagtagtggtaccagtcccttcattgcttggaagaattcacaaaaattggacatatacatcaaactaaatttttaccatgtgaatttcatgttccattttaaattttatcccaatcatctataaataattctcttagagattcagtagcgacatatctattttaatctatatttgaaaaccctgttgaaatggttcattctactataatagcactttatat

SEQ ID NO: 475223 - DNA, 612 bp, Homo sapiens
gtgttgtgttgtgggagggacccattgggaggtaattgaatcatgggggcaggtctttcccatcctgttctcgtgatatctcaggtatgttgttatcagcagtatgaatacagactaatacagcaggtctttacagattgcgggctagagttctgttttcacatctgtgtccttaaaggagacagaagaggagaccaagagaggaggagaaggctacatgaagacgaaggcagagattggaataaggcagctatgagccaaggaacacctggagccaccagaagctggaggaggcaaggaaggattcttcctagacccttcagcaggcctggccctgctgatgccttgatttttgacttccaggctccagaactatatttgcccttttggagatctagacttcctttggtatgtggtcaacagtcccttgaaggtgtatctgtggctatttacctaaatacacacatcagatagtgtcattcatatgttggtaattaataataaatatagtagaacttgtttatagaaccagggtaataggcatgatgggcaatacatattacctgaggaactgtaacctatttagcatacttaggatttgtccagttatcc

SEQ ID NO: 475224 - DNA, 667 bp, Homo sapiens
actgttagaaggaaaactaacaaacagaaaggaatagcatcagcgtcaacaaaaagcacatctacaccaaaaccccatctgtaggtcaccatcatcaaagaccaaaggtagatgaaaccacaaagatggggagaaaccagagaagaaaagctgaaaattccaaaagccagagtgcctcttttcctccaaaggatcacagctactggccagcaaaggaacaaaactggatagagaatgagattgatgagttgacagaagtaggcttcagaaggttggtaataacaaacttctccaagctaaaggatcatgttccaacctatagcaaggaagttaaaaaccttgaaaaaaggttaaacaaatggctaactagaataaacaatgtggagaagaccttaaatgacctgctggagctgaaaaccacagcacaagaacttcggaagcccatcagactaacagcagatctctctgaagaaactctacaagccagaagagagtgggggccaatattcaacattcttaaagaaagaattttcaacccagaatttcatatccagccaaactaagcttcataagtgaagaagtaaaatactttacagacaagcaaatactgagagattttgtcagcaccagacctgccttacaagagctcctgaaggaagcactaaac

SEQ ID NO: 475225 - DNA, 607 bp, Homo sapiens
aacaattgcccagggttctgtttgcacctggagatgaaacggttcaagaaaattggtactgaggagtggggcattgctactcttgaaatggtacagcagtttcagatacttgaaaatatggaagtgtctttggaactgggaatgggtagagagacctttgcagcatccccctttcatcacaaccccaaagtcctaggaggacagaatggtttcatgagccaggcccaggcccccactgacctgtgcagccttgggacactactccctgcttcccaactactcctgctccagtcctggctaaaagaggcccaggtacagctcaggctgctacttcagagggtgaaagccataagccttggtggcttgtggcttccatatgatgcttctcaggggaaagtggaagaaggcagcatgcgttttgctttctttgtggtcctagggtccatcatccccagggtggagagtttctttccagttgaccttctgattgaccaggggaggaataaagtgtagggtgtattgattggttttgactttggagatatgaaacaaaggtgctttctgctgatggctaaaactaattacaacacaggaccacagggctttc

SEQ ID NO: 475226 - DNA, 580 bp, Homo sapiens
tgtcacctttctgattctcagaaaattggtactgaggagtggggcattgctactcttgaaatggtacagcagtttcagatacttgaaaatatggaagtgtctttggaactgggaatgggtagagagacctttgcagcatccccctttcatcacaaccccaaagtcctaggaggacagaatggtttcatgagccaggcccaggcccccactgacctgtgcagccttgggacactactccctgcttcccaactactcctgctccagtcctggctaaaagaggcccaggtacagctcaggctgctacttcagagggtgaaagccataagccttggtggcttgtggcttccatatgatgcttctcaggggaaagtggaagaaggcagcatgcgtttagctttctttgtggtcctagggtccatcatccccagggtggagagtttctttccagttgaccttctgattgaccaggggaggaataaagtgtagggtgtattgattggttttgactttggagatatgaaacaaaggtgctttctgctgatggctaaaactaattacaacacaggaccacagggctttc

SEQ ID NO: 475227 - DNA, 480 bp, Homo sapiens
tttctcaggccaatgttcttggatgaatgcacgctgctgactctctggaaccctcatttggtgacacatgctattttcatgaaatggtacgtttatacgcacacttcccagtataaggagagcagttggccgcttaatgttcacggcaaccagggagaaacaactacttacttgaatcttttctcgtcctgtccacctcctcatggtgctcagagttccactgaggagagggagccagaaggcagtgccaaggctgtggaaacagattctgtcacccctagagctggcatcaggcatacgagatcctccgaatttaaggacctaaagtccttatgtaatagcctattaggctattttataaggctatataacacatctccaccaaggaaaagggtctgggcattattagatacttcttgcaaagggtagagaagatttcttgaatattttaaccaatccttatgctatggtttgaatgtt

SEQ ID NO: 475228 - DNA, 675 bp, Homo sapiens
caatttacattcttggcttgtcagcaagactgagaaccataaagtttctgccttccttatgaactctattgaattggcctttgagacccaggcctgtacagaagaggtgtttgtccctcctgatgacggaggaggcctgtgcccctgccttggcccccagatctttcctccaccagcaagcaaaatacaaggagccagtatcagcaccattgggtccatcctgcggtctccccacatgcagaggactcttatccacacagtgaggacctcactttcctctgttgctcctctggtcttaccatcagcactcagagctgctctgtacagttgtgcaggttgtgcattgcacaatggtgcccattgccggcagttaccactcacatcacagacattgcggatttgtgaagctgatctacttggtaaatactatcttcttgtcgttattgaagaaattctctcatggttactggaggaggagtttgctgaccctcagtccggggcagcacaattccaggtagttcacgggctatgccagtccaagaactctttgttactttctgtggtgagataagtgctgaaatggagagtgtttagaaacttttgtagcaacttgatagagtaattttatatccgttgaagctaagggcaaaatatttacctgcatatgtacatttt

SEQ ID NO: 475229 - DNA, 550 bp, Homo sapiens
gcaggtagtagccgaataaacaggaggctttagagccggtcctaaatttgatgttcgtttgtaccagtggaaatcaacgagaacttgcccgccagaaaaacatgaagaaaacccaggaaattagcaagggaaagaggaaagaggatagcttgactgcctctcagagaaagcagagggagagcagagcgaggcagctgatcttccggattgggggccttgcccggaagctggacctcacggagatgaaacggaagatgcacgaggatatgatctccatacagaactttctcatctacgtggccctgctgcgagatgttgcaacttttgccactacaaacaattctgcgatgtggattatcgtacttattcccatttattggtgctttcatttctataagaatggatttttaaagatagaattccttgggaatagttatgtcaaagccaaatataatatagagacaaatctctaaaaacattttatttgatatttcttgtatactatatagaagccaagggtattttgggggaagagctcaaagttcctttc

SEQ ID NO: 475230 - DNA, 1904 bp, Homo sapiens
gctcccctgtgggagattccccagcactggctgtgcacacccagggagcctcacggcccagacctgggcagcacgggtaggagctgagagcatcctcacggcagcaggcagaacaaacaagtgggcctggggctcacaaccctgaggcattgttgaattctgccaccaactcgaatcggatcgaagccagacccttctcaggtggaggcaacgaccgcacagccagacccatcctggaggtccctcgtgggactctgagcaggaggcagtcacttggcctagcagaacttctgacctgtgagctggtgtttgttttaaataccccaaattgtttcttcacactgtggaagcgagaaaattcagtgtgtgtgtttgtgtgtgggaaggggcggccgggagccgtgtccggttacggcgaaactggctcagcagaaacacagcagctaaaatctttgaaaggttctcatcgcagatccacaatcaaaccaccccagccggaacttctgcctgtacagctgctgtcacggagcagacttgaatctcacccatggagaccggcaggcaaacaggtgtgtctgctgagatgctcgccatgccccgaggtctgaagggcagcaagaaggatggaatccctgaggacctagacgggaacttggaagcacccagggatcaggaaggtgagctcaggagtgaggatgtcatggacctcacagaaggtgacagtgaggcctcagcctcagctcctcctgcagccaaaagacggaaaacacatacgaaaggcaagaaggagagcaagcccaccgtggatgcggaggaggctcagaggatgacaaccctgctgtctgccatgtctgaggagcagctgtcccgctacgaagtgtgtcgccggtcagcgttcccgagagcacgcgttgcgggtctgatgcgggctatcactggcagttcggtgtcggagaacgcggccattgccatggctggaatagccaagctctttgttggagaggtggtggaagaggccctggacgtgtgtgagatgtggggagagacgcccccgctgcagcccaagcatttaagggaggccgttcgcaggttaaagccaagggcctcttccccaacagcaactgcaaaagaatcatgttctaggcccacggccagagggcagggtctgtttgtgcaggaataagtaccgcgttcatcttccaatgacaggagtgtgtgcgccggagctcccgcatctcagtcccacctggatttacccacgatcttcgtgtcttaaaatgcgaagttgcccttacctggatgaagacagcagatcgcttcataggagccttggctaaatctttgggcattttaatgggatgtggaggcgtttctctatgtctttccagctggaggaatcaaggtgcctgggcctagagcatcctgtggacaggcagctgcattcagagagggaagcccttcccaggagatctgtatggtttcctgctgaagcctggtgtagctctgtcttagcttgtaggcttatgtctgggttccagtaattggagcttgcagaaatgtttccccgattgttgttcttctgtagaatttcaacgctcatatgtatttttgtgagtcaccacgaaaacagttaaactgatcaaccgttttccaaactgcagacaccaaaatgaaatcacaaagcactttctttttttcccctaagttgactcttctattcctgcctgctgtgctttatgtcagcaagtgaccctttcctgtattataatgcagtatagtatagatgcatcatgtaagaccagagagaaaccgattccaaaaccacctttcctcaagccgccgtttgtaacgaccatatgggcggtttgaaggacacagagagagcctattgacacttcactttc

SEQ ID NO: 475231 - DNA, 1404 bp, Homo sapiens
acagtggttcagaggaggcagcttgcttcgatagggaaagatccataatcaaaccaccccagccagaacaatttctgcctctacagcgctgtcatggagcagacctgaatctcacccatggagacaggcaggcaagcaggtgtgtctgctgagatgttcgccatgccccgaggtctgaaaggcagcaacaaggatgggatccctgaggacctagatgggaacttggaagaacccagggatcaggaaggtgagctcaggagtcaggatgtcatggacctcacagaaggtgacaaagaaacctcagcctcagctcctcctgcagccaaaaggctgaaaacagataccaaaggaaagaaggagaggaagcccactgtggatgcagaggaggctcagaggatgacaaccctgctgtctgccatgtctgaggagcagctggcccgctacgaagtgtgtcgccagtcagctttcccaaaagcacgcattgcagctctgatgcagtctatcactggcagttcggtgtctgagaacgtggccattgccatggctggaatagccaaggtcttggttggagaggtggtggaagaggccctggacgtgtgtgagatgtggggagaaatgcccccgctgcagcccaagcatttaagggaggctgttcgcaggttaaagcccaagggcctcttccccaacagccaactacaaaaaattcatgttctaggcccaaggccagagggaaagaactcaatgctttgagtggggtctgagtaaagctgaactgctgaaaacagaaacaagttcccatcaagatctcagaggtcagctcaggagcagcaacacagcgctgtttctcaaagagaaaaaatggattagctgggaaggttcagtgtccctacacattcaaaatcttctcactatgtaatatcatatagccacagctctcgagaaaggaatctgtagaaggtggtatctttctaggcaaaatctttgttagctttcatggctggttgtattacatgttaatgacaataaagtttttcctggagcttcatcactattcttaaagtctatctgataatgtgcctttggagactgcctagaaagatgtggtgtctggtaaggtggtgatgaaatttctaacaagtaaagtgactgtacttgactattttcaaaaattcaatattttgggataagcttaacatcctcactgcctgcctttgcccccacaaaagtacttagcatatgcccaaataaagtttaagcaatctatctccactattctcaagcacatgatatctagggtctagtctttaaaagtacaaagcaaaaagtttaaaagtataactcacaaaaagttgtacccagactgaaaaagctgaaatgataaattgatgggtttgtgttttttac

SEQ ID NO: 475232 - DNA, 634 bp, Homo sapiens
atctggctaagtactttcttctgaattcctatatcatttccagaggcatactttcctgtctgtgtgttaaacaacatggggaacaaccccaaaaacccaaacaaaagtgtcagctactcgctttggggccgacagcttgctcttcagggctctcttcaaacgtctcaccccactccccttcaatccactcctgttatgtcagaaactctgcccaggcccaaccatttccccaccttacaatcacccagacccccaaactctcccccttcctatcccccgaggtggggggatgatggtgaaaatttctaccctctaatcatatgcttggttcctctggcaaccaaaccagcccccatcctgaggcaatccaggggtcctgccaagagccacttcactcacataatcccagatttactgactcaccggtgtatccgcagtagagatagcagacgccaaagacatccactggggaaaacctgtgaaaattcataaggtcacaagtctttgtgcagattctcttgggttgcagagaggagagatttggaattctctttgaaagtacagcttagtcatagatcacaagcaccagcaagactaatattttaaattatatgtttattcttgatactgaatg

SEQ ID NO: 475233 - DNA, 692 bp, Homo sapiens
ggataattttgaaggtagctccacatctgttcgtcacagcaccatttaaaatagcaagaaatgataatcagtctaaatatcaaaccatacgagttagttcgaacaataagccagaaaaaaaaaaagaagaaacaaatgagagaactgcaattattaaaaagcgctgagaagaaatgttcggggaatgtggtggagggtgatgggagaggaatttgccgcactggatgggaaggattttcggaagagaagtgtgcacactgctggtctgaaagcgaaagatcatccatctctcataggattcacaagtcaatcattaagcaagcatttactgaggaccgatatgatgtgccaggcacagttccaggcaccgtgaacccaaagagttctccaagatacattcctcaggtaaacagaagaccttccagtcaggcaagatgtggaggtgaagacagtgatattgatgatcctgaccctgtgtaggcctaggctaatgtgtgtgtttgtgtcttcatttttaataaaaaaagcttttaaagttttaaaaaactgttcttaatagaaaaaagctgatagaataaggatataaagaaagaagacacctgtacctctgcacaatgggtttgtatttttcttgttttgtttttacactcctgcccctcccccaggttctgtgtttgtgttttaagctaagc

SEQ ID NO: 475234 - DNA, 664 bp, Homo sapiens
ctctcctcctcaaccatcacctccaccatcaacaaagaccaaagccacttttccactgtcatgacttttttaagggtatctcatcagatatgcttgagaaggcaaatgtatattttgcaatttttggaccgtactgtctcatgcgtccacgtgaagagaccaccaaacaggctttgttcatgatatctccagtgatgcagtcatctgaaggctcaccagaccagaggatgtgcttccagggtggctcgttcacacgagctggcctgtccactgggcagcttgagtgtccacccaacatgggcctggctctccccaaagtgagggatccaagagaaacagcagacagaagccactcttttgacacagaaggcacgggtcatctcttctgccataccttatttgttagaagtgagtcacttaatcaggctgcacgttcaagggaggaaaatcagactccaccttttgaagcttccttccaaaaagtttttaaatattttttgacatatttaaaaatcattacaccatcttatatgttccttccaaattcagcttcctaaacaaggcttaagttgattcagctccctgatcagaacatgtaagtgaattaaagtggaaaaaaacaagtagaaaaaactcttcttgttctagtgaatacatctgctgc

SEQ ID NO: 475235 - DNA, 608 bp, Homo sapiens
agctgaattagttccccattggctctgaggaagagttcaagccatgggtgaggccttccttgggccattttttttgggagttgagctgtatgcagaacaagattatcctgtctgccctaagcagctgtggctcaggaccaaacctggtgaagaggctgataagagggactgcctgggcaatgagctcttaacatcgctgtgtgggacaatggatttttcaagaagcccatttcaaggaagttataaatacaaccttccagaggctagaacaaaagaaaagccagagtctgtcatgaggcagcaaacagggaatgtaaagcggcctaaccaggccgtgcatcaacagggtgtgcatgggcttcagagagcaggcacccctctacttagaggcagctggaagactttgggcaaggcagttgatgcctgtgagcccccatttccttattgataaaacaaaataagaaaatacctttgtttctggtgtatttagaggaattaagaagcaaaacagcatggcatagttgttttttaatggttgcttttttccctggctaagatctccaatacaatgttgaatttttaaaacatcattttattttacctcacct

SEQ ID NO: 475236 - DNA, 1313 bp, Homo sapiens
tccagtacgaggcagtacatgcagcgaccgcaaccctttgagacgccatccgcactgcaggcgcctcgtgcacttagcagtaggatcaacagaatagtgggcgtgggtgaaaaacaagggatgggagcgcgcccaagggccaggcccaaccacgcgccggctgcaggcgcagggccccacctaccacctgcggagacccacgggcacggactaccactccagccctcctgcaggagcagggatgggggtgcccacagtcaggcgcaggagaacagggtagaccagggaggcaggatgtgcagccgggactcacaccccaattctcctcgccagagacagccagcagtggacaccgaccaagacgataaagaaaatcaaggggctaagacccaaggtgagcagccgcctcaacatcaactaccgacacagacacccagaaaactctaaaccacaagatggcaaagagacaaaagcaatccatcagctgagaatccggctcccaaggctgattgagatttttaagaacttcatttttaatttgtaataaaagtttacgacttggttttttcaaaaaagtcaacaaactgtaaggacctgttaattaaagtcttaaataattttttttaaaaaggcttctgagaacctgtgatctaggttaattgtcctaggccagagaagtcttaatgaacagtgacttcaaacctgtgactatccagaagaccctcctctgacctttctctaggccatggaggctcagaactggacatagtgcaccacatggaatctgacaattcactgggttcatcattttccttcttccggaatttgatattctattaatactgcctgtgattgcattagtttatcctttggtgtgtattcactttttgtccaagacttccaaatatttttcaaataaactgttttcagacccttcttgcctgcatcttatgcttacgtaagtacttttttttcctaccttgacacaggactttatagttatccatgctaactttcatctggtttgtttttatattgcatcagccaaagtaatttttttctttttgaaataaatcttttttattgttttttaatgaaaggaatatttgctcattacaaaaatactatgaagtgcagataaacaaaaaataacattaaaattttattatgccactcacccacagttaatcattgtgaatacttcggtgtatatctttctagaatcttaataaatatctttctaaattatccataaacaaatttccacacataaatgacccatagcagtaatttttagattcagtcttacatct

SEQ ID NO: 475237 - DNA, 773 bp, Homo sapiens
tagatattaccctgttttatactgagaggacccaaggttcagagagtgcccgaccatttgaggaaccactcctcagggtcgcaggagatcagaccctgcaggaacttcacaatgctccttgtgcaacctatggtcccatccctgcccacacacccatcctggctccacctccaaggcttcatcctcaatgtgaatcatataagggatggggatgatcagggagctgatctcgatgagctccttcaggttacaagccagccctccctacagagctgcagcctctgcccctccctttttgtccttaacactggctctgtctgttctgccagccttgtcaaggacagcccctgcaatctgaccacacagcagctggtagggcctggggctgcacttgacatcctgatccaaccatattctcagagagaaaacaggttgggagttccgcatgcttgcacacacctgcacatatcatgcacacgctcacactctcaatgtcagcctagactagagaagtggttcttagatttcttgggtcatggattatctggctgtaatctcctcagaaaaaaagatgcatatacccaaccctttgcacatcccatcaagagggcctgggataggggtgtccttcctgattcctgccctccactgtaaaacttgcccagggagtgggactctaccaagaagatgttctctgggaagatgcactgagtttgggcactccccaggagtagtgccagtggggctgggctgaggtgcaagaggaatcagaa

SEQ ID NO: 475238 - DNA, 1012 bp, Homo sapiens
ccccactacccccatgggtacagcagttgattggatgggggttcccagcggaactgcttttgcatattcaaccccctgggggggaaggggtagctgcgttggtcagtgtggcattgctgcctgggatgtagacattctggcggtagtcgggcacgtgctgcagggtgaactggggtccgtagcgggcgctcaatcccatggtgccggcaccccctcccagggtggagctcccatcagcagcttctgcagagacagaggaagatcagacctgccgaaagatctggagaaactacacaggtttgacatccagtccgtgggcatggtggctgtgagatgcaccccagaaccccaggtctcccactcttccatacacacactgacaccacttaccactggcggacgccaagatcatggcttgcagcatctctgtgtcaaactggttgttgggccaggtgccggtgtcatcgccattttgggagctggggagagagtaggatgaggactgtgaaggtgggaaatggaagagaatgttccagagctagagaaaaagtggggacctaggaggtacctagggggagatgtaggaggccccaagagaccctggagcagggagaagaaatttctaaaattcaatggcttcctaagccctcagagtaaaatccacggccatagaagaacctgcccctcctattttacaagaatccccaccccccgccctcaaacactctatcatcaaaccttttccaaggtaactgtttggcaccatctggctcagagaagtttttcaataaatatttgttgcctaaatgagtgggaagagaccagcagagacagttaagtgactgtaaggtaagaagaagggtttggcaccatgggaaaggctgtagggtaggccttgaaggcatgaaaatgtctgtgtgtgtgttgcgttgtgtgtgtgcatattttgtcatggtgggtgagcacaaccaagaactgctttacaatttttccaaggtctgtccctgctttt

SEQ ID NO: 475239 - DNA, 896 bp, Homo sapiens
cgaagctgtatcccagcacagctttgctctttgctgtgacagggtgatatcccagagagtttttacatggcctcttggcagagaattcagacttcctactcaaatcttggagatccaagtgatggaggcagaagctttgactggactctggggctaggatcatggtggtggtctagcccgggtagaggcaatgccaagaacaaagagtggctcctggtcaccatcgtgggctgcctggtcaaggacatgaagagcaagtctttggaggttatctatctcttctctctgctcatcaagaagtctgaggtcattgactcttttccggtggcatccgttaaggatgaggttttaaagattatgtcctgcaaaagtagatcctcattggccagtagaccaggttcaaagcatttgttgccattggagactataatggccacattgacctttgtgttcagtgatccatggagatttttaaatatgtcataccactctcttctagcctttaaggtttccactgaaaagtctgctgtcagatgtactggagctctcttggcggcattgggttccaatgcaaagtcccagattctctctccatgccatgtgactgttgctggcagggatgggccaggggtggcataagtggttcaagactttctttcctaccctcttcagtgtctctttcctttatattatgttaaaaccagctactccggctcccttttggtgtctatttgcatggaatatctttttccacctcttcaccttgaatttatgtgagtccttatgtattagtgaaaatcagcaatctttgtaagatcacacagtttgtgacggtgtctatatatcttatctttggagttatctgctttctaggccaaaggcctggaaaaagggaa

SEQ ID NO: 475240 - DNA, 2647 bp, Homo sapiens
aataagggagtcacaatttacccaggctgggaaaattgcctgaaaaaaacaaacaaacaaacaagtaggacacagtagcctggaggcataggaataaaaagcggtttcacgggccaggcccagggtccctgtgctgtgtgcagcctggggacttggtaccctgcatgtcggctgctccagctgtggctgaaaggggccaatgtagagcctgggccatggcatcagagggtgcaagccccaagccttggcagcttccacgtggtgttgagcctgagagtgcacagaagtcaagaaatggggatttggaatctccacctagatttcagaagatatatggaaatgcctggattcccaggcagaaagctccacacagagtccctactggggctagtggagcactgcctggtgcagctgtgagaagagggccaccatcctctagaccccagaatggtagatcttcccacagcttgcacggtgcacctggaaaatctgcagacactcaatgccagcctgagaaagcagccaggatgggggctataccttgcaaagccacagggatggagctgtccaaggctgtgggggcccacctcttacatcagtgtgacttggatgtgtgacatggaatcaaaggagatcattttggagctttaagatttgactgccccgttggattgtggacttgcatggagcctgcagcccctttattttggccaatttctcccatttgaaatggctgtatttacccaatgcctgtacccccattgtatctaggaagtaacttacgtgcttttgattttggaggctcataggtggaaggatgaatcacaccattacatattaaaacctgcatgttgtattagcctcttggacaacttttcattttgttagtactgccccaacaatgtgtgattttaaagttaggaaacccaactttgaattcatatccagaatctactacctgcatttcctgtgggaatcccagtttccttacttttaacttgtgcaaattaaaaaagataatgctagggaaacatctagtgaagtataggttttaaatggacattagttgcttttcccttcatctacctgtgcagatttgcaagcccttagacaacaattactctttgcacattgattatctccaactttataatgtctttgacacaggattcgaaaatgcaggactgctaaagactgctcaagctatacacttccctgtctagttaaaaattgtgtagtatgaggattagggacttgttattttcagttcacaaaggcatactatgtaagtacttacagaaaatgaaaaatgtttattttaatgatcatactaatggtaatcattcactgacagatgggcactgcatattttgtagtttcaaaacactgcctctttattcatttctacagccccaatcttagtaaattcacttcataaacataatcaagattattaagtaaccccactaggaaaaatatataaatttatatatccatactctctcttgtctctaaagaagacacatattccagccaaataaaacttctatacctgtgatcttgattttaactctctacattttctggaattttgttccagaagtaatccttattctgtatccagtctctcaactctgctatcacagaaactggatcatcaataagtgactaatataaataatagattaaggtagcaaggtggcaaagggcatacatgcatcttatgccagatttcttgcttttattaccaagttttaatcaatatgtacaaattatatgaagtaagaattacaaaatatgtacattcagcaaatttgaattgaatatatctattcaatttctcttgtgttcctagtaaacaaaacatgttaacaatatatcaatccaatataatgctatttataaaatatgctgtcagttatgtggtaacattcttaacaattatatttatgttatatagaagaagttgtattttagggttatctaaatacaggggcaagaaaaattaccaaactatgaaatcgacacccaagggaattaactataggactttttggacatcccgttaagtggactatccctgaaaaattacaaataacatgtgttagccacatcaacattgagtgcctttaaaatgtaaacgagtgcttggttacacaattacagattcacaaaaattatacagaataggcaatacatttatacaaatgtcaaaagcgtcatgatgaagtggaaatgctgaaaattgattgtctaaaagattagattctgtatttcaaactacttcctactgtgaccttgaaaatgtttacctttaggactctaaaactgactactatataatgtccaaagtatatattttatacatcaaatatattaatatattgtagaatatattatacataataatatatgatatacatgagttgtagagataattatatgttatatcatacagttctcatcattttgtatttctatactcttcgccttgacattacatactcagagagatgattgtctttaagattagtgacagaagattgctcccttcaaaaccaaatagccaagtaaagtggtctacttagcagtgattctaaaatttgtcatcagttagttgatgaagtacaataatttcacatttatc

SEQ ID NO: 475241 - DNA, 427 bp, Homo sapiens
gatggccacttccaagaagaataccatgtgggttttgatagggattgaactaaatttgttgattactttgggcagtatggacattttaacaatcttatttcttgcagtgcctgaacatgggatgtcttttgatttatttgtgttttctttaatttcctttatatcaatgttttatatttttcagtgtacaagtctttcacctttttggttaagcttattcctaggcatatcacatggagagagagagagagaaaagaagaagaagaagaggaagaagaagaagaggaagaagaagaagaagaagaaggcggaggaggaggagaagggtgaggaggaggaggaagaaggagaggaaggagaggaaggaggaggagccagacattttaaacgaacagatattgtgtgaactcagattttctgttcatca

SEQ ID NO: 475242 - DNA, 595 bp, Homo sapiens
atcaatccagctgcttccagatgatggggaacatggtaagaccagtgaattccatgagcatgagcccactgctgcactgctttagccataaagtgagtgccttggttagaggcaatgctgtgtggaataccgtgacagtggataatgcattccgtgagtccatggatggcagtcttggcagaaactttgcatgcaggataggcaaacccatatctaaattatctgcagaagatagtagggccttgctccaaaatcctagaggcctttgctgtgattcacctgtgctggcctgccaaaggctccaaacagcatccctatctgccattgacaccttagtcaccattggatttattgggtcatatggcccaagtggcagagcagcttgcacagcagcatgggcccattgcacagccttctcctcttttggaccatatccaaaactggcagcctttcagcaaaaagaatatgacttgctgaaggctcagatgatcattagcagtttgtagcaataaaatattttaaaattaaggttggacaatcctcagtatatacaccttactacacaaaggcttagctgaaatataaacttatttgt

SEQ ID NO: 475243 - DNA, 1427 bp, Homo sapiens
accctgaggatgtgtccgaccgaggaattgattcaggacaccactcagcgtctgttctttctgcaagtgaaagagggcattctcagtgatgatatttactgccggcctgagactgctgtgctgctggcctcccatgctgtccagtctaagtatgggaacttcagtaaggaggtgcataagtctggctacctggccggagacgagttgctcccacagagagtcctggaacagcacaaactcagcaaggaccagtgggaggagcggatccaggtgtggcatgaggaacaccgtggcatgctcagggaggatgctgtcctggagtatctgaagattgctcaagatctggagatgtatggtgtaaactacttcagcatcaagaaaaagaaaggctcagagctgtggctgggggtggatgcactgggtctcaacatctatgagcagcatgacagactaactcccaagataggctttccttggagtgaaatcaggagcatttctttcaatgataagaactttgtcatcaagcccattgacaaaagagccccggactttgtcttctatgctccctggctgcagattaacaagcggatcttggccttgtgcatggggaaccgtgaactatacatgcgccgtcgcaagcctgacaccattgaggtgcagcagatgaaggcacgggcccgggaggagaagcaccagaagcagatggagcgtgctatgctggaaaatgagaagaagaagcgtgaaatggcagaaaaggagaaagagaagattgaacgggagaaggagctgatggggaggctgaagcagatcgaggaacagactaagaaggctcagcaagaactggaagaacagacccgtagggctctggaacttgggaaggaacggaagcatgcccagagcgaggctgaaaagctggccaaggagcttcaagaagctgaagaggccaaggaactggaactggcccgacagaagaaagagagtgaggctatggagtggcagcagaaggcccagatggtacaggaagacttggagaagacccgtgctgagctgaagactgccatgagtacatctcatgtggcagagcctgctgagaatgagcaggatgagcaggatgagaatggggcagaggctagtgctgacctacgggctgatgctatggccaaggaccgcagtgaggaggaatgtaacactgaggcagagaagaatgagcgtgtgcagaagcacctgaaggcccccacttcggagctggccaataactgatttttacatcttgttttgcatttttatattcacttatccatgcttctatatttactttatatttatagtgaataagatgttggcacatttctagaattattggcttatatttttatgttttttaaatcgttatgattaagtgtgagttatttgatagttttaagttt

SEQ ID NO: 475244 - DNA, 778 bp, Homo sapiens
tgtctcacacctgggtcatgctgatgcaagatgtgggttcccatggtcttgggcagctctgcccctgtggctttacagggtacagcctctttcctggctgctttcatgggctggtgttgagtatctacagcttttccaagtgcacagggcaagctgttggtggatctaccattctggggtctgaaggacagtggtcctcttcttactgttccactaggcagtgccccagtgaggactgtgtgtgggggctccaaccctacattctcttctgcactgccctagcagaggttctccttgagggcacagccactgtagcagacttctgcctggacatgcaagcatttccatacatcttctcaaatctaggcggaggttcccaaacctcaattctgacttctttgcagccacaggcccaacacaatgtggaagccaccaaggcttgggcttgcacattctgaagcagcagcctgagctgtatgttggcctctcttagccatggctgggatgcaggggaccaagtcccgaaactgcacaaagcagcaaggccctgagcccagcccatgagaccattttttcctccttggactcctagcttgtgataggagaggcttccatgaagacctctgacatgccctggagacatttttcccattgtcttggagattaacatttggatccttgttatttatgcaaatttctgcagccagcttgagtttctcctaataggtttttcctttctatctcatgatcttgattaggaagtgttactatggaccag

SEQ ID NO: 475245 - DNA, 705 bp, Homo sapiens
aaactttcctcagcatctggatgtccctcctctctctttctctgctgtgtcattccactgtctttggtggctggatgtggagagtagcacatcagctgacacctgcacaccagcaggccaccaaccagcagaacaacgtgaagtttggccagggcagttggaggagagcttgggctgctgaaatgttgccttctccaaaaccaccctggcctgtacctcccctcatcctgtactcagaaaaactccaggccccaccagcagagtggcagagcagcgaaggagagaagacgcagctgcacgtgggggaggagcaacttgacttcagagggatgctgcccatactgctgagagcgactttcatctgcaataaattctctgcatatatcatcttcaattcattcccatccgtggatggcaaagctgaaagggcacactgtaacacatgcactctggggctctggggatcatggttatccccctactgccacggggctgcatagagtcctattctgcataagtttgtgttaattaagtctgggataattttaaagtttactgttgctattattacccttggtaaagaggttcttattaacatgtcctggtttggctatggatattcttatttgtgctgctcttaagagacaatttatcttttgcatcctccaactgtattcttctgatgtttttatttagtacttggtt

SEQ ID NO: 475246 - DNA, 793 bp, Homo sapiens
gagggtccgtggcttcattcctgaatttcctcttacgccaggatgtctgctcagaagggactgccccaacttaggtgcaggctcaagcctacaatacctaaagctctggacctggaacttgaggctctcatcagccactgcaacagtaaacctgtggaagacctgaaattcctgtttaaaagacagccacaagataacccttccatttatactatctataaggagccctccactgggaatgcggacctccctcaaacaatatatatacactccctccagaacaacgcaaattatacatgtagtaaagaactaaactttactattacaacatttacctttgagagtacactttgtacttctggcacatttacaagaaatagtttcataagccagatgcaattaacagaaacccctcattttcctaaatgtttccaactctttcatgaaaatgcaacaatagtcccagaaatccaaacatttagatgatggaaagtcagcctttttccttcattattaaaaaataggtatggtaattttttcccacgaagtattataccatatacagcagtttatttaatgacaaaaccttaagcaagatgaagagatagacacaataaaagttaccaataagagaagattttaacattattttttcttttggtacagtctttatctttatggcttcctttataatttttgttttgacaatttcttgttatgttaatttcttgctaataattgtttatattaacatttctcattgaattatgttactttatatttattgcacttc

SEQ ID NO: 475247 - DNA, 696 bp, Homo sapiens
ctgagtctacacggacacaaagaatggaaggacagacactggggcctcctggaggaaacctttcctgtaacacggttactgaggacctgtggatgatgtggacaaatcctgttacattccctgctgccgctttctcaccttctttctgctacatctttgccacagactgctgggctttggaagcaaataagagaacctctgcaaaattgctggctcagaagaaaacaggaacaatttggaggactcagaagaaaagtgtgacacttcctagagatttgttgaatgtctttgaccaaaatactgatagtgatatcagcagtgaagccctggctgaggtgggctcagatggagatgaagaacttgttgggaactggaataaaggtgactcttgctatgttttagcaaagagactggtggcattttgcccctgccctagagatctgcgaaactttgaacttgagagagatgatctagggtatctggcagaagaaatttctaagcagcaaagcatttaagaggaagcagagcttagaagttttgaaaatttgcagccagatgatgtgatagaaaagaaaaatcaattttctggagagaaattcaagccaactgtagaaatttgcatgagtaatgaggaaccgaatgttaatcactaagacattggagaaaatgtcttcagggcatgtcagagacctttgc

SEQ ID NO: 475248 - DNA, 931 bp, Homo sapiens
ctctccagctgcagaggagcctccactcccgagcaggcgagggagatgatgggttttgctgttctattcatcttgctgtgttttcacgttttaataattgttttgtttatatttctcctacagacatgttctcgtgtttataatgcaggaccaaatctttccttggcagccttagagcttggtggtcttgcattcaacatcccccagcatcgctttccaggggctaatgatgttaatggtggtggtgatgataatgttggtgttgatggtgatgacaatattggtagtggtggtggagaggatgatgatgatgatggtggtggtgatgatgattatggtagtgaagacagtgatagtgatgatagtggtgatgatgatgttgatggtaacgatgatggtgatgatgatgatgatgaagagaatcatggtgacagtaatacagacagtgatggtaatgatgatgatggtgatagtgatgatgatgatgatgatgatggtaatggtaatggtgacggttataactattatttatagagtttactctgtttgagacgcctccctcttatttaatgtaatgtaagcctcaagtcctgggatgcacttactattattagtatgatttgaagacctgggaactctccttggtggagtctcgctcttcttgtttgggacagttcttttcgtaaagccatcatatggcctcttggaagggcctgccatgttcctctccttgcatgtgtagtggtgaactcaggactccatccgagtcatatgatcccatgaggtacagaagtagagagtgaagacaaacatgtttaggagtgggtgagagtagatatttttttaaaagggcttaatgtcccagcctttgccagaggcatgacagtgccttatgcaaccaaagtaaatgggcattctcagagttactggt

SEQ ID NO: 475249 - DNA, 1723 bp, Homo sapiens
gatggcagggggttcctggcgctgttctctttgcaaacactcattgctggatctaccgcagcaggactatggctgccgccactcaccgcccacaccgtgtaagaagccatccctgcgatgatatctaccctgcgtgttgcacccgcatcacagctttctgagtccaaacatcttcaggggttcaaagccaccctggctggtccccatgatcatgtcctgtctcatctgctatctcccgaacatcccaggccctgctccttcctatctgccttaatcccagtgctctctgggccgcctcctcacagcccaacttcacattccttggaagccacaacaactcctccctctgccagtggagcctcggctgccctccagggcctgctgtggccctgctctccccggtctctgtggctcctggggaccctggcactctctgcacccccagcctggagggcagatggccagcatgcaggaggagtgtgcaaaccaacatcatcccaagaggtggacagtgagccaggctctgctttctgtgtggacccatgactgtggaaaaatcacactgtccttaaaaagccaaatggtgccttttctcttgactaaccctccaaatgggattttgagagaaagaaaaaaaaatcacccctttgaaccatattaaacaagccaggtctttctgagtttgaaagaaaaccagaacactgaaaggaggtcaccatggggcactggggttcctgcaaggacccctcggggctgggaatgtgtattcccgagcaatgagctgcctccggtgtagtcaattgcagaatgtccattctgagtggatactggagttttcgctgctttacaaacttcacggaatgctgtgagagtctggctggggttgacagggcaggcctgtgcttgtgggccctggggccccaagcacagctgaggttctgggaccatgtgccagggtcctaagtcagtgaagttgacaactagagtgagcaactgctgaatatgatgtggtctctccttcctgagaaccagaggccaatgtgaagatttccttgagaaatggactatacttttatttttttagcctggaatcagccctgctccccaccccatgtgacaggagccctggttagatatgggaagggggtttggtgaaaacaggaaggaacagctgtggggggcttggaattggtctaacaatggcaagtacttagaactaattgggggaagagaggcttttaattaccttgggttgttttcaataactttgtaattatttcctcttagaaaatgaaaaatgtccaagtccctgatttgtggactctgcctgcaatgagatttgattatatttttcagtgaggcatacagaggacaaaatagaaagtcagaaagaggtggggctttgtggggagctgggcaaagggttattcagtgtagaatttacccttgttgaactaagaatactcacggctgtcctgagaagtgccctaagcctgtgatgtggaacggctgttggttccccatatccttgctccatgccctgtgctccatggagacttgggtttagatggccttagtatagatatagttaatattaacattttcattaatattaccttcacatcaagaaactgtagcatagcccattttttcctccaatctttccaaatattttatatattctgcttctaaattagattttataagcatttcttaagcacct

SEQ ID NO: 475250 - DNA, 571 bp, Homo sapiens
gagggaggagtgctgctctgcccagcgtctaacccagagatgcctgtgcttagggaaagaagaagatcctcagcatttgttgagcagctcctggggcccgtccatggcagaaacacttgcagcatactgggcaagggtcccaacatcaagcatgacacaagcacccatgaggcccgcagatcgctgcctggctccttccgctgcctggaaaacatggaagaacaggagtggagaagaataaggaaaaggaaagagctcacccagcgtgtggtcacagaggggctggattctgttcctcatatcaatcgctcattgactgtgggtcacactcaggatgatgttacccaggatcccatgacagtcaatcagactcatagtgaggccttgggtattgtgctgggtgaagccctgcaggtaggaaaggcaaatccaatcccagtaggtgtcaaactcagtcagcatgaattgctgcccttctaggaagactgggtatgatatactagactatcccccaaaatggtggggtggtcttcttgagggaggtgcatatcaggggattagaatcagcttc

SEQ ID NO: 475251 - DNA, 571 bp, Homo sapiens
gggcacaaaagcagtaggggtttgctctcactttaaaccaggaacctcagccctgacagtccaggaacaaggcttacaagaatgacaacatcttatatctgcatcgttctcatttgctgcagcttaagggtcatgtgcctgctctcgaatgttttaggctggttaaatggtgatcatcaaaatgctgatagaaatatggatggtgaagtccaggctgacaaggtcttatatagaaatgaggaagttattgggaactggagcagtgcagaagagaaatgtgaggttggagccctatgcagagtccccaccagggcactgtctaatggagctgtgggaagggagccaccactgtccagactccagaatggtagattcaccatcatatcgcaccctctgcctggaaaagttgcaaacactgaactcaaaaccatgaaaagagccacaaggctgcatcctacaaagccacaggggcaaagctgcacaaggccttgggggaccaccccttggactagcatgtcctggatgcaagacatggaatcaaaggagcttgctttgcagctttaagatttaa

SEQ ID NO: 475252 - DNA, 525 bp, Homo sapiens
gccaccgacctagaatgtcatccagaatattccatctttgcagaatgtgaagtcatctaaatcgatgttggcaagaacccaaggggatacttaccttgaaggtgctgaaattgggaccaagttcggccatggagcagtgaaaaatattcagagctgttatgtcctccaagaatcaatgatgacattcagcagttgcaagcttcctgacaaagttgaaatcatctttcacttggtacccatgtcctcctcttctcaagctgcccatcacaaagaacgaccaagctggctgtcagctcagttgcctgaacagtatccaaaccatcagaaccacctccaccctcccttcgtcttcccaccatctcacgagaaaccaaatctccgtctgtcaattgcactgttttctcagggttttacagggaatcagaccaataggatctattataaggaattggctcacatgattatggaggttgacaagtccaaagtttgcagaattgatgtctcagtttgaatcctaaatctggt

SEQ ID NO: 475253 - DNA, 1074 bp, Homo sapiens
cagctctgctgtggccagtggggtccacaacccctgggccgccaatggtaccggtctgaggccgtttagaaacccggccgcacagcaggatgtgggcagtgctgccagaaactggtgtcttagacaacagaaatctattgactcatggttctggaggccagaagccccatatcaaggtgccagcagggtgggtttcttctgaggattccatcccaagcctccctccagcttcggggtctgctggaagcggcctgtggcagcacaaggtgggtctccacacgacgctctccctgtgtgtgcgtctgtctccaggtttctcttgttctaaaaccaattcgcttcgtttgaaccctgtggaggacatggctgatgatgaaagtaaaaataaaatcatccgactgcattatcagaagacaccctgtagctttgacccagaagcttcaagaacgtcagaggagaagataggagcagaagagctctgtgcaggtgaccagaagaaaaagactgaagctcaacatgaagctaaggaagaaaacaaaagcaaaagcaaaaccctgagcaggcatggagtggcttagtcttgctgtcctgtctgagttctgaacacatgtaatatcccgtcaccaattccagaaatacttgagagatctgagatcctgccagtgcctctgaatcacagtgttgttgggaaggcagcctctcccgaacccagggaagcctggcacgctatcagctagattatgtcatagacatgctatggttttagtagttgtgaatgtaatttctctatttcattttgtaattggttattactggcaaaagcaaaaatgcaactgatttttatatgtttatattttatatagcaatcttgctgaactatcatttcccagccttcttggcaagaaaaaccattgtgcttgatgggttttcaacttctgccggtaataaagcatgttaattcttcctaatgtggaccatcccgacattggtaagctaacttggccatcctcatggactgtgtcactttttagccttcttttcttatttgtaccttttaaatactttttgatggtc

SEQ ID NO: 475254 - DNA, 2359 bp, Homo sapiens
gcatccaccagtcagggcacactttcacaaagtcgcatggacagcgctgagccttttgaggtgacccttcatttcccggccgctccgctcagactcctcaagcttcctgctgcctccaatgcaatggtggaggatgagctccactaaggaacacatccggctcacagatctggctggcattgctctgtcttctgctttcccggctctaagctccaagtgctatcaccttcagttgaccagctgcgtctttgtccctccccacatcactttctgcagccagggcagcactcctggacaggaagccatgaacttgcaattccaccatttcttccagttgcttttggtgtttgtgagcccaatatttcacggccatgtgacaaggacccagctcttagatgaactaaggagaaggtactacaacatttttggtgctcataatgtgaggcttgagaagggtgagcagcagctccctaccaccatcccctccctgccagggctgggacacatggcccaagaagccccaggctgctgggctccacccagcaactgggttttcttctgcctgtctgtgtagttatacatgtgttgtgcataatgatacctgtaaaaagagctctaattaacttggcctaaaggaagacatgtgcttggataaaatattttttaaagggaagagctgtggttcctttcagttcacatgactttaatctctgagaaataaaaacagccttaaagattattggtaaaatgcagatgccatcaaaatgtaaacaggtgggcttaaattgtgcaggtcagatgcaagatttgctaagtgttttaaggttgtaaactgccttttgggttttgagaactatttaacttgttagctccacaattggtaaggcctagggacatacggaactaaccacaaccttaattatgctggaaggagtcaaagcttggctgcacttagcatgcaattaaaacaacttaccaggttttacattaaagttaacattggtaaaagttaccattatgacatgtaattgaaactactgaaaatagatttatatgcaaaatgcgtaaaaacagtaaaatgtgtttttagtaagagattataaaaaagcatgaaaatgtaaactcttacccagggttaagaattgttttgaattaggataaagccgaagattcaaacacattctgaaaggtttctaaaaattaatcttgcagaagaaattctgtgtgtaaacattaactaaattcaaaagggttttatatagtttttctgtaaattgagcattgaaataaaagcacaataaggttttcttaaggcactggtctgctctttagcaaaatttgtacaggattataaaaggtttttgcttctttaaaatttctgagtcatcattttggcaaaataaataacttatggcaatctggaattctatttcattacatcaagtgttttaaacctctaacacatttcagagccttcccaaaatcaaactacagtttcaaaattgtctttcctgaaaccttctttttggaagctccagaagggcccccagagtgcccagaaaagagatgtaaacaggattatttgatatgttaggcacatgagattgccaaaatgatgttcaatcttctttaggttatatttttgtgaataaggctaatatatgttccaaaattgtatgggatttctaaaattctaaactctgagtatatgctatcaaacacagttaaggtttttaagttgttgtaagccacagagataagcaaacttgtcaattgtgtttctaactgtgactaccgtgaacattttgttattcacagacaattggtgttttgttttaatccttttcaaaagatagtttataataagtgatagcactctgaaacgtactcttaaatacaggtttctgataactttggaggttgtgacattggaataaaggaaaatgtacaggactcatgaaagctaaaatgttcatgaatatcaagcaaaacaagtattaactaaatggactgaactcagaaagctgaagcaaactgtttgactttttcttggagtattgctgatccttgttttgattttcagagtcaaggaaacttattttgaactatttatggccattaataattgagtaaggtatactcctgtgaacaaaatttgtagcatattttctgtctctggctggcttctccagaatttggaaactatctgtgagtattcataacttatggaaatatacttgtttgcatcaatgcagtaagaattcacttttcttttgcaacaggatgcaattggagaaactggttgttttatcaaggcttggactgaaagtgtatgcttccccttaaaggagtcaagctc

SEQ ID NO: 475255 - DNA, 574 bp, Homo sapiens
gaccctcaaccaaagagagcttcttccttcttatagaatgtctgcatatcggagcattatcagcaattctgggtcctggaagagattggtgtctgctttggaaactcaagtagctagaggcattgacaagctctacaacacattacacagcagcgagatgaagcaggcttctctccatcattcactctctagttccatctcggggactgctgcagcattcttgtgcaagtgcaagaggctttcacaggacagaccagccaggaggacatccatgcagatgaggacggatgaagtgctaaagccccaggagtgttcagagaggaagaagaacaggatttggttggagaagatccttggagggaattctgatttgttgctgcctgaagggattctgagaaggctgcatggaatagtggaagaggctttcacaggacagaccagccaggaggacatccatgcggatgaggacggatgaagtgctaaagccccaggagtgttcaaagaggaagaagaacaggatttggctggagaagaagatccttggagctaagagctgggtccttatcacacagcc

SEQ ID NO: 475256 - DNA, 1455 bp, Homo sapiens
aggtttatgttccacgtgctttaagttgatgaaggaaaagggaacttgttatctgcagcatttttccaccctactcccctcttctgctgcaggcctgagacgctttgtcatcatcccccagtctttttgtcagatgtgggcaattccatgttgtggcagcacctgtctccccagggttgccctgggtcctcatcctcctgggcagtttcttccattcatgaaaacagcaatctatgccctcctccctcctcctgcatcccaggggacatggatgcccagcctagaagttgatcccaactgcttctgccctacgcacagccagtctctccaggctgtattagtccatttccacactgctgataaagacatacctgagactgggcagtttacaaaagaaagaggtttaattggacttacagttccgtatggttggggaaacctcacaatcatggtggaaggcaaggaagagcaagtcccattttacatggatggcagcaggcaaagagagaatgaggaagatgcaaaagcggaaacccatgatcaaaccatcagacctcgtgagattcattcactaccaggagaacagtatgggggaaaccgcccccatgattcaattagctcccaccaggtccttcccacaacacactggaatcatgggagtacagttcaagatgagatttgggtggggacacagccaaaccctatcacaggctctgtcggttctgtctcctcaatgtttcttggcttcgtgcccttttcacatctccatgagaacagtctcagccaccccaccttctgtaggcccacacagactgcctggtcactctggggtcttcacaccctgtctccccagtacagccctggcaaccttacctgcaactgcaagcaaggcacatctccaacagggagacagtgggacatctgtgtgtccattgctacagccagaaggattctcaaaacagagcctggaactgaagatgcttgggaaggacctgttgaaatggtgtcgtgtgagggctatggagaagaagaggaagaagaagaagaagaagaagaagaagaagaagaagaagaagaagaagaagaagaagaagaagaagcagcaggagaaggagaaggagaaggagaaggagaaggagaaggagaaggggaggaaggggaagggaagggggaaggaggaggagaagaagaagaaggagaaaaagacggaggaggaggagaagaaaaagtaagaagagagaaggaagaaggagaagaaggagaaggaagaggaggaggaaaggaggaggaggggaggtagaggagaaaggggaggaggagtggggaagtaggaggagaaggaggagggggagggggtgattgggatgcagataagacacaaagaaggatgaccatgtgaggtcacaacaagaaagcaggcaagaaattgaggtctcaccggaaaccaaacctgcc

SEQ ID NO: 475257 - DNA, 847 bp, Homo sapiens
aattgtcatgcccgttaggggaatggcagagcttggacaggagggctgtgggcatttgcaggagaacaggggttggggcattggtggtggcccatctggcagcatagacatagagtgtctgctgaatgcatatggcaggaatcactgtaagaaagatgtgaggaagatttgtccagtgcacccaggaaggcagggcctgtttgcagaaagcaataatgctggctggggacgaaggaggtcatggtcacagggacgttcccagggcctcatggttattgactttagatgtgttgggagtgactggggtgggagaaggcaaagggccttgctgatggcagcaggggacactgtggctgccatgggggtgtggggctggggtattactgggctgcagaggagaaggtgtgaaaatccagacccctgcagtccccctggcacctttacctaccactctcagccctgctggtctctgacttggtccaaagcagaccccttgccccatgcctcagctggccctgggctgccctgcctgggaccctttacacaatacagcagcatcctctcccgaggcttggggcctcacccctgaaggggcacccaagagcctgtggtcagtgcgtgttctgagaaggtattttaaacaccaccaccctgggggattgtcttccattccctctcactagtttctgcttccaaatgaataccacattccagattagaggacttcttgcaagatcgcctcaggtatctgtggaagaagtaaaggtttgctgacagatgaggattaaaaacagttcacttgtgggaaaattatgttttaaaaaggctttgtttttggcaacgcatt

SEQ ID NO: 475258 - DNA, 558 bp, Homo sapiens
actaggggacctggaccctcagttaccaggccctctaaagagtatggaggagcaacgtcaaagaatcccggaactgagggagaggaagaatagaataggtgcttcaaatgtggaagagcaggccacttcaaaagagaatgcccccaaaaaaggtgacctcaccctcaccactaacagtgcccttaaccctgctgctttcctaactgggaatccaaaccccaaagatcctgaacatgattgtttagatctcattgactaccatactaaggttagacctgatttaagagaaaccccttttgaaacaggacgtcatctttttatagatggctcctcccgggtggttgaaggaaaaagacacaatggatactttgccatagatggagttcttgccgaaatagaatctggaagattgccaaataattggtctgctcaaacttgcaaattgtttgtgttaaatcaggctctaaaatatttatgaaagcaagaagataccatctatacctactccaagtacgcctttgtgggtagtgcacaccttcggaaaaatttggactgagc

SEQ ID NO: 475259 - DNA, 699 bp, Homo sapiens
cactcgctgcatttgctttacaggacatccaagacacaaagaggagagcatcagaatgaggagagaatcattaaccgttaaagagttgcaacagggtggccagggcttcatcggtaaacgtgaaaaggctttgtcttctgctaaaagaattccaaatccagatggcaggggcctgctgaaaaggtcctccaagaaaaagacatgcattagacatacagtagatttattgaaagaaacatctgtgaaggacagagaggagaggaagcaggaggaggccgtggagagccttcagactagtaaacaggtgggtgtctggctgctcataaagggatataggcatgtgtttgagatgcccagatggcaaaaccaagatgatgaaacttctgagggaagtggcaactttaggatactagcctgcagcgagacgtgctctcagatggtatcgctgcttctcccagcacctggtcctaaatttaggttctccctagaccttactggatgagagcgttaagagtgccttgttacttctccctacacaccctccactgataccatgaagggctggggtgggaatgtggcctaattactgctgggtggttggtaaaagttctgtctctccactgtgcctcctctcacaccactttagggaggagggggaggagcaccttattactgatgggtgggggatagaagcccata

SEQ ID NO: 475260 - DNA, 1085 bp, Homo sapiens
tgtattctgtttatgaatgaaagttcttttgcagaacaagagatccgtaaagcagggtatgcaatatgcaccctgaatgacactattgagagcatgcctttctcctcgggtagaagtgctcaactagctgagctaattgccctcacaagagtgcttaaattaagccaggggaaagcagttaatatttatactgattctaactattctttcctagtcctccatgctcatgtcattatctataaagagaaagactctcttccatgggaagtggcagtaatacactgtaaaggccaccaaaaggagatgaatgaaatagctgcaggaagcctggattgggaaggaccttacactgtacttctttgtactccagtaaagatcactggaatagattattggattcattacactcgagtaaaggcctgggaaactgacagaattacctctgtcgatccagaagagcacccaaagcaccagtgtgaagaaatcggagaccgtaagctaaaaatcacaaaatatgctggtgcccaatgcggaagccactttcagcatgctgggtccagctgcaggctgaacacgaagccacggcggtatgggatccaggccagtagcccaagccaagcgcaacctgctggactgagtgggcagagcaagcccagcaagcctgaattaagccccaggcagagggcacagaggccacggagacttcaggctggcaaagcagcatcaaaggaatactggaacatggttaccctccctcctgttcaccgaccaatgggagaaaaaaccgaggttagaaccaagcaggtggaagaagggggatatgctgtttgcttgttgagtcttcttgctcgctctgtcttcctgtgccagatgcttgcttcctctcctcctgctcttggacatcagactccaggatctttggcttttgaactctggaacttgtaccagaggcctcgtgatatggttgatagataatatgtgttggtatctgtggccaaatttgtcctgaggcataattttattttaacttttacttattttaaactgttgacagctatcaatagctgcccatgaggaccctctgg

SEQ ID NO: 475261 - DNA, 981 bp, Homo sapiens
aaactatatgactcttccagaaaatagatataggattcagataaaaggagctcaccttattattaacaaaatggtatgctctattgggcaacgtctggtgaagggatggtaccagctcttctttgtatatctggtagaatttggctgtgaatccatcaggtcctgggcttttttggttggaggtattccagaagaaggcattgttatcaaagatgatgacagccccatgagtgttattttccctgatgaccttccagtaatacaagaagtgggagattcattggcttgttcatgggcttctgaagttacctctgaatcatataaacttgttagtcctgaactgtttgcttcacaagccttgattatagttgttgagtttagtatcttgactgtgggttcaactcatagtgacattatctattttaccaaagaaaaggactcaaattcaaatgctttaaaaattccctttagtcctctgatcccgtgtctatgggagagattcgggtttcctcctgtttgagcaagtaagcttaattttatttgaaatggcattttcctgtacacaaaataattcatacattctgatatgcctacatttcaacatcaaacatccaccccactatactcctaccggttgttggcagcttgggagttgctatttaatcacttcaagctcattttcctataaactaaactttgtaactgaaatttctttaaaacttttgatcaaattgactcctcaactaattccgtaacttgtcagtggctgaacagttccaccaaaatactgaaaatgttttggagctacagaaacagaaataaatcaagtatataccagggaaatgtgatatctttcataaaatgtcagacttttatattcttaatcaaattaaaaagacattttatcctcgttgcaagctaagcaacctatctcatttaattccatacatctggattattctacaacgagtatcaggtctt

SEQ ID NO: 475262 - DNA, 546 bp, Homo sapiens
gtggccagctgggataatcaggggagatgaatgggcccaaagaaaagacaatagcctgggacaaaggtcctctgagctctggggaaggtggtgacaagttatgggaaggtaccctacgggtggtgttgaggctggtccccaacattggtggaagaagcacctttatggaccagacagccatgtactcggtcagccccactgcagatacgccggaaggaggtccaaaagccgttttcagggagaggactctttgccccttgttagttaaaccttggcagacatgctgggcaggaatgacataccctatgtgtaagtacctggaaaaccccacggtgctcccacacactcaaccggaagcagcattttcagatctgctcgtgctggttcttctgcattagttgatagtcagtttagatttcagatgtcactgtccctgaagggcctcccctggtgcctcataaaggccaagagaccacaaaagttgaatggccaagccaggctggcacgacgcagtgccctagctatctccttttctgctgcagaagc

SEQ ID NO: 475263 - DNA, 922 bp, Homo sapiens
ccaagaggatgggacaaagcaaggcaggcacctagtacacctgggagagactgctgtagtccagaatggggtgtcagagcctgagtggggtaaggagggtgtctatgtagaaagactgcctggcatggggagtagacagggaggagaaggcatctgaggaggaggatgtcagagcctgtgaaaggagtctctctccacctccaacttgttggtacaagtgtcctgcgggagcagctgacctcttccttcatcacaaagccaaacacacacctggcgcaggagatggagctgctgaaggaggacacagggcaggtggagcagctgcagccgtcaaatgagcagcaatacaggatatccaaatctcagcctaaacaagtttctcatcagccacaaggattttcattttccatcatcacccagctctcccttaaggcaagacatggtacccagcccggtgctctcagcagggagcttctagctgttgttcccacaggggttgtcctgcctgagcccatggcctccctaggggagcccaatctgggggccagagagtggatcctgatggtatacaagaaggaggtggcctgggacatggctgacctgctgaccttggagatgtttgccccacaaatgaggctgcaggattgagtctatctgaggaatgtcctgcagccaggcccacaaggtgtccctcccagccctgccccagagccctctcaatccttcctctctaaaaccgcagcccctccttcagaaggaagccctctctgcacagactggttaaggtttattagtccttaaaattccttcgagatgagttggtatttatttccctgcaaagcttatgtaaccgtaagaggatactggggctgccaaagctgtctgtggtttggatggggctcacagcggtttcttctgggag

SEQ ID NO: 475264 - DNA, 1186 bp, Homo sapiens
taattgaatcatgggggtgggtctttcccatgctaatctcatgataaggcaggatctcaccaccttttctgggctagtctggaactcctggccttgttaccagcggcaaatcccacagagacagacacacacagaaggaagaccatgcgaagagatacagggaggagatggtgatgtgactggagtgacgcatctaaaagccactggctgtcaaggattgcccgcaaacatgggaagctgggagaggccagaaaggattctccccgacagtcctctgagtggacacaggtcatcctggagagtggtgtccttctggattgtcacataccctgtgaatgaagcatgtgttacaacaataatggaaaatatgcaaatgagaaaaaaagtttctcagtgccccaccaccctaaattctggctccacccctatttgttttctcatatttgtctgaatttctccaagaagcccataatcaatgctgggtcattcctggagtgttgacagtcaccaggattcacctttggcttttgtttcagtccaaaagtaagagttagtgtcacgtgtgaggcaaacacatgctgagacttgtttgagggaccactgagatttcaagttgaggaaaagccttctggtacatgaggtcgattgtagaatgaatatgaatattgaacattcctgccagcagtctgcagacttctgatttcaggcccctgaaaactgttatttcctgggcttgtttttaaaagcagagcccaaacttatttctgagaaaggacagaattaaaattcagcagatagttgttcatgctgtataaataaatccctcttcagagagtgaaggaatcctttttctcagggaccacaggactgcttataatgactgttttcctcacatcaagagctcagtctttgtggcaccttgactttttttggagggggcaaccagtagctgttgtctaaatctgcaggctgcccagagcctgcaacatgcgaatgtgtgtcataattgttcacaaagggctccatcatgttaagcatttcctagttatttgaccatagaacttcttttttcatagttaagtctattaatagctcctagaacagagttccaacgatcattgtgtgatgaacactgaagatctttttcaaaagctttgaaggttcttgtcaaaagtacatgcattat

SEQ ID NO: 475265 - DNA, 558 bp, Homo sapiens
cctgctcaccatgttgtggatgacaagaagagaagagctatggccctttgggaagcccggacctagggcatccctgagccagagctgtgacaccctctttggggctctgtggttcctggcatctccaggcttccaggtgccactgagttccccttttccaggcctgcagcctcgcacagagccagcacctgtgctggtgcctgaagctgtccaccccatcacagcaaccagcatgcctggctgtgcgcagtggtcagatcccgtgcttgctcactcgctcccacaccctttgctgcttctcaactggctcacccttggcagatgtggcatctgggttggtagtaggaaccaagcacagcctgccaggttgagttgggggaatgagcccagtgggcacaagcaaaacccaagtagaggcaccaccagccacagaggtttctggctggcaaagtgataccctaaagagcttgtgacattattcttatgtttgttatgttacattagctgtgtttacctacacaatttgttttcattcattttagatttttaaattacttt

SEQ ID NO: 475266 - DNA, 935 bp, Homo sapiens
taggaaccgcattttctttgagcagtcttctttgacctagagatgacgttacatctcattgcttcattggctgtgggtggctccctggagtggagcatggccctgtggcaaaggcagtttccagcaaactctccgcagtcggtattcccagcagctggagaagtgagtagctcagtgctaaggggagatcttggagcaccgcctatccactaccctattctaaaaaatatccggaatccagacctgcagaaagaaaaatctttccttctgaaagggcttgctggacttttccagcatgtccagtgtgcaagaaggcagggcaatagctcagcaactccagtggggaagtctgagtctaggacccccaaccaccatttcttattggtagcaataattcaggaaatccatcctaccatggagggtaaggagtgttccagaccgaagaatggcaataagaggtctagatggaagagccagcactgccctgcttggggacccaaaataatgacttctgggaagaggtgtaggtctgtggaggaatttgaacttgaacttcagggcaaaggggggctgctatgagtacagtagcatggtaatgaggagagacttagacctgtaaaattttaaaatttgtatatagtcaaaataatatgcttgtttatactttttttttgcattagaagtcctcaatttatcagtcaaatgctcatgtatattttctttttaatgtttttataggtgaaatttattctggtgtatggtaagatgtgaagatagaatttgaatttttaaaaaaatagccaattctcacaacaccgttattgaaaagttgtcttacattgacttcagttttagggctgtctatacaagtctactctctctgtcccatcttgcgttggccccgcatagttttgattgttgtgacttcgttagcc

SEQ ID NO: 475267 - DNA, 1267 bp, Homo sapiens
cctcctctctctctcttgatttctctctcatcatgcgatatgctggcttcccctttgctttctgcggtgatcataagcttcctgaggctctcaccagaatgtgagcagatactggtgccatgcttgtacagcctgcagaattcctgtgaaatccaaacaagttatctacttccaaaatacaatggtggaacaggcataggatacacatgcacatttcaaaagggagcaacaggaaaaaagaaaggagtaacaggtcccaagtatttgttacagcaacagtcttacttcttggtgccaattttctattttagtccattttctgctgctatatcagaagaccacagactagtgggtgatatgacagtaaaaagcatgacaaagaagctgtttccacaatgcattttagtcaggttgagtgtgcacggccacatctgcccaccacagtgccctctacaaccagactaggggatcttcccctgcagctgtccccatttctgcatcctcctccaccagctatgaacacccaatatttcaaagccttttgcttccctaaggacaatagcaacgcaagaaatcaggtcaggtcttgttcttcccccttctatctaaatggatttttctgaaaggaagaagccaaggagaagaggctcgagatgctaggtatcatctgagtgtacaatgttaatacttccttacctcacacatctgatttcctagtttgcacatgctttttttctgtatatcttttgaagctctttgaagacaaagaagccctctatcctttgcccagaaaagttccacatgcaaagaggtcctttcaagtgagcttttaatcacaccagaaataagtttgccctgtggtctctttatgtggctggcatactgcagtccatgttattttcaaattgaagatgttatttccactacctgaagattatgtgtctagataactcagaagggctgtgctgataaccatattaaaatcataaaaataccattatgtttttcaaggcagagtcagattgagttaatcagaattggtttgcaagatccagtttgtttctctgttgaaaatagtgtcaggttgataagtcttttgttcccacactatcacattgggttctattctaatctgtgtgatacccggacaatacagataagctaaatgtggtctaatcagttctgactcttctgatctgactgatatttttgcatggattttgattaatcagaaatgtacagaatattcatgtctcatcccatagtt

SEQ ID NO: 475268 - DNA, 584 bp, Homo sapiens
atactcacattccatcccgtctttcgatgctgaacacgggagagactgaggtctcaggatggctggaaaagttgggatccttcaccacaaggcaccagatgctgaacaatctgtaagagaagttagaatgggccttgcaaactgccagagttcagaggaaggagcctccctggcagccagggccctccctggaggtggtgttctggagctgagcatgaaagaggactgggtgaagggacagcttggctgggagaatggctgggcttatgcttggctggcaatgaatgcaggagaagatgcctcctgccctgtgagccggcaaaaaggaggccacagccataaggctcggactgatgggccactcaatagtccacaaccactggaaggaacatcaggagaaaatctcttctctgagtgtcttcatcttcaagatcctaaggcattctcagcaattgcccctgtgcccagagaaatggaaggagaaaagcagaccccaccaccactccactcgctctggctttgcaattccttggatcattgagctgctttgtgccggagttgtttcagctggagaatcaccctga

SEQ ID NO: 475269 - DNA, 549 bp, Homo sapiens
aaaggatttgatagtgtctgtgatacctgggaaacccaattatttgttttttgtttgttttgttttgcttttattttaagggaggattagatgaatatctctgagccacttatcagctcgaaattctacggtcaaataattcaccctcattacttacagacaagtggaaatagaattaggcagagacacaagcagctggacgtcaagaggaacacatcagttgagcacactgacaagtaccggcagatgccgacacgatggcaggccatcgaccagcggaatgacgtggagtttggccagggcagtcggaggggagcccagccactgggtggcctgactccagggaaaaaaccaccttcccacttcatctcccttctggctcccccatctgctgagagctacttcagtcagagctgttacagtggaaatcttctgtcaagtatcaggaacagatcttataatatggctttgacatttatgtccaaagaacatgaggcagatggaaaggtttatttttcagagattgtgtcccacagagaatgaggtgcc

SEQ ID NO: 475270 - DNA, 606 bp, Homo sapiens
ggtagctgacagaatttgacagctgctgtagatgtcatttttttgtttttgttcttaagacattcttttaatctttttttttttttggagacggaatagggcctgagggcagagtagcacgtcacactggggaatgagatgtcacgtctcaccttcttgcagacatcttcaattcctacaagtgatcctttagaggaccccccactggactttatgggtgaacattcaccttccttcttcattcaaagctcagcccagtgtttgcctcttcagcccttccaaagattttgggggccccctctgtctcttactaaaaaattctttgcttataccagctgtgcagccaagaaaagccatgagagactgcactgggaggaatggtacactcctgcccagatactgtgctttttccatggtcttcacaaccagcagaccaggagattccctctggtgcctggctcggcgggtcccatgcccatggagcccagcaagctaaaattcattagcttaaaattcttgctgctagtgcagcagtctgagatcaacctaggatgctggagcttggttgggggagggatatcagccattgctgaggcttgaattcca

SEQ ID NO: 475271 - DNA, 653 bp, Homo sapiens
ggtggagccctgagtaacaaccaaaagcctcactgcccattgcctctgcactggaaatacccttgctacccttggactcatgaaggtatttaggtggaagctaggcaatatagtgggtgttacaaagaatccggctaacatcttgtgcttgtgctctcgcgtgctctctctctcttttttctctttccctcagtttgggggaagcaagctgccattcaattgtggatcagacaggcaattctattgcatgtttcggtacagctggtataaactaacctgggaagatcttaagagggacagctggactctcctccacgtggatttcattcttcagcagttttataggaagattaatttgaagacaatatacaggacaaattacagaaccagaattggagatataagtaagaatctttttccactaatctggatgagggctgatgagacaatgaaccgagagagatggtgtggagaggtggagacaaaggatggatttgagtactctttcagaggaaaaggaaacaaacttcctgactgaatgaatatggaaagtgagagaaatcaaagatgactcagaggcttctaccaggatagttgtgtggatggcagtgccattagccaagacacaattctcagaaaggaatatattttgt

SEQ ID NO: 475272 - DNA, 990 bp, Homo sapiens
ggtgtttggttctttgtccctgcgatagtttgctgagaatgatggtttccagcttcatccatgcccaaggttatttcagtcagaagctagtaaatcctgcaagaaccaggtctatctcttcaagacagcagatttccttctggcccagtgtgggtctaggaatgctgtctaggagcaaagacctagaatcaagggctccaggaatctgcctggtgaatctctcctggagttgcaatgcctggagttgggtgagggttgacatgggtactcccttttcttgccacaactggtatcgcactgggtcatgcacatcccaagtccactggctccaagatcagtgcagcatgagtgtttgtccaaaaactccagttattgtggcctatcactcaaatttgttctggaccagtgggcaccttaatcagctggtggtaaagctggccaggaatcaatttcctcccactggagtggagaatcctcttctggcaagatctggtctaaatgttccttccacgaacaccagtagaaatctgtcgtgtgttgtgctttgctgttacagggaaacactgagttccagtgcaaagacccacactcacttcactctcccttcctgagcatactgattctctttccatgctgctctgcctcgggttggtggaggggtggtgtagaaaatgtaagtgtctttcctatcatctttaatgcgaattcccttgatattatatttaaaccaggtttttgtatatatgcttacattatttacccaaaataaaaatcactgttgaaacaaaagagcaatcaggcaatatatatgttatttcttgaaaactttacaagggcatgagctaaaatatctgtacctataagcttatggcattttgataaaaatgcgagcccatttttacatttctaattgtgactatgtatatctgaaatgagtttacatatgaaactactggaaagtaactcagactaagctatgacccaaatgat

SEQ ID NO: 475273 - DNA, 1649 bp, Homo sapiens
gaggcacagcccgtgcgggacacacaggccattgccagccctgccggggctccaaccagcccttctcgtctgcagcagtcacacaccacccctccgtgagggtcagcagggactgcctccctcccccaagtgtcgtctcagtgccttggcctgactgcagcttctcacctgcggtcttcagattggtcgggggaagccatgaaatctcacgtgcccagtcaggacccagcacggggcctttcctttctccccaccccacacccggggcccagcgtcccttcagcataagttctcccactgctgtggcaggtcccccagggaaagcacagccagagagctgctctcctgcagcctggaagctccagtccagccccctgctgctcccagcacccccttccgggctcccccgcacacccctctgtctgaaacacccctgccattatgagggctcagatccatggactggcaggaacccagacccttgcctgaatgagcagtcgcaggcccgggccggcacacacaccgggagcccctggcccacactccccagccggctcctgtggccctgttctcttcctgccgggcagagaagcagagcttgggacacgtcccacccgtaaccgccagggtcctcttctgccccgagcatccgactccagcctcccatggccggaacatctgaacgttcattgatctcatcgatttctcaacccaaagccatcgagtgctttgaggtgaagaaaaaggctttccttacccacggcagataccacggcagtggcgccacgccgccaaagaccaaagaccccaaaccagaaacgttctgtggtcagacagggctgcccaccatggaggtccgcattaatgtctcaaggcagcaggtcgagaaggtgttcgggctggaggaatactggtgccagtgcgtggcatggagctcctcgggcaccaccaagagtcagaaggcctacatccgcatagcctatttgcgcaagaacttcgagcaggagccgctggccaaggaggtgtccctggagcagggcatcgtgctgccctgccgtccaccggagggcatccctccagccgaggtggagtggctccggaacgaggacctggtggacccgtccctggaccccaatgtatacatcacgcgggagcacagcctggtggtgcgacaggcccgccttgctgacacggccaactacacctgcgtggccaagaacatcgtggcacgtcgccgcagcgcctccgctgctgtcatcgtctacggtgggccccgggactccctggtcacagggagaggcactgcggtgcccctgggcagtgacatgtggctggtgggtgaacggtgggtggtcgacgtggaccgagtggtccgtctgcagcgccagctgtgggcgcggctggcagaaacggagccggagctgcaccaacccggcgcctctcaacgggggcgctttctctggagcccgtggagcaagtggtcggcctgtgggctggactgcacccactggcggagccgtgagtgctctgacccagcaccccgcaacggaggggaggagtgccagggcactgacctggacacccgcaactgtaccagtgacctctgtgtacacagtgagtcctctctgccctgaggtcctcttctgttc

SEQ ID NO: 475274 - DNA, 737 bp, Homo sapiens
ctcctattatttgacatcttgtttaattctttgttgtctctctctctctctctctctccccccatctctctctctctctctccctctctccatctccttctctcttctctctctctttggttctgtcctttctctcactgagactccccaaactagcaaaggatgtctaactgcttctcaaattttctctgtccaaaccttgcattccagaatttgactctctcgaagtttcaaaattatgctttctgctttctcttcacccaatgtaatgaagaaccttgtaaaatagcctctgacgaacctcctctgaaatcgtgcctcagtaaatgggcttctcatgctgccttcatacctagtctttctgcttccttcttcattggaaacttacaattacggcaggagataaaggagaagcaagacaccttcttctcaagatggcaggaaggagacttgctgagcgagggggaaagaaccacttataaaacctcagatctcgttagaactcactcactatcacgagaacagcatgggggaaaccatcccaatgattcaattacctgcacctggtctctcccttcacacatggacatgatgaggattatgtagattacaattcaagatgagattcaggtggggagagaaaacctaactatatcaagtcatgctccgtttagtacaagacttagcactacccctcttttgcatcacagatctgttcaaatggatatttgcatatc

SEQ ID NO: 475275 - DNA, 1129 bp, Homo sapiens
ctgacatacacctgggagtctagagagacagagacagtctgtgttttgcaactccttctgttgcaatgcactcttatattggagactattggcttgaggagatgaaggatagacggttcagagagatgctcttccccaaggtagaaggctctggcaaagtttttcccccggaggtggaaccagccataggccctcatcagaggcagatgctggcactttgcttctcgtacagcctgcagaatggaggagctcgctgttacctgaagggatggactggtcggtggaatgtccggtgccgtgagttacctgctcagccctggagcaggggtcaaagctgggcggagctggacagccagtctcagcctcagcttcacatcctggataggcaggaacgtttccctatcatactcctgtcccgggtctcatgtgtctcagttcaaacagacactgccgtctatcttcaagctgcaatgaagctgagagccacagaaaacacctgtaccatggtttcagggaggagtctcttccctcagccgaaaacagacagctttgctggtcatctgttctccactgcgaggacgctgccactcagtgtggagagaggaaggggttctgcctatggtgcaagaaggtcggactcggcagttgcccctggtgaccagtcatctccattatgtagctatggctcgcagggcaagaagtcaggaagtgaagatcacaagcagactgaaactctgaagcttcatgatgaagctgttgtcacagttaatactcttggataatgtatttaaggatgcttaagtcatcaaatatttattaactgccaactatactatggcaatatattttgttcaacaaatgcttcttgaatgcctagtgtgtgaaaggaattatactgtgaaattcgggtataaaaacatatgctcttgatggtcttatcctccaaatgcttataaagagctaagtaataagccaaatgctattcaaaattaaaagtcattgtgtaattttaagaccttcaatacaatcaccaaggaaatattatgagacaaactccaatagctcattttatgcacattactcattttgataattaaactgatagcacttagaatatagttatgttata

SEQ ID NO: 475276 - DNA, 509 bp, Homo sapiens
cttaggcttgtgagattggagagaagacctgaagaaaagcaagactaaaggagaatcttacacaagaagacaggaaaatgagggaaagtttggaactccctagagacttgttgaatggctttgaccaaaatgctgataatgatatggacaatgaaatccaggctgaggtgatctcagatggagatgaggaacttgttgggaactggagcaaaggtgactcttgttatgttttagcaaagagagactggcagaattttgcccctgccctagagcagcaaagcattcaaaatgtgacttgggtgctgttaaaggcattcagttttaaaagggaaacagagcataaaagtttggaaaatttgcagcgtgacaatgcaatagaaaagaaaatcccattttctgaggagaaattcaagccagctacagaaatctgcataagtaatgaggagcagaatgttaatcaccaagacaatggggaaaatgtctccagggcatgtcagtgacctttgcag

SEQ ID NO: 475277 - DNA, 799 bp, Homo sapiens
agccaggattcacaggtccaggaatccaggggtaaaagtggaaatggcatcactcaccatcacccctagtgatccactagaaacatttttgcttcctgtccccatgacattacgttctgctggcctagtggtattagttccagagagacgaacgctgccaccaggagacacaacaatgattccattaaactggaagttaagattgccacttggacactttgggctcctcctacctttaagtcaacaggctaaggagggagttacagtgttggctggggtgactgacccagactatcaagatgaaatcagtctactactccacaatggaggtaaggaagagtatgcatggaatataggagatcccttggggtgtctcttagtattacgatgccctgtgattaaggtcaatgggaaactacaacagcccaatccaggcaagactacaaatggcccagacccttcaggaatgaaggtttgggttactccactaggaaaaaaaaacatgacccactaaggtgcttgctgaaggcaaagggaatacagaatgagtagcagaagaaggtagtcatcaactccagcttcgaccacgtgaccagctgcagaaaccaggactgtaattgtcatgagtatttcttccttattttgttaagaacatgtttgtgcatgtatacatttgtactaagaaaatatcttcattttatttcccttttcctttatcatgtgacataagatttattgacatcatatcagcattaagtgtttatgtaatattatttgggttgggggtttccacttgtac

SEQ ID NO: 475278 - DNA, 673 bp, Homo sapiens
aggcatttgggtggaaaggggagcatggcatttgttaagcaagaaaagagaggcccaggggtttctgccaaaaggaagaaggtagaagtgggtgttagggagcctgaatctgaagccaggaaactgcacagaggcaagagggcgtgcggtcctcaccagagcctgagggagagaggcactgccctcgaacctgccctcaagccccagctccacagcacccaactcgacgaggatggaaaatttcctgaagtgagaaatgcttttgccatctgccttgcccaggtagtctacctcagatggagtcaccacaaacaattgtgtgcgtgtctcctgatgtccatcgctgtcacggggggagaggccgactatcaccccactggagccctccttctagagggcatcagtggcccctatcctatctgccgctgggctaaggctagaatatatagagtcatctagattagcatcattataagctgctatttgtggtctcatcagaaaaacaagatatacaaaagagaggctgttatcccttctcaagtctaggcaccttaaaatatttatatttagattaatattagattcatattagataagtttagctttatatgaagattaggtttatgttcagattaagattaaattagattaagggtatatttagatttagagt

SEQ ID NO: 475279 - DNA, 1706 bp, Homo sapiens
ggcgtggctgattttctggagcaccgcaccgtcgaacgcacccaccagcctctgcctactgcttccggcgctcctaatcctccttccggcttatgaagggggaagaagcccacgcatgctccatagagctggccccgccctgggcgactcctatttataggcgccctgctcagcaatattgctcttcgtgcaccctcccttctctcttgagctcttgcctttgccttctgcagcagatcagctccaacgtcatgaagatatactctagtgccttgcaggagggagagctcagcagcccgtggtccacatgcatgcaccaagtcacaaggaggggtcctcagggaacctgtctttcaaattgcacccaagtgcgttgccaactgccagaagtactgcctgagcagatgagcaggtgcaaaattgtgatggtgagggatgtaatgacagtcctatgccagccgtgtttttctcacaaggtgtcctattcatttgttaatatagctaagcacttttattatgcatttcagagattttctaatctttttaaagcatttggattttacatctttgcacagatgggtaaaaatggagtgaatgtgtatgttgagtatacgtggggaggggagggtgtggtgatcgaggcagaggagactttacaaaatcgaaagcaagaatgagaaggtgcagcaatggatgaccagctcttttgctcttggtctgcaatcctcccttactggcaatgattgcatctaccacaatccaccaagtcactggactaattacaggttttccttacatgtgtgggttcctaaccttgaaaatacagtcataaactgaggtgtgccataacgtttcttaacagaagactcttgtccataagccaacctagaatctgctttccgcgcttgcttttttcagtgctaggaagggactgaagctccgaaattctcagttctagcattggaaggttaaaaggttttgatattttggttggcaaaactttatttacactatcactctaataattatctaatttatctgttctagaaagctcattatataacagattccaaacaaaactttgatctagaattgggtttggcttcaaccagtgctcaaagaaattagattctttagtacataccctcttcacttcttcctcagtagaaacaattgccaaattcctgccaaatgatttggtttcagaaatatcactgttaggttatgccaagagaatcaataagcagcacatggggatcatgttagagattctatttgagatagacatgcacctatagggtaaaacaattttaaaagaaggctttagcatttaccttgtgcttagaaacaaaattcatactccaaaggggaagaaaatttaaatatgaattctctctacaattaggaaccttttagcattgtatctttctgaaaaacatgtatttgaagccataaagagttccaacatcttggaaatatgaaacatacaattaacatagtgaaagccgagatattcaaaggcaacaataactaaaactgagacaactatcagtactcattaatcacataaatagaaatacaatttcttggtaagacattacttcaagtcacataagaatttttatgtgtaaattttagtattctatgtaattacaatgtgacttagcaaagctgtattttaacctgcttcaggaaaatcacatttc

SEQ ID NO: 475280 - DNA, 755 bp, Homo sapiens
ccacagcacaggagcccagcatgtgagtctcaagtcccctcaatgtctttcctcccctatgcaggttttaaaagactgacaatgccaaatgtcaacaaggctgtggaacgccccacacatttatacaatgctggtggcagcgatgaatcaaggaaaggagaagatatgaacaaatgtggtcaatatgtcatatccaatgagaagctttctcccacccttggcacaggggagcactgggcttctgagtgcattcagaaaacaagcaacacttacacctgtttagcctcatgtttcctaacagctttagaagtacaatatggccctaggtctttgtttcagtacagcactatcaggattagcttgaatgagcagacggcctcagttaacttaaaagcggagcatctgcaggcccctgctgaattatacagtcagcaggacagaggttaattaggagccgaccagcagagtcacagttcagatggacctgaagcttccagtcaactgctgataatagcataatttccaagtttaagagcaatacttccagggaaggcttgtgatcgcttttcggggccagttattacctagaccatttatgtatataaactcaaagcattgttttgttttgttttcatctcttttgtttcaaagtgttgctcctaaagttgttttaagatttataaatttgtcagatcaggctgtgatagaaatagttgttatttcagccctagacatcttagggctgcctcgtgcac

SEQ ID NO: 475281 - DNA, 752 bp, Homo sapiens
acgttggggtcagcggagtggaaaaaaggcgcctagttccctccttctgtcttggaaagcatccttttgcattcggtcagggacgtttcccgctattttctcttttgttggcttgggcaggaaagagcgtgcgttcctcttttcattcagcccaaacataaaacacgaagcttcccgtgctttaggggacatgtggttgtgttctaagagccatctgcagaaggacggttttgggaaagctgcttccccagaacggagaaacgtctccggagcgagcgatctccggcccgcagattcaataagccccaaccacacttggctccgtcacaaacctaatacggcagcccatattgttgctcgggaagtctccagccaaaccgagttcttatggctaacccctcgctcccctcctttcacggtgcgaacgcgaagaggctcggctccggggggcgggagagcagtactgcgccccccgcttcggtgtgcgccaggcctgcggacgcccgggaggctcggcgcggcggggctcgctcggcctcgagggcgcgcggttccgagggcctgggaacgcgagcgcaggcagccgggcctcgccctcccccgggccgcccgcaagaagccgctcgcagcctccatacacttacttgcctgccttaagctctttattaactcccccagaggagcgccggctgcggccgcgcctcctgcgccccggtggtctggctcctccgcgcggcgcacatgctaaacag

SEQ ID NO: 475282 - DNA, 1926 bp, Homo sapiens
ccagtaggtgcctgagtgtccactggaatgggtctgcgggcagtcacctgatgtctggaccccttttacttcttccactgacctttgggaggccagtgtttcagaaaaactcggggtgggagctgtgggaaagcccaatactagtgaggcaagaagaagtgggagggattctgaaagagactgaagtggacgaacttgagatgccagagaaaagcctgggctgctctcctggcagccaagagagaagccatggtggtggcaaactgagcaataccagccacgactcgtggccacaaaaatcagtgtcgaagctgccaagccttcgaggcctgactttgttgcctaacaggaaacccatggagcaaaacaacctatactcctcccccagaatggttgaccactataaggaaactcagagagcctacaatgagagaaaacccacaaaaacaccaaaaaagaaacagaagaaccctatgggctgcccactcctcctctcccaatctgaccctgtcaagatccacttgcaccagaggagctaccgagctagccaatactaactgctaacacatacataatcacacctggattaaacagtcctctggggatgcagcccatctgtaaagaagggccagtttttagaatgttcttaagttttgggaaaagcttctattttttctcttttggtggaagaagcttgccccttccaagcccgaagcatgatgttaatttaaccacataaccacacgcagctaaacccataccataagtgtgagcacactaagaaccagggagacttctttcaacttctctcagtgtatcattatcttatctgggactatgctgccgctgcctcctcctcctctgcctcctcctccccctcctcctctgcctcctgcctcctcctcctccccctccttctcctcttcttctcctcctcctccttcttcctccttctcctcctcttcttctccttcctcctcctcctccttcttccttctcctcctcctcttattcttccctctcctcctcctcttcttcttccctctcctcctcttcttcctcctcctcctcttcttcctcctcctcctcttcctccttcctcctcttcctcctcctttttcttcctcctcgtcttcctcctcctcctttccttcttcctcctccttcttcttctttcttcttcttcttacaaaggcaatacttatttatgagaaaggcatacagtaaacaaaacaaaacaaaacaaaacacgttcctctcatccctcccctacaaattctattcccttggagtaaccatgactaaaccatttggtgcatatttttttaaatctgacacttgccaagactcaaatacatactccatggtcatgttttagttgttgctgtttttagctcttgttttaaaatcaacgttattgagagaaatttacacacaataaaatatgcccattttaagtgtgcagctgggtgaattttgataaatgtgtgcaccctcaggaccacttccacaatcatgatatagaacattctcatcaatcagaaattcccttgtgcccctttgctggcaattccccaccctggccccaagcaaccccaatctgccctctgtcattataggttggttttgcctactctaggatctcatataaatggaatcatgcagtatgtactcttttgtatctgtttttttttaataaatcagcatgtttttgagattcacttgtgttgctatgtgtatcagtagttagttcttttctattgccgagtagtattccattatatgaatgtaccgtaatttgctcatccactcttctctggctggacattagagttgtttccagtttaggggtgatatgaattgcctgaaaagctgttatgttgtttttaatcattaaaaaagtagagagagtaaattcaaatgtat

SEQ ID NO: 475283 - DNA, 635 bp, Homo sapiens
aaagacttctagcctccaggacagcaatgggtttaaggtcaaagacacaggcctgggctcagattcttgccctatcactgaccagctgtgcagttatagtgctgggccctggcaaagtcaggaggttgtgcggtgggttctacagagggccctgtccagacatggatgccctggggcttgggagagggcttccagaatgtggggcaggagcacagacaatgcgttctttcaacagtgtgcggctccatgggaaaggctctgctgaaagtgaagtggtggggtccacagctgcccctctgggaaggagtggtatgggggcaggtggggaccagatgcctggccacagccgagctggggatgagcacatggaacaaccgcttctgatgcagatagaaaagaggcttagccacagccgttcacctgccccgctaggccttccatcttcagttcatttcaatgcctcccgcgtcagttccgctccagtgctgcagcagacatggcatggggtgcaaaaggggcacatgccctctgtcttcagtgggtttgcaaaacttgtgaaagagacaggtttaaccacaggaaccatctgaggacaatacaacccagcatatggctcagtggggaaatgaactgga

SEQ ID NO: 475284 - DNA, 954 bp, Homo sapiens
cccacccccggtgttcacgcaagagttgacacagctgcacctgctgctgccgtatgctgatcctaaccagaagctggctgggaggagaggccccctgggccatgaagcagagctcgggaatttgtcgtcttgcctttattagtcacaatattagtcgtgaaagccctgagaagtacctagagaatccactgagctccaagatagccctttcattgggatgctatatctgctgcacagacgcagaatacagcaggcccactcctggttcattggccacagtaagccatgtggtcacagctgaattcaacagccagagacgtacagtcctgcaagggagcccctcaaaggaggtgaaggatcttctgaacagcagcaccagccaccctgcatgccagtttgtgaatggttctactagaaactatgcaacccagacgtcaaggaacagagataagaacgacagccgacttctctgcagaaactatgcaacccagacgtcaaggaacagagataagaacgacagccgacttctctgcagaaactatgcaacccagacgtcaaggaacagagataagaacgacagccgacttctctgcagaaactatgcaacccagacgtcaaggaacagagataagaacgacagccgacttctctgcagaaactatgcaacccagacgtcaaggaacagagataagaacgacagccgacttctctgcagaaactatgcaacccagacgtcaaggaacagagataagaacgacagccgacttctctgcagaaactatgcaatccagatgactgatgacatcttcaaagagactaaagacgaatgcggccaccctggaattctatgctaaaataaacatcttttaaaaatcaaggcataatagaaacattttgaaatcagcaaaagctgagataattcactgccagtagttcataatgaccaacaatgtt

SEQ ID NO: 475285 - DNA, 1449 bp, Homo sapiens
tctcactttgtttcccagtatggagaacattgatagtccttggcatgaactctttagagagttatgcaaaataaatgcatttgacacttgtgattcactaatcatcagaggcaaggagtttagtgactctatacataataccttttaccatatgcggagaaccagggaacataatgaagttggttggttgctcctgagttcactggacaaagtgaagaaaggaaatgatgaactcagggattctaactccctgcctcagaagcagaaactgagtctcaaatcttccaagattgccctgagagacctccggccttttaccacggtaactgtgcactggggaaagggaaatgatcagacatttcagggactactggacactggctctgagctgatgtttattccaggggacccaaaacaccattgtggtcctccagttaaagtaggggcttttagaggtcaggtgcacgagaagcaatttgccttcagctggcagggtgaggaatatacctttatcatcctacctcaggagtatatcaactctccgtctttgtgtcataatcttattcagagagaccttgatcgcctttcacttccgcaagataccacactggtccattacattgatcatattatgctaattgggtccagtgattttgagtggggtccagaacaggagaaggctctgcaacaggtccaggctgctgtgcaagctgctctgccacttgggccatttgacccggcagatccaatgatgcctgaggtgtcagtggcagataaagatgctgtttggagcctctggcaggcccccataggtgaatcacagcagaggcctctaggattttggagcaaggccctgccatcttctgcaaataactactctccttttgagacaaagctcttggcctgttactgggctttgatggaaactgaatatttgactacaggtcatcaagtcaccatgcatcctgaacttcctattatgaactgtgtggtttctgacccatcttgccatgaagaaggactacagatggcccagacccttcaggaattggtccactcttctaggaaaaaaaaccatggcctgctgaagtgcttgctgaaggcagagaatacagaatgggtagtagaagaagcttccccattggctgaacccaaccagaagcttaaattcacagaagccttttgggtaagagcagagtgtaaaggaggcataatgaatctgtataggccaaatagaaaatagctaaatatttcagtctaagcatgtatccttacattgtctgacaaatcttatggcttagaagcatggtatgctaacttaatatcttcttcactctactaatagaaaggaaaaacacctttgctccctgaatacatgttactaactagataaggattaatttacatttttatccctatcctctctattttttaaaaatattactcatt

SEQ ID NO: 475286 - DNA, 683 bp, Homo sapiens
atctaccagatggttgagctgccaccatcatgggcagacctaggttgtaaggtgaatgttgtctcaagatactctccagtctatttgctccctggagttaaacatgagctgctcagagaattctccttgactctcaggaggaatgtatggccgcagttccatgtggggaatcagcctacattacttgctgtcttaagcaatgagttgctcaatacccattatctgaggcccaacacaggattatcccagtgggaagctctgctaacacaggtggctgagcagcctggcggcaacaagcctgtcctggaaatatggagaacctcctgggagaagaggcagcaacctccagatccttccctcttcctgtcccaccagatttacagtgaagaagaagaatcaagtgtacatcccaatctgaattactgcattcaaagaaaaattaccactgctagccactctacaagaatagcacaagaacaagaaagtcacctaacttgaagacttggtgaccaaaactcatccagcaaagataaataacaaagaacaatattgctgattaatctcttcctaggatgtacaaagagaaaacacaaggaaaaacaatgaaaccatggaacctgagcaagaaaactaaagtcatagtaaagtaactaaagacaaataaaggaaaaaacaaaatgaaa

SEQ ID NO: 475287 - DNA, 805 bp, Homo sapiens
tctgcagcccaactaaaaacttgctctcacttcaatccagccaccttcctcccagaggaaactggggaacctgaacatgactgtgagaaagttgtaatagaaacctatgcagccatggaggatctcagggaaattcccctagaaaatccagactggaccctctttatagatgggaaagaagtagcagtaatgcattgtaaaggacatcagaaaggatcggatgaaatagctgagggaaataagttagccaaccaggcagccaagtcagcagcacgaaagcctcagagtgccaacacccttgaagcccctctaatctgggaaggctccatcagggaaataaacttcagtattctcctgcagaaacagaatgggccatttctcgcagattcactttccagccatcaggatggttgcagtcagaggatggcaagctccatttgccagcctccaaccaaggagaacctactaaaaacagtcaagcaggttgttaatgcttgtgaaatctgccttaaaaacacctccctcaacagatggcttcttctccatcgagctcagagaatgggaagttatccaggggaggactggcaaatagacttcacccatatgccaaaatcaaggggcactcagtacctcctggtgtcagtggatacgttcactaactgggtggaagcatttcgatgtcaaacataaaggacctctgaggtagtaacagtattaatcaataaaataattccccgctttggactccctaaatacctccaaagtgacaatggctcttcatttaaagcagctgtcactcagggga

SEQ ID NO: 475288 - DNA, 700 bp, Homo sapiens
cctattatgtgatatttgaagtagtctcagctttcttcagtgtataatggcccctgcttttgctagaatttctctccctaacaagggagtggggctttcaggcataattagaaaagcatgtgaaaagagtaaagctcccccatcacaacttagtgactgggagaagtatctagtgactgactgtcctaggacccctcagacagtgacagatctggaagacagttgtccgggacaggagagtaagactgagaaggccgcaccagtgtccaggagacagttaacctcctggccctcaatggtcaagcatacctggggctctgtgagggtgacggcatgggctggtgcttgccctgggcaccctcagtcctgctgctggatcatctgcccaattggaagtggcaatgggcgcctcgctggatcaggagcacagcagacaccctgctggatcctctggatggatggaagtcagcggcgggtctgcgacggtggcaaacagcagtggtggacggcaagcaaaagctcagctcgagacttgatcttcaatctctgatatcctttcttttgcttgattgattcagctattgatatttgtgtatgctttatgaagttcttgtgctgtgctttcaactctatcaggtcatttatgttcttctctaaactgcttattcttgttagcagttcctgtaacctttgatgaagg

SEQ ID NO: 475289 - DNA, 788 bp, Homo sapiens
cagccagaggcagagcagtgagatctgacagaagatacctaatgatcaaagtgaagaaaaatgaaggtgcttctcgtctgcatcccacagagtccagctcattaccaaacctgtccactggggccagtgatggccctcatccgtgtctgcactgtgtgtatgttggttatgaggggctcttctccctgccagaactgcagccaagcttctggagggcagaggcctgtcttcctccttaccatgtcctctacaaacctctgtatttggcgcatagtgggagctcacaaactatcgcaaggacaaaaaaccaaacaccacatgttctttttctttcttgccatgtgacctctacaagctggctcccctttaccatctgccatgagtggaagcagccctcaccagaagtagaaattggtgccatgcttcttgtacagcctgcagaactgtcacccaaacaaatttcttttctttatgaattacccagtctcaggtattcctttatggcaacacaaacagatcaagacagctagaaagtgatagaagaaaaatgtataaatgttgtttaaaatgtttaaaggtatttttattaattaagttttgtatataatttaatacattaatcaaaacttccttaaaggttattgttgcacccatgaactcgtcatttacatgtatacatatgtaccaaacctgcacattgtgcacatgtgccctagaacttaaagtataatttaaaaaaagttattgttaaaatgtgtcagttttgagaacagaataataagatttat

SEQ ID NO: 475290 - DNA, 512 bp, Homo sapiens
tctagcactatgagaatcagttttggaaagctgacgacatttggaaatacctggccacccttttctgagctctctgattcctctgctttttcagctttggtggaccagtggtgccagatagcaacttttattgaagaggccgtgtatggcagcagcagaggcactggtccttgtggagcagagatactccataggcagtgtgcccagagtagcagctcagaggcagttcttcagtcatatttatacccacttttaattacatgcaaattaagaggtgtacaaagcactaaggaaaagttcagacccctgagccagaaaacttcattttccacattaagatcaaaggagtatgcgggagagatgtggcattcccagtactgggggttctgttataacagggtcagagagagggccagaaagggaggagaaaagcaaaagactgcccagaaagtcagccagtgaaagcaagtgactcatgtatactttcatgtactcattaatgtagcaaatat

SEQ ID NO: 475291 - DNA, 1643 bp, Homo sapiens
ctgggtgacatctcttctgtttaattcttacatctttctcccatgttggatgcttcctgccctcaaacatcggactccaggtccttcagttttgggactcagactggctctccttgctcctcagcttgcagacagcctattgtgggaccttgtgatcgtaggtgaggttgagagtgtgacccatgaggaggtgtgttacactggaaaagaactgtttgaattctccaatttgtataaacagaaatctggagaacaggcatgggaatggatattaagggtatgggataaaagtggaaggaacatagagttggatgaagctgaatttattgatttgggcccactaagtagggactttgcttttaatgttgcagctcggggagttaaaaaggttctaatactttatttgcttggggactgctggcctttcaccagggtaactgtgcactggagaaagggaaatgatcagacattttggagactactggacactggctctgagctgatgctaattggaggggaccaaaaatgtcattgtggtcctccagttaaagtaggagcttacagagtgtcagaatgcatgattgccatagccatacttagcagctggcagagtccccacactggctccctgactggtaggatgagggttattatggtgggaaaggccaaatggaagccattagagctgcctctacgtagaaaaatagtaaatcaaaaacaatatcgcatccctggagggatcgtggagattagtgccaccatcaaggacttgaaagatgcaggggtggtgattcccaccacattcctgttcaactctctcatttggcccaccagaagcaattttccttcagctggcaaggccagcaatctacctttactgtcctacttcaggggtatatggactctccagctttgtgtcataatcttatttggagagaacttgacctcttttcgctttcactttgctatcactttggtccattatattgatgacattatgctgattggatccagtgagcaagaagtagcaaacacactgggcttattggtgagacctttgcatgccagaggatgggaaataaatccgactaaaattcagggaacttctacttcagtaaaatttctaggggcccagtggtgtgggacctgtcaagatattccttctaagatgaaggatcaattgctgcatttggcccctcctacaaccaagaaagaggcacaacgcctagtgggcctatttggattttggaggcaacatattcctcatttgggtgtgttactctggcccacttgtcaagtgacccgaaagcctgccagctttgagtgtgatccagaacaggagaaggctcctcaacaggttcaggctgctgtgcaagctgctctgccacttgggccacatggcccagcagatccaatggtgcttgaggtgtcaatggcagataagaatgctatttatagcctttggcaggccctcataggtgaatcacagtggaggcctctaggattttggagcaaggccctgccatcttctgcagataactactgttttttttgagagacagctgttggcctgttactgggcttgggtggaaactgaatgtttgactatgggtcatcatgtcaccatgtgatctgaactgcct

SEQ ID NO: 475292 - DNA, 670 bp, Homo sapiens
ctctctctctctctctctctctctctaaatcacacacacacatctgatgacaggcacagggctctgagcatcagccaatgcgactcatatgtctggaaatcctgctgctgctgctgctgctgctgctgctgctgctgctgctgctgctgctactggagaagtcttgtttggatgctctccccactaccatttggttgaggagtatattggtgggctttgtagttactagcggggacttggctttcttctgttctgcatacctggagcctagagctaatttcctccatgaatttcctcctgggagaagagcaattccggctgctttgcttgactggagtgtggagagaagaacactaggtgcttctggtaaagtctttgggtctggggtgatggccagtgctcttaactccagcccactgacccagtggggtggagcgatgcagggaaatgaggatgaggcaaagaggatgggaggatgggacctggagaagacctgtgggctttttgtgggccccaaatgcggatcgactatctgggctgcatgcggggacttcacctatgtgatagcccttttaaaagggtttaatcaacaatgttgaaataggcaacactgtctttttaagatcttgatttttaattttatatttattttccagttacaaaaatgaac

SEQ ID NO: 475293 - DNA, 540 bp, Homo sapiens
agcagcgtggctgaaacttgaatgtgcatgagtcacctcgggatcttgttagacataggttcttggggatcattcttaaagattgtaattcagaaaatctgcggaggggcccatgaatttgcatctctgagaatgctgatgttgccagtgcctgagcacactgcgtcatggtacactgcgtcagtgatcattagatttctcaagctgctgctgaagcccttgaagcagtgtgccctggaggcaggcttctttgaagatctgcgaaatatggccatagagaaaaacacgcagccatattttcctctctctcttcctgaacgttatatgacagcttgggtaccccacacaagactctttacccctgcatatctttccctaagagaatttttgatttgggaagaagaagggatagagaatgcaattaaggacccagggctagtgtggaacagatgaaagtgatttgtctttcaggaaggataatgagtttctgaaagtagaaatagtgtagggagggactggatttttaagaagcctgaaaaa

SEQ ID NO: 475294 - DNA, 554 bp, Homo sapiens
gatagtgttgcttttttcttgtaaacatgtttaagttcctcaacagtccactggatgaaggcaagatgaatcctttttctgctggtcccttccatcttttgtttctcactgtcaaagtccccccacagggcaatagccctctctctccctccttctctgggttgtgttgcctggcctctccaagcagccactgggaatgctatggcctctgtgggtcccatccagagacactcacggtgtgtcttgttggaggtggtgccaatggcaggggcaggggtggtcaccagggctacctagggcagctccatcagacaagcaaggagaagcaggaccaaacaactttgggctgttgcataaaccagcctaaggaaataacagataattttctgcaaaatttagcactgtttccattagtgaaatttgacagtgaagctgctcataccagagtataatgtatataataaaattgaaatcatggggtagaaaacattagtgaaaaatttaatgatatatttttaagtgaaaaaagcagattacaaaataatgtcatatga

SEQ ID NO: 475295 - DNA, 831 bp, Homo sapiens
tcccacagcagctgctccagatgggccactgccaccatcactacttactgacagagctccccacagtcatatcccagggagaatcctgaaggggctgagacccgcgtggctgtccggtcttcacctccccatcaaactataatatcaagtagatgatcagtagctgcaccactagaaagatggcggagcaagagcaaagaaaaatccctttggttccagaaaatctcctgaaaaagaggaaggcttatcaagccctcaacgccacccagtcaaagcaggcacttttggcaaagaaggagcagaagaaaggaaaagggctcaggtttaagcgactggaatcattcctacatgattcctggcggcagaaacgtgacaatctaaaaatgctgtgtatagtggaaccttatgtgacctggggatttccaaatctgaagtctgtccgagaactcattttgaaacgtggacaagccaaggtcaagaataagaccatccctctgacagacaacacagtgattgaggagcacctggggaagtttggcatcatttgcttggaagacctcattcatgaaattgccttcccagggaagcatttacaggagatctcgtggttcttgcgccctttccacctctcagtggcctgtcatgctaccaaaaatagagtgggcttcctcaaggagatgggcacacctggctattggggtgaacgcatcaatcagctcatccgccagctgaactagacccacgtgccaaactgtggtaaatttttatcaatgaagtggaagcatgtgttttgctgttttaggaatttttatcaagtatcttcagagaaga

SEQ ID NO: 475296 - DNA, 552 bp, Homo sapiens
ctgggcctgaacactttcgttgtgggtttcacagccgttagaatgttagagctggcaaggactttatcaccaaattcttatcaccaacacccctcctttagcagaggagagaaactgaagctcagagagtttctgttctccccagcttccggttctctccctgcctttccaactacagcaggtcctccaataatgtcgtttcattcgatgtcatttcctcataatgttgatgaagaaaaagaaggggccactgtggagttcgtgtggtctccccaggccaagtccaggttctaccacctttttaatgttttccttgattgctgcagtgataacccaattattcccctttactcccaaactttttctgattatatcctaccatgtagcattgcacatcatagcctctcatatggttctctggcttttccttagaattgtgttgccttcttaattatatttaatgctctttgaaggcaaggcttatgtttatatttttatcatatatactattcccctcccatccgttggaaatatgttcaaagaccctcagtc

SEQ ID NO: 475297 - DNA, 599 bp, Homo sapiens
catcttctcacttataagtgggagctaaacaatggggacacatggacataaagaaggagataaaaggcactggggactccaaaaggggaggcttccctcagctgtctgtgtccttggctgtctgctcatatctagcactggaacacaaaaatctaatgggaatccctggcaatgccacactatatggttctgttgctgggctatttaactgggaaaaatcccagcatgagtacttgggtcatggtcaggggaaggtctgtaagactaggagtgatcttggaacatccaaaaaggacacaggagagaaaagagagagaaagaacaagggagaaggagaaagagagaagaagagagaaaaagatgagaggagaggaaatgcagtgactgtgccagaatgtggtgccctccgcttcagtctggcatgtcagcaactggctgtggctgttggctaatactactcagtggtgctcgtgttaattccctttccagtagaaatttcttgtggttaatatcagcagctaccatgtagcaagcatcatgcgggcttttacatttactctttaaaacaaccatgtgaggtaggtgaggaaaccaaggct

SEQ ID NO: 475298 - DNA, 667 bp, Homo sapiens
caaaagtaaggaagcgcactcacttacatggttgttggcattggtcgtttgactggagccctctgttcctcaccatgtgcagctttccacaggctgcctgagtgtcctgacacatggcagctggcttctcccaaaaaaccaagcaatgacattggaggcccatctggtctggagcatgacaggatgaagcaggatgaacaggtcaaggcaagaggttcaggctggaggctgtggacagcaggtcctggatggtacccaagaagtgctgccaggatgggaatagaatctaaaggacactcaactaagaatgagaactcacttctgcaagaatggcaccaagccattcatgagggatccacccccatgacccatatacccccaagcagaccccagtcccaacagtgggggtcacatttcaaaatgagattgagtggagccaaacaaacgatatccaaaccgtagcagtaacaaacaacaatcaacacctgtgactcagtcaccaacagttgttgctaatgctttgaaacatcatttaagttcatcaccattttgaagacacaatacttatttaaatccatcagtagatcttatttaatgtattaataaagaagcatctaactatatcacatatttttaaaaagtatttgataactattcttcagtataa

SEQ ID NO: 475299 - DNA, 1717 bp, Homo sapiens
gaacccagacactgccctccgttgcctctccccagcgctcccaccttttcgggtgtgaagctccacacctgcctccatagcactttgcctgtccctaagagggctcatcggagaagaaagaatggctgtcagccacctgccaaccatggtccaggagaccctgaagagtgatgaacttgtcacagaacgccagctccctgtgtgccagcagtcctgtaaatgcgcacaagctcctaggggctgccagtctcttttccagagaaccatgtgcaggggtagcccctggtcaaggagaatgaatttgctgttgcaggaatcggtgaccttcaaggatgtggctatactgttcacccaggaagagtgggggcagctgagccccgcccagagggccctgtacagggacgtgatgctggagaactacagcaacctggtctcactgggactcttaggacccaaaccagatacgttttcccagctagaaaaaagggaagtgtggatgccagaggacacccctggaggcttctgtcttgtattcgagagagcttggtgccttatccaagcactgtagcgtctccctgtcagctagcattttgcaggctgtggagtatttttataaaccttttgctacagattcttcacgacgtctatagatctaagcaatatttgctttgccgttgcgtgctttaaaacttaacatgtatgtactttactgtagaaacctttctacaactggcttttttcagatccatgttgaggcacgtagctctaggtcatttctgaaattgcacttttccttcagtgatataccttactttatccagtctcctgctgctggctgtgtaagttatttccagactttttactattatggataatgctgacctgaatattcttgtatatgtttccttatatacatggaccttgtttgggagtttctttgcgtgtattcatagatgtagagtgctttcggtgtcctgtttaaatcatctttcctatcttttgatccatgagggaaggactttgtcttgtttgctcttgtatcttgggcaatactaggtctcagtatgtatttgttgaataagttaatttctaataatatttacctttttcttttttttctgtgtaaatgttgtcaaaagtttgtcttttattagacttttaaatgactaaacatgtgactttgctgatcctttctatttttgtttattttattaatttttgttcttcactgtttccttcaacttttttggagtttattctgttttttcccccttttctttattttaagcatttatttttaattgaagtaatacaagcatttaatgaaactgtatgaggtttgtggtgaacaatggtggctctttccccccacttccccattttcccctctctagaagtagccactccctcttcttttagctgattatttgatatatttgcttccatttctgcaagtgacatgtttgtgttgctacctcttgacttttcagttttagacatgtattgaattctttctatacgaagtgaggcttaaactcagcccctgccccttcagtgactcctgcttgttggatttccattcgctgtcctctcggttgtagtgtagctttgacttggtcagtagtcaatgtttacattcttaaacactagtcataactgagctgtgtcggaaattatgaccacttttgctttcctaagcaatgtattcctagaattc

SEQ ID NO: 475300 - DNA, 1260 bp, Homo sapiens
gctgagggttatcctctagacccccagtgacccatctcgcccctgtggctgacaagatggagctccgaggagggcacccaggtccccaggaagccttgccatttggtcatcgccctccgtttcctctgtaaaatgaggattgcagtccccccatcacaaagctgttgtggggatgaaaccgtcatgcaggtgcaatggaatggtgcttgtgcaaacaatgaaacggtttttcattgctggtcatacagaacagtcctgacatctgagaaggaaggaaatgcaaaagagcttgatcctggctgctgcctgggacctgagaggggacaggttcctagcacaccttcttcttcattctttaagtatgtctatttacctgtattccatattattgtttccatagcagcaggtctgaatctctttctacaaactcagtgcaagaaactgatgtcaatctatttcccacattttcaacttgacccctccctctgtgggaatatacatctgaacccctctggtggggaattcaaccttcattattcttgaagacttttctgtcacaagattgttgccaagtttctggaggactgtaatgtggtgctaagcaagcaggagggagttgcacccagttgcttcttcactcccgttgtttggcaagtgggaggaagtgtcacagctcttttatttctgccacccacagcttgaaccttcatttgatcattatccactcaccttcccttatgctttgtgaaactcttgggcatttctgtattaccagctacttaaaaaaaaatcctgttttaaaaggcataaatctattaatttgccgtctgtttaagagtcttcaatagcttttgtaatgcaaataaaatgaaaattcttgtcgtggttcccaaggacttgtttggtttcagtcctgacttcctattcaccatccactcatgtgcccacctctgctgctttctcagctccagcggcgacagcttcttcaagttcttgatgctgttcaagtgcatcaaaacatgctcttccccacagcctttgcagagactcttttctctgctcttcgtaaaattgacttcttatccttcatgactcaacttagaagtcagttagttgaagacttttacactactcttctaaagtagattctataatgctgatctcaaaatcggcactattttatccccctttttacttagcatagaacgaactcatatgtatgttaaattgctaacctacatatatttttaattccccact

SEQ ID NO: 475301 - DNA, 537 bp, Homo sapiens
ctgagttcatgcatttgagcgctgtaacacagagtgatgctacagaagacttggaaaattgaggatccagggacttatggaagtggggacactggtgggtttcaaacacaggagggcactccagcaaggtaccattttgaaagcccagcagactgcatcctaccctgggaccccacagaccttgcaactccagattccttgagccccattgacctccccctaacgcagaccctgctgcttctggctgctgcctccatatccaatgtgggggccactggaagctacccaccatccccatcagcagggtaccgtacatttagaagcaccctgagaacaggctaccccaccagcaactaccacctggggccaaagtgtgtgctcccagtggccctcctaaggcttctgccaatgaaagcaaccccagcaacatggctagggtgtagctgctggtcctcccatccaagcattccactgagggcctggaaatcaccacgcccctgcctaccatagctagtgcctatatataccatcgggggg

SEQ ID NO: 475302 - DNA, 1832 bp, Homo sapiens
aggtcctcagaacatgtggaacgtgggtgtgggcacagacagtggctgccaggagtccagacagagcctgtctaggactctggcctgttcccaggtcaaggaggcaggtccagcagggagagaggcccagatggagggatgggaggcccctgtcagtttattctcaggcacctaccccagtggctcaagtgggggagatgagccagtgacaggagggcctagtgcagccaggccaggggctcccacagtgtcagcagggtcttgtccttcggtccttctcaccctgctccccacacaagacctcaggagctccaggctcctgctggctcattcaccccagtgggttgggggacagagtcttttgcccaaaacttccaggcagcgtcccagccctgatcattctcagaaggaagtcaaggggctacagacaccagtagacctacagaaagggacccttgagcagaaacacataacactccagggcacctggtctcctcaccaaagactcaccactgggggcaccaaggcaggcaaggagagagccccaattcatgcaggaaggcagccagtttcctctgctggccctccagggcagtggtctgtgcccttgacccaggccagcaagaccaggttcttccccatgggagcatatcctcccctcgctccatctcaggactgggaacaagatctgcaccagccacccctggagctggtggagggctttgcacaggcatggcccaaagcagacccaccgtgggatggagctttccaggggctacccccttctagctcccattatcagtcccacaatctccaacaggcccaggggagggagattctgagggccggccactggaacaggaaacctgtgcaaagagtttgggacttcttgatgcccaagcaatgaaatgctgatttggaggcactggctcttgtcacagaagctgagaggtaggtcaggaagtcaccctaggtacctctccttcactgtccacacccaaacaatccccaagtcctatttatttgacctccagaggagtctcaaatccatgctttctcttcctccccactacaacctcctggccaagtcatcattctctcccatctggactctgagttccctcactgtctccccaagtcttcttcagcctgttctccactcaacatcaagcacagtccctggcacctagtaggggctcagcttacactcatgccgtggacggacatggctgcttttaccttccagcaggccttggtgcaggagctttgcttctcagggtgtatgtcatacccctggatggtggggattgttgctgctatttttggcttgctgggaagaaaaataacaacttgtcctcattattaaaactggaggagaaatactacttcaccagagtaggtaggaatcacagtgagaacacctggtgttttggccacaggtccacttagtagatggtctctggttggaattatcattgctcatgtcctaccctgtgggaaaaaaaaacattttattttgaaataattgtacacttgtaggaagttgcaaaaattgtacagagtcccttgtaagcttccctcagctaatcttaatgctgacatcttatataaccacagcacaagatcaaaaccagggaattgacattgatattacaatgctactagactctagaccttattcagttctcattattgttgagatggtaatcattcctctctctctctccgtttctatgcaatttcatcccgtgtataaattttgataaccaccaccacagtcaagacacagaactgttcatcatcacaaatgcacacccttgcactacctcttc

SEQ ID NO: 475303 - DNA, 2343 bp, Homo sapiens
ttcatgtggagacaaaggctcatgtgagaacaccggctgggctgggtccctgtgtcagggaggtggcagcctgcggcaggagaagcaggcagtgcagatgccagatctcgcggcaagatgcattctgcttgacaccacccacggtggcgcaccggcagctccacaccccagcctcgatgctctgggtctctctgaagatgcccgccctggggccgacatccttgtgtgctggaaggccctgcttagctggcttcacccacccgctgctgccctacgggcccccttgggcatctgaccctttctgtgaaaggagctccaggcagtgccctgagaccatggctcgggcagagcggtgggacatgagagctcacaggcacagcggcagccttcatcctgccttgaggagtcacagtgctcctggccccgagctgcagagaaagcagggcgtggccacagagagtggatgtctgtcttggtgggtggtcgctgtcctgttagccagcagccaaaacgggggcctatggcaacagtccagatgtcagaccgtgggctggtggggaggccttgggaggcagagtggcgaaggtagaaccttgctcctggccctgggggcagcgtgcaggggccatagaggctgcctgagcaggtggggctggaagccaccgccagccgcctttgccaaagtcaccctgctgatgatgccttatttctccattgcttactgaaaccataaaactggacattttatggagaaaaaagcaagctccattctcctgaactttaaatgcccatgtagctctttcatgagaaagacatgtgtctgccattgcataaatgcacacatatatggacatttcagccaggaaaattagccatgttgagctgacgggaaaggctcatctttactctgcccaagcatttttattaaggatggaaggatgcaggcacccaccctctattccctgcctccccggtactggcatgaaacgccttttgtatgttattttgctgagtgtgcaaaacaacttcctgaggcacattgtagttttgttcccattttatagactaggaagttgaggccgggcatggttagcaccttcccagggtcacatggctggacagtgctggggcctagcctctgcagcaaggaccaacgaggccctagctggggaggtgggagtcaccgcagcagccccgacctgccacttccttcacctcggagtgtccttagaaacgtctgagtgcaaatcctgaagctgaattctcgtttctggctctggacagcttcactcatccgctctggtcgtcatgtcaaagttcaagcaggcagacagacttgattagatttgattttatcccttgtttgaattattcatgcctctcctctaatctccccgggaataatttaataacgcacggcagcaggagggcgcctgggtgagtggtgtctgcgacgtgctggccaagaactgccgccatggctgccgagcaggggctgccccacactctctactttaaagcagagcccgccctgagtatgcagcacccaggaccccgcttgggacagtttccgggcaggtagagctccagcacctgcacagtcctgcatcctggtccctgacacttcggcttccagcactctccctagtcctgtgcctggacccctggactctgctcctgtcatctcccacccaggccacgttcccacagccccagactgtgggggagaaaaccccagccacagttctctcctgtccagatccttccggaggtacctacgtatttctcttgggcaaggtcccagctcattggcctgggactgtggtttgaatgtttgtcccccccacagctcaggctgaaatccaattgccattgtcaaagtgttgagaggtggggcctttacaagatgattaggcctcaagggctccaccctcaagtgttcagctcctttcctctaggagctgctccccacccctcccaggcatgggccacagcagccaagttcaggccacgtggtcctgtcgcctcggccacattcatctggctggggtggataactgaccctagcgtggccaagcagatgccttcttctaggaatttgtaatggaagcgaagattctaattgagtccgggctggggggtgaacccaggtgaagggaactcaggccccaggtcaacagccctgcatcataccctcaccctcagagaggcggcagaaggaagggacggaaggcgatgtgctgggagctgcagacgggacctggggcctgggcctcacatgcattggcacaaacttacttgttcataatcatctcttatctttttttttgtttctttgcaaaa

SEQ ID NO: 475304 - DNA, 1253 bp, Homo sapiens
agacaggaacgatgaaatgatggccaagcccttccctccagccttggatgagctcctgcctggagacccccgccctagcagcctccctggcccggccgacctcattcctgcaggcgagagggtgcatgtttctgagagttcccagctggagtcgctgatctcagggccgagggcacgggctgctgacagaggagagaaccagggcctccgcctgctcaggcctgctgcgacaaaacaccgaacactggatggtttatacacagcagaaacttcgctctcacaccgaacactgggtggtttatacacaacagaaacttcgctctcacagttctggaggctgcgacgctgtgctctcttcctctccatcccaccccagctctccttgggtgggcagatgcaccggcagcctctccgagagacctctatgccttcttaaaagacaaacttacacaaattaaatttagcagagtttaactgagcaaagaacgattttcggattgggcggcccccaatcagagatattattctaaggatagaattaaagctggccaccaaaatttagctctactgattttcatcaaagcattgttcatgacaatgaaaactctcaacgtataacaacagtgaatcggttgagcaaaatctttggtcattaaaaaccatgcagtcaaggagcaaaagctattgacatgtgaaaatgttcccgataagctagggtctgagagcctcgttttcatggctctgcaataccccgctgtaggaagtaccgttattgacctaacgaaggacgctcaggctgtttcccctccttttcgatgaaggttttgcacagttaatttggcacctgtgtgtgtgatgatatttgtagataaagttctagaaatgtgtgaagctttgtatccagaaatttgggttgaaatcaccaaagcaccctccacggcagacacaccaatcacactccagcagacactgtcctgaattctgtaaatcccactgaggagtcatcctggaaatcacacacttgtccttaactcagcaaagttggtgtcgaccaacaccctcatcttcctcccagatgacacagagaccgtggaacaccctcatccccgcttatgtgtcactgctgttgcacatttaaattgtgtctttttcctgtgacttccagggtctgtttctagtgtctttgtcagtgatatcagatctaaatattttccccagtttgtctttttttaattcttattttggccatagag

SEQ ID NO: 475305 - DNA, 1431 bp, Homo sapiens
tgagagtcagggaaccaatttagaaatcgattgatccttgagttgtaagataaggaaagttggaattagaatggtggctgtgggaatagaaagcaagggatggagtcagaaacagggccgacttcataggcttgaagtcatgcctccaatctcagacgctatgtccaccaaaggctccgtggttctggcctacagtggcagcctggacacctcctgcaccctcctgtggctgaaggaacaaggctatgacgtcattgcctacctggccaacattggccagaaggaagacttcgaggaagccaggaagaatgcactgaagtttggggctaaaaaggtgttcattgaggatgtcggcagggagtttgtggaggagttcatctggccggccatccagtccagtgcactgtatgaggaccgctaccttctgggcacctctcgccaggccctgcatcgcctgcaaacaaatggaaatcacccagtggaagggggccaagtatatgtcccacagcaccacgggaaatgggaacaatcagaaccaagcacctccaggtctctacacgaagaccaggacccggccaaagcccccaacacccctgacattctcgagatcgagttcaaaaaaggagtccctgtgaaggtgaccaacgtcaaggatggcaccacccaccagacctcattggagctcttcatgtacctgaacgaagtcgtgggcaagcagggtgtgggctgtattgacatcatggagaaccgcttcattggaatgaagtcccgagggatctaccaggccccagcaagcaccatcctttacctcgctcatttagacaccaaggccttcaccatgggccaggaagtgcgcaaaatcaaacaaggcctgggcttgaaatttgttgagctggtggataccggtttctggtacagccctgagtgtgaatttgtctgccactgcatcgccaagtcccaggagcaagtggaagggaaagtgcaggtgtccgtcctcgagggccaggtgtacatccttggccaggagtccccactgtctctctacaaggaggagccggtgagcatgaacgtgcagggtgattatcagccaattgatgccaccgggttcatcaacatcaattccctcaggctgaaggaatatcatcgtctccagagcaaggagtactggtttttgaataaaggactgaattttcattttgctctggactccatgaatgatgtagtcagccctagtcagaagatgttttgctgggagaatcaacaggactttgtgattcaccgtaagaaacaatgtagcagtcaggatgacatttgattaaacaggtgaaatgcaaccattttcatatatgaaacagcatccccctttaagaaaacagacttctctgaagcttctcttacagctctccttggattagttttattctgacttga

SEQ ID NO: 475306 - DNA, 890 bp, Homo sapiens
gttgtcaacttctgatggccagccactacactcctcgtcttcaaggctctcgtctcctttgcaaacttcttaagctacgactgcactgattctatcatgctaactagagttccttggtcttccaagactctcagttgcttctcctcgactccaagtcctgcatctctgcaccaggacctggaaactctcctcagacaatatggtccgtattgtttggtcacagctatgaggagtaaaaagaagatgtcttcaaaacataaaaaagtacaaaatgaagtaacaaatgctgatgtagaagctgcagcaagttatctagatgatctatttaagataatggatgaagttggctacattaaacagcaaaatttccatgctgtggctgccatagataagaattcctctgatggaactgggaagactatattgaaaacattctggaagggactcacaattatagatgtcaatggcattaagaacatttgttacggaggtcaaaataccaacattaacaggagtttggaagaagttgattccaacactcatggatgaatttgagagatttcagacttcaggggaaagaagtaactgcagacgtggtgaaaatggcaaaagagctagaagaagtggagactgaagatgttattaacttgctaaaatctcaggataaaactcttggattacctctttgctgccctaagttctttatcttgcttctctcttcatcttaactcacacttgcctataagcccgtccacctaatgagtaatcaaataacactttcacttaaacttcatatttactatctgtacacattttaagtttagagagatttggctcttttaatacattatggtttgaggtatcatttctaaaactacttttcagaattt

SEQ ID NO: 475307 - DNA, 585 bp, Homo sapiens
gagaattcctacagccagaaagttgtgagggtttgggcggggggcggggccacttgcttcagggtgatgggaaacatgataagaccaatgaattccaagaccatgagcacattagcatatgttatgtgctataaaacaaatttcttggtcagaagcaatgctgtgctgaataccatgaagaagcttatactgagtttggtaggactcactgccaaagtattgcctggtctggagaaggtagagacaagggagagttgggatttctactatttcctactagcatcatttgtctgccataagatgccaaaatgcagggccccagatttgcaaggtatggaattagagcacaaggctattgaggcagtaacaatcagcttcttggcatcaaacactggtggcccatttttcatgaggagactaggaaatggtactccatattcattgcttccacccactctaagttctgatttctcccctaagcccttgattggtgtatagcaaacctagtttgttttatcataggatggttgtttccatattaaattctagtttctgttatcctgtatgttttagaaccaaggtgac

SEQ ID NO: 475308 - DNA, 557 bp, Homo sapiens
tgctagcactgccatagaattgctcagggtcctcctggaaccataagacatcccgggcttctgtttgaagctgaaggttaaagatgaggccagaacaacctgacttcggggtcacaggcgcccccacctgggtgctgctgcggggtccccatggagcttgctcctgccagtggccaaaccagccagctggatcccgcactcatttgctcacacctggtttggctgcagggcccacatggagcttgctcctgctagcggccaaatggccggctggatcctccactcacttgctcacatgcttcctcctgcaaggggttgagcaccatgggctgagtaaatggggcacccccgtcgcaaatccaacaaagcggtcgagaaaaatcctgcatcagacagaggcatctcagcaggctggctccctgggaacacagatggagctcgagaggagtaggttcaggactgtttctgtgaatggagaagaggtttcaaagagatttttctgaaatttcattctctggtttgtttgtgtgctgtacaagtaagatggatcacatgtt

SEQ ID NO: 475309 - DNA, 596 bp, Homo sapiens
cctgaatctgggtcacatgcttatatcttagctgcataggagatgggaaaggggatgtgtcattttcaggtttcttgtttcacaataccaaaatcttatggagctacaatcaaattggttcatcttggttcaaatttccagccctgtcaatcagcaggactggcggtggcactgattagatatgactgccgaagccgatcccttcagaagagaccaatgctaaaggaaagtgtatgtgccaagtccttggagatctttccattcaataagccaaggagaaaagatgccatgcagatacacccaaagtgtgtccctcttggttgtggcccatctttactgctcgctcctagtgtgcaagtttgggcttgtgattgtgtttatagcaagaagagccgcagacaaaatccttcagacaccaagttaaagaaggaaggggtttattcggccgggacatcagcaagactcctgtctcaagagccaagctccctgagtgagcaattcctgtcccttttaaaggctcacaactctgagggggtctgcctgagagggtcgtgatccattgagcaagcagcggatggagtctcactctgtcacct

SEQ ID NO: 475310 - DNA, 603 bp, Homo sapiens
aaccaggtacctcagttggaaatgcagaaatcaccaatctttgatcacgctggggactgcagactggagctgttccttttcagccatcttggaatgctgctctggaggaacctgtggagagacagtctaagaccatgcaaatatccttccagtcatcaaaatgtccctctagatttaatatccattgatgaattttgcctgatccaaccttataaaaatgctttcttaagtcacccagtgaatctacctggctccgggctggtactgagtgttgtctgcacagagtcctgtgatgtaaactgtctatgggtttctgatctgtggataccagcgcctgttccaggggagatggtggagtgtgcagtggactccatgagggtccttagctttggtgaaagcatcagctatagtagttacggaaagggaccggtggtgggcagggccctggaactcccaagattatattccctttgtcttccactaccagggtggatcgggaagcaccatcagaatcccacagtggatatgttggtcaattgatggtgtttcataagttccataggctttcttcactgtttttcattctttttcactttgttcctc

SEQ ID NO: 475311 - DNA, 653 bp, Homo sapiens
tggagaaatttacaagagttttagggcatggatgggatgtgccttggtactgagggcagatgggcagctctctctatgtggtctatattagtgcgaatatcacagaaagtagtgattaatgagaactgggagcctgagggagagacaaaggtttcagggaggagtaagaatagggtcatcaactcaacccagtttgccggaaatggaaacatactgaggatgattaccaaccacataccacaagagaaacatctgtacacaaacgtggagcacatcattaatgccaaccctggcaccattctcctgtggcaagtttccttattcctcacagttattgattcatgtgctttttctgggctctttgttgaaaagatctgtgatttagagagacacaactttcatgtgaacaagcatcacctggggattgtgttaaaatgcagattcagtaggtgtgaactgaaatactgcacttttgataagttcacagatgctgttgattctgctctggggaccacattctgagcaataagagcttagatctgtgctgtccaatatggtagccatgggtctttcgtaggtattgagcacttgaaatgtggctagtgtgacagagaattgaattttaaattttattccattttaattaatttaaa

SEQ ID NO: 475312 - DNA, 1185 bp, Homo sapiens
gggcaccctttctctgaagatgagaagaagaaaccgaaagactaggagatatggagttttggacactaacatagaaaatatggaattgacacctttagaacaggatgatgaggatgatgacaacacgttgtttgatgccaatcatcctcgaagtgttgaattcctggggttctttgtggcccaggccattgtccaaaatcaaaagaactttaaaagtcagtcccctactagcaatgtacttctggacttcagggacaaagcatcagtggaaccagtccagaaaaagagttttcagtgtccaggccttcttcttgtacaactaaaagactggcagctggtgtttgtcttttcccttcaaggtttggtggttagcagctttgtatataagaatgtgccttttgatgaaagaactttatctttctacaatgaagagtggaatttctatgtttaaggaataagaagccactatatcaatgttgggggtatttaagttacatatattttaacaacctttaatttgctgttgcaataaataccgtatccttttattatatctttatatgtatagaagtactctgttaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctcttaaagtggtccaaattatgtgtttataaaataaacataagactatagaattaaaaattaatatatgtatttgtaatttgtcggaaaatctatcaaaatgttattctattttagcaactactatgtaacatatctgctttgattagatatttcagaaatctgtgaattttacagccatttaatatctttactgtatagtaagatgtagaaatggcaataatggcatagttcaaatacttcattgtgtt

SEQ ID NO: 475313 - DNA, 892 bp, Homo sapiens
caggcttcaattgtcatgtacaaagaactatgaattctgagttgatctaaaactctacgggagctctgctccgggctggctgctgcactgcgattccaccgggcacgcagccctgcccggagatgagaggggccaaaaacagcctcgagactctcatgtcgatgagtcaatggctgaaaccacagacgggctccagtcccctcaagaagacacagatgctaccgacggtgagatccaaagcggcctgaagctgtctggagatgccagcgcctgtggaggttgaagtacacacgcccagggcacccgctgcagcccaggccgcctccggcagctgctgaaaacctaggattccatcaggaaggaacccggaaaggagaggaaccccagcctttctgcaggcctgcagcacgacctgcttcaactgctgccctggaaggagtccgaggcactccaatggggaccctcatgctgtccctgtggacatttgcactggaactattctcaggaggagcgcacaaggtagatcccttgcatgtgcagtttacagtaggcttcgtgcacctacgacaatctaatgtctctgctgatctgacaagaagtggagctcaggtggtaacgctgggctgctggccactcccatcctgctgtgccacggggctcttaatgctaacggtagagggtgtccaggttcttggcgtcttgaagaaagaattggacaaaatgcgcaagcaaagcaaggacggaatgaagggatttattgaaaacaaaagtacactccacagtgtggtagtgggcctgcgcataggggctcaaagttacagagtttttgtgagtttaaataccctctatttggggtacgccctatgtaaatgaagaggatgaagtaaagttt

SEQ ID NO: 475314 - DNA, 498 bp, Homo sapiens
cacttccccgtctgaggagaacagcagaggcagcgggaaagacgcaggaggaagctgggggtgggattctctgtggacatggctgtgaaagtcatcaggggatcggtgttgttgactctgtccttgcaggagaatggagctgagaaccacagagcagaggatccctttgttttgagtgtgaggacaacgtgtccaggggccagtgtggcacctcccataactgacctggtgactcagcataaggtctccaggacggaagagcctgcacaccatggctggcacagaaccataaaacttgtgagcctggagcctccagttcttatctcagtcctgtttctaccttccaggggctccagggcaagtgcctgccacctcagcgtcctgcctctgcccactgatctgacctccccttctagcatcaacccctcgcccactctgttccagacacgggcttcttttctgtacacaccacatcccacgcttgcctagggtgttcac

SEQ ID NO: 475315 - DNA, 569 bp, Homo sapiens
gcagctgaccaaagatataggagtctcatgcagttgtggtggtatggtgtgggcctgtgcttgtgtgtatgtacacgcgtgtaacatgtgcctgtgcatgtatgcatgtgtgcatgtgcctgtgtttgtggctgccatgacaaaatcacaaactgagtggcttaaacaacaaaaagttactgtctctcagttctggagactggaagtcagaaatcaaggaggggctgacccatccaggaaaagggctttcccacaagttgaccagaaaagttcacaaaaccaaaacctctttttaaaggacgaatatcttctggctccacaaatacggatacttataccaaacagaaaggttttacttgtggcagttagagagaaaagagggttggggcagcagacaagtaaaccagaaactggatttgccccagtaggaaaagccatttgttttgagaagcagagatccacaggatatttgcagatataaaattgaaaatttggattgacctttcttcacattttctagaaaatcattagcttaatctctgatatatgcaatgctttttctaatcctt

SEQ ID NO: 475316 - DNA, 519 bp, Homo sapiens
taacgtacaatttttaagttctagttatcataggtggtgatgggataaaagatgtttacacaggagtgtgatctttgtaacttcacttcagcctctggttggctgctttctgcaaccaatcagactgcttgcaggctaccacttcatttacatgaggccctgacaaccaccctctatcctgtttctatgagttcaacatttttagattccacacataaaaatattcatgaacatgatagctcatgcagatatgttgatatttctgaaacatgggtggaaatactttcctgctgctgcacttttgacctgagctttcctgatgatatgtcaggactgatgtttccacttgccaggagttcaaaagcttcttctcaaaaccagcttgttaatgtttccacttgccagagaattttatataaaggatttgcctgaaatggataattttatgagaactgtttgccttcatatggcacttgaagagaccacttggaggacacttcagactctaaaatatagagc

SEQ ID NO: 475317 - DNA, 606 bp, Homo sapiens
gctggtgatataggtaaacagggtctggagtgggcctccagcaaactccagcagacctgcagaagaggggcctgactgttagaagcaaaactaacaaacagaaaggaacagcaatgacatcaaccaaaaggatgtccacacaaaaactccattcgaagcttaccaacatcaaagacccaagggaacaaaactggatggagaatgagtttgacgaattgatagaagtaggctttagaaggtgggtaataacaaactcctctgagctaaaggagcatgttctaacccaatgcaaggaagccaagaacgttgaaaaaaggttagatgaattgctaactggaataaccagtttaaagaagaacataaatgacctgatggagctgaaaaacacagcatgggaactttgtgaagcatatgcaagtatcaatagccaaatagatcaaaccaaagaaaggatatcagagattgaagatcaacttactgaaataaagcatgaagacaagattagagaaaaaagaaggaaaggaaacaaagcctccaagaaatatgagactatgcgaaaagaacaaacctacatttgactggtgtacctaaaagtgatggggagaa

SEQ ID NO: 475318 - DNA, 554 bp, Homo sapiens
gcagcaatatatgctattctgcaatatttgctgttctgcagtctctgctggtaatacccaggcaaacacggtctggagtagtggacctccagcaaactccaacagacctgcagctgagggacctgttagaaggaaaactaacaaacagaaagaaatagcatcgacatcaacaaaaaggacatccacaccaaaaccccatctagcagaaaagctgaaaattccaaaaaccagcgcgcctcttctcctccaaaagatcgcagctccttgccagcaacagaacaaagctggatggataatgactgacgagttgacagaagtaggcttcagaaggtcagtaataacaaacatctctgagctaaacgagcatgttctaacctgtcacaaggaagaatctcatatccagccaaactaagcttcataagtgaaggagaaataaaatcctttacagacaagcaaatcctttacagacaagcaaatgctgagagattttgtcaccaccaggcctgccttacaagagctcctgaaggaagcactaaacatggaaggaaacaacc

SEQ ID NO: 475319 - DNA, 734 bp, Homo sapiens
gaatacacatttccagctgcaatttgccttcgcaggattgacatggcaatgcgggttcttttttggttccatatgaactttaaagtagttttttccaattcttcaggaccctcagctgcaggtctgttggagtttgctggaggtccactccagaccctgcttgcctggatatcagcagcagtggctgcagaacagcggatattggtgaaccgcaaatgctgctgcctgattgttcctctggaagttttgcctcagaggagtacctggccgtgtgaggtgtcccgcctctactggggggtgcctcccagttatactagttggggttttcctgagtggtcttatctgtcctgtgcctttacagctttcaatataatgacttccaactgtagctcagtagaatttggagactatttacagatcctgcttattcctatgaaccaaccagtgatctctggctgcaactcagaaaaacaagagggatgagtaatgtaaaaacaaaaatctgaatcaaaattctaattctgggcacatgttggaatcagctagcaatcccacatcagcttggttccaacaattgcctaactcatgggaagccttcttatttagtttatttgggataattttgctattttgctttactgttgttgaatatattgctgttgtactctctgtgtaggaatgcaagataaggttactcaatattctcttgaatggaacacttattaatcttccag

SEQ ID NO: 475320 - DNA, 3143 bp, Homo sapiens
tgggccgcctctacttgcagcagcttgctaagtccagtcaaagaggaacaagttctaacccaatgcaggtttaaaacataaccaaaagaacaaaagagagagcttgacacaccaatcttgaggtgttgtgccattctctgggaacatacagatgaaatgacctgaaccctgcccaccatttaaccaagtaagaatacaattctctctcatttaggttatcacgctataatagagaatggactcattaatatgggattacagaggaaggaatggttaagaaaaagacatggcctctgactgctccaaaaaaggataagcagggcttcacagaagaggtgacaggtaataaagatgattgcacgtgtctgtatatgtccctttttttctattgtgctcagaacattatctttcactcaaaaattgttatcctaattgtcaaaaactatgtggagatctaagtgataaaaccactcagggttgggcagggacaggatttttctaactctttttcctttcatcacaacgggtagtatattttatattaaaagcagaagctcactatatgctggtgtttaatgcattggtgaaaatcagtaatttttctatgttagataataagtatgcaattaacatatttttaatttatagcaggtttctggatggcagatcattcaaccttctttttcttgagttttctactctgctgtcatcttccactcatttctgcttcattttgtgattcgttaacagaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggcttaaggcatgaaatctcagttgaaacccaagaccacaaatctgctgtcaggggaaataacacacacgacaactatgaaaatgtggaagcaggtcctcccaaagctaaaggaaaaaccgataaggaactatatgaaaacacagggcagtctaatttcgaggagcatatctatggaaatgagacatcttctgactattataacttccagaagcctcgtccttctgaagttcctcaagatgaagatatatacattcttccagattcatattagcttttcaaaatattgacttttgttattggatgataaatattcactgtaatttttcaacagcaaagacaaggaatcaaactaaatgttgatcaactgtagactggataaagaaaatgtggtacacatacaccatagaatattatgcagccgtaaaaaaagaacaaaactaacatgggaacagaaaatcaaataccacatattctcacttaaaagtgggagctaaataataagaacacatggagagaaggagaggaacaacagacactggggcctacttgagggaggacagtggaaggagggagaggttcagggaaaaaaaaaatatcaggtactatgcttagtacacacatgatgaaataatctgtacaccaaacccccaagtcacaagtgttcctacataacaaacctgaacatgtacccctgaacataaaattataattaaaatattaaaaataattcactgtgatttttattgtactgatgccattcttaatcaagttctgataagtggatggtctctgcctatctccacctttctgaatcctatgtgtatcgctgtggattaattctagatatcttctccaccctccttgcaccagactaaatctgtattatgtgatattgattcttccttctaaatattacccgttatctctttcctttatttctaccattatctttatctggctcagaattattgtcataggctcctaactgttcctcctgcttctagtttctacccactcaatcaattaccgatggtgttgccagatttatcttcagaaaatattcctaacagccacattatttctttcacttaaaatgttttaatgccccctctttgcaaaagacataatacccataatttgaactccaaaatttatggttttccacaattggttccaattcacttttccagtgacttctcttactatctctcatttctttgccttcagcagaatcatcttaaaacctgccaaacttatccttccttcacagctttgcttttctgcctcttctctcaagcctgcttcagatcataagttcttccacacatctcctgaatcactccaaacccgcatttacctttttattttctgatataagctttgatgcctcttcaattcttaggacatttaaacatatgaatgttgccacagcattttattacctagcttcatatgaaaatgtcttaaattcccacctaaatgaaaagaaactgcccaaatgcctagaacatcacataaggcactaaatgcctcatgttttactgacgggaattgaattgtacattttgctgagtagttttgagaaaaaaatctaataaattcatctgttattcatccatacaaggaatatttgttgtgtcttctatctacttgctattgtgctgtgcacctgagggacatgggaagccattgtggctggagtttcctgaggaagggttggagtgacacctgctgcgttggtgaaggagggaatgggagaccatgagcttctcataagtcttagtacgtggctttgactctattataggtgcaacgggaatcagtaaagggttttaagcagagacgtgatgatgacactagcatttttaaaagatttactgggttgagaagtgactggaaa

SEQ ID NO: 475321 - DNA, 1335 bp, Homo sapiens
agcggagctgccttgatgggcgactcgtcctgcaagcatgatgaccatcgtgagcgaattgcggcagagtgtaacactgtcctccaggtcctgcaggacctgcttttggagtacatgggcaatgctggatgtaaagaaagaagtaattccctcaattctgctatagataaaatgaccaagaagaccagggacttgcgtagacagctccacaaagctgtcatggaccacgtttcagattctttcctggaaaccaatgttccacttttgaaagatgtggatggcctggactgcacagctagtgcaattcaaggttgggcagcctgggccattcacatagtcacctcagagatggacaactatgagccaggagtctacacagagaaggttctggaagccactaagctgctttccaacacagtcatgccatgttttactgagcaagcagaagcagctgtggaagccctcagctcagaccctgcccagcccatggatgagaatgagtttatcaatgcctcctgcctagtatatggtggcatccgggacatcaggaaagcagtgctgatgataaggacccctgaggacttggatgactcttactttgagatggaagatttcaatgtcagaagtaggatgagcatccagacaaaagacaatcagctgatagctggccagagtgagcaaaaagcgaagactgcagaacaggtggccagcttccaggaagaaaagagcaagctggacgctgaagtgtccaaatgggacaacagtgccaatgacatcattgtgctggccaagcagatgtgcatgattatgatggaggatggacaagcttggctgcaccatcacagaccactgccccgactcggcctgcaagcaagcccggcctgctcgactcagcctgccctgacttggcctgctggcctacctgcactgcatcgccctctactgccacctgctcaacagctgcagcaaggtcaaggccgagatgcagaatctcggcagggagttcattgtccctggaatggacagcgctacgtccctgatctgggcaaccaaggacttatgaatgctgtggtgcagacaatgaaggcatcctacgtcgcctctaccaaataccaaaggtcacagggtatggcttccctcaaccttcctgctgtgtcatggaagatagaggcaccagagaaaaagcccttgttgaagagagagaaacaggatgagtcacagagcgagattaaatgggcatctcagaagaagcacttgaacccggtgcaggccctcagcgagttcaaagccatggacagcatctaagtctgcccaggccagctgcccccacccctc

SEQ ID NO: 475322 - DNA, 786 bp, Homo sapiens
ggtgtcagccatggaagctgcttgctgtatgcctagcccagctgcagcctcacagggagcctgtgcctgtaccagcgcctggagctgcccgccccactgccgcccacatgtgtggctgtgtgcagtggctggaccccaccctcgatcacacactcctcgctgctctgtgcctggccaagcgggcagaatgaacccagtgggcccgagcaaaactcggacagaggaaccactggccacagaggtttccagctggcaaagtgacagcccaaggatcccaggtgatgtcggcaacatcaatcgaaacattaaatgcacatgccttttccgctcagaaatttcacgtctaggaatctactcaacagatattcatgtatgtgtggaaagatataagatagtaactgaagcattatttaaaatcaaagtctagaatagcctacaagtccattaacagaacattaaatcaatattagaacacctgtataatggaacatctatatactgtacatctcttaaaaattagctgaatatgtgctgatatgggattttctataagatccgtaatggagagaaaagcaaggtggagaacagtttgtatagtaagtgcccttttatgttacaaatgcgtgtctatattttattgttttataacagcaagatgctatggaaactatataataaaccattaatagtaactatctctgacttggattctgtgggaggatagtcttttcaattcttcaaataagtaaacattttttcagtgattgtatttagggttggtgaggg

SEQ ID NO: 475323 - DNA, 815 bp, Homo sapiens
ggctgctagcacattgtcacctctcgctgctagcacgttgtcacctctcactgctatgcaaatgtactctttgtttctaccagtgttctcagacggagatgaggagattgttgggaacaggagcaaaggtgacccttgttatgctttagcaaagagactggccacattttgtccctgccctagagatctgtggaactttgaacttgagaaagatgatgtagggtacctggcagaagaaatttctaagtggcaaagcattcaagaggaagcagagcataaaagtttggaaaatttgccgcctgatgatgcgatagaaaaatttcagaggctgtatggaaatgcctggatgtccagacagaggtgtgctgcaggggtggagcactcatggagaacctctgctagggcagtgaagaagggaaatgtgggctcaggacacccacacagcatccccactggggcactgcctagcggagctgtgagaagagggttattatcctccagagtccagaatggtaggtccacatacagcttgcatcatgcacctggaaaagctgcaggccctcaatgccagccagtgaaagcagctgcgatgggagctggtgggttgaaacggcttcgatatctagcctccatccccgagaagcagcactttagcttggagacctaaatctgaaccaaatcaattttttttgtagtatgaattaaaaggaatgttacttttcccttcctacattgtttgattttaaatttctgtgatttttaagagtgtatcctgatttatagaattactcagaacctttctagaaatgggctat

SEQ ID NO: 475324 - DNA, 1075 bp, Homo sapiens
gtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggttacccactagacatttgaagttctacaatgaacccatcggagatgcaaagaaaagggcctccacggagatggtaacaccagtcacatggatggataatcctatagaagtatatgttaatgatagtatatgggtacctggccccatagatgatcgctgccctgccaaacctgaggaagaagggatgatgataaatatttccattgggtatcgttatcctcctatttgcctagggagagcaccaggatgtttaatgcctgcagtccaaaattggttggtagaagtacctactgtcagtcccatcagtagattcacttatcacatggtaagcgggatgtcactcaggccacgggtaaattatttacaagacttttcttatcaaagatcattaaaatttagacctaaagggaaaccttgccccaaggaaattcccaaagaatcaaaaaatacagaagttttagtttgggaagaatgtgtggccaatagtgcggtgatattataaaacaatgaatttggaactattatagattgggcacctcgaggtcaattctaccacaattgctcaggacaaactcagtcgtgtccaagtgcacaagtgagtccagctgttgatagc

SEQ ID NO: 475325 - DNA, 4777 bp, Homo sapiens
gtggaggcttttctctagggtgaaggacaagtcgacgagagatcccgagtacatctacagtcagccttacggtaagcttgcgcgctcggaagaagctagggtgataatggggcaaactaaaagtaaaattaaaaaacaaggaacttcagatctaaaagattggaaaagaattggtaaggaactaaaacaagcaggtaggaagggtaatatcattccacttacagtatggaatgattgggccattattaaagcagctttagaaccatttcaaacagaagaagatagcatttcagtttctgatgcccctggaagctgtttaatagattgtaatgaaaacacaaggaaaaaatcccagaaagaaaccgaaagtttacattgcgaatatgtagcagagccggtaatggctcagtcaacgcaaaatgttgactataatcaattacaggaggtgatatatcctgaaacgttaaaattagaaggaaaaggtccagaattaatggggccatcagagtctaaaccacgaggcacaagtcctcttccagcaggtcaggtgctcgtaagattacaacctcaaaagcaggttaaagaaaataagacccaaccgcaagtagcctatcaatactggccgctggctgaacttcagtatcggccacccccagaaagtcagtatggatatccaggaatgcccccagcaccacagggcagggcgccataccatcagccgcccactaggagacttaatcctatggcaccacctagtagacagggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatgctaaaagatatgaaagagggagtaaaacagtatggacccaactccccttatatgaggacattattagattccattgcttatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctaccctgattttgtggcaaggctccaagatgttgctcaaaagtcaattgccgatgaaaaagccggtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgggagcccccacaaaaaatccctacaggggtatatggcccactgcctgaggggactgtaggactaatcttgggaagatcaagtctaaatctaaaaggagttcaaattcatactagtgtggttgattcagactataaaggcgaaattcaattggttattagctcttcaattccttggagtgccagtccaagagacaggattgctcaattattactcctgccatatattaagggtggaaatagtgaaataaaaagaataggagggcttgtaagcactgatccaacaggaaaggctgcatattgggcaagtcaggtctcagagaacagacctgtgtgtaaggccattattcaaggaaaacagtttgaagggttggtagacactggagcagatgtctctattattgctttaaatcagtggccaaaaaactggcctaaacaaaaggctgttacaggacttgtcggcataggcacagcctcagaagtgtatcaaagtatggagattttacattgcttagggccagataatcaagaaagtactgttcagccaatgattacttcaattcctcttaatctgtggggtcgagatttattacaacaatggggggcggtcactgtagagcctcctaaacccataccactaacttggaaaacagaaaaaccggtgtgggtaaatcagtggccgctaccaaaacaaaaactggaggctttacatttattagcaaatgaacagttagaaaagggtcacattgagccttcgttctcaccttggaattctcctgtgtttgtaattcagaagaaatcaggcaaatggcatacgttaactgacttaagggctgtaaacgccgtaattcaacccatggggcctctccaacccgggttgccctctccggccatgatcccaaaagattggcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagtgagagaaaagttttcagactgttatattattcattatattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaaatagaaataagaaaagacacattaaaaacactaaatgattttcaaaaattactaggagatattaattggattcggccaactctaggcattcctacttatgccatgtcaaatttgttctctatcttaagaggagactcagacttaaatagtcaaagaatattaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtggagtggtcattccttcctcacagtacagttaagacttttacattgtacttggatcaaatagctacattaatcggtcagacaagattacgaataacaaaattatgtggaaatgacccagacaaaatagttgtccctttaaccaaggaacaagttagacaagcctttatcaattctggtgcatggcagattggtcttgctaattttgtgggacttattgataatcattacccaaaaacaaagatcttccagttcttaaaattgactacttggattctacctaaaattaccagacgtgaacctttagaaaatgctctaacagtatttactgatggttccagcaatggaaaagcagcttacacagggccgaaagaacgagtaatcaaaactccatatcaatcggctcaaagagcagagttggttgcagtcattacagtgttacaagattttgaccaacctatcaatattatatcagattctgcatatgtagtacaggctacaagggatgttgagacagctctaattaaatatagcatggatgatcagttaaaccagctattcaatttattacaacaaactgtaagaaaaagaaatttcccattttatattacttatattcgagcacacactaatttaccagggcctttgactaaagcaaatgaacaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcatatgttcatgtaacagttgatacttattcacatttcatatgggcaacttgccaaacaggagaaagtacttcccatgttaaaaaacatttattgtcttgttttgctgtaatgggagttccagaaaaaatcaaactgacatggaccaggatattgtagtaaagctttccaaaattcttaagtcagtggaaaatttcacatacacaggaattccttataattcccaggacggccatagtgaaagataatagacactctaaggacaggctcaatttc

SEQ ID NO: 475326 - DNA, 850 bp, Homo sapiens
gaatactacttggcttggattcctggaaaagatactacctgacttggacccctggtatgatcgtgtccctgagaggcttgttttcaatctgcctggtgctcagagatatcgagtgcccacaggacaatgctgtccctcccactggtgatgaaaggtactgggaacttgttacctataaatgccaactgaccctcagctgcaggtctgttggagtttgctggagatccactccagaccctctttgcctgggtatcagcagcagtggctgcagaacagcggatattggtgaactgcaaatgctgctgcctgatcgttcctctggaagttttgtctcagaggagtacctggctgtgttagatgataacttccaaaaatccaaggaatatagttctgaaaaaaaaatagacttcatcaaattgaaaaatgccttctgtgtgtattacacatatttaaccacagaactgggactaaaacaaatgtggtgattagaataacaacacagtatatatatgtatttactctaatgatgtggaaatgacacaagaagcaaagttagagaggaaggagagaaggggttgcagaaaagttagcatgctaaagactttatttctaattgctaatagtcgaaggttatttaaaatttacaaataaagaatcatatggatgcttaagatttaagatataaagacaagcatgcaagacttgcgcactacaaactacaaatattattgaaaataaaaaaataaaatgtatttaagtggaaaaacatcccatgtccccatgtctatggacttaatcttgttgtaatggcagcattccccaactgatctacagattgaatattatactt

SEQ ID NO: 475327 - DNA, 1860 bp, Homo sapiens
ccatttctcatgagagtgaagttactcagcagtctgacaatgacagcacgagttatgaagacaaccatccagaacatgttcagtgactgcaccctgcaagctctcagcaaagtaagcaggcactgcttggctggggtagctcggtttctgggctcccagttgggcctgggttggctccagctctccaactcagaactgacagctggcacccacaccctcctcctcagcttccgggatggcctgatgggcaaagagaaagagaatggaatctggatgacagggctgggcagagcgagtccagaatgctataagcctgtttgtcctcctcttctggccccaggaaaggcttactgggtccagtgtggcaccatactaaggactcgaccctgggtccttgattattactgcaacagagaaattaatatcttccatggctgtgctcatcaacagaaagaagcagcacaagccgaggctctgcctctggccttccaaatcacatgtggagtccccagtctccaggccacagactggttccagtctgcagcctgttaggaactgagcggcacagcaggaggtacatatggatatacatcccttcatgtacattgtagcataaaaagaggcatctcactgtgcaggtcaagctgctgctgcagccactgatgtacccattagaggggccacccaatgggaagaggatgaactgggcatgaagagccctgagcacctatcttcttccaaggcaatataattatgacagaaataatgttcacagattttaagtcaacaatgaccctcttaaatattcttattatgagttttgtaaaggtttgtgttttatcttttctctgttaataaactgagaggttgctgagggtaagaatttggtgttactcacctttctatccatgggcctagaacagtgcctggagccaaaaaagagctgacactgtgaagtgaaatgaagtggaaacttgctctagtctcctgaatctttcagaggaatcagttgtctcctttttgcttaccttgctatactttcatttgtaatactctggtcactctttcgaatgcctcagggacataagttgccggttcagtgggaatggggggaggaagaaatttatagaaatgttttctaggttgtattatttatgaatttattggtggtatttattatattcccaatagatggagagtttcaatgttttttaaaatgtcattttggtattcttagcagcaagcctagatcaggattttgtaaaaaaaaaaaaaaaaaaaaggaacacttgaaaaaaaaatctctaaaatagaatattaatattaagaagcctagcataaattcactgatgtgatagatatgtttatttctgcaaaaacataaagtaaaaatcagagcttagctcatttgataaaatcatatttgtttcatagcaattttttttctttcaacatctgccaacaatttacccaatgagatatttagttagaacaggtgtctgtgctaatcttaacatttgcagttgctcacattcatttttaattggagcattaaataaagacaattagttttaactggaagctaaaatgaggttttaaaatttataactgtcagaagccaggtttaaaaaaatctccccattaactttttaaaatatattcttcgccatcctccaacagaaagtttagaatctaaacaatcttgcagcctgcagataagaatgttagattctaaatctgaatgcagacatgggaacaatgaaattttaaatgcaattggtctccaaatttaatgtgttgtcaacaggaaatataataagaatgaattatattgaatatctctgcattcagagatttaaa

SEQ ID NO: 475328 - DNA, 568 bp, Homo sapiens
atccatggacagcttacaccatgtgcttggaaaagctgcagacaccccacaccagtgaaagcagctgggagggaggctggctgctgcagtttgctgggggtctgctccagaccctagtctcctcagaccctccctcaccaggtggtatcaccagtgaaggctacaaaacagcaaatatggtagcctgctccttcctctggatcacacctaaagccttgcagaccattacagtactaaggcttgtactcaacgctcatcatggccactactcgccactggttgccactgatgtttattcaagacccaagactactttagtcaacggatggaaaatcctaccagaactggtggagggagtctgccctggagctgcctggagttggggagaggataatgcagacactctcttggttgccacacctggtttcaaacttggttgtaccccaaatccactgcctctgagaccagtgcagcaccagggcttgcccgaggactgtagtccttgtgacctgactgccactgaaattcgttccaggccccaggccactttggtcagccagtggtgaag

SEQ ID NO: 475329 - DNA, 1205 bp, Homo sapiens
gccgtgggtcttcaaaggcttgagggtgatatttcagctgcgatatgaaagataagatgaagccagttatagaaagatttaggagaagggcataccatacagaagaaatggcaggtgcaaagggaaatagaaaaatggagcagttggttgccagagggccagttggagtcaagggaggatttttgaaaggaggagacacaggaacatgtttgatggaaatgatcctgtgtaaggtggagacagctgttttctcccacacagtggaggagaggttgaatactaagctgtggtgtctggctgcctgtcagaacaatagtaaactgcacacctgtcggctcttggcaagcagggatgaagttgccacagacaccccaaccattagcaacaaccaccctgatcagccaacagtcataaacattgagtctctttctctctttctggctctgttgctactgctccaaataatagtcctggaaaaatcaagagagaggttgactggccagagagctgtcatcccagcaaaagcacctcctgtgaccccggtgtcactctgcttggatgagggtggcatggaagtcagtggtcttgaagaaggagaaggaagaggagaaggaggaggaggaggagaaaaaggaggagagggattaaagagagtacggacatgtgacccaacaggcccattcgaacatttcctgagagtattactggagcttttgaaagagggctccgtgtcattgaggactgctagctctagtgctctgagctgccatgggctgtctttgaccccaggtcgaaagagcttgtcaaaaaacaaattcgatgcagagaaaaactgaaaagagagacagagaaatgaataattctgtttattaaagtcagatgtttgtcctttccttaaaaacttatctcacttgttcaaagttgacgtttcactccattagaattgggtatgtatgttatgcacattggagagtgaattattgagcgaaccagaaacacagaacttctttgctttgatatcatattactgttctctctgtttacttttggagggtgacttatatgtgaatacattccagggtaaaatcaatgtctccatttttttcagtctatactttagtattggccaagtgttgtaatgtcagtccttgttcctaaaaaaaaaagccacgaattacctgatgtcctaagaaagcagatgcagc

SEQ ID NO: 475330 - DNA, 2089 bp, Homo sapiens
gcagaggaggcacaactagagagactcctgactgaaaatagcagaataattcctgactaaggaggaatggccatgtcacatctctacataccacagaagattgatggagatacctcttcctgggcctctctgaatccgcttcatcagatgtgtgacatagcctgctatcttgttgcagagcttcttgctggggataatggcgatctcctcacacacgcgcttgttcgtgtggaagtcgttgcccaggcacgtgtagtacttttctatgatgccccaggccgccttcttcacggttttggtgcgaatgaggcccatgttggcaggtccttggtaaaaggggcaaagcatatgaataaaactcatctcaggcttcaatcctcacagcctagtgaaagagtccatccttttttgctgtacgaacagcagtcttggtggttagcagcgcaagacaccgagttaaagaaggaagaggtttatcggccggtagcatcggcaggactcctgtctcaagagccgagctccccaggtgagcaattcctgtcccttttaagggctcacaactctaagggagtccgcatgaggaggtcatgatcaattgagcaagcaggggggattgatagaagatagatagatagatagatagatagatagatagatagatagatacatggatgactgataaggaaggaaggaaggaaggaaggaaggaaggaaggaaggaaggaaggaaagagggagggaggaatgggagggagggaggaaggaaaggaaggaagggaaggaaagaaggaagtaaggaaaggagggagggaggggaaaggaaatgaaggaaggacagaaggaagtgatgatatacgaaaggttattaaacaaaatgttgttttcatcccgtaaatagccccatataaccaacttctgatcataatagctctcaagcaaatcaggtttgataatttttattcaaattttctatagttttattttaaattttgcttacttaatgcatcagtttttaaaacaagcacgtaaattcgcagattacaatgttaatgtacattttctcacatttttagtgatttctgccttaggaaatttgaaactatggtgtacataacatcttgtaacgaatacatttcttgttgaattgaaccttttatcaacatgaaacatattgttttttccctttaaataatcttaatattgagttctattttctctaatattaatatgttataatagcctttgttatcattattgttattagtatttgcttagaatgtctctacccatccatatattttcacctttcttgagtcattccattttatgtgtcactcataaaaaacatatatctggtattcatttttcaaagctgtgtttctttgtttcatgtggagtcatttaaaccatttacatttatttctcatactttgtacttgtcccagtcatcatttttgtgtgtattatatttaccatgctttgttattgactcttattttaccgtttgacaaattttttggattgattatatttcttttacatattatatttattccacatttttccttaattggttggtggttattcctcttatttctgcttttctagtagttatactaaaaattttaagacatatttcaatgtatgtcaaatttatgaaaaacttatgtttaaattattgaagcctagctttaatgagtacttgtaacttcctgtctcctcctctgacctctgagctcccacaatgttgaaattatatgagattttagtacgaaattttattgtgttttaaataattctcagttataaattatgctttctttgctcagtactgctgtttgttttccatatctttgaagctcatttttaatattgctgaagtgtgttctgtattaattattgcgtggttcacaaatggtatgtttttaagtgtttttgttgttataaaatgtcttaatttacctttctatttgaataacgggtggatggatgtggtatggaacacaattctctcagtgctctgcaaatgctaggtatacatattttaaagtttcctcttggttgctatattaatcatgtctcttcagat

SEQ ID NO: 475331 - DNA, 584 bp, Homo sapiens
tacaatttggctttaggtgaaatagaggaagccttctatgctgttaggattctagggcacttcaaccatctagcttaggaattaattcttcatggaagaacgttttcagtgggaacataatatgggaagaattactcatactcactattgcccatcattacatataaaagtacagttcttttctcgttttaattgtttaaaatgtgcaaagattggtaatttatatggaatcagaaaaacccctatgttgttcctacagtccaaatttgaattttcactctatgttggcaagattttcttatctatcctggtgagagatttgggcaaaagtcagaccgcctgctgcctgaaacacctgactgaacttggaagtactccagtcacagaaggcttagttgcttctgtcctgccctggcccacgtctctggtcctcatgctccaaggagagcaggttgatccctaccatgccccacctttcatgctacgaagcagccacaaagttaaatattcctttctctaagtggcccatgatctcactggccatatggctgttcgacagagcattcacgactctgattgctctt

SEQ ID NO: 475332 - DNA, 921 bp, Homo sapiens
aacaggtacgtgtaattgtggcacctgtgggtgaactaggcagttcaagggagcagtcatgattcactcattctggctctgttgtttggcagctgcagaactgtgggcaagtccgttaaccatttggtatctcctcatcaatggcaaccacaagcaggcagctcatcctctcctaggacctatcttcaacttgcaccatgggcagtacctgagagactccaaatccaacaccggcagggggtgcatgtcccagttgcacacatgtagtcaggctgggagtgagttggagccaaaagagaaggaactactttcccaggattcccactggctgtctcttgcccctagagagaggccacatccagctggaatctggcagggactaagtagggattctggttctgggagcacacagagaaagtctccttgtctcttgaatatctccagttccttctgtgggacttcctctgctccatctgatgtccttcgagtcttgtcacagcatttcccaccttgacttgctgtttacttaattttttcttactattagacttgtagtcattaatagcatggactctggtcttagactatctgagctaaaatgctgctctatcacttgtctcagggtccacatctgtaaaatgagggtaaaaatcactcttccttaatagggatgttgtgaggattcaatgaatttatgcagaaattctcgagtgtatctgcttagagagggtctgtggttggtaatctttccagtccttgcatgtcagtgattttattttgcccttcaactttaatgctagtttggctcagcatacaatagttttcttgcagctgttctcttttcagcagttgaaaaccagtgaatacccctaaatagctgtcatttttgttctggtgctgcttttcctttgatttcagttt

SEQ ID NO: 475333 - DNA, 1808 bp, Homo sapiens
gcctgcgctgcaaccacgtaagacatgattttgctcctccttcactttccgccatgattatgaggcctccccagccatgtggaactctgtagccacggctagaaggggccaacgtacagctcaggctgttgcttcagagggtgcaagcaccattcctcggcagcttacacatggttttagacctatgggtacatataagtcaataaataaggtttgggaacctctacgtagatttcaggggatgtatggaaatgcctgtatgtccaagcagaagtttgctgcaggggtggggtcctcatggagaaactctgctaggacagtgtggacgggaaatgtgcggttggagttcccacacaaagtccccactggggcaatgcctagtggagctgtgagaagagggctactgtcctccagactccagaatggtagatccactgaaagcttgcatcatgcacctggaaaagccacagacactcaacgccagcctgtgaaagcagccaggagaggggctttaccctgcaaagtcacagaggtagggctgcccaaggccatgggtgcccacctcttgcatcagcatgacctggatgtgagacatggagtcaaaggagatcattttgaaaatttaaggtttaatgatggctctattggatttcagacttgcatgtggcctacagcccctctgttttggtcaatttctcccgtttggaatgggtatatttacccaatgcctgtacccccactgtatctgggaaaaaccatttcacttcagccaaaagagctccctttaacactgcttactagcgtagacctggtaccaatgaattttcttcgagtttcccttaccccagctttgtacttgttaagatggagtgatgactttcaagctgtttacatgctgaaccagaaaccagaagtctggaggcttttaaagatgtttctcttcatcactagttgtcagcaatttgattatgatgaacaaacctgctgcaattgcacatatgtttgactgtttaatattgtcccataactcactgatgctgttattttttcaagtctgttttttttttctgtttcatttgggatcatttacatctgtataacttcatgttcactgatctttcttttttcagtgtttaatgggctcttgaattcagtatatttttcatttcagctattgcatttttcattgcttgaagttccattcaattcttctttatttcttcgatttctcccctcattgtgtccacattttaaaaatcatttgaacaaatgtagcatgtttataatagctttttaaatacacttttctgataattccataatctctgtcatttccagatttatttgttactaatggatttttctcccaggtatggattgcatttttcagattcctattctgtataatttttttgtataaaagaacattttatataagtaaataaaatttctgtataaattttattttctgtataaaatataaactattctgtataataatttttattgatactcagacatggtgaatttcacattgcagagtgctcaattttgttgtctctctttagtgagtatgcagagattgataatcaaccaaagttgcaagggactccatgaacacttctatagcagttaatcctttgtaagcagaaggagaagtcactatatctatgtttaatgaagatagaaagagatgcagaaatgttgcatcatgtttttgccctcaacttttcaaatcccaaagacttaaattacctacagttatttttaagaaatacatttgaaaatatttatgtattaagcatttt

SEQ ID NO: 475334 - DNA, 1013 bp, Homo sapiens
tcaaactaagacaaccctaataatgagcacagctattgcccatatcttggcttctagatgccattctccactaaagaacccaaagtttctactgaaagtggactattttgatgacgtgatgagtcctagactctcaggattcacagatacacatcagaggattaaaggggctctaagcatggggtttaatctcagagatagggctcagcccagccaggatccagacctcaaggagagggtcaacttgactggggctgctgcctcaaaaactcagaggaaagccccttggagctggactcagacctctgaggaggaggctctggccagctgccgctggtatctctgtggggaacacactaagctggtctgggagactgagggaagaatcctgagaactggaattcaacagccactgccggaaggaaaaaccattgctggggtgataccgacggaaactggaagcaaacaggaaggagcaagcaagcaccttctttctcttccaaccttccacgtccctcaacacccctgttggcagagctggcaaagccaaaatgtggtttacatagtccgagtcctaacatcacaaagcagagcattaaaaggtggttttggaattgagagacaatggcttactcaccaactcagtgggatccctcgaccaaagttactgggatcaggtaactttggtccaagtgtgggtatgacagaagatgagcctataaaggttagagatggctatgatgaaccttcactgatataccagagggatgggatattattggcagagaggagtcattgaagtattttaataggaatgagataaagagattcctgatttcagaatattaacagggctggaatgtattaaatgaattatgatgtctgggagggggagataatacaatgtttctcatttatgatcaggttatgtactgataaacccaaaatattttaaagtagaaagtgcatttttggcatatgatattttcaatttacaatgggtttgtttggac

SEQ ID NO: 475335 - DNA, 1085 bp, Homo sapiens
gcctgttttgtttctctgctctgtctttagtgttgaaaagttcatggtacttgtcttcctatgatggtcacagttggggaatttctgccactgcggaggagccaaccagctggctctgagcctgtatttcatagcctcactgtcacaaggctgctaggccttatccacaggccaatagctatctttttgaaggcagacccgacaaatgcatggggcccacagttgccttcagaagctagccatgagggggctggtgagcaagcagacactggccttcctgtcctcaacaaagctactgtcccccagtgggggctttgctcagctggctgctgcctgtccttggattacacaggcataaatgctctggcctcttgggcttctggacagattctagtgggcctcaaagggcttaatactgaaaaagctaaggcagctggagctcagcgagtgagaggtggtgctggcgttggagagcaacggcccacacctgggtatgtgacagaagaagtttctcagcagcaaagcattcaagatgtgatctggctgtttctaaaagcatatagtcatatgcattcacaaggagataatcagaaattggaacttatgtttaaaagggaagcagagcacaaaagtttgggaaatttgcagcctaatcatgtggtagaacagaaaaacccattttctggggagaactgtaaacttttggctgcagaaatttgcgtaactaaaatgaaactgaatgttaatagccaaaataatggggaaaaagtctccagggcatttcagagatcttcacagcaatccctcctatcaaagacctggaggcctaggagagaaaaatggttttgtgggccatgctcagggtcctgctgctctgtgcagcccggggacatggtgccctgtgtcccagccactccagctccagccatggctaaaaagggccaagatacagcttgggccatgactgtagagggtgcaagccccaacccttggtgacttccatgtggtgttgtacctgagggtgcacagaagcccagagttgaggtttggaaacctctacctagatttcaggggaggtatggaga

SEQ ID NO: 475336 - DNA, 1523 bp, Homo sapiens
aactgggtggagcccaccgcggctcaaggaggcctgcctgcctctgtagaatccacctctgggagcagggcatagctgaacaaaagacagcagaaacttctgcagacttaaatgtccctgtctgacaactttgaagagagtagttgttctcccagcatggaggttgagatctgagaactgacagactgcctcctcaagtgggtccctgacccccaagtagcctaagaggcacctcccagtaggggccgactgacacctcatacagccgggtgcccctctgagatgaagcttccagaggaaggatcaggcagcaacatttgccattctgcaatatttgctattctgcagcctctgctggtgatacccaggcaaagagggtctggagtggacctccagcaaactccaacagacctgcagctgaaggacctgttagaaggaaaactaacaaacagaaaagacttccacaccaaaaccccatctgtatgtcactatcatcaaagaccaaaggtagataaaaccacaaagatggggagaaaccagagcagaaaagctgaaaattctaaaattcagagcgccttttctcttccaaaggaatgcagctcctcgccagcgatggaacgaagctggctggagaatgactttgacgagttgagagaagaaggcttcagacgattggtaataacaaacttctccaagctaaaggaggatgttcaaacccatcgcaaagaagctaaaaaccttgaaaaaggattggacaaatggctaactagaataaacagcatagagaagaccttaaatgacctgatggagctgaaaaccatggcacgagaactatgtgatgcatgcacaagcttcagtagccaattcgatcaactggaagaaagggtatcagtgattgaagatcaaatgaatgaaatgaagcgagaagagaagtttagagaaaaaagactaaaaagaacaaagcctccaagaaatatgggactatgtgaaaagaccaagtctatgtcgattggtctgcctgaaagtgatggggagaatggaaccaagtttgaaaacactcttcagggtattatccaggagaacttccccaacctagcaaggcaggccaacattcaaattcaggaaatacagagaatgacacaaagatactcctcgagaagagcaacaccaagatacataattgtcagattcaccaaagttgaaatgaaggaaataatgttaagggcagccagagagaaaggtcgggttacccacaaagggaagcccatcagactaactaataagagagtttctggatctctcggcagaaactctacaagccagaagagagtgggggccaatattcaacattctcaaagaaaataattttcaaaccagaatttcatatccagccaaactaagcttcataagtgaaggagaaataaaatcctttacagacgagcaaatgctgagagattttgtcatcaccaggcctgccttacaagaactcctgaaagaagcactaaacatggaaatgaacaacc

SEQ ID NO: 475337 - DNA, 597 bp, Homo sapiens
agcaaacggctttatggccatttttatgagggatgcctctctgaaccctgcaaatggccctggcccactggccagcaaagagccagggatggagcctgcaggtgccactgctcttcaaacgtgtgtcatagctgattttcttgtcctcacagccttggcagctctctccgtgtcactgtcctccacatccaacccaccagagggtcctgaagcggggggagtctggttggctcctgtggccaacaccgctggctgcccactcagcaaccaccctcctcatcaggtttgttcaggtgaacaacctcaggtggtgaatacatcattggtttgtaagagcgctgagagtgaaagaatctgtgactggaaatacttaggttctcaattaaaagaatacaaaatgttatttgaccccgaccccaaaaaatgcacacgcaaatactagaatggaaaaaaaaaagcctgaaacaacacaaatgattaacagtattcaacaaataaacaagcaaatacaaatatacaatatcgctgtgatattcttaagaaaacagtattagatgtgccatacttaggcaagcttgtgtggaacagcaacagtgc

SEQ ID NO: 475338 - DNA, 700 bp, Homo sapiens
gttccggttcatctcagagatctcagtctttgtaagacgcaggtcttcccagccagcgtctgcagctcctcatacttgatctgatacatgctctcggcctcagcccgactgcgggagcggctgttgtcaatggacagcaccacagacgtgtccgagatctgggactgcagctcccggatctcctcttcatacagctgcctgaggaagttgatatcgtcagcccttccaggcaagactccagctctacctcttgttcttgaagtcctccaccagcccctgcgtgttgccaagctccgcctccagcttcagcttctcctggcccagagtctccagctgccgcctaaggctgttgatgtagctctcgaatatgttgtccatgttgctcccagccgtcttctgctgctgcaggaggctccacttggtctccagcatcttgttctgctgctccaggaaccgtaccttgccaccccggaagctgctgctgcccactcaggagaagctcaaggagctgatgcagacaccaggcccactcgtgtaggagcagctgcagaaggcccgggtgccagaggtggacaccttgtaggacttctgcaccctgatggacatggtggaggcaggagtggaggcaggcgggctgaaccaggcggagattccagaaggagtggagaagctgcttcttggtagaatatatcttttctaa

SEQ ID NO: 475339 - DNA, 2057 bp, Homo sapiens
cagtctcatcaccctgctctggccagcagcccagaggctagttcagccccagcactacttcccattgcatggggtggctgatgggctatggtgttactgccttcttcatatgggcattcagcagggtcctgagttcttgtcctgcatccaagaagaatgagcttatgctgacagccatggatatatgcgctctttcccttcggtgtgccactgaagatcctggtgttgccatgggccgccgccccgcctgttgttaccggtattgtaagaacaagccgtacccaaagtctcgcttctgccgaggtgtccctgatgccaagattcgcatttttgacctggggcggaaaaaggcaaaagtggatgagtttccactttgtggccacatggtgtcagatgaatatgagcagctgtcctctgaagccctggaggctgcccgaatttgtgccaataagtacatggtaaaaagttgtggcaaagatggcttccatatccgggtgcggctccactccttccacgtcatccgcatcaacaagatgttgtcctgtgctggggctgacaggctccaaacaggcatgcgaggtgcctttggaaagccccagggcactttggccagggttcacactggccaagttatcatgtccatccgcaccaagctgcagaacaaggagcatgtgattgaggccctgggcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctactaactctccaaaaaaaaaaaaaaaaaaaaaaaaaaagatgtgcttttattgttttaacaggtccttcctcacaggtcacacagatattattttctattaattgtatagtcatacctttcccatttatgtttttaatttttctgtaattcaccattgcatataggggtttgtgagcatccaaccttatttttctaggtaaactggttttcccaacataatctccaagaaaatctttccattttatttgttattacataacaaattctcatgggcctatttttgagctctcaattttgttccattggtttctttcttaacactgaggacagcaaaaatcacctggtgaccatacagcagccatggagacaaaaactccttatctgaggaatttagaagtataatgaagggagcaaagcccacctggtggccatcaggtgggccatttagagaccaaaaacctccttatttgaggaattttagaagtaattagacttccctattatctaaagtcagcacctggttccaggcctcttttcaacttaaaatttacaggtaacaagaatttctatacatctcagaatacatgcatggcaaaactctttgtgcaacccttgctgacattaagacatcagaatgtctacaaatgtaatcatttatcaggtaaactactcttcatctcctgctttgaagtccataaatgctcctaaggaaaattcaccacggtgggcttagttctctcttgctaaggcacccccctgcaccccatctgcagtgttctttctttctaataaaactttcctttttcaaacctatactgctgtcagtaaatccttcttatcaacctgtgagttgaccattttctgataccagagctctgatacctcacctgtcaaacaccaccacactggattaattattgtgattttaaaatatgccttcacatctagtaagtctattagtctattggaattttcaggtagatgctccctggtgaacttagatcagttttagtggagagaaggggacagaagccagattgcactgacttgagaaataaatgggaggtgactaggaaaatccagaggtgggggtatagaaggggagaggggacagggaggaggtggggagagaga

SEQ ID NO: 475340 - DNA, 1019 bp, Homo sapiens
atccagcaggggttacaaggacacttctgcagtttcaaagggttcaggagtacctggagattcaaagttcttatgtttatacctttaaatagccccttcttaggctcagggcctcctctcttggtattagagccttgtgtttggtataaagacacatgctttgctgactttgctttaagttgttgtccaacgtgtccatcattttttctcttcaacaaatcagcagtgcttagcaagccactgagttccacactctttgttcacagtacccctgcctctgacctctcaaatgccagagaggccgtatcagctcttgtaccccttccaatgttacctgaccctgttcaccagaagaaacaagataaagctggtgaaaagctaagcttttcagaatgtggcctcagtgggaatctggttttagcctggtttccctgtgactctctggagcacaaatggtgccacagagatggccccaacttgagccaaggtgttctcatctaccaagaaagagtcttacatctgtattgcagaattttggctaaagccatgaacaagtgtgccttagaaaagaaattttcactaggacattcacagcattcctgatgactgacatcgcttcaagttcagtgaattattctaacaggcatagcataagtacaaagtgacccagttgtgaatattcagggctgggacgccacgagaggaaattgacgttggggacaatctgtgggagcaacatattctcctatagatgaaatgccagggagaatggtgggctgcttctcaccagctagttttctgtatgtccccagaatgtctaatgttttctcacagtagagctcttaaagaaaagctctgttaccttttattgaaaattctggactcaaatgctataattaaaagaaaaaaattaatatgccctatactgacctttgaaatacttggatatagaagggaatagggcaagatctcagctgtcataaagttcatattctaggtatacatcatttttgttaagt

SEQ ID NO: 475341 - DNA, 1728 bp, Homo sapiens
cagacgatgaggccgggatgaaaacttgcttctgctcaggattccccatgagggttatttttagcccaggacagtttggtctgtagcaggaaaccacaaaggaatgcctagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggttaaagttaaacagtaagaggaaccagcttgtgagagaactggaggaagccacccggcaggtggcaactctgcactcccagctgaaaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctggtaagggccgtgtctggctggctggctggctggctggctggctggctggctggctggctgaccggccttctgtgtttatggggattggtctaccctgagcttcaggaagaagctccaccttcaaaagaaccctagattccacttctcaccacttccccagacccaagccactgtcttcccttacctggatgatggcagccatctcctacttggtttcccggcttctgtccttttccccttcctcttttttcaacagagtagccagactaatcctgtttaaatgtaaatcagtgcatgccattcttttgcta

SEQ ID NO: 475342 - DNA, 628 bp, Homo sapiens
acgctctgatcttgtctgtctgttctagaattagaatccagcaggggatggctgtcacagggatgcatactaacactggaacactgaaggaggtttaagaagaagaaaacttaaaggtggatgcttgagtccttcgggctggggctgggcgtacaggctcaggttagcgacaggacctggagtcagtgtccttgtgagaatctatggcgctgtggatcttctcaacctagtgctggcacacatgagatgcttggccagggcctgccagatggggaggctggagatgggtcggctgtgattgagacctctgtggccaagttttactctaagaggcagacctgtcagcaagcagttcatccccagctgccaatctccttttggccctcagtcttccagaggagctgggaggtgggagagaggggttctgcagggcagtgttgttcagagcactcagcacactgcctggaatgcaggaaatggttgctgaatgaagcgatgaattacatttcagcactcatcaagtgctcagcctataactaagtctgagtgtaggctgctaacacttagacctttaccttacagaatcttcgcagccagtgctgtgcattggaagttgcagatggggaaa

SEQ ID NO: 475343 - DNA, 535 bp, Homo sapiens
gttcactacccgatgaaagatagtgaagaggcagtaaagcctaggctctcacggctggcaaactttgatatgcaaaggcaggccattagaaactgggtccacccaaacatggcgattccagctctcttctccttgcccttgctccaacatgtgcctgacaacatggccgcccacacatttccgcatgtggagcacttcatttgcatattaaaaggtggagaggtgggagtagataaaaatgtgggaaaagtcaggaatgtgcacagagcctctagtaaacatcattctactctctacctccatgagatcaactttttaagctctcagttaactaagcagaagtctcataaggaaataagagacttgaaaaacatttttaaccaactagatgtagcatatatctatggagtacttcaccaaactgtagctgcagaacatataatctgaagtgcacagggaatgttttgtgagatggaccatatgctgaaccgtaatacaagcctcaatacacttaaaatgattgaaatataaagta

SEQ ID NO: 475344 - DNA, 674 bp, Homo sapiens
gtgccctggatgacttgggtttatgtttgaaggtctgctccagctgaaagatgagtaaaaccgtggataagtcagacaatggacccacctgcctgacgcagccgaaggaacaaactttatccattgggctaaatccttctcctggtccttggctggcacctggtgccatagctcttctgggagggcttctggggctgctaggggagagtggaagtagatttcctgtgcaactgccctgtcccccttcaccagtgaagcaagcattgctgctttccaaggttcttgcctgctgctatgagagcaaattgggatccagagtgcccagccaaggcaccaatgctctgaaacttacaatcacagcagaaggagaaggggaagcaaagcatgtcttacgtggcagcaggagagagagaacaaggaagtgccacactttaaaaccatcagctcttgtgagaactccctcactatcattagaacagaaggggaaaaaccgcccccatcgtccaatcacctcccactagagccctcccttgacttgtggagattacaattccagatgagatttgggtggagacacagagctaaaccatatcagtggttaaataacttgtctaaggctcgtagctaagtaaagagatagggaaaggattttgaacctagtcgggttggctcct

SEQ ID NO: 475345 - DNA, 1213 bp, Homo sapiens
gtgttttgtgcgaaatctgccatggaagattatggtgtgccacgcttttatccagagagaccacaccaaaaaagtgtaggattctttctccagagcaatgctgaatctgactccacgtcacggacttgtcatgcacaagcgatgctgaagataataaattatggagatgacggaaaatcgttcaaggaccagttttgtggccaccagggaaatgacatgtacgatgaagaaaaagtgaaatatactgtgttcaaagtattgaagaactcctcacttgctgagtttgttcagaacctctctcagatcatggaatttccacaagatcaaattcaattgtggcccatgcaagcaaggagtaatggaacaaaacggccagcaatgttagataatgaagctgatggcaataaagcaatgattgaggtcagtgataatgaaaactcttggacaatattcctggaaacagtcgatctcgagctggctgctagtggagtgaccttacccaagtttgataaagctcatgatgtaatgttttttttgaagatgtatgatcccaaaatgcggagcttgaattactgtgggcatatctacacaccaatatcctgtgaaatacgtgacttgctcccagttatgtacgtgtctcttgaaaaagcccttgatgaactaatggatggtgacatcatagtatttcagaaagatgaccctgaaaatgataacaataaaaagatcaggttgccacaggttggacaggagggagaaatgaaaagggataatgagctccctactttgactcacctgctcaggccccttgagggatgtctgaatgtcaccatagtgatagggtaccacagcagggccctactgggaatgggtagtgctcaagggattatgctcccacctggtttgcatgagggttcctatagctctatattcttgccagctgatgatatctttaatgcttgaattttgccaatatgaatagtatcaagtgatatatcctgatagtcttaattggtatttatctgattattagtgagactaagcatctcttcaaacagtttttcaccattagagtttcatgaattgcctattcatacctttttctgttcattttctgctgggtttctgtcctttccttgaagatttttgagagtttcttagatattctagaaactaatgttctgtcggttatttatgtgaagatctcccagtctac

SEQ ID NO: 475346 - DNA, 527 bp, Homo sapiens
cctggatacctcagttgctgttttggtagacgtatgtaccaaattctcttgggtaaatacctaggaggagaattcctgagttgtgtgacggactgttgtgcagactcaggcagctcactcggggctgggcagcagacagtgattatcgtcaccccctgctttcatccattacggcgggtgttagcaggacagcgagtgggtgcagagatgtcatccaggagcaagggtctggaatcagggaccccaggaatctgcttggtgttctaccctattgtattccacaaacttgtgactaagcgggtacccaagctgcaagacaaagtcccctctactcttccctcttatttcctcaaagagaaggactttgatgccacaggaagccagcttgctagctccctgttacctgatagttccctgactaaaaagactcttcagtgaggatcagcattttaccctagacaggagtcgtgaattttctttttaaagatacacatatctcttaaaagggtccagaatatttcctgcaa

SEQ ID NO: 475347 - DNA, 634 bp, Homo sapiens
cctgcttcagcacctctttcctcaatatgatgttataactaggcattgtgaagactggaaatatggatgacgagtgttgaaaccttcacattgaatgatgtcaagactcctttcatgtaccacctcagacacacttcacccactctgactcgtgttctgtcatcccactggggtattacctgcaagttctatgggcaccacccgacactgttatcactttatgcctactccatatccccttttcttccccctgaggcttccctgacacaaagaaaaggaataaggcagactcccaaggtgctcacaaatgagcaaccccaaagtgtgaggaagttaatactccaaggagcacaccctcagccaatggaagataacagttgggagataaatttgttgccctttctctataacttttcaacctccaccatgtggaggtggtatgggaatgagattcgggtccaattattgtgatcaattgttcatattgatccaccacttttcaggtacagatataatcacaagctatcaaagaaactccttggcccatctcttaagagctcaaagaatatgcctgggagcaaaggaaccaccagctcagttaggttgaaaccagttagccattgtagtactactt

SEQ ID NO: 475348 - DNA, 1280 bp, Homo sapiens
cagccatttccacatgcttagctgcggcccagcatgctccgttgaaatgaaaaatgatcaaaagctggagatgggatctttgccattagggaccatcaatgagagggaaatacagtctcattttcaatgtttgatttgttctgacacaggcatgactttgactaaaaaaaggaaaaaagaaggcaagaagtggaaattacatgatgaggaggcaatagagttagaacctgtgacttggcccatgaacaagctttcgggccatgtggtagaactggatgagaactatgggattaaaagtctggagacaagactattttttctggttcagcaacctggggttttgaaacctccttgctgctgtcactacaagagagtcctgttgtcattgctaggacttggttggatggatctgacattgaaagtgaggggcattacatccatctgtttgctcaaggaaggaatttatgaatcatttttaataaccctacaccctcactcctacttcgcatcaggagcaaatagtttagtgggggatatagaggagcagacaggcaattccaaacaccacaagggcatgtcagagatcttggcagctggccctcctgtcacaggctcagaggccttggaggaaaaatggttttgtgggctgggcccagggtccccccaacacctgtccagcctcaggacatggcaccctgtgtcccagcttcttcagctccagtcgtggctaagccaaggtacagcttgggctattggtttggagggtgcaagccccaagccttatcagcttccacatggtgttgggtgtaggggtgcacagaagtcaagaactgaggtttggaaacttctgcctggatttcagaggatatatggaaatgcctggatggccaggcagaagtctgctggagaacctttgctagggcagtgcagaaggtcaaatgtggggttggagcccaccccctgccacagagtccccactggggcactgcctagtggagctgtgagaagaggaccaccatcctccagactccagaatggtagatccaccaacagcttgcaccatgaacctggaaaagctgcagacactcaatgctagcccatgtaagaaaccaggaggaggactgtatccttttccatgatgttaagtgaaaatatctacattgccattgactcgggtagtagtatagctgctttcgttagtttaataatctcttaaaattggaaagacttatcatttgatatggttaggatgtttcattcccttcaaatgtcccctcaca

SEQ ID NO: 475349 - DNA, 705 bp, Homo sapiens
ggcggtggcttgcagcaggagggagcagtggagacagtgagatatgcttagattcgggatgtatgtgttgttccctctggctgtaattcttctgcctcatttgctgctgactagcgcccgcccgggtttgagctctggggtggctgccagaggcttctgctgggtcatcgcagtcaccctcgtggatgcaatgtcaggatgctgcctcagtgcggaggctgtcaacacctgtccagagacttcaggcacactgcttacgcatttcgatgagcgcatttcacttgaatccaccaaagtggacctgctgctagttctatttccccctggagtggagactctccaaagtgagcttcgggcaattacattctttctccattattgcttttgttcctcttacacagccacttgtccaaactctattaacacttggtgttggctgaagcttgtgttttcaaacatgtcagcagatggcagggccccagatgaggtacgaatccatcttgaagggtcacagggcactcgatggctgcaatcaaaattggcagccaagacgtgtcttttgaagcaatcttgataaatgcaagaaagaatatagccagaagaagggacatagctgcccttcatgttcattcacatcccttccgtccaatgagcatttcttaaaagttcaataaacattgattgcacttctactgtgggccaggc

SEQ ID NO: 475350 - DNA, 453 bp, Homo sapiens
cagcagcaactctcctcagacttctcatgcatacactcatggccatgcagagttttcaaataggggatccaaagtcttcttggggtgccttgagtggcagaagtaaacctgaatctatagacataaagaatgagatagcatgctgcatcattccagcagttcttgattccccgtcaccaactagatgccccacaattcagttcaacgctgactacccagggttactgccagactccatgggtttaaagcctcaatcccacaagattgccctcactttagatgccagtcgcaagtcctgggttcccaggttacctgaacttctgttggacttggctataaattcagggattctcactacccctccctgcctgggcacccccttttttcacttccagtttcataatttgttagaacaactcagagaactcaggaaagtgctatacatgtgattac

SEQ ID NO: 475351 - DNA, 712 bp, Homo sapiens
cccgggaactggaaccaccgaaagcgcagtccacccgccgggggttcataaagtggagacgtagatggcgccggaggctcgccagagggctgcaggtgatgattctgggtgttgtaatgaggcatgtttctgggggtgaggcaagtgactcatggggagctgctgaagaatgcgttgggggaaaatgctagtgaagttgtaaaaggcttggaggacccagaacccagaaataccgcattttcctctctgcagtcacttggacaaagaaaaccctttcaattaaaacccaaagagttgagtagttctgcagattcccccatggctggtctgaattataatttggacttgtcactcggtgaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggtgagtcctcctgatgatgtagatatcctggactcagactagggctaagttgattacattgtgaaatattgatactgatggatagcagctggagtctaaagataaaagtcaacggcttgctcagcaggcctacttttcctgtgactaacccccattgctgtgaaggatggctaggggactggagttaatcatgttagcattttgt

SEQ ID NO: 475352 - DNA, 730 bp, Homo sapiens
ccacacgtggttctaccctgggcaatgcctccagaccccaccgtccagactaatgatcagaaacgtgttttaacagctcctccaggttactgggggtgcctgctcagtgccccacccaccccagaccaattcagtcagaatacttgggacaggggcctaggtattactgcttttgatgcaagatttttcttctcagtcgctttgcaagccggggacccccagccagtgacgccctgcccaggtctcactcagcccatccagctcaccaactatgttatagcttgtacccatattcagcggttccggatctcttgtgccgcacccaagaagaatgaggatacgtggggcattgaaggcagtgaaaacggctttcagtgggggggcggggggatggtggggggtggaggtggggcactggttcccctaccccaagattggaaagttgtcccctccccgtccctccccacaccttgtgtgactgggtctggggccttttatagactcagaatggggactgccgatttgtttgttagtacgcaaaaaaaggttaaagggaagacaccactcaaaggtgggcatgacagtgtagaaaaccaattaggaaaagcaggagaggtgagatgtgaagctcaccaaaagcatcaaaatttctaccaaattcaatggtgataacagtatttaataactcatccagcaaagacagttgctcacccggagaaaggggtgggtt

SEQ ID NO: 475353 - DNA, 3557 bp, Homo sapiens
gcgttgttgtgtctttcttttctgcggcgcttgttttgtgtctgttgcggctggtggtgtttcgtgttcgtgctgtggtgtgttctctggttgtccgttgcttgtgacgtgttgagtgtggtgtggcgttcgctgttatcgttatcctggcgagcctgtgtgtgggactcgctgcgctagtgctgtactgtgtctcctctggagaatgccatagaaaccatgtccacggccaatgagaagatcctgatgatgataaaccagtaccagagtgatgagaccctccccatcaacccactctccatgctcctgaacgggattgtggaccctgctgtcatgggaggcttcgccaagtatgagaaggccttcttcactgaagagtatgtcagggaccaccctgaggaccaggacaagctgacccacctcaaggacctgattgcatggcaggcccagagcagccccctcctcagacattcgcccactctgggctctcagcaaaccacccatcagaacacaggggtgggctccggagggcaggagctggcgggaggtccccagccttctggggtcgtcatgccctttattattcaaataatgatgttctcccttagcatccccagtttgggaagcaggaaggccaggctttgactcgttcccatcctcagatattgctgggaggcctcagggaaggctaacatgtcatacagatttgcttagttgttggatgtcactctgaatctatacaattgccctggtcctctccactggggacctcttctcctctggaaacagcttctccatgctgtgtttactgtacccaaagaatgaactgcagcttcacagcacagcgaataccaagctgtaccttccaagaaaattctactactgtcttggagcttactagagggacattaccaacaaagccggaaggctttgaaagcatgtactctattagatgtggcggcttctgagaaccgttagctaggcgccttcagacaccgccccctagtggccgccttctccttagcaccacccgctgctcctgagaccacctatacagaggcccacctaacccccaaacgaggttgacctcagccatatccctcccacccagcgcccaggcaccctaactatgggcacccgcatgcaaaagatgcagtcctgctcatagtgaaggcagccttttaacattatcacatgcagcagattagctcttccctacctgtttcattccgtttgttcttgcaacttatatttattgagcctctgttgtgtcctaggcaacagtaatagtgatggacaaaattgggcctgctccctgctcacttggagcttaattctatgttggattttggttttgcaaagccaaatacactttgaatttacttaaaacacgagaaggttagatttcaaggggagtgaatgtatttgtacctctagcaaccgaacaaatgctgaagccttcaaagtacatttggtgttcaacgtttttgcagatttcaagatcgatagcttgttaatttattttctttctgaagactttctattttttggcataaaaagatgtctatagtatgctcttcttttaaagcttttgttgtgaaatattatgtacagaaaagtacacataaaaatatataacccactgatttatcaaaaacatacatccgtttgaccaccacccagatgaaatagaattctgctagctcccctaatcctatcttaggcctccttccctaagagtgagcactgttctgtttttatagtaatcatttccttgctttaaaaaaaatactttaccacccaaacactcattcttaaacactatagtttagatttgcttaattttgacctacatataacagaatcacataatatacagtctttcgtatctaacttattttgcccaatgttatgtttgtgaaagtcattcattttgtttatgagtcataactatgattcacattcattttcattgctatatagtagtccgtacagctggcttatgtaactataccaaaatgcatttatttatttttatactaatagagaattgggtttatttcagcttggggctattataagtaatgctattctgaacttccttgtgtgtttttttggtacacatatgcaaaatttttgttgggtatatacctatgcattgatttgcttggtcatagcatgtgaggatattcagctttcataggtactgccaatcttctatcaccataggttaggttattttgcctgttcttgaacctcttataaattgtattatacagtacagtatgtactactgtatctgtagcttctttggctcaatataatgcctttgagattcctctgggttgttacacatactagaggtttgacttttttgttgtttctaagtgtcatctattgtatgtgtatctaaattaccaataatatatcaatttatttatccgttctgttggacatttggatgttttcaggtgttgtatattatgagtaaagttgctatgaacattcgtgtttgtgccttttggtggacctaagcacccagttccctcagtatacatgcagtagtggaattgctgggccatgcacatttaaccttactggacacaagaagcagtttttcaaagtggctaaatcaattttcactcccacacaacttctaagtcagttgatccacattctccctgacacttgatactgggagtcttttttaattctagtccttctggtggatgtgtaatgatatctcagtttagttttaatttgcatttccttcatgagcaatgatgttcagcaccttttcatatgcttactgctaattggattacccttttgtgaaatactttttcaaatcttttacttatgttgttaatttagttgtctctttattattgatttataggagtttatatattctagatatgcatcttctgtcaaatatatgtattgcaaatatcttctcttagtctggcttgtctgtttgctttcttaatgatgtattttgatgaacagcagttgtaattttggtcaggtttaatttatcatatttttaaatgattagtgcttttgtgtccactttaagaaaccgcaactaccccaagatcatgaagatattctcctatgttttattctgagtttttattgttttgtcttatacatttaggtgtatgatcctttttgactgatgtaaagtaagaggcagattattttcttacacagatttccaatttctttagcaccatgtgttgaaaagactattttcccccacttttgaccccccaaattgaccatatatgtgtttttctattctggactttctattctgatccatcggtctatgtccatgcttataccaataccacaccatcttaggtcttgaaatctaatagtcagtgtaccccaattgttgcttttcatcaagtgtgtcttgcctcttctaagtcctttgtatttctctataaattttaaaataacttgccaatgtttacacactcctcccaaacacattgagatttggattaattgtacataactattagattaattggagaattgtaggt

SEQ ID NO: 475354 - DNA, 711 bp, Homo sapiens
cttaagatctttaggctgagatgatgagcaaagaggagaaagatgataaagtggtcagtgactgaggcttcaagagttgtaacactgaagagctgctcacactgcaagagctatagcactaagcaaaggctcttttcagagccctcatttttccagacaggcggtggagctccctaccctctcaggggttacccgtcccaagaaagtgtcacaagattggcatctgaaatgcccaaagaagagttcctgactctctggcccctgggtagaatcagtgtgtgtagtataagcaaaagggctattgacaatgagaatgtcttaaccatccccccactgactccacccagacttgtggctcatgactcaactgatcctgtggccccatacagaggagacttagtgcatgaggaccattttccacacccctacgatttcatccaaaatcaatctgcagcacccatttcctacccaccaaattgtccctaaaacccctaacttctgagcctttaggaagactgatttgagtgataactctagttctcctaggcttcaaaaacattttagatagaaaatatggagcatagcatgctgacttgaaaaaaagaaacgggcatttttcattttcattgtgtcaagtgggtgaccttttgaatctgaactaaaacaaattggcaatgacagcttcgaattttcactgatttctcttgaaaa

SEQ ID NO: 475355 - DNA, 663 bp, Homo sapiens
agagggtcccttccagctgcatgaggccctgtgagcatcttttctgtgccaggcactgtgctcctggtaaggcagatgcagagttgaaagagacgggagcttgcactcccaagaagtgtccatatttgtttggagatgacctgcatgtccctccttatgtccagaggctggtggagctgagtgcctgctggtcttccgagttgctcttcactgagctgggcccaaatccttccaactcattgtcacccggagaacctataaggaggcgaggcccgggcccacccagggaggtggctgccgtgggtccagattgtgagctccatgtgggcaggactgtgtgtgtctcagacgccctgagccccagtgccccaaacagcaccaggcacattgtaggcaaccagcacatacttgctgaataaacagatgaaatgaaagttcacaggttcattatgaaacagaggacactgtctacctaacaaaatgcccatcaatggtacttcactcttcattcaacaattattagtgcctcttctatagtcttcctcacaccatcctggtggcagaagggaaatagggagacacagagatgaataagatagatgtggttcctgtcctcaaagactatacggtccactgtgagaaagtgccgtaatgcataggaag

SEQ ID NO: 475356 - DNA, 1052 bp, Homo sapiens
tctaagataccggataaaggggattggttgccctgtaccagcacacttggtccttccaccacaatcaacaatggggcaaagaagtaagaaaacccaatacctaagagacagccccttgggaaagggaagaaagagagttgtggggaggaagagggagggacaaagagagagagaaaaagaagaaaaaggaggagaggaaaaagaggagaaggaggaggaagaagaggaggagaaggaggaggaagaagaggaggagaaggaggaggaagaagaggaaggaggaggaggaggaagaggtggaggaggaggagaggaggaggagggagaggaggaggaaggggaggaggaggagggggaagaagaggaggaggtggaagaagaactaagagaagaggaagaggaggaagaagaagacgaggaggaggaggaggacagttttaggagaaggggaagaaatgacacattcagaatctgaatctttgaacttgaggttcctataggagacgttcgggacacaactggatattagggtctggaactgttgagttgtagtagtggataaagccttgcaaaggcagagcagtgttagaaagtgtgcagaatgaggagagtagaagacagtgttcaaccctggagaacatcaacatttaatagaaacaaaaaagcttacaacaaatgcaaaggagtggctagaaaggtaggagggaaactagggggaaagaggtttaatagtagccaagtgaggagagaatgttgaaaaaagagaatggtcaattatacacattactgctgaaaggttctctagggcaaggaagatacaacaagaaggtcttttaggacattgcttgaaagaacttcagtagaattataaggacagaaaacccaggtggcctgtgaaagaggtgtggatgggatgtaaggcaataaaatcagagggtggtccagtgttgatggcacccatttgctcgttgcagtagacccattgtctaaagcactttatgacacattgtaggtattcagtagacatttgttgaataatatatattgaatgt

SEQ ID NO: 475357 - DNA, 1325 bp, Homo sapiens
cggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcatcactcagtattatataatgaatgataacggcatcactcagtattatataatgaatgataacggcatcactcagtattatataatgaatgataacggcatcactcagtattatataatgaatgataatggcatcactcagtattatataatgaatgataataatgctatcactcagtattatataatgaatgataacggctattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacatgaaacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataacggcgtcactcagtattatataatgaatgataatggc

SEQ ID NO: 475358 - DNA, 854 bp, Homo sapiens
agcaaacacaggaggatgagtgcatggctctgacgctaggaactcctccacaggtgactctgctgagtttgttcccctgcagggacccacccacaggtgacagtgaacaactaagccatgggaagatgggtgaaccagtcctacacagatggcttcttcctcttgggcatcttttcccacagccagactgaccttgtcctcttctctgcagttatggtggtcttcacagtggccctctgtgggaatgtcctcctcatcttcctcatctacctggacgctggacttcacacccccatgtacttcttcctcagccagctctccctcatggacctcatgttggtctgtaacattgtgccaaagatggcagccaacttcctgtctggcaggaagtccatctcctttgtgggctgtggcatacaaattggcttttttgtctctcttgtgggatctgaggggctcttgctgggactcatggcttatgaccgctacgtggccgttagccacccacttcactatcccatcctcatgaatcagagggcctggaaaaaagccctggccacctgctcctcccacctaacagctgtcaccctcttctatggggcagccatgttcatgtacctgaggcctaggcgctaccgggcccctagccatgacaaggtggcctctatcttctacacagtccttactcccatgctgaaccccctcatttacagcttgaggaatggggagccctctgctcactgagatcgatgcagcttctgattgactcctttggaatgtctcatcggaaactcaaaagactgcaaccatttgtctctcacctacctgtgacctggaagccccctccctgcttc

SEQ ID NO: 475359 - DNA, 1704 bp, Homo sapiens
gtgacgccagtgataacagactcagagtgaccaggagcaacaaccgagccatggagacgtgggtgaaccagtcctacacagatggcttcttcctcttaggcatcttctcccacagtactgctgaccttgtcctcttctccgtggttatggcggtcttcacagtggccctctgtgggaatgtcctcctcatcttcctcatctacatggaccctcaccttcacacccccatgtacttcttcctcagccagctctccctcatggacctcatgttggtctgtaccaatgtgccaaagatggcagccaacttcctgtctggcaggaagtccatctcctttgtgggctgtggcatacaaattggcctctttgtctgtcttgtgggatctgaggggctcttgctgggactcatggcttatgaccgctatgtggccattagccacccacttcactatcccatcctcatgaatcagagggtctgtctccagattactgggagctcctgggcctttgggataatcgatggcttgatccagatggtggtagtaatgaatttcccctactgtggcttgaggaaggtgaaccatttcttctgtgagatgctatccttgttgaagctggcctgtgtagacacatccctgtttgagaaggtgatatttgcttgctgtgtcttcatgcttctcttcccattctccatcatcgtggcctcctatgctcacattctagggactgtgctgcaaatgcactctgctcaggcctggaaaaaggccctggccacctgctcctcccacctgacagctgtcaccctcttctatggggcagccatgttcatctacctgaggcctaggcactaccgggcccccagccatgacaaggtggcctctatcttctacacggtccttactcccatgctcaaccccctcatttacagcttgaggaacagggaggtgatgggggcactgaggaaggggctggaccgctgcaggatcggcagccagcactgaacccagggcatccagtgcctggctctgccatctcttagctccagggatcgcagctgagatgagcaaacaacttcggaggaggctccttcccttgggggtttaattgcctgaaaaggtgtctccaaggactggtgaaaatagaagtaactttccttagtcacggggctgcaagattttccactgtgtagatggatcttagtgtattctgtgaccacttgctgatatcacttaggtaatgcccaacctaccaaattaatttaagctctataatatcaaatatctttctgtgtattctcctcattttcatcatatctttttgccttgtacacatttctatttgccccaaattcttctcttccaggaagcatccctgattaacctcatgcccactcagatttctctgggattttgcacccttcaacccgtaagtaccttgagtgtttcaaccacaactctttatctatagccactgaacccctagactggaagaaaatttagagcaaacttaatccagcccccttccgtgatgcagaattttggatcataatcacccaagcaaaagtttcaccagcctttaccttatctagtcccatgatggggaaattcctatttcattttaattgcatttcattggcataggcttgatgtccttaattcatttcccgcacaaggaccagggaattccattgaaaattatctactgaac

SEQ ID NO: 475360 - DNA, 867 bp, Homo sapiens
gcaggctggaagtctagatcagggtgcagcacactgcagttcttggtgacagagggaaacgtcttgaacaaaaagaagaaaagaaagaaaaggaagttttcatgcccgacgcggtagcataagggggcatgggagaccggacgagagggtgtggcagcgaccgcagggagaggagacggcggacgcggaactgtgcggggttggcagtgggcttgggggtggcacagcggggacgcgctggcaccggtttctgagaggggacattcgggagaagctgcctggggaatgggaggccacgagttcgggcgtggagacggagcttcagggcctggagaaaggggagtggaaatgacggaggaagtatccgtatcgcatcctcggtttgcccgagagatgtctggagttccggcgggcccaggtcccctctcctcctgcagccctgggcccgggctccgctgcgtctggcgctgcaagacctgcgcgccgagatcccggggcgagggaccctgggcggcgcgatctgcacagcgccgagcctgcatcgcgcccccgccaggaccagagccgcgccgcggtggagtcctgagcgcccccgagcggtcacgtgtgcggcggcgacccaagaatttgaaagagtcgcggaaaactgcactcatcatagagcatctgaaggttcctagagggagctgtgaacggttaacaaaaaacacggccatggggtcccctggtggccctgaggatgccaagtggacacaggaagccagcgtggccacacagcaatgaggaagcacaggacccctcatcccctcccaggggcttctttcaacaagttacaaatacaaagacaggtaaggaacttggaaaggc

SEQ ID NO: 475361 - DNA, 906 bp, Homo sapiens
cctccaggcctgtgatgggcaggcctggtccctggatcctgtgggaatgtctggtgcctgggactgtgaggacctatctgacactggggtaagtcttaagcctgagtctgcagttgaacctctggagtctgggtcttctgagaacaacacagaatcttggtccataggagctagtctggagcttggggctgtgggcagtagactggtgctgttgcagggctgccctggtactgggaaagacccaaatcctggggccactggaaccagcttcacaccaggattcactgaatgggcctggtgctggggtctgctggagttttctgagggtccactccagaccctatttgcctgggtatcaccagcaaaggctgcctgctcctttttcctggaagctttgtcccagaagagcacctaccagatgtcagttggagctctcctgtatgaggtccactttcaactgggtttctgtcacttgcaattgaaattatccaaatcaacataatagttcaaaaaaattttgataatttatttatcatagtaactcatcaacttttaaaatacttttatattaagacatatggcaaaatgtttttgagaagagagaagttggagtaatgacgaaagctgatttgtgagtcaaaaacagtttttcttaaagtaatagaattgcacaagtagcctatataaagtaaaggattttaaaatataaaggtttctagtcaaaaagtttttggggggtgggagaactggaaaactggacttattcctagaatagattcagcattttacccttatgaaataactttgtgccatagacacagatttattaaatcatgaggaaatttgcctgaccacagtgttagcacacataaatcgttgggtcttgtgtgtatgttgcatgtatgc

SEQ ID NO: 475362 - DNA, 582 bp, Homo sapiens
ttgcaacctatttttttttttttacacggagatcttgttcatgggcctctctgtacttggtctccagggacctttccccaatcccaacgcagccaactcctgcttgtccccagaagtcagcttagcagctcttcctccaagaaggcttgcccacccacagctctggaccaggagttcccccacccccatggccacctgtactgcccctcgcatgacaggaagtgatgcctcctctgagatctcagaagctgaaggcagggtggtgggagtctggggacattccaggcagaggggattggcctctggtaggaaagagaaaataatatatgagggatggagatggggagatgggcagtgtgtctggggccaagagcatgagaaaagatgtgtaagagatgatgctggaggggccagcagaggccaggctacacagagctttctgggacaagtaaggagtttgcggttttatcccaagcaatgaaaagacactgaaagcttagagggggtgactgatatggtttggctctgtgtccctacccaaatctcatcttgaattgtaatctccatgtgtcaaggggggaa

SEQ ID NO: 475363 - DNA, 1077 bp, Homo sapiens
agtcttcatcagctttaactagccatgcttactagagcagtggctcttaatccatcagacataatgcatgctttcaaggcccaagtttcaccggctgcacggaaggctggagaccacagggtcaactttctgctgatggaggaccctgagaaaaagctgaatcagaagagtgatggcaaaccccggaaagtacgatttaaaatctcctcctcctacagcggtcgagtattgaagcaggtctttgaggatgggcaggaattagagtcaccaaaggaggaataccctcacagttttctgcaagagtctcttgaaacaatggatggtgtttatgggtctggggaagtccccaggccccagatgtgctcccctaagctgactgctcagaggatcagtgtgtttagagagggtaatgcctacaccttggcaggcggccagcctcggttcaacgattacaaggcgaatgaccataagcataagctctgggtagttggagtcctgggaagggatggtgaaacgcaaatcagccagaggatatgttatgtgaggaagaagtttgagctaatgcccctacctattatagattttggaaagataatcatctacactaataacctgaaaatcattcgaaccccaatggacaagagagattttgtgaggaaaattctccagaaggaagaggaggctgaggaagagtctctgatgaacaaagaagaaagctatggaggcagggaccagcacgatagacctttggtggaggcagaaagcacattaccccaaaaccggtatacacaggtgcgttggggagcttgactgtcctgctcggagctggccctacagcaatggtctccaagctggcttgattgtgcactgcttaagtaaaaccttttgaatatgaatacttaagatacctaaacttgaagatatgaggaattttaacatttgttatattttaatggtacattgttagcaatagcagttataagtccatatttcagatactctaaatttttaattttttggctgacttctttttagatctgattaaatatttattgttttcactgtgcagtgtggttt

SEQ ID NO: 475364 - DNA, 639 bp, Homo sapiens
cgctgctcctccaggtgggaactggagttttgaaataaaatggatgatttgacgttacttgatcttctggagtgccctgtgtgctttgagaagctcgatgtcacagccaaagtcctcccttgccagcacaccttctgcaaaccatgtctacagagggttttcaaggcccacaaagagctgcggtgccccgaatgcaggacgcctgtgttttccaacattgaggcgctgccggccaacctgctgctcgtgcgccttctggatggagtgcgctcagggcagagctccgggagagggggctccttccgcaggcctggcacgatgaccttgcaggatggcaggaaaagcaggaccaaccccagacgtctgcaggccagtcctttccggctagtgcctaatgtcagaatccacatggatgggtccagcagaattatttgcactgtcacccctggagtcagtgtaaaaaagtggacacggaaagctgtggcttgggccattggcatacttagaaaatcaaagctacattccttgaagtcttacctagagcaagcattagagtctaaatgctggcagcagtgtcccacatctccctgctctgaagaggaataacgtgtgggagggtcttgcaggactgcttcctta

SEQ ID NO: 475365 - DNA, 867 bp, Homo sapiens
ggtccttgcgatagtttgctgagaatgatggtttccagcttcatccatccaaacctcaccgcaagacaccttttagagaagaacaaaggtcgccagtcatcccgcacaaaaaacctgtccctggtgtcctcgtcctccagaggcaacacgtctaccctccgtaggggcccagggtccaggaggaaggtgcctgggcagttttccatcacaacagccttgaacactctcaaccggatggtccattctccttcagggcgccatatggtagagatcagcaccccagtgctcatcagctccagcaacccctctgtgatcacccagcccatggagaaagcagacgttccttccagctgtgtgggacaggaaatgacctcacagatgaactgcaactacggactaaaaacaatggcactcgaaaacaattcaggattagacctgaagatactgagagtcacaacccaactttatggttctcagggctgccatgagaaatggtttacttagcactaatatatatattttttcctttggatggttctcagggctgccatgagaaatggtttacttagcactaatatatatattttttcctttggacaccctcccagttcaaatttatatttaagattcttagctaatcttccttcttgaggggagcttttagaatctgtcatttgtgtgactggggagaaccctgaattaacacagggaatgggccaaacgttttaaaatctaaatgatcattccaatctgaatgttttaaggtatagtttttcacaactactaacagatatggaggagggggtgatcttgcctcttatatgtaaaacactggcaggaaaaggtacttccttaacagactcaagg

SEQ ID NO: 475366 - DNA, 1821 bp, Homo sapiens
tttaatcttgggagggtggctagcagacaagagaggttaagtctgatgaaccatggagatcatggctgcatttcctgccatgggctccatctcagggagattagagttctgtctgcaaaccctggctggagttattgaaattcccacagggaggcttcacccagtgagaaggaatggatctgagtcccacctaaacaagaagtctggccatgatctgcacacagccgctgtgctgccctgtggagaattcctcttggtccaaaccacccagtctctctggcaccagcaggggaaaacaacagactggagccacagtgatggctgttcccctccccttgggagggagtatttggcagtcatcttaggcagtcccaatcatcttatgcagtatccagcctgcagctgctggctgcaacctgagcggccatcaagcatctgcacagctctgtgcttgggaacctaggccctggtggcatgggctcacgaagagatctcctgatctgaaggttgcacagatctgtggagaaagtgttgtttcccaggcagaagctgtatgctatggatttttctgatcatttcatgctgagctcaggggagggactctaaagtgagtgcatacaagtccaaactgttaccattgttgtcaactgcccccaggcatgctgagtgtgctgagtccctacagtgttcctttgcgagaagaagaagagtgaaaagatgaaggttggaagtctgaacaggctcatgtcagatgagtcttcctttataatggcaattccttcttaaattgcattggccatggataggaacatagctagcctcaattgtgttagtctggaggtgcagcatttttaacatagcacatttccccccaccccctgcaagattaggattttatcaagaagagagaacggattctaggtgagcaatcagccaagatttatcagagctttatatttctcagcaaagcacttagttttgctgagattcagtttcttcatacttgaaatgggaaaaataaagtgtctcatggggttgttgtgaggacataaggcatgtatgtaaagcaatcagcacaatgcctaacatataataagcattcaagaaatttcagctattacatattaaaatgcttataaacataataatctatcatatgattgtacctcaatttcattggcaacgctaattgaatttttggttattgtaaatttcttataaataataataaatacttgtatttttatttaagcttatgctgctgggaataattcgtgtgtatatttttcttcagtttgtgttatattcttaaaaattcataggaattaaagtaatggatcaaggtgcttcaacattttaaaaatactcaattcatcttgatggcttgctcttcaaaatgcactttttacacaattcatttccacagcagttcccatttcttcattctaaactttacctcattgagtatagtcattagaaatgaaattgctaatatgatgggtgatatggaagactattacctactcatcaaagcccagactctcttcttcttcatgggaatactgcttatgtatattcctcatctgcccttgcagataggaatgcagccggtgcatcacctgataataagtacataagatgtaaaacgaaatatattgtgtgatgaacctatatatatatattcttaaagacatcttgaaccatcataaaatcatattagtattgatttttgtttaaataagcattgcagactgaaatgccttcagggcataggcaagtatcataaatgtacgaaggagtcagaaacaattgagaagtgtt

SEQ ID NO: 475367 - DNA, 709 bp, Homo sapiens
cgcggcggcagaagccatgagcagcaaagtctctcgcgacacccagtgggaggcagtgcggaaagtcctgcacaggaaccagcgctagcgccacaaattccaggagacggtgtaggtgcagatcagcttgaagaagtatgacccacagaaggacaagtgctcctcgggcaccatcaggcttaagtccactccccgccccaagttctctgtgtgtgttctggcggaccagtagcactgcgacgaggccaaggccatggatatcccccacatggacactgaggcgctgaaaaaactcaacaagaataaaaaactggtcaagaagctggccaagaagtatgatgcgtttttggcctcagagtctctgatcaagcagattccacgaatcctcggcccagatctaaataaggcaggaaagttcccttccctgctcacacacaacgaaaacatggtggccaaagtggatgaggtgaagttcacaatcaagttccaaatgaagaaggtgttatatctggctgtagctgttgctacaatgcaaacccagcttatatatgtagcattcatgtggaccctcttcctcaccaccctaaccctgggggcaagaggaactaaagcaaacatgcggatgctcatgctacttactgaactgtgagtaataaattcttttgcctctgacccattaatcttgtgtctcctgccagtatccttgaaa

SEQ ID NO: 475368 - DNA, 879 bp, Homo sapiens
caataagaaaatgggtcagaacttaagtcagtaatctacattgctaaccagttttcttgagaaaaatataatgcaaacagaggaatgcacaagcagctgaatttcagaggaaggttgtcagtcttcttctcctttattgtgacttacaaagactttgtaactgtgattcaggccccccagcacccccgtgactgtagagtaccttcaaaactcagctgtcccagccagtgccaacctgtgaacttcccgccatatcccagatctgctatcccccaaaccacttcccagttttcctttgaaaagaagaccaaaatgaccattatcaggaatgaaaaagacatcactgcaaagcctacagacattaaaaataatcataagaaaccggaagacgactttgaagcacggcctaataagaacctggtgtttgcctctcctttagacattgtggatgctcttgagagcagcagcctcgaccatggctttagctgaattacgtaagttttgatatgtcatacttctatgagcattcaatgaaacattttaaaataatttccactgcgatttcttctttgattcatgactttttcttttggaagtatattgtttaattccaaacatttggggatcattctaattatctttttgttattgatttataacttaattccgctggtcagaaaacatactctacagatttcaatccttaaatattagttgaaatttgctaaatttattgaaatttatcatccagcatataagtctatcttagtaaataatctatgtgtacttaaaaaaatatataccctgtagttgatgagggctatataaatatatatgttaattacatcttgtctgttaattgtgacattcaaatcttct

SEQ ID NO: 475369 - DNA, 588 bp, Homo sapiens
tcgctgtgctaaacacttcccatgtcaatttacacagcaaattcaaaagtttgtgttcctgttttattcctgaaaccagagtatagtaaagaaagcctgagagactccttacagagtggattcacactcttttcttgcctgattttcacaataactctaagccaaaaagttaagacacttattatttccttgttacagacaaggaaactgagactgactgagagatcaagatctttgaatttggagattgtacatgccacacagataaattgtcagctttttcttgcatatccctgcgctctgatcacgttgtccccagatgccacctgctgcattcaactcattgacatggagcataacaatgtggatgtcatcaggctcagcaggttccatgtttgcaggaccgtgggccacacctttgtaccttcctccatttggccaccctcaagggaccttgatgaagctgttgatacttgtggctggaaataaccgtcccagaggttccagctgccccaagaggcaaggcatcaatatcataccccatggtgcactgactcgccatttgggccgtcccgtgtaggatgcatc

SEQ ID NO: 475370 - DNA, 654 bp, Homo sapiens
ccctgactgttagaaggaaaactaacagaaaggaatagcgtcaacatcaacaaaaggacatccacgcagagaccccatccgaatgtcaccaacatcaaagaccaaaggtagataaacacgaagatggagagaaaccaggcaaaaaggctgaaaattgcaaaaaccagaaagcctcttctccaaaggatcgcaactctgccagcaagggaacagaactggatggagaatgagtttgatgaattgacagaagtaggattcagaaggtgggtaataacaaactcctcccagctaaaggagcatgttctaacccaatgcaaaaaagctacaaacattgaaaaaagtgatggggagaatggaaccaagttggaaaacactcttcaagatactatccaggagaacttccccaaactagccagacaggccaacattcaaattcaggaaatacagataacaccacaaagatactcctcgagaagagcaaccccaagacacataatcaccagattcaccaaggttgaaatgaaggaaaaaatgttaagggtagcccatcaaattaacagcagatctctcagcagaaagcctacaagccagaagagactgggagccaacattcaacattcttaaagaaaagaatttcaacccagaatttcatat

SEQ ID NO: 475371 - DNA, 764 bp, Homo sapiens
aaaagaaacttagctgctgctccagccatgactaaaaggggccaaggtacagcttgggctgttgcttcagagggaggaagcccccagccttggcagcttccacatgatattgagcctttaagtgcacagaagtcaagaattgaggtttgggaacctctgcctagatttcaaagggtgtatggaaactcctggatgtccaggcagaagtttgctgcagggatggggcccggatggagaacctctgctagggcagtgcagaagggaaatgtgggatcagagcccccacacagagtccctactggggcactgcctagtggagctgtgagaagagagccactatcctccagaccccagaatggtagatccactgacagcttgcaccgtgcacctggaaaagctgcagacactcaacaccagcccgtgaaagcagccaggagggggcctataccctgcaaagccacaggggcagagctgcccaaggcagtgggagcccacctcttgcatcagcatgacctagatatgagacctggagtcaaagaagatcatttggagctttaagatttgactgcctcactggattttggacttgcatgggccctgcctttgactgattgaataagaccaaaccacgttttgaacactaatctgctttactcaaaatctatagttttaaatgttaatcacatctaaaaaataccttcccagcaacatctatactgctgtttgaccaaaaactggggtaccatggcctagccatttgacac

SEQ ID NO: 475372 - DNA, 934 bp, Homo sapiens
actatccaggcatttcctccagttctcccatctctctaggcttcaggatgcagactatagatagaagttggtaaggtgagatggggtctggggagtggaagatggagagaggagactgggaacagaatttcttccaagcttccttaaaccaaattaaccacagagggatgacacagagacagaaaaacatcaagaagggggagaagaacacaattgtcacctcctacaacaggaacttcacgggccgcaatgacacaaaccccaagaccatgccttcaatcatctccccagagattgtcacagccctggccattgcaagaaccctaagttcaacccagagaccgactgccttatgggcaaggatggcaagaagttcaagctggaggctccagacgcaatatgagcttccccaagcgcagtttgacccagggcaggacacctaccagcaccccccaaaggacagcagcaggcagcatgtggatgtgagctccaccagccagcacctgcagctcgtggagccttttgacaagtgggatggcaaggacctggaggacctgcagatcctcatcaaagtcaaagggaagtgtcccactgaccacatctcggctgctggcccctggctcaagttccacgggcacttggagtacatctccaacaacttgctcattggtgccatgaacattgaaaacagcaaggccaactccgtgcacaatgccctcacccaggagtttggccccatccctgacactgcccgctactacaagaaacatggcatcaggtgggtggtgattagggatgagaactaccgcgaggactcgcacggggagcacacagcactggagcatcacctcctcaggggccgggccatcatcaccaagagctttgccaggatccacgagaccagggcctgcagggcctgctgaccctgaccttc

SEQ ID NO: 475373 - DNA, 1102 bp, Homo sapiens
tgataccagcgccacaggttctccagaacctagagaactggccatggtgaggcagggtgccacatcagctcacgtacctggagggacagatactctgctgggccagggccccagttccccagttcctcaaaggaaagagaggaaggaaggaaggaaaaaaggaaggaagccagcgaccaagccacgaccaagcccaaccacgaaggccaacaccaagcgagcgccagagcgaccacaaagccaaagacctcacagagcccacacgcgcccccccggccccacagggccacacgtccagaccaacagagccagagccgcgccaccacaacacaccacacagaccacgacacgacaggccacagccagcgcgaccaaccacaagccacaccccagccacacagccaccactaccgggggcgacacgaccacgacacacaagccacaaccacacgcgagcccaccaagccaccccgccagccaaaccaagccacggccaccgcccaccccgcgaccacccgccacgccaagccacaaaaccacccccgccacaaacaacgaccacacacggccaggccacggcacaacacccgccacgccaacgcccccgacgacacctcacgagggccacccacccacagccacaaagccacccccacagcaccccaccacgaccaaagaaggaaggaaaagcgaaagacacgacacagcacgagagaaaccgcaacgacaagacatcccgacaccgggcgacacacgacaggacagacgagagagacgggaggacagacagcagggagggagcgaacgagaaccggcccatggcggcgcggcagcggaccctctgtttttggtgtcccaatagagggagatattgaatatgtcttaccttgattgtggtgatagtatcatgagcgtttttgcatgttcagagtcactaaattgtacatattaaatatctataattatttctttatcaattatagcttaataaagctttttaaaaaagaaaaaagtggaacatattatctttagagaaactaagctgtgaaaacaagtagtaaaaacaacatacctttagtactttactaaagaaagtcagtgt

SEQ ID NO: 475374 - DNA, 609 bp, Homo sapiens
tagtagtaaagtccacttgatatgaaccagtgtcaagatcgcatgggtttggaatatgggctctcattcctctgtagctggagctcttctagcagaggcatgggttggggagctgatgccacagtattggttttttgcgcatctggcggcgagcccctttgctctatgacacctccagtgtgccccagccccagctggtctggctctctcaactccactgcctgtctgtttgcacttctggtgaaagcatgtggaggtggcgagggaatacagctcctcaagtgtgccaggatcaccagatctattcccaagatctgtgattctgtctgcgctgaaccatccaaggtgctggcgtctgccacagagaaaggtcttgtcgtgcagaatgcttttaactttacacattgcattcgaagagggaggagacacatcatgatgattatggccatgggttaagctccctgggtcttggtttccttattgtaaactccggagactgatggtgggtgggctggagagtttctaaagcaccttcccctttttaaatgtctgaaaacatgacaaaagctaagatggtgtttaggactgcgtttgaatgtttctgataag

SEQ ID NO: 475375 - DNA, 828 bp, Homo sapiens
aaatccatagaggcagaaagtagatattgtttcattctggttttgaagccagtacaaacctagagagaatgctagttaaagtcacctgagctgcggctggggtccgggaacagatgcttgactgggtgactaaaaggcatggcagttttcgttatgagaaccgactgaaaagattagagctcttcatcctgaaagggactcagactgcagcctatgaatcaagaagcaatgtgaaggctggggtaagcactctttgtccaacagaccccttggtgaggctgctgaaagtgccatttgatgctcgacaaagctcctttcagaacacggaaagggatttttctctttcaaactgggccaaacgatatcagttcttagtggccataggatcttcctgggaacatctctatagagcagcaggagtgcctattggaggctgtgggacccacagcaagtttgcagactcagtggatgtagagaagagattgggtgtaaaagtagcagagcatgggctcttaaatatgtctgaaatacccccgggggtcccagaacaacttgtagtagaaggagacatggtcaaggcactatggttctatggttaagaaagtattaaagggggtatcagaatacaattttaaaataaaaccaacaaacatgacaacttctattaaaggccagtagttgttgaagaaacactaaaaagaaagttattattttgaataaaagaagcttaccaagctatgtgtggcttggattgtggctaatgtttggtaaggcctcaactttgactctccattcatgaaattcaaggtttcttatctcctgtgttgt

SEQ ID NO: 475376 - DNA, 1257 bp, Homo sapiens
ttaatagcttcctttgcatcgtgggacgagggaggaggagcagaaggagagagagggagctgaaagattgttttgtctgatacagcatgagctttaccactcactccaccacctcctccaccaactactgttccctgggctctgtccagctgcccagctacgtggcccagctggtcagcagtgtggccagtgtctatgcaggtgctgggggctcaggcttccagatctccgtgtcccactccacaagcttctggggtggcttgggggacctggtgggaataggggatatccagaacgagaaggagaccatgcaaggcctgaatgactgtctggcctcctacctggacagagggcattacttcaagaccattgaggacctgagggttcagatcttcgcaagtactatggacagtgcctgcatcattctgcagactgacaaggcccatatagctgctgatgactttagagtcaagtgtgagacagaactggccatgtgccagtctgtggagagtgacatccatgggctccgcaagaccactgatgacaccaatgtcactcagctgcagctggagacagagattgaggctctcaaggaggagctactcttcatgaagaagacccacgaagaggaagtaaaaggcctccaagcccagattgccagctctgggttgaccatgcaggtagatgccctcaaatctcaggacctggccaagatcatggcagacatccgtgcccaatatgacaagttggctcagaagaaccgagaggagctgaacaagtactggttggagaacagcctgagggaggtggagacccgctatgccatgcagatggagcagctcaacagggttctgctgcacttgaagttggagctggcacagacctgggcagaggggcaacaccaggtccaggaatttgaggctctgctgaacataaagatcaagctggaggcggagatcactacctaccaccacctgctggaagatgaggagggcttcaatcctggtgatgccctggatagcagcaactccatccaaagcatccagaagaccaccacccacaggataaaatttccagaagacatagcaagtgctcttgttcacaaagaaaatgaaattcaagttttgagtaatggcattgtgcagctgaaatagctgcaggtgaccagactgagaaattaaaaaacagatgatgaatgtctcacaaaaggaatctttgttaacaatagttgaaaactacatagaccatttctaatcc

SEQ ID NO: 475377 - DNA, 747 bp, Homo sapiens
tgaaggcttataactcaaccactactacccattcagaagagcagaaagtatctgctgtgtgagcgtccatatgttacctaatgtgtattttgctgtcatctcagctgatagatgtcagagagctagttatcatgaaagtcaaggaggaagagatttacaaaggtcaacattgtcaaaaggagcaaagaggtcaaataagatagagctgtcggaaattttcttaagatcagttgcagtgaatagactgggggtaaaggaggaaaattcaaagattgaggagagaatggagacagagtcttgctgtgttgcccatgctaaagcacagtatctattcacaggcaccatatcgtgcatcgtgcaccttgaactgctggactcaagcaatcctgctgcctcaacctctccagtagctgacactataggcatgtgccactacaccaggctgccccacagatttcttctcttccttggaccagcagcatattattctcacggcaaaaggcagaagaggaagagggcaagcccaaatgctcatttcaaacctgtgcttacaaggcccttggcattcactgaccgaaaaatactggaatgagggctaaggtttaacaaattttaataagatatttagaattaccttctcagaatttgaatactgtaactacaaacattcaaatatattctaaacttcaatttaatctttcttgaaaatgacaaatacatatttttaaaaatttatttatttattta

SEQ ID NO: 475378 - DNA, 707 bp, Homo sapiens
cggttcgttcattgagatctggacatctgaatatggtcaaccagaatctggaattttcgaaggcatctcagatgatgcttctcagagctatatttaggaatgccaccttaaaacatatcagtagtaatcttatctttagcattctgcagaaggttttagtggtctggatggaagatcaaactggccacagcagttcctcaagtcaaaacctaatccagagcaaggccctatctctcttcaattctgtgaaggctaagagagacaaggaagctgcacaattaaagctggaagctaacagaggttggttcatgaagtttaaggaaagaagacatctccaccccgtaaaaataccatggtcagaaacaagtgctaatgtagaaacctcagcaagttatccagaagatctagctgagatacctgaaggtgactatatgtctggagttggttccttccagtggatttgtggtcttgctgacttcaagaatgaagccgcagaacttcacagtgtaacagctcttaaagatggcacagactcaaagagtgggcagtagcaagatttattgtgaagagtgaaagaacaaagcttccacagtgtggaagggaacccgagtgcattgccactgctggctggggtggccagcttttattcccttatttgtccccatccatgtcgtgctgattggtccattttacagagtgctgattgg

SEQ ID NO: 475379 - DNA, 1511 bp, Homo sapiens
acagtcaaatgctaaatgggagatgttactacgtaagaaagacacagacagatgcaaagctgacagctttgaaggtggaggaagaagatcacacaccaagaaatgtgggcagcttctggaagctgaaaagaggggcccaaaaagatcagcagctgatttaacattggaaaccataaaggccagaagacagtgggatgacacattcaaagtgctgaaacaacaacaacaacaacaacaacaacaacaaaaacaaaaacagatatgtgacccaaaattcttatatccagtaaagcaagttttcaaaaatgaaggcaaaataaagacctttccagataagcaagaaatgagagaatttgctgctagaagacctgtcttaccagaaatattgaaggagactcatcagacagaagcaagtaaacccaaatggaaatttgaatgtattcaagaaaacaaacaggattaggaaaggattgctttggttattcaggctcttttttggttccataagaattttagaatagttttttatagttctgtgaaaaatgatattgacattcgtagtttgatagaaatagcattggatttatagattgctttgggcagtatgtccattttaacaatattgattcttccaatccatgagtatgaaaaatttttctatttgcatgtgtcatatctgatttattttagcagtatattatagttctccttgaagaggtctttcacctccttggttagacgtattctgaggtattatattctatcatattgtatttttctgactattataagtgggatcgtgttcttgatttgactctcaacttgaatgttgttggtatatagaaatgctaattttggtacattgattttgtatcctgaagctttgatgaggtcattttcagttctaagagccctttagtggggtctttagggttttcaacgtacagaatcatattatccatgaagagagatagtttgccctcttttcctatttggatgtcttttatttctttttcttgccctagtgctctggctagcacttccagtagtatggcaaattgtctagttttctcctcagttctgttggctttttcttcatgtattttgagactctgttgtctattttatatatggttatgtatgattataatcattataacttgctgatggattgaccctttttattctaaaatatcatttatctttagtaacctttttaaaatttttataaatatttaacagtaacataaaggacgtgagtggaagcaagatattaacttatatatacaggataaaataagaaaattagaaatagtaaataagaaggcatagatagcatcaaaaatatatactgcactcctttcttttttcagcttttttaatagacatcaaattatataaagtaataattataataatttatgttgtttctgtaatacaattaaaaataatatgtttaataataatatcacaaaaagagaagaggaaatagagataggagtaatgttttc

SEQ ID NO: 475380 - DNA, 762 bp, Homo sapiens
agcagtggtaatgtaaagaaagcccacatcttccaactttcaatattgaccactgtttgcaatggaaataaaggcaactaggtttcctaagagagttaggagcgaaaagaagaggcaggaggaggatatgaagaaacatccctccccttcctgcctgggtggtgtcagagatgaccaagtggggactgaagactttcatccccctggtggagagcacatgggaagcctagacttccactcccactcagcagtaaaaatctgttcatcctcttccccattggattgggaatcggcaaagggaaaaggcccatgggatgaaggccagaagaaatcaagctacaagtttttctctccagtggagtcccatgaggatgcacacaactctcccagcagcaatgtgggacaacacatgcaaagtattggccatcagggaagctccccccagctttggtcaccagggttttttattggttgtcagtcatgcacacattcagtgcttctgtgactgacctcacccaccagactgtaacctcaagagcaaaatcaggtattcaccataaatcagactgttaggataaacttatatgctcaaattgccatagcatggcccaaggcctcaggcttatggaaatattatcaggcagggtattccaggagctcagaaattgtctccaggagacgaatgggacagggaaggtaggaggttgtagcaacttgctaaaatgggagacatttcacaagaaaaaatcagttgtagaaaat

SEQ ID NO: 475381 - DNA, 868 bp, Homo sapiens
gagttaatgggtgcagcacaccaacatggcacatgtatacatatgtaacaaacctgcacgttgtgcacatgtaccgcccttggacagctggagtggtgtgggtgatggcagtagtggtattggagcaactactgggacccaggtgttttgtgttggtgttgctggaggctgcgatgggcattatgaccgtcatgcacaactggcttttcactccctgaggattccctctggctgccagaaccttctctccctaggtcccttgaagggccagagagttaacatcttgtgggagcagcccccaggaagtgatctctcctgttggatggccctgagtcacatgtgccacagtagctcccagctttatcccagtgggaactactgcccctctaccagtgcctctgcatctgttaccacagaactgtcggaggagaacagggaaatgtcagcaagttcccctgaaacaaagcagtgtcagcctctgagcagagcccaggccctatccaaccagactggacttgggaaagtaggaacaccgaaggtcacatactcccagaagagaaaaattagaagtcagggcccccaaaatatgccatttcctggactctctgggaagtgacttgtgttaccacctgtgtaagagatattctgaaaattttattttattccattttatattaaagatttgaactggaaagccaaaatcaaatttgttaggaaacttgaaaatttagctcagaaccataaataccaaataaatgataattgacaacacatttgaaagggaaaataaagtacttcaaaatagaaggtaatgtaatcataaataatcttagctctttcataattgaagagccaattattctgtaat

SEQ ID NO: 475382 - DNA, 2256 bp, Homo sapiens
ctccaggtctgtgatgcgaggggcgccacaaactggattcacacattttattgatatgttggctataataatcattctccctaaagctatttcaatgaagggcatatccactggaaataataacatcactataaagaaggagaagaagaaagaggtagaaaagaaggaggaagaagaggaaaaatgtgggagaaaacagcgacaacatcagcttctgttgtatttgcagcaggcaattgagggtaaggtgatgtcatcctccaggacaaagtacgagcttgctataaaggtatatccccatatctgtctgttctttggctgtgttgtaaacctgctgtgtgtacaggatccacttagtccactgtgctttattccagtggaacttgtgggcaaagaaaaccaatgcatacatgaaatgcatattgcttgctgttatgtgaaaagtcctctgttaccgaccctgtagctttctgtgttcttccatcaaccatgacaccatacaaagctaacttacaagcttgcaaaggggtaaaggcccagattctggcaggagtgaaaaagaatgaaaacttgttatgttaataattgcaattcctttactatgctataatgtaggtaataacatgatttttctcatgaagaggagtttctcactcagttgaatagttgggagatttgttagataatgtgttaatattaatatgtaaagtactgacatgtataaattaatttcttctatcatataaactagagaagatctaaggttataatgataaaaaacctcaccccagattaatgacagtgatacaaaaggaattcattgaggacaaagaaggcgtcactgaattctgtaacccaggctttatttttcctttgacttccctgcataagttttaagattctattaaaatttagagtaatcactactcatttctacacgggaatattttagtgatggaaacatctattggtgttgggaaaggatgggttctgagtatgtgttttcatagcattttccatgaaaaattgtcacttgattagctcagagaaaagaagaacgcaaagaggctggtggagattactgggaggatgccggtggacaaagacagatctagggacaactgtaaggatatctcattcacaatcagattataagggatccctttattcttatttactctgtattacctggagaaaaatgtaaaaaacactgctttagtgagaaatgaatacattttggagataagcaaaacaggtttgagtttctgttaagacttcctgactgtatgaacttgcaaactacacagctctctgagtctttggtttatgtgtaaactggagagactactttttgtgaattctataatcttatttttgtaaagttaatcttttttgaattcttaaatgaaataattcataaaatttaataattcaaataatttatttcataaattatgaaataattcataatttaaaaattcccaccacaggcagacactttttgtgtacccccacatggtactgtgcagcatcaagcacattcttaggcatgctcataaatattaactcatttaaattcttcaataattccatgagatagataacattattctcccactttaagatagagaaaatgagatacagaaagattaaatgacttgcacaagatcatatgcaaaaagataagaccagggttggaccaatatattcatattattaaacactagctgtactatcctactgttcaacaaatagttcccaagctctaagccctcagtaagcttcacaccatgaaggagctatgtcaatatgaatctttgaagctttataattgattagtacaattttgaaatactttttcctctttagcgtacattgattttgtgtcacttctctgggagatatagttaaaaggaagttttattaggtcggtgcaaaagtaattgcagtttctgccattacttctaatggcaaaaaaaaaaaaaaaaaaaaaaaaccaattaattttgcaccaacttaaaattttgtaattgaaaataaagtagttaaaagttaatctcaccatcacagaaagactgaaataaatactgtaagacatgaatcatgccatttctctaggcctcatatccttgtccacagcatttcttcctatcaaaacctttatatcttcttttctttgcagcattatttaaagaagagctttacttcagaatttagaatttaaaatataaagtttagatcatgtccaaattttcc

SEQ ID NO: 475383 - DNA, 1263 bp, Homo sapiens
gaggcccgggacttatagtatgtctatctggctttataatccaagctctctatgccatgattctgcaaagagcattgtatattggagattccaaacaccaagaacatgatgtagcaaatggtaggtattcaacaaagaattatcaagtgaatgagaaaaagaaagtggatgtaaatatgactgcagaattgcccctaagctgctcctctgggcacactgcctatggggtaaccctggttcacaaagagcagtaccttgctgctgctgtacactgctgctttaaagaagacaggaaaaggtggaaaagtttggaacttcctagagacttgcagggctcagaatacaggaagatgtttgaaagtttggaacttcctagagacttgttgaatgcctttgaccaaaatgctgatagtgatatggacaatgaaggccaggctgaggcccgggggcctaggaggaaaaaatggttctgtgggccaggtccagggactttcatcctagccactctagctacagccgtggctaaaaggggccaaggtacacctcgggccatttctcctgagagtgtaagccccaaaccttggcagctctcacatggcattgggcctaagatgatgattttgactccagatcttaaatgctcttctaggattccaaaatgttacaactcatccattggtttcctaagatagaggttgaacatatggctttattacacttctcagaaggaaatattttagttctaaaactttttatagttttaaaatgataaatagtattatctgtatcaaccgggtatgaaaatagattacttaacatgattatatactgtgttacaatggcgcataactgaacttatacagtatgttgcttttacttacaagtatggaaataaataatgatacatttcaaattcatcccagaggctattttaaacttgtcatttaaaatacagtttctatattcaatatcttggtagaaacaaaattatatttaattttattgaagatgctttttgtttaatgatgctgttatacattaatgttctcttatgccatcattgaaaaagattatattatgtttgtataattgtcaacaattatacattgtaaaatgcaaatatactttctcacttttaccattgtatatattctgttgaagatatggtccaaaaaaaaacaacccattcaattcacttaatgacttatgttttaaactttttgcgtatgtcagaagccagtgtggcaactgataatatgatac

SEQ ID NO: 475384 - DNA, 488 bp, Homo sapiens
agcaaattctgagttgacagcaactctggaaggagagagagatgattcacacagattataacagtaataactgtttaccagatgaagatgagggacttgttgggaactggagtaaagatcactcttgctatgcaaagagactggcagcatttcgctcctgtcctagagatctgtggaactttgaacttgagagagatgatttagggtatctggcagaagaaatttctaagtggttaagcattcaagaggaagcagaccataaaagtttggaaaatttgcagcctggtgatgcaatagaaaagaaaaactctttttcagggcagaaattcaagctggcagcagaaatttgcataagtaacaaggagccaaaagctaattgccaggactacggggaaaatgtctccagggcatgttagagacctctgtggcagactctcccatcaaagacccataggcctataagggaaaaatggttacctgggccaggt

SEQ ID NO: 475385 - DNA, 588 bp, Homo sapiens
gagggctgccagcacgctgtcacctctcagttgcaacaccttggactaggctttggtccctggaacccatgagtaccgcaaatgttgcagatgttgcagaaagtttgcagaatgtggttaagagtctgctcccacatcatttctggcattcactctctctctctttgactggctggcattgggtcacatgtctccccttgaacccatctctggggcctggaggatgggatacagaaactgtagtggaaaattacagtcaaaggggttgttctctggcgggcaggggcggagttcacaaggtgctcggagaggagcttctgagactcattgtccaggagaaggaatttcacaagataatgtcatcagttaaggcaggaactgaccattttcacttcttttgtgattcttcagttgccttaggccatctggatgtgtacgtgcgggtttgggctcagaggcctgacatccctgtcttcttatattaataagaaaaataaaacaaaatagtggtgaagtgttggggcggcaaaaaattttgggggtggtatgaagagataatgggtgatgtttctcagggctgctttgagc

SEQ ID NO: 475386 - DNA, 1603 bp, Homo sapiens
gcaaaaggaagaggccagtttgaaggttattgccatagcccatgcaagagacaatgatggcctggacttggccaactggcattagtttagattgtatgacccgcccccggccaatggggaaagggtacaagggcaggacttgcgttgggaataaaggctcttgtacccctttgttcaggtgtgttctcatggcaaccggccaaggaggcacccctctgcgcaaaagcggcttaagcctgccctgtggagtgtccctgcaggggactccagccagcctgagaggcacgatccaaagagcgctcctgggtaggcaattgccctggtggaacgccttgccagagcagcacataacaggcccctgtggaggattaacacagcggctgaatacccggaaggaactgggacttggattaaaagaacagcagcataagcggctggcaaaggcaaggaaagaccagcagagagaaaaaaaggccatctataccaattctaagttaatttagactaaacaaggtcttattaatagcaaaggataattgaaatcccaaacttacaaggttttcaacaaaagtgaagtttgctaaaggttagcagtgtagcatgtattatggtaacttctaatcttgtggccttagacagtctagtccaaagacataaaaaaagttccctttaaaaaaaggaatggttatgttccaaaaaaaaaaaaaaaaaatgggaggcagaatttatgtaaaaggagtgttatatggtaaattcttgtcctgaaataaattaactggttgtttaaaaagaaaatgtttgtagtaagtcagaaagttgagacatgttgaagaactgttggccaaagtcatgaaaaaaaattataaaaaaatttatgcgaaaaatgttgtataatttaaaagtaataaggcctcccgagtactattaaaaaatagtttatgtgcaaggtgtataagaaaaataaaatatacctttggtaaaaagattataaaggggcataagaatgtagatttttacctacattaaaaggttaaaaaaattgttttaaaagtttaagcaagttttaaaatgttaattgtaaaaaaaaattctgtgtgtaaacatattaactaaagttaaaaaggtatcatccagtttttctgtgaactggacattaaagtaaaaatgcaacaggtttttctgaaagcatcaacctgctctttaacaaaagttacaaaaggttaaaaagagtctataaaatcttaccttatggtcaaacataaaaaaaattggataaatatgtctacaaggttttactaaaattgtttaactttaatagctcactaatataaaggtaaaatttagcttatctggtataaaaatcatacaagaagcattattaaatataaaatggtgtttagctctctttggtctaaaaactaataaaaattggtgctaaaggaaacattcattttactagaagatcataaaagttaaagactttaaaaaaactttggcaattaagacagcataccaagatgcaaatgcctggttgaaatggatcaaatattccatctgcacgttaaacaaaagcaattgttatgcttgtgcacatggcagtcca

SEQ ID NO: 475387 - DNA, 630 bp, Homo sapiens
gagagattgcaaaaacaattcactgccaacagactgtcccagcagggtcccagtgctatggtcgtggccctgattggcatgctgcccctcggatgcccaatcagatggaaccggaagaaatcgaatacagagaaatgtgggagagcacttgtgtccctgaaggaacagccagttgccatgcgcgaccatcactatagatctacaatttatgaaaataaagcaatatgtgcctgtttcggtgcctgccgtttgcctaccaatggtgcagtgttcaccattccagccctctcggcattcacatttgccatctttacaggtcccgtgctcaatgcagcgggggtggcacacgcgctggtcacacgctgcgcctgtccagccctcttcacagcggcaggctcccccgatgcagacgcctgtggcccctggaccaacagcatcagtatcacctgggaactcgttagaaatgtagactcttgtgccctcgttggaccaagtgaattagaagatctgggaatgggactcagagattttgttggaacaagtcctccaggtggttttgatactcgctagaatgtgagaaccactcttctagagattgagaccactccaaccagtttggcaaagctaacc

SEQ ID NO: 475388 - DNA, 629 bp, Homo sapiens
gaacaaagcttcggaagctagtccacttgcttctgtctagaagaggagggcggtgctgggaggaacctccctgactcctgctgcagacccactgagaggtgactcccacacggctgtcctggaacaagacagcagcttttcttaggttgttctaagttaagggctctcactgctgaagagagtaccaatcactccataacttgggtaatgcatgtcaatggtgatctgtgtggggccgcaaggttccagatggttgggacaactctacaatcagtcacatttgggttggttaaatcccccactcatctttacagctgtatcctgcaagttagtggctgcctgtctctgaacttcaccttccttatgactcagcatcatcaagactggagggacagagcatttgaatcatcagacgctgggccagacgtcaccccacgcgttttctcattttatcgtcctaagaagcccagaagatgttgcatttcagagaggctgagcgtgttgactaaggtcacacagctacaaacatcagggacctgcgaaaaagctctgttccctggtgacaggtgttctgtgatcctaacacagccggaggtggggacaacgtccttgcagtaacaaaggccctg

SEQ ID NO: 475389 - DNA, 948 bp, Homo sapiens
accaggaggaaattgtctgaggacctgacgctggccccttctgccccagcccagacaggctcacatcagtggcgtccaaggccgtgggctggcagctgactgagagctgggcctctgtccttcactggttcctgatgaggggctgagtctttggtttagcaagcacttcctaaatgatgggaaatgaggacgttcccatccttgaggacagatgaacgtttgggaatgtcaccaagcaccaagcaatgttaagtgctacactagccataccgggggcattggcttatcaaaaattggagaagacagtgttacaagaagaacctgagacagtaaatgtaaatcatgtggccccgaccataaatggaatgggggccttcagcatgcactggcatggtcagaggtttggggctggaaccatgaaaagcccctattgggtcctaccttccgcccaccacaccatccagaccaacagatgcttactgtccacaggcttaactgatgattcctgtcacctgattttccaagttgatgggtacaatatacgtcattgtggggacggataccctaaaagccctgacttcactactacaaaatctatgcatgtgacaaaactgcagatgtcccccataaatttgtacaacaagaatttgaaaaacaaaaagtgtcaggggaataaaaagcatttcagttgcttcacctacagtaaatcagacaatgctgacagcaattgccatttaccaagcacctgcaagctcaggcactgtgttaagcctctgtgtgcagactgccctccatgctcacagcgcccctagtgctagatgcggctgatagctccattttgcagactggtaaaactgagtcccagtggcaactaatctgcttagtgtcatgtagacagtaactgctggatctaggatttatccctgtgactttgtgactcaagccttc

SEQ ID NO: 475390 - DNA, 514 bp, Homo sapiens
gcttcatcgggttgattgcatgtctcacagcagaggggtgcaagaacaacatgcaggtgcccctgcactatgtctgcgatcccctgtgtgggggacccggtgcacccatgctgtgtctgcaataccctgcatgggggacccaggtgcacctgcactgtgtctgcgatctcctgagtgggggacctggtacaccttcactgtgtctgcgatctcctgagtgggggacctggtacaccttcactgtgtctgcgatcccctgtgtgggggacccaggtgcacccatgctatgtctgcaatcccctgagtgggggacccaggaggccctgcactgtgtctgtgatcccctgagtgggggactcaggaggccctgcacagggcaggctgatgagacgggatggctggcaggggctcacagcactctgatggctttgcccaggattcctgatagttacactggatcttagaacaaaatcatataaaactggaaaacactatggattcagatttggccttt

SEQ ID NO: 475391 - DNA, 1054 bp, Homo sapiens
ggaaaatgacctcacagcacatctcaagggcagcgactgcgggctatgagacgagcagggcagggacatctaacccaacaggaagaggagcatgtggcttcttgctagacatggcagctgagctgagcctggacgatgtgtgagaatcatccaggtcacgtccagggagctgaatggggctggcagggagaagacaatatgggaaagcgcacgagattcaccactcgcttcaccttctccaccaactaccagtccctaggctccgttcagcctcccagctatggtgtccagctggtcagcagcgcagccagcgtctatgcaggcgctgggggctcgggctcccggatctctatgtcccgctccaccaacttccaaggctgcttggggtctgggggcctggctgcggggctggccgggggtctggagagaatgggaggcatccacaaggagaaggagaccatgcaaagcctgaacgactgcctggcctcctacctggacagagtgaggagccaggagaccgagaaccagaagctggaaaacaaaatctgggagcacctggagaagaagggaccccaggtcagagactggggccattacttcaagaccatcgaggaactgaggactcagatctttgcaaatactgtggacaatgcccgcattgttctgcagatcaacaatgcccgtcttgctgctgatgactttagagtcaagtatgagacagggctggccatgcgccagtctgtggagagcgaaatccatgggctctgcaaagtcactgatgacacaaatgtcactcggctgcagctggagacagagatcgaagctctcaaggaggagctgctcttcatgaagaaaaaccacaaagaggaagtaaaaggcctacaagcccagattgccagctctgggttgaccatggaggtagatgcccccaaatctcagaacctcaccaagatcatggcagacatccgggcccaatacaaggagctggctcggaagaaccaagaggagctggacaagtactagtctcagtagattgaggagagcaccacagtgg

SEQ ID NO: 475392 - DNA, 3391 bp, Homo sapiens
tggggctcacagattggttccatgagccggggctgtcttgtctgctccttagtatacatgtggcagacagagagaagggaagacggagccgccatcttgaacatgattggcacaactgcagcatctatgtctgcagctcgattttacaggctgttcttttgctctaccatggtggacgtaagactggtgtttatccagcccttgctgtgcagcagtcatggtggaaggaatcatgggagtatcatctcattgagcccccaccacctccctgagactgaggtcaatgtccgcattctacagatgaggaaagtcggactcaagagaaccgaagagacccgcctaaggtcagaaccagcttgctggcaggagagtcaggattcgaacccaggtctgttgactcccacatctgactctttccacatactccctgggccagctctccacgccaggcccctctctgccaaagagaagacctttgcgatgttttgtgtccttgaaggcaaaccaaaagaattccctacaactcgctgctggcatttcaagtattggtttatgggtttcttgacctcttccctgaaacaatacgtgtgtacgtgtgtgcatgcagacacaaataccttgtgagtttatactgatatgtccaattcaaattcagcacttcagagatattacttaggcttctctatgttatatttgtatctgcttccacaccgagaaccctggttcttaaggacacagcagttggtaaaatctgaataaaccataattactcatttgctttgttccatttcatacatacaaccatcgcaaaataacaatattaaagttaccaccatggattaaaattgctgaaacggctcattttctttcatatagtagcttcactcttcttcattaaaaaaagaaaagaaaaaaaactgttgtactatatccacatagtcagatcaaagaaccattctctactatcatctttcccttttgactctcatttagccttagttctatgcatagttgtcccttctgtcatttttgttgtctgaagatcattctctagtagattccacaaaaggctcatgggaataatatttcttgagttgataacagtttgtaccctttatatttgaaggttagttttgctagatataaaatccttggctcaccttttctttcctgtgtcttctggtataaaatgttggtgtcaaaaagtctgatgactatcacattttctttatcttataagtcacatgtttttttatttccccatatgcctgaagggctttcttttttctttaatgttcagtgattttactagaatatatctggtttttgtcacgttgggtcaataaagtctcaggtacgtggtgtcatcattcaatacatagtttcaattctttttagtttaggaaatttttgaatcatggattctagcatttgttctgttactttagttttcttcctctgggaattcttttatccatatgttggatcttcttggtctatgttcagtgtttgcaacttcccctcaaattatttttagtctcttttttaacatctttattttaaaattatttctctttttcatattgtatttatcttaaggcattatttgctgtgttgtctgcactgtgcttcttccaagtttagtcttcatttataaaatcattcttttcctttatttctaattctgtcttgagttctgccatctcacttctgaggttttaaatttttgatatatgtgcttctatcattgtcttaaggtcttttatttatctcaaaatagtatattagaatttttatttctttttaaaggatttttctggtgtgttcttattaactgtagaattatttttcagttcttgaatctcttttttcttgcactaacactgtacagcatttgtccttaatgtctttaatgtttatcctttttatgttaatttaattttcctgaactcctagaaagttagttgttcttttataacttcttaggttcctcttctgttattttcatgtaaagtaaaaaattataggattttgctttttgaaacttcttggctatgttctcctctttcactttacctgtactttttcaatcctttatctgtttcccctgtcctatttaattttgattcttttcccagaagtttctcctcagtgttggatcctgtcccagaaaggagttctggtgggtccattctgagattgtgtaggaatgagactgcaccaatctctcccttgcttactggttctactcatcccttttggaagtcagcaaaggccctcctaggttcagctgctgtggccaagttggtctgtcacactttctcatgaatgcctcttggctattttagggtcctctggttcttggggccattagatgccttgttgcttccattactttctctttaatggaagccaataacatgtagctcttatggctattggtgctctggggtttgtgggcattcatttttacctagtttgttttaaagattgtacgtgggtttggggttttctacctggttgctctgtttttatacggggtttgggtacatccaaagctatatttccatcatcactgccctcaaccttttagaaaccatatctaccttatgtgataaatgcatcatcatacaacagtccaatgaaatagctattattttctctcttttgcagaggatgtaagcaagtcttccaaaagagggaaataatgtattcctaagtggcagagctatgatttgaatctgtggaaccctaaaatcgtctatagtgtaacaaattctttgaccttcattattcctgttttaagccacccaataaatatttaaatgcctgctttgttctgggcactgtagaataagcagtggacttaaaataggaataatagtagttataacaaacatatatatggaacaaaaatgttccaggctgtgcgctgagcacgttacacactttattccattccatcctcattaccaccagagctctagataattacagttgagcaaactggggttcaaagaggttaattaatgtaaagcagattgtgtcacattatcttgcttaatagttcacaatgactccctatcatactagaagtcagatttaaaatctttaatctactttaatcacactagaagtcagatttaaaacctacttgacctggcccctgtctacctttctgaccctatcctagaccactctcttccccatccccatgcgccaaccaccccgaccttcttcaagttttttggctgttccaagatcattctcatcccgttccaagatcattctcatcctagggctctcgtctcagctgttccagctgccacatgagctgtccctgaatgtcagaagcatggtgccttcctgtggcttcagagagacctttccc

SEQ ID NO: 475393 - DNA, 615 bp, Homo sapiens
ccacggtagcatcccgcagcagctgtctctgctggtgctcactgtgaccatgatgggtgggactgtgggggcctcagctctcatagaattcaaagacgcacagaacaatgagtcacagaaaagaaggaccccagtggccacaggtcttccatgcttggggttcacagaaccttttccttatagcatcgccctttatgggattcacctccaacaacaaccaggctcagtagttccagcaactaccagttcagttccaaatgtcagatccatggggaacaattggaattggcctggtgtgggtcacttgctcattgtatgccaaagagcaggttcaagagaagatggtgatgagcaaccaagccacagaaagcactggctggcagggggcaccctgattttgggtcaaagctcttccattgggaaaatccaggttgcctgccttccagggaaaccacttggcttagaggaatcaacaggggtttgggagtcggaattggatataaatccttgttccaccacttcctaggtgtgtgaccttgaagatatgacttcccctctctgagcctgtttcctcgggtatagaatggaagtaataatgcctcctttgtgaagggc

SEQ ID NO: 475394 - DNA, 873 bp, Homo sapiens
gacaaggttctggggtgattcgaatgcaccccaatgcatgagagaccagtctattggcttcttgtgataatgaaatcaacctgtccacacagctgtaggcccgttgcagacccatcatctatgggcagcccctatgagctgcactgttgatctcaatcagttcatcaaatcatcgtggcaaccagagagatggagttactctcattcccatttcgtggatgagaaaagtgagactgggagagatccaaacacttgtctcagccagatggataaccactggctgggacacagtaagagccagttcacttcctcttgccctccccaggagaagagagggctaagcagggaggccacggcagaagcggagccctgtgcaaccatgggcaaggacccagaggaccccctggggcaaattcaagcgctgaaggggaaaggccatgttccccacaggaaactgcagagaggggccacccaggaaagcctggcaaactcgtctgagcctaggcggccccaggagagaggcacaacttctgctgagctgtgaagcctcagcgatgctatatgaaatcagccgggctgggtaattcacattaaggcaccggaagctgtctaacagaggcctttttctccttcttttaaattaagcaatgggatttgctcatggactttagggtcctaaatactcttgactcctatggaaaaaatagaggcacgtattagagaagcagcatgactgtgggaatataggagtatatctgggaacttaggagccataagaaccagggagctgagcaccccaggactctctctcctcatttggaatgcctcttttcctctgatttctgactttaccttctcagacagttgtggctc

SEQ ID NO: 475395 - DNA, 617 bp, Homo sapiens
gatcatcatataataaagtgtggcgatgacatgcggcctttagcggtgctgcacacgaagcgctcagcttgggtgctgttaaaatgcagagttcagggccccagcccagacaaatggcacgggcatcttcagagacaaagccctggaatcagtaccttccctaactctctgggtattgatggagtgcatccaggtttgaggatccattactgccctcaccacaaaactgcacagctttttgaaatctgtgaaaaagctgtgcgagtagctattggagcggagtcagctgccgtgattcatggcgtcagtgcgctttggtgtcctgccacgtttccaggctttgtaggaaacaattttatggaaccagttgctgagtggatggaagggatatggtgtaaaggcatcatccacttcatctttcattgggtttgttacctgccccaggtgacaaataagaactctgtgattctcttggaaaaagggaatggtttgtctttgtggacaatagagagttagagaaatacctgccaagaagctcaggaacaagtttacagtaagagtgcagtcattgtggctcttcagacttcatgtcctgaatacctttcactttctcccac

SEQ ID NO: 475396 - DNA, 610 bp, Homo sapiens
tgagcggccagtaagggaagaaaatgatcaaaatttggcaaaatgggaagcaagacgcaatttgcaaacagggaaatcaaacagtgccacatcaaaataagagggaaggaaatccagcagctaagcaggccacacagttcccagatagaggtaaacttcttttctggccgaagccctggttacgggaaacagtgtcttctgaaacgaccaggcaaactgaagtggacagatggaacaattatttggaaagcacaaccaatggaaagcaaaacaaaaagacagagaaaggaaaccctgtacccaaccctgcagttgagaggaaagagtttattggtttaaattattcttattgcctgctggcatcgattgtattttctagttcgttcatttttcacaaatatggcgagaatctgattcaatgccagctgaacaatgagtgtagatttgctgtggaagtgacaggccctaattggatcttcaatgctgaaacagctgtctgggtagaggagctgggcagggggcacatgctttggccttccctcggtgccatcctgcctgagtttagggggctatgctgcataacttaaggtcatgtgaattgtgtttcaaa

SEQ ID NO: 475397 - DNA, 719 bp, Homo sapiens
ccaggtagatatgagtgtcctcacttttgatgaggggctaaagttcagagtgatgaaatgactcatccaggaacatagaactgggtaatgtgggggtctccggtctatatgacaccttttcttatctcagtccttgcatctaacatacattgcagatgttcatgtgtgagtcataaaactaatatcaaccacagctgccattgtctgagtccttaccttgactatgtgccagacccgtgaagagacagaccatccttctgtgcctgtgaacacgtctcctccacagcgccctggctgcacccctgtctcctatggcagctgcactgaaaccttgcggatgccaaactttcatggagatttcatggcaacaatggggagaatggccctctccctctttgagtcctacagcagggcttcctgggcccagtgtattacagaacttcccattctacccacacagcctgctgctagcttgttgctgaacccagatatgaagccacggacttgggctggggacaaatccaaggagtcatacctgtgcccttcttgggacctcccaggtcagccctctatgcccaactccttcttaagttcttattctctccaggaaactcctcatcgctcctgtacgtcatgtctggtgggtccgtacgcccagttcagcagacctgctcaaaggcatgtctgatttccatgcgtattgagtcagtcctacccct

SEQ ID NO: 475398 - DNA, 1920 bp, Homo sapiens
gcactggcagcaggcagaggcagcacaggggagtcggttctgggctctagtgcaggctcatggaaggggtccttagggaaatgattgcatgggctttaatttataagctcatcatttcgttgctctatgatgatttcttcagctgtgactaccacatttttgcacaaatgaattcacggcaggaaataaagggagacaaaatgtttttcataaacctccaaccagatgtcctgttggtcagaatttggttacatggtaaggacatcatcaacatggatgaactcagggctctgttagatggaggtaataactattcagtgggcaacgaacagtgtctgtcacatgcctattctacaaatgatgaaacaggctccaagggtgccgtgataacaggtgaagacgtatgccttgaagctcattttactcacattcctgaatcttccgctggccaattacacacttcctgctgggctccgcctggttacctcggtatgaatgatactccacactcactgactgatggccccataacaattgcaaccaactggacaagggcttctggttgctgtttgggggatacccggacacagctccactgctctcagtgtagtcattaacacccagctgttaaagggaatggctccctgtttgcactgagccaattttatgacatccagtgaacatgagagaactgcaaccagaaccatttatagacttcatcttagggcctgcaatgatataaatgtctaatgctttttccaggtgtgggctgggggaagctgtgtgcataaaccttgggttgaaaaaggactgacgtaggagggttggggtcacaggaaacatggctggaaactctggctggggaacaggacaccttcctctagtcctatcatgatcctgggcggaccatctcttctctctgagctgttctgctcaccctccttgttttttcccccaaatgccctggaagaaaagaactaattcttactcatcttcatttccttattaatggttaaggattggcacataatgggtactcagaaagtatttgaatgaatgaatgaatgagtgaataaacgaagcgaatggatgcctctcttccttgagggaggagtaacatctgatttcctcattcctatctgaaacagaggaggagctcaactgcaagtctgttgggtgaagacatgaatgaataaaatgtttcaaacctggggttgcatttactgagttgacttagctgttgtactcaatggtccctctgcccagaaccttcttcccctgactcactcaggtctcagctcaaatctcgccttctcagagctgctgtacccgatcaccctatccaagatttaccatcccctgttccagtgcctcctgaagcttcatcacactccttgttcattttccttcctgacacttttcttaatatgcaattattgcatttgtttatagtctgtctccccccactatgaaataagctccttgaaagtaggagctgtgtccgtctcagtcactgcagtacccccattaaaatgtctggcacacagtaaaagttcaataaatatcttttgaatgagtgaataagtgaatatgacttccaaccttttctctggctgccagtgtccccctctccagagctggaggctccttcccatttattcaaatattccagggccctttacaatataaagcatcttaaaagtctttccggccttggctttagtaaccctacaccaccttggccccctacccctctgaccacattccccatccttctcctgcccccacagtcctgaatcttctgaattactggtcatgcttaattatggtacaaccatacaatagaataaacactgaaaatgatgttaaagaagcatgtctattgacatggaaagtcattcacaatatattgctaattaa

SEQ ID NO: 475399 - DNA, 526 bp, Homo sapiens
gaggtttgacaaagattttctgtaatggaccagacatttgctggaggtccactccagaccctgttcacctgggtatcaccagtggaggctacagaacagcaaagattgctgcctgctccttcttctggaagcttcatcccagaggggcacaagcctgatgccagctggagctctcctgtatcagttgtcgacccctgttgggaggtctctccagttaggaggcacgggggaggtattcctgaagaaagcgttattgtaggagatgacagctccatatgggctactggccctgaagaccttctagtgggacaagatgcggaggaagaagacaagactttgcacacattattcaactgtcatctggaactgatcattgctctgaataagactgactcgagatatgcaaaggactcctttaacattcagctaattttctagttcatgtcctaggtactggtcattttctatccatttttttccaggaatatgatgtaccttcttaatatacaaagttatatcttcctct

SEQ ID NO: 475400 - DNA, 978 bp, Homo sapiens
ttgaatcttcacaatgatcttgagggcaggagcccaaccttagggttccatggagactagagctgcacacaaggcaggtcctcaacagtaaattcagtaattccttgagtgagcaagtatgtcagtgagggagactggaggagtagccagaggcaggagaaaaccgggaaggggaggagaagctttgaagaaggagggagcggtaacctccaatgctgctgggaggccacggatgccggagcagacatgcggccccagttttggtggcgaggctgtcattggcagcctcctggagagaggaaaggaacgatgcggcggccgtggtggagagagggaaaggaagccggctggggcccagggagaggctgccagcgatgcggatcacccagtgcgggccagggactgggagcacagaggccagctgcccctcaggggctgtcaatgggagatgcaagagacatgtccagtgggcctgggggccctttcgttcatctacatgtcattgggaaagtcttatgcaaggtgcttgggattgatgattgacatgacagatgggaaacctgctctcatggagccctgtgcctgggatggcagaggagtgaagaccagatgcacggagcggcaggggccagagcagacagacagcctcattcatgtgggtgctgacgactcccttttcgcagtcgaggaaactgagggctcagaagagttaaaccacctgcccaagggcaagttggcaagagatgaagctcagccttccccgagggctccttacggctctcctgagcagcaagacctccagcccggagccttcctcgccagcctggctccccactcctgccactcctctgcagcacaggagagccgtggggaccctctcaatgccctctgaggtgggaactattattgtccgcccttcacaggtgaggtatagagaggtggcatcgcgtgtccaaggtcacatggatagtaaatggt

SEQ ID NO: 475401 - DNA, 528 bp, Homo sapiens
cctcactatccgccccaccagccctataatggtgcaggctgcagtggcagccgaggggtggcttgggggatggacatgtgggtcccctaaatctccatcagtctttcccccaagccatagtaaacaagaggcccttttctcacctctgagtagtgtgcagtcccaaaccccctcctgggtaggatcctgggtcctggagcagactgtggtcatgctgcacagggttcggcaagaaagagtgcctgagatggattcaccctgtcaaggtgccgagcgcggggacagcgtccattcctgcctgtggacaactctacttccaaaggaacagaagttgtccttgctctcagagggtctgactgtgatcctcctcctctgggacccggtatccacgcccatcaacgggaaatgctgatagtgaaaaatgcaaacacattgtaaacattccaaagaagatgcagacttgcaaaaggtaggagacatctttaaaatttctcttcctttgatattagtcttagtcttatatctttg

SEQ ID NO: 475402 - DNA, 1608 bp, Homo sapiens
caccatagccatccagggccggagaaacgcagacggcgtaccacacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttatgatagtgacaaggatgatgatgatagcactgaagcagtcagctaaaactttttgattgtttgccatatgtcaggaatatatgaggtgatatattcacacacatgaaaaggaaaatgttactgagtgaaaaatacttctatttttaactaatttaaaacattttagtgttcattgtttgaataatgaaaggcctgtgtatatctacatttttaataaaattatctgaaccaagagattaattcagattatagaataaatcaaacttttttaaaaaaatgtattattctgctaatttgcaaatatcacaaattcatgaatggctgttagagacagaaaaagtaacaggtcagctcccctatcagaggagactcatgcaaagcttatgttatatttttattactaagttgttgcattt

SEQ ID NO: 475403 - DNA, 690 bp, Homo sapiens
aggagcacctggcacccagaagtccctgtcccctgacagtgcagcttcagtttttatcactttttaaacgctgacagcaatatggtctatacctcgccctgctgttataagaagccatcaaggaagactagtctgggaaaccagagatgggtctacacaaaacttaggcagaaacccacctttggcaccctccagccacggctctttgttttctatagcatccctggggatgtgaagtatgatgattttattactgctgaaattgtcctcaggaaatggcatttggaatgtggaaggagagaaggaggaaaaggaggatgggtaagaaatgagaagaaaaaaggaggaggtgagaagtatcaaaaaatgggggagacagagattagcagtatccagtactgcgagcacaaatctcagaaggaattttgcatgaagaaaagcccccatctcctctctaaagggagtaatgagccctttgagtcttctcagatgtgttcagaaagtaccttgagtaaggcttggtgccagtgccgaggtgagaggctgagttgtgtatcaggaactaaaaaggatgaatctttaggttaaccctttgtataacagtctctggctttcctcagatgaaaacagagaaggtgaactccttctgcaacagtatttgccaaaatgttttctcagaacactagtgcc

SEQ ID NO: 475404 - DNA, 734 bp, Homo sapiens
tacaaggaatccaggatggttatcttggagacaagcctttatacaatccccattctacagatgaagggaccaaggttaatagacacactttcccaagatcatacagtcagcagcaagtggcagaattgggatgcaaatccaggtctatctgacttcaaaacatccttcagtgcatatcagtatttgctgagctttgcaaataattggcagctcaagagtgaattgaaggatcattcatataagcaattgcatgttcttgttttgttcaaaccaacaaactatacacacaactgcagaccgttgaggacagcaattgtgtctgaattactcaccattgtatcaacagcaccttgcaaagtgactgacccagaagaggtcaatccttcaacatggcctcttactgacaatactaacagtgggttttgtacacttaggggccatgatgaacaaaacaacatgagattaaatcaagatcaagagaaaattaagcaattaagagacatgtaaaataagacgttttttggtttttcttgttgttatgtcaaacaatattgcaatgaacatcctttatgtatattctttatgtatttgtgtgcatgcacctgaaagagaaattcctagcattggaattgttgagtcaaagggtatgtgcactacaaattttgatggaacactaataaggtctaccagtgtctgtttccaactttaagtttttataagatattaaatttgcc

SEQ ID NO: 475405 - DNA, 647 bp, Homo sapiens
ggttttcccattttagagccatggagcaggttgggagaggtttaataacccaagatgatgatcatgatgatggtggtggtggtggtgatggtaatggtgatgatggtggtggtgatggtggtgatggtgatgatgatgatggtagtggtggtagtggtggtggtggtggtgatgatggtgatggtggtggtgatggtggtggtggtgatggtgatggtggtggtggtggtgatgatgatagtggtggtgatggtgttgtgaaagaagattatccctattttaacactactggaggagatctttgggattctgtgggttttaaatccttattctgtgatagcagacccttggcagcagtggaagtggcaggatctgaaaaggatgattgggttaagtggtgcaaagactctttaaggataggcactgggaatctgtggagaagcccgatgctgctcagctgttcccaaaaggaaggctctcttaaatcaagaggcgtacggccattaggtgccaacaaaaaccagttaagccagaaactgtgaattttgttttgtttcaccaataatgtgccttttatttttatatagtgacctcacagccaaagttccaataaaaaagagataacatttatggagcatgcaacaatc

SEQ ID NO: 475406 - DNA, 683 bp, Homo sapiens
atctacaaagaaactgggacctacagggatgtgtagtggatatgtgatgctgttgctgccaaatgcccctttacccagctgccaaatgcccctttacccttctccaagttcagtgcagaggaagagtatggggaccatctccgagcccatctggaggaccaatgatgcccagcagtatcacgttctgggaacaacagaaatgacagtgatgagcatcttcagctttcatcaggaccctagccttccccatcgtccataccctttaagctccaaagaagtgaatgcttcaagcatgacagatttcacttactatcaactttcatatatggaggctgagaactttagtatgccaaaatcatggagcagatctgtacctgttgtgtttacatatgtatatcagtgtatgggcatgaaaactttctgggagaacatgcaagaaactgctgaaggtggttgcctcaagcaaggtggtcactttgcctcattcaattcagccttcctaatatgggcatctgctctattttaacgctattatctctcttttatctatttgttgatagatgcctttgtgtaccatttggttgtgcaaaaaaaaatttcccagttatttttgaaaaggtacgtctcatgtgtcagaaataaagtcactggcattaaatgttcttataaatatttattgagca

SEQ ID NO: 475407 - DNA, 1842 bp, Homo sapiens
catagagcctcagggagtcggttccttggggctggctgggcgtggagtgaaggctgggcctggcctcagttctgggacacaggaccccggctgcacagcaggtgagctggcgagcaagcattaccgcctgagctccgctcctgtcagatcagccgccgcattaggttctcataggagcatgaaccctattgcgaactgcgcatgcgaaggatctaggttgctcactccttatgagaatctaactaatgctaatgcctgatgatcagaggcggaacagtttcatcctgaaaccatctcccaccccacacaccctgtccgtggaaaaattgtcttccactgaaccaaaaccggtttctggtgccaaaaggtgcttcggtggaggggaaccagagcagcagaagaaggaaacagtggatgctgcattcatcatgaggttctgcaaagaacaagtgagagtgggcctgggacactgcagggacggctgtgagcgtggccgtgtggacatagactggtgggagggcagagagcctggggcggtgtcatttgacccagactcagcccagtcctccggcaccatctcggtctctggcagcatctgtcccctgctgcctgctccattccccattgccagggccaaggcccaggagacagccatgaatgacatgctccagggagaagatgacaaggcagtcatcagtttcaatgtaatgtgagaagtgtggtgtgagggtctgtccagggtgggtgaggtagagaggaggtccatcacactcccgtgctcattccacagtcctgagcatcatggaatctcggggtgggagggcacctctgagctccacttgtctacttccttctcctccaccagaaaggctctacttgattgtctccaatgatgggagactcattccttgatacacagggtatgtaccttgtccggggcacacagagaatgggttggccagaaaatggtagttaaagaatttgaacccaggctatccaactccagggaccacagccaggtgtccagctcaaggtgggcattcaccaaacatggactcagatgacccttttcagtgccttctctctgacctgccacctcctttcctggttcctgctggtctggactcccactggtgatctatcagagagggagggctggcaattcctgcctcctcccagcttcccttggctgccagagaagcaggtggcttcccctcatctcccattcaaagggtgtcgagctggtggaaggcagatgaatgagctcctcagccagggaagattctgttgctaaaatacacggtctgattaggagtgattgaagggctagagacagcgactgcagttggctgtgatttgttccgatctgaagtagttctaaacaagtcaccgggaggcaggagtgggggccacagagttcagtagcacagggcttggcagggatacatttcctgtggatgctggggccctttccagcaattccggacagagttttcaaacagcttttgaaatcggattcggtgcatttattttgtcttgtttccacttggcatgaaagcttcccctttgtgtctttctctctctctcttttctttctttctttcatatatatatatatatatatatttatctctctctccagcatcagaagtgagctgtaaatcaagtggaggtggcttgggaaaccgaaaccagcctggtatggaataatgatgttatctgtggctctagatcagccatgacactgcctcccgtgttgtctgacaaggagaatctgcctgagggaattcatcctgtcaggattgaaggcagtaattggggccagtgattcatgaccccttt

SEQ ID NO: 475408 - DNA, 576 bp, Homo sapiens
cagcccacatagatgagaaggaaccagcacaagaactctggcaattcaaaaagtcagagtggtttcttacctccaaatgaccacactagttccccagcaagtgtccttaccaaggctgaaatggctaaaatgacagacatagagttcaaaatatggacaggaatgaatgttactgagattcaggagaaagtcaaaacccaatccaaggattctaaggattacagtaaaatgatacaggagctgaaagacaaaatggccattataagaaagaatgaaaatgatctgatagagctgaaaaacacactacaagaatttcataatgcaattgcaattataaacagcagaatacaccaagctgtagaaagaatctcagagcttgaagactgggatgccaagttggataaagaagcaaagcctactggtatgctatcttcaagagacccatctcacattcaatgagacccataggctcaaagtaaagagatgaaaaaaaatctaccaagcaaacagaaaacagaaaaaaaaagcatggtttgctattttaatttccgacaaaacagactttaaaccaacaac

SEQ ID NO: 475409 - DNA, 583 bp, Homo sapiens
acttcgcacatgctaaagcctctgcctggaatgctcttctttccagggagcctatggctagcaaatctgaatctgcagagctttattcacttggatttcacaattgaacttgtgattgctggacctggctttgcccactggggagaaggccttactaaatgtacagataagtctaggcttggacaaaatgcagatggatttttacctaatatgcttaaattatcaaagtctaagtttaatcaaaaccttgctcttcctttcaactggaaagatggccactcattggttttacgaaagctgcccataaatgatcatttagcctggtttatcttcttggatagcgaagccaaaattgagttttatcaattctatgcaattgtaaaaacagctaaagagtatagttccttgaagtcagatcatgctgactttaaatcctggccctgccatttactggctgtgtgagtttagtacccagtctcaggtatcctttgtagtaatgcaagaatggactagtacagtacttttgtcacaaaaaagaagaaggaggaggaggaggtgcaggaggaggaggaggatggtgact

SEQ ID NO: 475410 - DNA, 759 bp, Homo sapiens
gacctggctcggaagaactgagaagacctggacaagtgtcggtctcagcagattgaggagaacaccacagtggtcaccatgcagtccgccaaggttggagctactgagatgacgctcatggagctgagatgtacagtccagtccttggagattgacctggactccataagaaatctgaaggccagcttggagaacagcctgagggaggtgaaggcccgctacaccctgcagatggagaaggtcaatgggattttgctgcacctggagttagagctggcacagacccaggcagagggacagtgccagggccaggagtaccaggccctgctgaatgtcaaggtcaagctggaggctgagatcactacctaccgccgcctgctggaaaatggtgaggacttcaatcttggtgatgccctggacagcagcaaatccatggaaaccatccaaataccactacccgctggatagtggatagcaaagtggtgtctgagaccaacgacaccaaagttctgagacattaagccagcagaagcagggtaccctttggggagcaggaggccaataaaaagttcagaggtcaaaaaagtatactatgatgttagatatatgtcattgttcatttgtccaaagactgtccttagaatgtgcaacaccaagagtgaactgtaatgtgaactatggattttgggtgataatgatgtgtcaattctccatgcgacaaaaggatggctgtgtctttctcttccactgtaaaatggg

SEQ ID NO: 475411 - DNA, 1219 bp, Homo sapiens
gcagccatcaacaatttgtttgccactgaaatattaaggatgaagttcttttgttggttttggggtttctggagttggctgcttaatattattagacccgaaaatgctaaggactctaattctaatagtatggagaatattgatgatctttggcatgaactatttaaagagttatacaaaataaatgcatttgacactcctgattcacctctcatgagagacaaggagtttagtgactctatatatgataccgttgaccatatgtggagaaccaaggaatataatgaagctggttggttgctcctaagttcagtggacaaagtgatgaaagaaaatgatgaactcagggattctgtctcctggcttcagaagcagatactgaacctcaaatctgccaagattgccatgagtcaccatcttatctcctgtagagaaagagctaaaattgtggaaattcagacacaagctcttatcatgagagtggttgacctgcaatgaaaggttcagtcacagccttaccaggtgtctactgttaaagattctctcttgtcctgaacctttgagaacatgattattatataccttgggattgtcttgtttgggtatctgtttggtgttctctgactttgctgtacctgaattttttatctttctcaagttgaaaatttttttgttattatttatttaaataaactttctaccccatctcttaatcaattccctcttgaccatcaataattcttagatttaattctttgaggtaattttctgtatcttgcaggaggtcttcattcatttttactttttttctctctctcttctgactgtgtgtttccaagtagcctgtgttcaattttactgattcttttctctgcttgattcctttgctgatgaaagcctctagtgaatttttcagcacagcaaatgtgtttctcagttccgaggatttctgtttgattttttacattattttaatatctttgttgagtttctctgataaatttctgaactgcttttttgtgttattttggaggtcactgaatttccttaaaactactactttgaattcatggtcagagagctcacatatagccatatcaacagggtcagttactggttttttgctttgcccatttggagagattatggtttcctgtttgctgttgtttcttgtgcatgtatgtctatgtctttgtattaaagaatttattctagtctt

SEQ ID NO: 475412 - DNA, 1249 bp, Homo sapiens
tgtagacagactgggtgcagatggctggtgtagacagacggtgcagatggctggtgtagacagactgggtgcagatggctggtgtagacagactgggtgcagatggctgggtgtagacagactgggtgcagatggctggtgtagacagactgggtgcagatggctggtgtagacagactgggtgcagatggctgggtgtagacagactgggtgcagatggctggtgtagactgagtgcagatggctggtgtagacagactgggtgcagatggctgggtgtagacagactgggtgcagatggctggtgtagacagactgggtgcagatggctggtgtagacagaccgacctgcacaccaagccctgtttgggacgaggcttcctagacaggttttgattcaatggtggtttctgactgcacagacaggaaaccagagatgggcacggtgtcggcatttcagctcctgcagaatacgtctctcccggggatggcccagtgtcggcatttcatctcctgcagaacaggcctcttccggagatggcccagtgtcgacatttcagctcgtgcagaacaggccattcgagatgcctctcctagatcatgttcctcttccttcctgcccatttctcctgtgtcaattgagcatttgccccaaatcctaaagcacagccatcctggtgcaggggatgaaacttaccctaaatctaggcttggttgtgcctcagtgacagggccacgggtctgcctaatgcacctgcccctctgctgtgtgacagcacaaggagaaccaccaggagctcgccctgcaccatggattcgcctgcacattttgtctttctcagttaactcacatcatgccagacacaggacaagggacttccgtgtggatccttcagatctggaatctcttgatgcctgtatccagaggacgctctctgccttgtacccaccgtttgaagccacggcagccacggtgctctggcagctgttcagcgtggccgagaggtgccacggtggggacgggctgcactgcctcaccagcttcctcctcccagccaagagggccctgcagcacctgcagcaggaagcctgttacgtgaaaaatgcattatctgcagagctcaatcagctggaacacagtaaaacaagatatgtctgtacatacagataagtcccacttaatgaatttattgtatgtttagtctgtttcttgggatatttatgctgtagttgttcttgaggccggggt

SEQ ID NO: 475413 - DNA, 959 bp, Homo sapiens
gctgatgccatctgtgggaacgagggacccaccaggcgtcacttcaggtcccctctcacagggcgcatcaggagatgacagtgccccaaccacagataccagggcacactcagcaaagcctgtggtcacgtggtgtcaacagcagccgcctagagcgatgtcactctgtggtaggagacgccgtgccgggcaccagggcttttcccagcactcccctgctcagtggccccgtggtctggccacagcctggcaggcaaacaccgctgctggccattgtgtgggcacaggaaatgaggctcagagccatcaaggtcgctgctgggacagcagagctgtgtctccaccctgcactgcgttcccaacagggcagtggcctggacaccccttggcagccatgtccactgcacggtgttccctctccctgcacacagccatgtccccctgcgtcctccaccagggccagcccaggcgtgctgacgagctgcaccttcacgtggatgctgggggagaggccatcccaaggaggcatccagtgtgcagacacagccacggtgcagaaaacaagctcactgcaatgggcccggcagtcacgtggtccttgcagttcacagggagactggccttgggctcaggggcaggagattgaacttagaggcggactagaggagttttttttgcagaatcaccagcaaggcagcagcaatttcagctgtgggaaaaaattcaaaagcccagctcttatggaaattggataaaactgtgcagcctcagggcctgtgcagacgtgaattctaatgacttgtcagggactagtgtgggcgagcggggtgatcctgggggtcctcgccgtgcaatgggagaaatcttaattctacaaccagcatctgattttccatgagggaccccagctcctccccagacaaaaaaaacagctccgttgctcccctcctggccttgag

SEQ ID NO: 475414 - DNA, 727 bp, Homo sapiens
cagcccgcgcagctgcggtcttcatgtggtcgctgcacgcaagggtttgccgttatctgttgcttctgaaggcaaggatgaacgccgtgggtgtgggggccatgtggacggtggtgggtgaggccgggggtccccacagcgagggcttgtgggtcttggtgctgcttccatgtggaggggaactgaggtctaagcaacgccttggcgggaacacccagtccctccagaaccgccgaagctcccccggcgcctgctcccggcctgcgggctcccagcgccacatcctcccccaggcacggctgttgccaggcatctgcacggccctagtcctgaaccaaaccgcaacggcagagctgagcacgtacctgcgtctgtttgatgaggaagccagggtgcagaatggagccggatgtgcaaggtgcttcgtaaacggtgccttccgggcgggctcagcggtgaacacggacaggcccgccttcctggagctcacgctagcaaagtcaggaagaaaaccgcgtggccaccttagcaaatgcagaacagcatctgggaacattcaacagccagtcatgaaaaggttctcagcaggctaagcatagaaaggcatttccttaactggacaaagggtcttcaaaaaaccttcagcaaatacagtacggcactaaatggcgagacagagaaactgtccccgtcagaccagaacacagtagacaggccttctaacaac

SEQ ID NO: 475415 - DNA, 505 bp, Homo sapiens
agttggttccggtcctcaggcccatgcctggggacctgggggctggccctgccttagagccccccagcacccccttctcctgcccctcctcagggcacacccatctccttctcaagggcagccgctctggactccttctggaactgcctggacatccccaggccactctggcagggccttccttaaggaccatgacctcagcagctgtgtccctgaggtctgaggacgtgacctcatccctgaccagtgaccacagggcacagtgggaaaggggagatgtcctagagcctctggagtatcacacagaaaccctcgccctggtcctggagtgttggtttggagtccccctctgccagcacgtggacacgaagtctctgagtgtcaaccatcctgaaagtgcatggggcctcaccagtgaggtttgggacatcaaccaaggagcagaggacccctgaccccatggtgaaatgccaccaagagcaggcgagttgggcagaggtggcgt

SEQ ID NO: 475416 - DNA, 1708 bp, Homo sapiens
tagcaacagctccagtctacagctcccagcatgagtgacacagaagacaggtgatttctgcatttccatctgaaatactgggttcatctcactagggagtgccagacagtgggtgcagatcagtgggtgcatgcaccaagtgtgagtcaaagcagtgcaaggcattgcctcacacaggaagtgcaaggggtcagggagttctctttcctagtcaaagaaaggggtgacagatggcacctggaaaattgggtcatgcccacctgaatactgcacttttgccacgggcttaaaaaatggcacaccaggagattatatcctacacctggctcagagggtcctgtgcccatggagtctcacagattgctagcacagcagtctgagatctaactgcaaggtggcaacgaggctgggggaggggcacccaccattgcccaggcttgcttaggtaaacaaagcagctgggaagctcgaactaggtgaagcccaccacagctcaaggagtcctgcctgcctctgtaggctccacttctgggtgcatggcacagaaaaacaaaaagacagtagtaacctctgcagacttaaatgccccagtctgacagctttgaagagagcagtgtttctcccagcacagacctggagatctgagaacgagcagactgcctcctcaaagtgggtccgtgacccctgaaaaccaagcagcctaattgggaggcaaccccctgtaggggcagactgacacctcacacggccgggtactcctctgagacaaaacttccagaggaacaatcagatggcagcattcgtggttcaagaaaaaccactgttctgcagacaccgctgctgatacccaggcaaacagggtctggagtggacgtctagcaaactccaacagacctgcagctgagggtccagtctgttagaatgaaaactaacaaacacaaaggacatccacacaaaaaatccctctgtacataaccatcatcaaagaccaaaagaagataaaaccacgaagatggggaaaaaacagagcagaacaactggaaactctaaaaagtggagtgcctctcctcctaaaaaggagcacagatcctcaccagcaaaagaacaaagctggatggagaatgactttgatgagttgagagaagaaggcttcagacaatcaaactactccgagctgcaggaggaaattcaaaccaaaggcaaagaagttgaaaactttgaaaaacatgagacgaatagaagaccaaatctacgtctgattggtgtacctgaaagtgatgggcagaatggaaccgagctggaaaacactctgcaggatattatccaggagaacttccccaatctagcaaggcaggacaacattcagattcaggaaatacagagaatgccacaaagatgctcctcgagaagagcaactccaagaaacgtaattgtcagatttaccaaagttgaaaagaaggaaaaaatgttaaggcagccagagagaaagatcaggttacccacaaagggaagcccatcagactaacagcagatctcttggcagaaactctacaagccagaagagagtggaggctaatattcaacattcttaaagaaaagaattttcaagccagaatttcatatccagccaaagtaagcttcataagtgaaggagaaataaaatactttacagacaagcaaatgctgagagattttgtcaccaccagga

SEQ ID NO: 475417 - DNA, 1470 bp, Homo sapiens
tttgtggttcagagaggacagaaaatgaagcaggccaatcacctgaggcaatcactggaaggtgaactgccccagaggacgaaggttccctgggtcagaagcccccaaccagatgatccaacaacaggactgatggtgcctgggcaagcgccagctcatgtcatcaacctcactgagccccgggtatgtttaattattgagggccaggaaattgacttcctcctggacactggtgcggccttctcagtgttaatctcctgtcctggacgactgtcctcaaggtccattaccatccgaggaatcctgggacagcctgtaaccaggcctgaagctcataaaggattacagaatatagttaaacatttgaaagctcaaggcttattaagggaatgcagcagtccctgcaacaccccaattctaggagtacaaaaactgaatggtcagtggagactagtgcaggatcttagacgcactaatgaggcagtaattccactatatccagttgtacccaacccttataccctgctctctcaaataccagaggaagcagaatggttcatggttctggacctcaaggatgccttcttctgtattcccctgcactctgattcccagtttctctttgcttttgaggatcccacagaacacacatcccaacttatgtggacggtcttgccccaagggtttagggatagccctcatctgtttggtcaggcacaggcccaagatctaggccacttctcaagtccacgcactctgatccttcaatatgtggataatttacttttggctaccagtttggaagcctcgtgccagcaggctattctaaatctcttgaactttctagctaatcaagggtacaaggtgtctaggtcaaaggcccagctttgcctacagcaggaaacccagagggcaaatactcatctagtcaaatgcgaaccagaggcagaaacagccttcaaaaccttaaagcaggccctagtacaagctccagctttaagccttcccacaggacagaacttctctgtatacatcacagagagagctgggatagctcttggagtccttactcagactcaggggactaccccacaaccagtggcatacataagtaaggaaactgatgtagtagcaaaaggctggcatcactgtttaagggtagttgcagcagtggccatcttagtgtcagagtctatcaaaataatacaaggaaaggatctcactgtctggactactcatgatgtaaatgacatagtaggtgccaaaggaattttatggctatcagacaaccacctacttagataccaggcactactccttgaggatggtgcttcaaatatgaacgtgcatggccctcaaccctgccacttttctcccagaggatggggaactcatcgagcatgactgccaacaaattgtagtccagacttatgccacccaagatgatctcttagaagttccattaactaa

SEQ ID NO: 475418 - DNA, 2354 bp, Homo sapiens
ttctgctaagggggagatagttggattgggtgatggactgtagaaggacaggtcccaggtgcagggacttcaattgacaagtctacatgtggtctccagtcatccggtgtctccacaagtcaacgctggcgaaaatcaaatctatccacatctgcgaacatgtcactcattgggaaccccttttctcccatggggggccctctgtggaatgcactccagaggagtacagcccgaagataacctgttacccatctagaaagagaagtgagaaaaaggtatcccttttgccttcttccttttggtatgacccagagttgggaggaagacagtgtgggtgtcccccagctgtttcccctccgtggttcctgggtcctggcaccttgttgaatgtgccacccatggttgcagaggggacttccgagcagaaggaaagagaaagaaaaacagctctctctattgagagaagacttccgagcagaaaaaaccagctggcggtggacacaccagtttttatatcccggcttgaggaggcagtgtctgatttacacagcgttcacagattggttagatcagaattgactaacatgatcacaagttggagttccaaaataggccatctgcaagttgaggagcaaggaagccagtggtggatcagttcaagtccagaaacctcaacagttgggaagctgacagtgcagcctttggtctgtggccaaaggcccaagaaatggtaaatcactggttcctataagaaatctatgtcctctaaattaactgcatgagtcaggatgaaagaaaaaagagggagtagaagccctgtcaaggaagtttcaaaattaaagttattctttatagaaaattatgttttctctcctagataatacaatcaagtggaaatttctattatgaccataaaaaaaatctgctatccaaagcctctaaagtcagccatagaaggggttttctagtatgtcctacaagtacttggatgaaattaaataacttgtacgagagaaaatacttagtattaatatttctctgtccatgcagaatattgatataaaatatgcagacacaatacatttgacttactcaatctgttatgcataatggatgctccctatatgtcctcctcatttgctcaatcggaatatctcaagtttttttatgaagtaaatatatctgactatactatttgatgactatacaagcagtattatgtgggcaatttcatctctgtgtaaaagttagatgcttccttaaaatagaaggttgtaacattttccatagacttggatacatagaaattaaatgcttgctccaagttttctgtacatttgtagatttccttccagtccattgctatttcttaatcagaaggccatggtaacatactgaccaatttggcatagcctatcaggaaaacaacaccatcaaaacatggtaatttagtgggtattgcctctgattaaattttttactatgtaagcaaactgcgatatattaagttaaaaaaagagaatactattataaatacatgccatggggattgatggaataagatttaattgggtttagaatgttaactgagttttaaaataggcaaaataattctctcaatatttattaggaaatcttacgtattcaaagaaattatgtgggatgggacatattaaataaagattaataattttgaagctctgtgcatttgcaaaatgaattcagtttataatataatcaaagaaaatacaactaataggagtaatgtttaaatgtgctttcatcacagggaaattttgggacaaaaagggtgaaagttccaagtcacggtgtctttttttgtttcaaaggtagatttcctccttcatgaaaagagcctgtttcatattttatgcccacagactagagaaagtatgcttgtggtaaagccatggcagtggaaagtagtttatgttctgcacttatatgggaataacaaatcaaaaccagacatatgtttgctttcaaaagtaaggttttgttatagatttacttaatgtttgaaatactgaagtgctattagcctggggtttggataggaatagagaaaagttaacaggttacatttttgccaaagtattgatttacattccactgaaagcctcttgttgttttatatttattttatattcatggaaacagaaatatgtgttcagtataaatatcaagttataggacaaatgatgaatatatggtattgagaagctgaacttgcaagaaaatttgaatttagttcagttgtaaaaccaagatacttctaaaatatgttctgtaggttcattataggcataattcaaattttcaataactagctt

SEQ ID NO: 475419 - DNA, 765 bp, Homo sapiens
ctaaaaccagacaagccctacagcctagccctcatgtctgcgtgcagcggctgccgctgctttaatacttttagaggccctcaaaatcacaaactatactcaactcactctctacagttctcataacttccaaaatctattttcttcctcacacctgacgcatatgctttctgcttcccggctccttcagctgtactcactctttgttgagtctcccacaatcaccgttgttcctggcccagacttcaatccggcctcccacattattctggataccacacctgaccctcatgactgcatctctctgatccacctgatgttcatcccatttccccacatttccttcttccctgtttctcaccctgatcacacttggtttattgatggcagttccaccaggcctaatcgccactcaccagcaaaggcaggctatgctatagtatcttccacatcattcattgaggctaccgctctgcccccctccactacctctcagcaagccgaactagttgccttaactcaagccctcactcttgcaaaaggactatgcattgatatctatactgattctaaatatgtctttcatattctgcaccaccatgcggtcatatgggctgaaagaggttttctcactacacaagggtcctccatcattaatgtctctttaataaaaactctactcaaggccgctttacttccaaaggaagctggggtcattcactgcaaggggcatcaaaaggcgtaagatcccattgctctaggcaa

SEQ ID NO: 475420 - DNA, 663 bp, Homo sapiens
tatctgcttaggcgtttgtctgcctcctgctgctatcacatagataaatgccctgatgtactcctgttaccctcgtacttttgccttgggtggctgcttttgcatccacgtcagcttcaggtttcctctagggcctacctacacagactttccttgttgggcacccaacattctaacagaaggcattttggaaagatcccatttaataaatacctgcattctcactgggttttgcacaactcatctctggaggtattgcactttcctccaccattgccaggttaatctcttgctccctaatgcatcagtagctccctctacactgtggcctcgggctgttccatcctttggatacttcatacatgcacagataaccctaccaacatttttccacaattcctggggcaccagccaagctttcagaattgtcttcttgaagggagtgcacacaagaattgacattagaagtgaacacctcaacctgtcccttaaagaggaatgactacatcactctggatcctgtgttgagagtaagcaataggaggaaaagagaaggtgaagggaactagttagaaagtgtctcagaaaactgccttttagctttccagaagcaccttccacccttttcaccctttctctgccctaggaagcaaacctgtatgc

SEQ ID NO: 475421 - DNA, 756 bp, Homo sapiens
aagtccagtgcatccagcaatacttgcagggaggtgtggagggagaggcgccagcgagaaccaaggctgcgcacggcgcttgcgggccagctggagttccgggtgggcgtgggcttggcaggcccccactcggagcagctggccagccctgccagcctgggccatgaggggcttagcacccaggccagcagctgcggagggtgtactgggtcccccagcagtgccagcccagcagcgctgcgctcgatttctcgcggggccttagctgccttcccacagggcagggctcgggacctgcagcccgccatgcctgagcctcccaccccctccgtgggctcctgtgctaccaggagcctccccgatgagcgcccccacccgctccacggcgcccagtcccatcaccacccaagggctgaagagtgtgggtgcacggcgcgggactggcaggcagctccacctgcagccccagtgcgagatccactgggtgaagccagctgggctcctgagtctagtgggaacttggagaacctttatctcagggattgtaaacacaccaatcagtgccctgtcaaaacagaccactcggctctaccaatcagcaggatgtgggtggggccagataagagagtaaaagcaggctgcccaatccagcagtggcaagctgctcgggtccccttccacactgtggaagctttgttcttttgctctttgcaataaatcctgctgctgctcactctttgggtccacactgccttt

SEQ ID NO: 475422 - DNA, 617 bp, Homo sapiens
gtattgtttacttgaaatttgatgagagcagattttctttacctccatcccccacaggcaaaatgctgccagaccaacaaactctattttatagagggcagggacatcaagctgggccacaacctaagtggactaacaactcgggtggaccaacaactccaaagaatattcaacttctgctctggaaggactccacagggtgagcacaccttacccaccctccagacgcttctgctcaggctccagctggtgacccaggatagcagcagtctctgggaaggagaggggagggagagaccaagaatatgtccagaggaagtggagggagatggaactgctagtgagcagaggttccaaatacctgaaaatttacaggaatacaaaaatattcattacttaacaaggtgaaatttataatatctgtcatataattttaaaaaactgtaagataatggttattcttacagatgtgaggtgatatctctttgtgattttgatttgcatttcctgatgattagtgatgttgagaattttcccatgtactattggctatttgtatttcttctttgtaaaactgtctatccaagtctttggcccctcccctatatttgtttttc

SEQ ID NO: 475423 - DNA, 659 bp, Homo sapiens
agcagaataaatgctatgtgatgcagaccttgttggagaggcacagctgtggtttactgaatgtcattgcactgctatgctggcagaccttactagaatctgtcctctagaacttgttagaaatctatttatgacggtgctagagaaagatgttcgctatgaagtgcttcttcaaaaggccattaacaacaaaaccctcgtgggacaggtgactagggaagctgctgactggcccctgggtgtagctgaatcccatacacagcaggagtcaggtgtgttggaatcttctgtgctgtggaaaagcagtcggagcagcggcaccttttctccaactcaaacattcttttccaggccctctgtggagcagtctgctccagaaagagaaaacagattcagactaaagcacgtgcctgacaatgtgtctgctgcattgcatgaggcagccttgctgcagccaaccatagtgggtctgatagcttcatagaaactctcatagctcttgtctcctttgtagtggggggattgtgataaatttccatatcccatcttagagtagaagctttctgagggcaatgaatgtgtctttttagctcactgttgtatcctccagtatctttcaatatttagacaaaaaaaaaaatgcttattttggaaatatg

SEQ ID NO: 475424 - DNA, 665 bp, Homo sapiens
agcagtctttttctcatccgaagccttcaaccttgaaaaagtactcatctctatgcaaagcaattaggaaaaaaagtgtgccttgcacaagtaacgaggagctgaatgttcatcaccaagacaatggggaaaatgtctccagggcatgtcagagaccttcctggcacccattttcatcacaggcctggaggcctaggagggaaaaatggtttcatggggtgggcccagggcacccctgctctgtgcagcctcaggacatggtgccccgtgtctcagctgcttcagctacagccatggataaaaggcgccaagaatggtagatccaccaatagcttgcaccatgtgcctggacaagccacaggcactcaacgtcagaccgtgaaaacagccaggagcacggctgtaccctgcaaagccactggggtgaagctgcccaaggctgtgagaacccatctcttgaatcagtgtgacctggatgtgagacatggagtcaaaggagatcattttggatctttaagttttaatgactgccctattggattttggacttacctggggcctgtagcccctttgtttcggacaatttctccatttgtaatgggtgtatttgcccaatgcctgcactcccattatgactaggaagtaactaacttgctttctatttt

SEQ ID NO: 475425 - DNA, 807 bp, Homo sapiens
attccaaccctaatggatgactttgagtggttcaagacttcagtggaggaagtaactgcagatgtggtggtagtagcaaggggcaggcatgaagctgaattccaggtgactgctgaagataaagcaggttttcaacaactgtttcagggactatttggtgagtttttcatcatcattttcagctgcaagagggtcctgaccaagaagagatcactattggtaccacctatgtcagttcagatcctccgagaagcagacatcaagacagtattatatgtgcaagagatttattgggtaggccctaaatccaatgatgagcgacatagcagacagacaaaagaggaagaggcaacacgtcaaccctggtgcctaacaaattatgacccttctcaggtcaatcttccctatccacagccattgttgaagaatccaacctgtgcagatgatgaagttctagcccccttgatttagctgattgaccctaggaaggtactggtagcataagcaaagcctggtgtggaaagtctttgctccctcattattttcttaatttaaaacatctttaatcttgttacctccaaacctttcatccctgcaacctgtaaagtaaacaggttgccaaaattttcactattaccaacattatggattcaaaattaacaaccattgtgtctgcataattatgtactctaattttaagccactatttatttagcattgccacctttgtgcctactgaaatcctctctttaaattcgctgacaaaatcctatttgccaaattcaacaatttttttctctgtttata

SEQ ID NO: 475426 - DNA, 1739 bp, Homo sapiens
tttgacaaagcctaaccatattgccaaggcatctataccacgtgtgtctgctcaaagagagagcttacttaattagtggtttgccaccattagtgagattcaggaagcacggatgggcagtgaaaactgaagacccacaactccccaaaatgatgaggaaaagaagaaaaggctgtaaaaaatgggaaatcttgaataccacagtatcatgccaagaaaatataaaagttcttgaaaaggaagtcaaaggagacaccttggagcctgtgtttcatcagactgggacattagggaaatctaaggaaaatggagatgagggtatgtctgcttctgtgaatgaaaagcagaattcttcttttcttcctaaagataagaaacagcatccatgtgacagcaaaatacataggaagaagggaaatgatgatcctcctttggctgtctctcatcaactggagaaagtcttacctatgatcacatttaatgactatggagaatcattatcagaaaacattacattacagaatctcctaggcacagtagaagactttaagccagcaaaaggcaaatttattacagaagtgaaacgtggggatttcaatgtgcaaatagaaatcaagaaaaactttgtctgtaaaccaggaatacagagctgctttcctaaacataagaatatattggtggaagaactaaaacctgaggtgctgtctaaacatgaaggagaaattgccagaaccgacagacccttgctgaaagattctaaggatgtggaaaaagagagaaaaatcaactttgatatcccaggaaatatcacatcagactcacatgtacagcaaagcacagaaggaataaattatttgccaagtaccattactgacatctttccactcaagatggcaaaaacttcacctttagttcttcatcttctctctctggaaaatgttgaaaaagacaaatgccagataatacccgtggtgaataatgcataccacagagattttgaagacctgtcaaatgagaatcgtgacaaagtctgttttcaaatgcatttttcagcaaacactgctgagtccaactgtgcagtgtgtgcttcagataatctgtttcttattgaaaaaacactgaccaatgatgtggacctacatggtaaccaagataaagaaaaccttggactaactagttttaaacaggagccagcacagtgccaaaggattgcatcaacagggccaaatactgaagaggatgagaacaaaaatgactcaaaggaaaattactgttaccaaatacacacgttgatgccacctcagaagcaagctttgaaagttggaaagaaaggcccttcagagaaagagccttttaaaaagaggacaaatagcagggtactccatttgggaccctccctcaatgagactgttgttgtctgtctactcacagacagtgccgccaagaaagccgggctccagattggagatgcggtactggctgtcaatggcactgaggtcaccagtgtcgagcttgcagaagctgtgaaccttgcaatgaaaggtaggtgggccagttacagaatccagagttcatctgaaggagcagaaagctgccatacagagttccaatgtgggaggggacacctacaggtttttgagagttaacagcctcaggattttaatgtaaaaaaaaaaaagagagagagagaaatgaagaaatcacagatctaaagcttctacagattttcccaggccctt

SEQ ID NO: 475427 - DNA, 814 bp, Homo sapiens
tgttatgattcactcaacgatctgcatctgagcccaagtgccctgggcccccgataggacctgtttataagtataaaaccactattcccgacagctgtttagaagccagcaagtccccatgcatcgggatcatccactgaactattccaaatgcatgcctctaggtacagacatcttgaccctggtggtaggatctgatatcagccgctgtcccagtaccccttggcccacctgccacggctacctatataagaggactcactccgggatcgtgaagggttggagaaagaggtggtttgtgctgaagtatgatggatgcctctactattacaaacataacaaggctgggaattcagatctcatgggagagctgtccttgaatccactggatggcagggcagcagattttccaggccaggaaaaagtcaatgtggctaaagccagagtacaagggggacgccagagaaggaaaaagattaggctaaagaggaattctgatcatcgcagcatatttactctgctatgctgggtgaggagtccaggggatggcatggcacacaatagtgacaggagacttcattttgaacaaagaataaaatttggagcatgaaataagattaaatattttatgcatgtatcctgaatgtcttttgtagctaaggcctgttaatctttatttccttttatcaaagaaaaatgagcgatattcccttccaaaattgccaagaggctaacaattcacttttaaaagctgtaaagctctaaaagtaaatggagatagggtggagaagtggaatagagtgtgagctttgaa

SEQ ID NO: 475428 - DNA, 2430 bp, Homo sapiens
gcagctcctctcaggactcatggcccggagctttgatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtggagatggtgcccggcacagcgactgccacatcactgccgaccgcaaggtgtacccacaggcagacatggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgaagtttgcatagctccctggacttctgctttgcactgccctgcaggagtgggtggggaaaggaagtggctttgaggcacacagaggggcttgttgaggccaccggaggaagcttctgccaccaatatgggacctgtgcccagcctaccagaagagagcatctgaaaacatgtatcgacatgtggtgaagacccagcctgctgagactcctcctgcagttcctcaacatgcctgcatttctgctgcctcagggcctttgcgaaggttgttccttgtaactggaatgcccttccatcccttttttattcaaaaggctgcaattttaattgaagaaagttcccttccaaggttcatgagttgcctgacttgcccaccggtttcctgcaagatcccttggcctggcacttagtgctcaggaaatatttggtgatgggccaactgagtgagaagaatccagctgttactccgtccgcggcctctcagctctagggccctctgcacactggcccccccagagctctgcggtagaatcccgtgccccccgaccccatcagcagcctacaccccttcatccttcctggccccggattttctctgcctctgccactcccggtggtaaaagagggcttagaatgcggtttgctttctggctttgtttttttgcatcctgatctttgtggcgtggatcgatcattttccagggaaagtaccttgggtgagatctctctcctggactcccgttccccgtttcccccaatctcccctcctgaaggtcaccggcaaagacttcactgtctcctaggaagaggtcgccataaacccaggggccacatgataatatattaatattaaatgtatctctaaacattaacctttcactggcagcccaagagcccgacagcacaaaggaatacttggttaaaattcaacctccctcccagtccgggctctgagtgtccctc

SEQ ID NO: 475429 - DNA, 1659 bp, Homo sapiens
cggctgtgtcttctctccagattgaggaagagtctggggacacaccagaaaaggacaggatcaagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggctggtgtggggcctgggctgccaggaacctcattttcctggggcctcacctgagtgggggcctcatctacctaaggactcgtttgcctgaagcttcacctgcctgaggactcacctgcctgggacggtcacctgttgcagcttcacctgcctggggattcacctacctgggtcctcactttcctggggcctcacctgctggagtcttcggtggccaggtatgtcccttacctgggatttcacatgctggcttccaggagcgtcccctgcggaagcctggcctgctggggatgtctcctggggactttgcctactggggacctcggctgttggggactttacctgctgggacctgctcccagagaccttccacactgaatctcacctgctaggagcctcacctgctggggacctcaccctggagggcactgggccctgggaactggcacccatggggccccacccatgagtgatggttctggctgatttgtttgtgatg

SEQ ID NO: 475430 - DNA, 700 bp, Homo sapiens
aggggtgtgagtgtgtacgtgccccccagtgccgcccagagagggtgcatgagcagctcagcaagagggtggggaaatttgggacctgggaaccgtgcactcctgcagggggccccggatgcgatggagctgcgcgagctgacgccctgggctgggcggcccccaggtccgcgccgtcgggcggggccccggcggcggcgcgcgcgtgcgcggttgggggcgcggccttgcgggctgcgcgagctggaggtgcgcgtgagcgagctgggcctgggctacgcgtccgacgagacggtgctgttccgctactgcgcaggcgcctgcgaggctgccgcgcgcgtctacgacctcgggctgcgacgactgcgccagcggcggcgcctgcggcgggagcgggtgcgcgcgcagccctgctgccgcccgacggcctacgaggacgaggtgtccttcctggacgcgcacagccgctaccacacggtgcacgagctgtcggcgcgcgagtgcgcctgcgtgtgaccctacctcactcggccggcgcggcggccactccccccgcctcgacggcaccactggccggccccgcgaaagactgcgcgtgcgtagagcacgccggcgcggccccgggactctcgcgataactgtactgagataaagtgtggcaactcgagctggctggtgattcatcctcggcgaggggctc

SEQ ID NO: 475431 - DNA, 804 bp, Homo sapiens
aggggtggagctgccgaagaccatgacctggagagcgactcccacagcgtccttagcaaccagccttggttcccagcggctcagagcgcagcgaagagggaggaagcaaatctgtacccagaattgctacaatatattccctaaaataaccaatttccaacaaaaaattttaagacatctaaagaagcgagaaagtgtgactcatatacaggagggggaaaaaagctgcaaaaactgcctggaaagaggagcagatgtcagatttattaaagactttgaaatagccattacaaatacgtccagagaactaaatgaaaccatgtttaaagagccaatttcaaggattaatagcctgggaaacacaaacttaccccaaactgagaatatgtcctcgagtgggctatacaaggcacagttctattacacagaaaataggagaaggggagcagtgaaacaaaggtgacattctttctattttgattggtgttcagagactttatacaaaagataaagcaaatatgtagttaccactgtatatagggttaatgagcatataggtgtcctagtctctggagggagatgattgattatatcctgttttatctgatggacaaggttgtaatcaaagtaacttccctatgaagccagtattacaccaaatagccgtttaatttaaatcaaatattatctgattgcaagcaagatctgaagcagttatagtctcattccttttcccttcccaacagaagcatccttttcctatatagcatatattattttggaggggggttgaaattagggtcc

SEQ ID NO: 475432 - DNA, 803 bp, Homo sapiens
tggagccttgctcattgctagcacagcagtctgagatcaaactgcaagctggcagtgaggctgagggaggggtgcccgccattgccatggcttgagtaggtaaacaaagtggccaggaagctcgaactgagtggagcccaccgcagctcaaggaggcccgcctgcctctgtagacttcacctctgggggcatggcatagccaaacaaaaggcagcagaaaccgatgcagacttaaatgtccctgtctgacagctttgaagagagtagaggttctcccagcaagcagcttgagatctgagaatggacagactgccacctcaagtgggtccctgacccctgagtagcctaactgggaggcacccccacagcaggggcagactgacacctcacatggccgggtactcctctgagacaaaacttccagaggaacgatcaggcagcaacatctgctgttcaccaatatctgctgttctgcagcctccactgctgatacccaggcaaacagggtctgcgttggatctccggcaaactccaacagacctgcagctaagggtcctgactgttagaaggaaaactaacaaacagaaaggacatgcacaccaaaataatatctgtatgtcaccatcatcaaagaccaaagcaacggaacaaagctggatggagaatgactttgatgaattgagagaagaaggcttcagactatcaaactactccgagctaaaggaggaaaataaccaatgcagagaagtgcttaaaggacctgatggagctgaaaaccatggcacgagaactacgtgatgaac

SEQ ID NO: 475433 - DNA, 3405 bp, Homo sapiens
ggttacccttgctctctctactttctccttccatttcactgtaacatggagcttccaccccactgccacatggtagctaagatgaagcaagtaaccatcggtagtcctgacatcaacatgagcttcaatcattgtctgccattttttgaccatggaacacattttatcacgggtaagatccatgccatggaagttgctcaggcagtttttgccctgaacatcttcagtaatcagcttgaattttctaaatgcaacttcatcattctgcaaatcagcaagactcacttcaaacacacgacccttgagaccatcagatgcaattttggttccttgggtcctggtgacgagcgtctttccaatatttcttatactgaacatagcagatgctttcacatcataccaatctttcttagaaaattgatcaaccactttcttcttggctccctttttgccgcctttcgtaaggcacttgttcttgccaactgccatggtgctggtcagagagccaaaaaggtgatatatttttatttattgatgaggagatattcaaaaggaagtaaaaaggcatgggattttcgaaacttgcatctcatccattaacaatactaaaggagaaaggaggttgtggattagtacttagctgacattctggtttaactttggtatataaccctgaggtaatcataaccattgccatggttatttaccacaatcataaccacaatcacaatcatacccatattcactgaatctttgtgaaataacagatctgtggctcttaactctatcaaactagacaccccattcactgttctttgattaaatttaggaatattaaaacctgaaaatgacatacctttaaaatcaatataatgccctaactttattaaaaatagaaaatagttcataaaattatatatagatatgtaaatattaaataagattacaacagaaaacatactgagcaagctagatatatgcactttttcaaaatgaacaaatatggattaagataaattaatctgacactttcagtacaagaacacagaagaatcatacagcagaggtacagaagacataaaaataaaaaccagcattgggatatataataacaggacttatttgtgttcaataaaagtgagcctacctcaaatgatatggggataacaacagataattatagacgattacctctgtctctgacactgagaaacaggggatagaggatggactgaaacaaacagaaacatcaagggccatagagaggttgtgtggttgattctgggcacaggaaaatagtaagagtaacaggtaactccaaaagaaatagttttaagatataattttctaacctagatttattctgagctataatttataattacataggaggtcaataaaatgaaaattaaataaaacttttaaaatagattcagtaaaatttctaaatgatatttgcccctgctaatttaaaaatatttgttctaagtctgtcagaaggagtctcaatgtcttctgttacatatttgcacatgaactaagcattagaaggcaggccaatagtagtgtagtgtatgggcaactcaaaatccactagcagtgttgctctccataatgcgatttcctaaaataatggtcaatatttcagttgtgtttttgaaaagtattcaaaccatgagaaatattttgtggttatattttaaagattttgtgtgtttatatgtcaagtgttttaaactcagctaattataaaccattctttcaattgcataaacatctgtcaaggtgttggaaagttgtgtttatgtgagacaattcttcaacgtgcacaactgttccttgcattgcaggacccctaacatttctcactctgtccactaaatgaaagtagcaaccactgttgttttctctgcttttatgagtttgacagctataggtatctcaaatacttcatgatttcattcatttttatgaggtatccataatcattaaactcatgaagcagagaatacagcagtggttgccagatctgggggttggggaagtggagagttgttcaatgggtataaagtttcagttacactagctaaatatcatgcctaaagggagtgcagccaggtgatgatgacaaaagcaacaagaaagaggactgagtgggaatgcaggagattaggcccctcttagcaccgtggaactgcactggatggcctgcttccagactcctgttatgtgagaaacacaagcccctttttagtcagatttcttgttttgtgtagctgaagctgcactgcctttgtcccagtgcctaaaggtgacaatgcttgttgccaaaaccacttgtatatgaaggcttctatttatcaggggagataagagagaagttcttggctggttttgtaccccctcacagtagctaccattctcctccagttgagttttgataagaagtaatggtacattttgtatatttaattcctgtttcatctattttaatatttattaatttttatctatgtctcaaatgaaagtaagctgcatggattatacaaaatatcctgtttttaaacttcaattaatagcatttttacaaaagtcaattatgaaaagcatagatgtcaaatgactaaaattatgctgaatataaaatgaattctataatcacctctgtaccatgaaatggctttcttgcaccattgttacctaaagtagcaggagaaaaaaggcttaccatctcctttaatgtaacatgcttgctttgggcttatgttgtaaaagaattgctaagaacagacaagcatttacatgcagtgctgctgctgctggacttgcctcaaagaagtgagaataaaaatggcctagcaactatttcatgcccatttgtccactggtcagtgcaagccaagggaaacttactgagtcaaagctagaatttagagagctttattatcttgctttgcttgtgaacttgatttttcaacacgattagtgaatctattctctgaaaagtaacatcacgtgggcattttcagtctttcaccaaacaagctagtatgtaagtgaatttgtatgaatttgcatatacttgttatttgttagagcatttgtacattgagtttgtgctcatcattataaaattatcatgaggaatagtttttgtacagtcatgtgtcacacaacattttggtcaacaatgggctgcatgtgtaacggtggtcccacaagactaatagagttgaaaaatttctgtcacctagtgacatcatagcctaatcttacagtgtaatacattactcatgtgtttatggtgatgccactgtaaacaaacctactgtgctgccagtcatataaaagtatagtgtatacaattatgtatagtacattatactttataatggtaataaatga

SEQ ID NO: 475434 - DNA, 823 bp, Homo sapiens
gcacaggatgtgaatggatgagccaggactttcttctaccagggcgccctcttgtggggatcttattaattatcttgcaaggaaagggaccttatacccggttgccttcacaaggcacaattgtgaagattcacttgtcctataaagcctcagtcatcaggcttcaaatagatatgctctctcctctcttctcactgtggttgaactggtctacttctctgttttcttgtgaccaaggtatgggcagcaacatgccgcatgaagagtgccctccttctggttcgggggtacatgtgcaagtctgttacataggtaaactcgggtcacaggggtttgttgtacagattatttcatcagccagaagaatttcagacagcaggaacttgacttcaaaggttggtgtgacgtgggcagacacagagggggaagcacagcccaagtacgagcggacggcaggatgggtggaggcagcaatgcaatggagtgaggagaggaagtgtgggtggaagctgatgtcattgacttgagacttcttcttttttaatttagatatttagagcaaaaatttccttatgattactgccttagtcgtaaacaatagattttcatatgtcttttttattttcattcagtttttaaaaatcttaattttttgtttatttcttttttgactcatgggttatttagcagtgtgtaattttctttctaaatatttgagttttgtccagattactttactgatttctaatttaattctattgtggtcagataatatactttgaatgtcttttgtcaggcttcttgattggaaatggaaatttaa

SEQ ID NO: 475435 - DNA, 2597 bp, Homo sapiens
ccgcgatgacttttcccctactgtccccaccagactcaggagcccagctggcttcacccactggatcccgcaccagggctgcaggtggagctgcctgccagttccgtgcggtgtgcccgcactcctcagcccttgggtggtcaatgggaccaggtgccatggagcagggggtggcgctactcagggagctcaggccccgcaggatcccacggggtggaggaggggcgggggcggggtgggcgcgggcatggcgggctacaggtccacagccctgccccgcgggaaggcagctaaggccctgcgagaaattgagcacagcgccggtgggccggcactgctgggggacccagcacaccctccgcagctgctggccccagtgctaagcccctcactgcccggggctggccggcccgccactccaagtgtggggtgccaagcccatgcccatccggaattctagctggcctgcaagcgccacgcgcagccccggttctcgcccgtgcctctccctccacacctcctcgcgagctgagggagccggctctggccctggccatcccaggaaggggctcccacagtgcagtggtggctgaagggctcctcaagtgcagccagagtgggtgccgaggccctctaggaggcgccaagagcgagcgagggctgcgagggctgccagcacgctgtcacctctcaatttcaaagaaagtgggtgctccagatgcctggagatctgcctcggtatggagcaaagagggctctgttgacccatgttttatgcacaggaaggctggggtcgctcaggctgctgatccaggtctccaagctggctctggatgcaagtctcattgcctatgagaaactacagctgcagcagctctcctaccaccccagacctgcaacagggggaagcacaattccactgcctactgctgggatgctttccatactcaccactcaattctggtttcctgggtctggaaaaatgcctgcaacttttcctagtgtttttccctctcagcgtctccaagcctctccaccagttagctcaaagttctcttccttggtctgggttgcatggatccccagtggaaggaggaaaaaccgtaaagctctctttgggtttcacagctggagttacctcaacaaaatgagaaccaatttggcatcagatattccactgacacagtacatcctacaaaataataaagcagatatgagaaaaaagatataattatgagtaaaattttagtattacaggaaactaccatatgaaaaaatccatatgaaatgaatattttataggaaagcagcacctaaacttgctaaaagtggaaaaaaaaaaagaaaaaaaaaagaaaaggtacccaaagatctacaccataaaaggcagcctatcctgatcaccaaacttttcaagaacagataatttctgttttgtaaactattaaaaagatagaataaagaaagttttggtaacttgaattgtgaggttagcataaccttttcacctacccaaatcaaaaaaaaaaaaaaatggcatggaaaagggaaactgtagataaatataacttatgaatgaagctgcaaaactcttaaataattgttaataaattaatctcaaaaatgtgtaaaatgaataatgactcatatcattttatcattccgtttcttcccctttattaatttggaagttacagcctcttttcattcttttacattctttagtttgttagtcatttggtgtttttaataacgaatttttatcttttcctctagcttttcaattattttcagcagaaagggtagttcaaattatgtcgtccaccattactagaaacataggctctggaactttcattttgggaaaaaataaatcagtgcccaatttcacatcaacgtaaattctaaatgaaatgcaggattaggaaaaaatgaagactttttaatatggttatccttaccaaaggaggtggttaaaatgaaaggaggaggattttttttctaagacacaaaacccaaatgctataaggtaaaaaaggtgagtaaactggaccacatacaaatttaaatttgtctaaatttaaattaaactcattacaaatttataattacaaatttaaatttacttgactgaagacatcttaaataatgttaagagataaaagacagcttgagagaatatatttggagtccacataacaaaaataatatccgtaatatgaagggggatttatatataaataagaaaatgaaaaggaactggggcccctcccaaatgaaccaaaattatcagcaagcaattcacagaacaaaaaatgcaaatgacaagtaaagttaggaaaatcatcaacttcaccaataattagtgatttgaaaccagactgtagataaactagcactggtatatgctgctggcaatagcaaaacttgtatttacctttagccagcattttacctctgattatctatctaaacaacattcacacaggtttacacaatgcttatttggaaatctttgatgccattctgtaagcaagtgataaataaagggaaatatatccaaagtgtgaaatgctgtgtagtagtttaaaatatgt

SEQ ID NO: 475436 - DNA, 474 bp, Homo sapiens
tgaggaaaacctaagtcacaattttgcttcaaactttggctctgctgctgcatgactctcagggtcattcaacattttgagcctcagtttcttcatgtcagtaaccccatcgacttgtcctgtggaaatttcctggcacagctccctggccttcctctgtccttaaatgtgcactgccttctcaattctgactcaccagcagcttccatggctttctcatgccccacacgagtgggaggtggttttggctctaatttcaacatctcattatcctggggcacagtcactcagtcacacagtaccagacccaaatccatccagacatctcctaccctcacaaacaggacccccacctgcaatgacttgcagagacttcaagcagcagcacattgtatggggctgggagggtcaaggtggagacagaagttgatgaagatactagtccatattactgtgcaatagaaacgtcatact

SEQ ID NO: 475437 - DNA, 624 bp, Homo sapiens
gagcgagcgctgtgacgccgactgggttaccatcttcactccaccagttggtaccggcttctattaccatctctctgcaactcagtcactacctccagcccctaccccctctacggcatgggcatggccaccccaccgacaaccctgcactaccactcagggcaatggcaagctcttactctcttcaaccaccacccgtggagcctggggcctgtggtggttggagtcagggcttggagagggctcagcactgaccaatggcctggcttgggagaagtgaagaaaagctttcaagaagaggttgcaattgaatgtggcggccttgaggacaagcaggcaggtcgtgaaagaatctggatcaataaatttgaccttgaagaaagaggggctcagtggggatccaggcctgaaaatcacagaagagcctgttcagcttgcccaatgaccctcaggggactgtttttccgtctggatgtgaagtttaagggagaagatatatttgaagtcatctggcaaggatctgccaggaccaaatgacccatgtctgtgggtttcctttttagttgttcctttggacactgagctctgcctgggcttcagcaatcattttcatggatgaatttt

SEQ ID NO: 475438 - DNA, 631 bp, Homo sapiens
tttgtttccccaaatggaaataatgtattcaaaagataggaaatcagtatgtcaaagagatgcctgcactcccaagttcgtaagagccaaggtaaggaatcaacgtcagtgtccattgacggataagaaaatgtgtacagacataatggaatatgattcagcattaaaaatgaagaaaatcctgtcatttgtgaccacctggatgagcctggaggacatcatgttaagagaaattagccaggcacagaaagacaaatactgcatcatctcatttatatgtggaatcaaaataaaagccaacctcacagaagcagagggtggaatggaggttaccaggggctggggtggggttgcggactggggagatgttggtcaaaggacaaaaatgtcagttaggcaggaggaataagtaccagagatctatcgtggaatatggtgatgttgttaataacaatatattgaatgcctgaaaatagctaagaaagtagatttttaagtgttctcaccacaaaaaagtgtatgagttccttctcattctcattgatgaaatgactatatgtaaacaatgaaaagtgatggttcatttcattgagtggaggtgggttgatgtccctcaggaaggtttgcaaat

SEQ ID NO: 475439 - DNA, 535 bp, Homo sapiens
gaggagttggagaacgatgcaggatttagaatcaaggaggcccagggcctattgacgatgaatcccccggtgggatggtgcacagagaacaccccatacgggatgccagggaagccgcccacagggctgcctctagaagcacttgctggaaaagagccctttgttttttcagtgcccttccagtgtcatctgccaatgaagcttaatgtcttctgcatttgtggccacttgaatctccaggacttcaaaaggcagcttagaattcttccccacaacaatactgatggagacccagatctagccacagagcctgggggaactggctcagcctctgaacctgtgactggttccactgactttcctaaaccccaaacatcagaccttcaagaggtttgcataggaataattgattgtctggaacaagatgccgcagatggatatttaatttggcacactttctgaagggctagatggacctagagtctagaaaatcgtcatatccctttaactctacccacttctgtaaatagagtct

SEQ ID NO: 475440 - DNA, 536 bp, Homo sapiens
aagccattaccatttctgcagtgttatgaaagcagaggcatggaccttgtcatttacagaaaaacaggagtggaaaattcccttgaaaactcgccagatatcgaagggcagtcagagagagggggaatcagattgggtttcatggaatctgaaccctgagattctcagtgcccttacgctaagggcttcctgcagacaaggatatgggctgtttgaaaactatttcattttcctcgtcatcatcattcatttcagacactcacattttcatctccccaaaaatgttgatgtacaaaccggtgtggggccctgggtatccacagtcttttcaggagtgtcaggagtgcctaaaacctttttcttcttaagtaaaacctggccttttgtagacgtccgaaaatttgattttgaagtactttccattttctgtaaaatcaaagaaggaaaatcataattctattttaagctaatttcttctggagtaatctttctttctttttaaatggcccctccatccgcagcttttgcgaaatgcc

SEQ ID NO: 475441 - DNA, 1404 bp, Homo sapiens
caaagatagtcctatcagctgaacggggtgcaccacctctgcctcgccatacgccagccctacccgggtctccaggaaggctggagcggaaccctcggctcccgcgctgctctagtgccacctgcaggttatgtgggggaactgcttctcctcatcccgaccctggacagacttggccttggccaaaagacattcagaagcctgggctggggagtgggctggagagtgggctggacccgacagtgaagcccacgaggagaagtagatcagcgtcctgctttaaaaagcagtctgccacacctccccaaaacagtcgcctctgcccctgctggcttggagtctccagagcccacagtctggaacagccgagtcatccaatcaacccaggtggtggccctctcctctcccagagagagagcagagctctgtccctaataagtgtgggcagaagcggctggaggtcctgcccgggaggtcctgcccagtgaggagaaatggatcaggggctctgcttaaagaagcagtctggtcacaatctgggaaagccactgtgatgcactgctggggggacccttcctcctccagactgtttggactctccaaagcccacaggctggaacagctgagtcaacctagcagtagaaatggtgcctgcccctccccagaggggctccggcccatctcaggcaggcttcaccctgttgccattggctgggtggaattccaagtcaatgggtcttgtagcagacaccagagcagacaccacctcagtgcctgctgaagctctgctcttccaaggagcttcttcccgctggtgggttcatcgtctcgctggcttcaggtgtgaagctgcagaccttcgcggagagaaactgcagaccttcgccgtcagtgttacagctcataaaagcagtgtggacccaaagcatgagcagcagcaagatttactgcaaagagtgaaagaactaaacttccacactgtggaaagggactcaggattgccactgctggccacgcaggagcccacggaggcggggggaggctcgggcatggcaggccgcaggtcccgagccctgccctgtggggaggcagctgaggcccggcaagaattcgagtgcagcgctggtgggccagcactgctgggggatccggcgcaccctccgcagctgctggcccgggtgctaagcccctcactgcccagggccagcggcgccggctggctgctcccagtgcagggcccgctgagcctacagccacccggaaccctagctggcttgcaagcgctgcgcagcctggttcctgcccgtgcctctccctccacacctccccacaggctgagggagctggctccagcctcggccatcccaggaaggggctcccacagtacagtggcaggctgaaggg

SEQ ID NO: 475442 - DNA, 1070 bp, Homo sapiens
gcggcagcgggctgaagggctcctcaagtacagccagaatgggcgccgaggccgaggaggcaccgagagcgagcgagggctgcgagggctgccagcacgctgtcacctctcactatcatgaatcatcagttcaacccaggtcctgctgacgggaggaaagggagatttgacactgagaagcagatacaggtgcaggtagggcatctgctcacagccattaaggctggtccattcacagatgtgagcactctggaagctccacgcaggagaggaaacacagcaaacatcactgaagacttagcagtaaagacagaaaacactacataccccacggaagactttgcccaacccccactctcacacctccttcccaaacgccagaaggagcagtgggggctggcaggggctctcccttgcccacctgccaccggcccagcagactcagggcttctctgtcctcataatgtctccctgctccgacatagcccctcccaacctgccagcccacacccaccagcgaaggtcactgtagctacctcaccctccctccttaaaatgcatgagggggagggactgcaattatataatatatattttattttcttgtcctgcgtgctctgaaaggtactgcttaattgtcatgacctgtgtttgtcaaatggctctttaggaatctttgtctaacctttgttcttcaagaatcattagatcagtaaagttgtgacaatttgtttttagttctaagggaagacaaaaggtatctttggtatatgatgagtatattcaagtatgtatgtgtgtgtgtgtgtgtgtgtgtgtgtgtagcaggataaagagggggaatctatgatgatgaggatgaaggtggaatttttactgaaatgggaaaaggcttctggctgaatgactccaagttattatgacttcatctcatacaaaaagggataagtttctattcagagtctaaaataagcttgaaaaaacaccaggcaagcccaatgcctgtcattctttctctggagaagggtaattgctcctaatctcttacagttaccttttctctgaaccca

SEQ ID NO: 475443 - DNA, 529 bp, Homo sapiens
ggaaccccctccacccttaccctcaccctaataccctgccttagttaggtcccaatcctctcagcttggctgggcccttcccatggccacgcaatggtctcccagcccccacccctctccttccatgcaccctcttctgccaccctgcgcctgcctccaaggcgcatccaaaatgcagacttcaccatgtcactccctgcccagagccctctaaaggcctacaggaaggcgcctgcctataggataacatccagattgtccaaatggccctgtgtgatgtggcctcaacctactgatcagacccacacccacctctgtgctccaagtgccccagtccccatctataccatcttcttggtgtttgcatattctgtccccgacaccaagaataccaatcatacagccctccctccaggaacctacgtgctgaaggaggagataatggagaaacagaacagctgcccaccacagcatgagcagtgccaccggtgaacttgggatcgtgctgcaggctccctggaggggttta

SEQ ID NO: 475444 - DNA, 1444 bp, Homo sapiens
gaagctgtgcccactgtgaccaggactaagtccacgcagggcctagagggcatggataggcccttgggagaggagaggcccgggagggaacccctgctggcggagctggaccgtggggtcctggagtcatttagccacatctttgtgttatcagaactgcaaactctggaggccagtggtactgatgagtcctggccttgtcacttcctaactgtgtcctggagcaaagctcctgaaatcctcgtggacaggggtgataggaggatctttggttctgatatttggtctttgatcccagttcctgacacagagctcctaatcccttggaattttctgggtaataggagcatcttttgttctattgaggcaactcttggtgggctcctggacagcctcaggatgagggctggtttccagggaaccaacgctgtcagtagagggtgggaactttcagcctcacctttgacctctaaggaggagaggggaactgaaagctgaatcgatcaccaatggccaatgatttaatcagccatgcctatgtcaagaagcttccataaaaacttcaaaggacaaggttcagagagcctctggattgctgcttgtacaatgcagaggtgccaggagggtggcatggtggagagggcatggaagcctcgcaccccttccataccttgccccatgcatctcttccatctggctgttcagctgtaacctttctaataccctttatgataaatgggccaatgtatataaagtgtttccttgagttctgcaagctgccctggcaaattaattgaacccaaggagggggttgagggaaccttgatttattaattgaacccagggagggggttgtgggaactttgatttatagccagttggtcagaagtatagatgacaacttactacttttgattgatgtctgaaggtaggggcagtctcatgggactgagccctcatcctgcagaatctgacactaattccaggtagttagtgttagaaatgagttaaattgtaggacagccagtcagtgtctgctggagaattacatgtcagtgggaagaaaactcacacaccttttggtgactagaggcgaagtgtttctgtgctgagtgttgtattgagtttgagtagacggaaaaaaacagtttgttttttacctttactgtgaatatatatataaaggacttggcattgtgcccaataagcagtgagcactcaagggatttcagctgttattcatgtttgcaaaagcagggtctgtgcatccctccaccaatccatccacccatccatctattctttattcattcatctgcttatttgttgagctctgcccatgttctgggtcccatccatgttggcccctggggttgctgagattcaaaacagaacaaaacagcaacatgcagctctcgtacgcacgtttgctcaagttgcttgc

SEQ ID NO: 475445 - DNA, 1174 bp, Homo sapiens
tgtttctctagaggggagcatgggctcactcagggctttgatggaaatgagttttgatggcttggatgctttcagagccgcccactcttcctcctcccaccccgctgagctgacaatttcacatgacatcaattcctctgacagccgtgtaaacagatggtggtccctgccgcccggggtgctggggagcggtaccatggtaacctgctaaacggtgacaggtgccaggacggtgggaaatccgggaccttcagacgcacatgcacctggctcaagcggcaggccttgggctgtgggttcttcccagatacagtgggccagggctggtggcatcacagcaaggagaagaaggtgagaagccccactctggctttgggggccctgttgagaacagggcacagcaacttctggggaggcccaatcatgcttgtcttccctggatctcagatggcagctgttgactctcccacaggtcagcatctggttctgacagagccatggaaggtctcgttcctggggctgcaagtgaccagagaagacgagcagcccattacccaagaggtgaaagacaggggggctgtgaggggcaccctgggccaggcagccaccctgagaggctgggaccctaaggtagggccaggccaacctggaaacgggagaatccgagccagcgatggcttccttaggaaggtggcgttgagcacagccttgaaggatggggagaagctgggtgggcgggcggtggggagagaagagacacagcaggcagcctcaaaacctgagaccagtgccgggggctggattcgtcaatacttatgcggttgcaacagctagaaatgggattaagctgatttcttcttctttttttggttcacataattgagaaatctagagttggctttctgcatagctagatgcagttttccaaacgctgtcatcatctcttttcatcactcaagtccgctctccccctgtagaatctcagaggggctctctcaaagcagcccccagcaccaatgtcttccccaatagctccagagtaagttccaagaaaggtctctctgccctggcttgggccacgcccacccctgagggatgggggatgaaaggctctggttggctttgatggggtcacgggctgatccttgggttaagaatgttcagaagtatttcc

SEQ ID NO: 475446 - DNA, 803 bp, Homo sapiens
atatgtgcaggccccagggtgagaaccagtaacagcgatgaatcagccatcatctgtatccaatgagttcactgcctaatggagagaccagagaaacatgtgattccaccccagcgggactggacagaaaagggtgctcagaaggtgttgaaggggcacgtgcccaacttctcaggggagatggcattggagctgagaggtgtgggagttgtccccgtggaggaggaaggtggagggtaggtcccagacagtggcaggtcagccagcaggtggagtggggttattggaggggagacctgaatccagccgacagctgcgagccgggagaggtggctccatctgtgggtgacaaagcaggggccagtgtgaagcaagatctccagaaagtaagatgtcaggacgtgaacatcttccggggccattcttcagcctgccacagctggtcgttcatgccagcagtcaccaagagagagctcagagaagatgaggagcatctgtgcagagagccagaggacagggacagggaagcccagagctctcacgtctgaaggaaaggtgggctgggcgtgctggctctggcctgtaatgccagtgatccgggagtactgggaaaggagggtgtggtccctggtagggctccacccccacggagctaggtaaggacaggcacttctgcctttgcacacaagtgttgcatttgtcaagaccaccctggcccaccacgcccccattctgggcctataaaaacctgagaccctagcaaggcagagacacaagtggctagacatcgtgaggaacacatc

SEQ ID NO: 475447 - DNA, 578 bp, Homo sapiens
tggctcggcaaagactccagtatgaatggagtttgcaatttgaaagatgatgtgtctggagccctgcggcgtgctttattccggcatacattttattgttatcttcattttcatgcaatagcattaaggcctagagaggttgggttcttgcttcaaataatacagctaataaatgaactgtctgccaaaaaggcggtaccaattttcaccctagccacagggccatttccccaacaggatatcattgtctttggactagggatgggcatgaccctgaagcaattgcttccatgtgataattccaggatcctgctagtctttggtagctgtgagagtgtatgtcacacttctggctctgtgatgggcctgtttctcattcccaaatgctgcaggtactgtgagggcagccttgcaaatacgcagcagccaggaaacatgtcttttgcccctggtggacttaaattgtaaggtttcagagaattatcttttcaccttggaaggtgttttatgggtacatgtgtattaactattactgagtaataaacccctccaaacacagtgccttaaaatgacaaggc

SEQ ID NO: 475448 - DNA, 880 bp, Homo sapiens
cgatggcacacgtatacctatattccttctctctgggcaggacatctctgaaagaaaggcagcagccccaatcaggggcttatagatcaaatttccatctccctgggacagagcacctgggggaaggggtggctgtgggcacagcttcagcaaacttaaacattcctgcctgctggctccgaagagagcagctgatcccccagcacatcactcgagctctgctaagggatagactgcctccttatgtgggtccctgacccccgtgcctcctgactgggagaacacctcctagcaggggccaacagaccccttatacaggagaactccggctgttatctggtgggtgcctctctgggacgaagcttccagaggaagaaacaggcagcaatgtttgctgttctgcagtctctgttggtagtcaaatccatgaagatgaggaaagacaaatgcaaaaaggctgaaaattttaaaaaccagaatggcacttctcctccaaaggattacaactcctcgccagcaagggaacaaaactggacggagaatgagtttgacgaactgacagaagtaggcttcagagggtggataataacaaactcttgcaagataaaggagcatgttctaacccaatgcaaggaagctaagaaccttgaaaaaaggtctgcatgcccactctggaaatgtactggttccaactgtggtggtatgtggaacaccagctgtcaaagtccatgggttgtctggctactggggtctccacatgctggtcagctggcccaacaggccacagacagattagctgatatagttgtgcagattccctcagtgttctgggtgaggtaagaggcagccttcttggcaacatctcaaaaggatagggaag

SEQ ID NO: 475449 - DNA, 682 bp, Homo sapiens
gtggagtatttagtaccgacttgcaacaggggtgagcgtttactctgcccacggccctcaaccccatgcagaaaggagcacgtgagcgagtgagtgcgagacccggacggccactctgggcgctgcaccagcagaagcaaactctgggtgtgaactgtgccggtgcccaggtgggggtgcttgcaactctgaagccccacagggcgtgttacagtgctctcttagctccactgtctgtggatgcttgtgtgttaacaactcagttgggctcttgcctcctcacgtggggcaactgccctccaccagtgagggcacagtgccagtgtgacagcctttctgagtacctgcacttggtgggccccgagctgttgtcagaatacaagaagaatgaggttgtcttctccctgaagtctggctgccttgtccccaaagataagccatctctcttccccagaattcggcagtctctcttctctgctgactgagtctgggatctttaaagacacaggatcagggtggggcgggccataggtagttttggaaaaggcaacattcagttgactctttctgaataatgcctttttactgatcaggagagagtgggcaaacaggaatagaagttctcactttgggctgcaggtttcagacttttcagcttgaaggattgctttgactatttggg

SEQ ID NO: 475450 - DNA, 1113 bp, Homo sapiens
tgttgctgtctccagtcagatgatgccagcaggggctataggattacttctagctctggacaaaattcagactactactccttactcctacttggggaccttagcaaataacactacaattgtgccacagaaagtaaccatatgtagggatcaattgaaaacattaaatgacttccaaaaattactaggggatattaattggatacgacctgccctaggcattcctacctatgccatgagtaatccatttgctatccttagaggagatcctagtctcagttgccctcaacaattaacaaaggaggctgagacagtgttacagctaattgagaagcaagtgcataagactcaaatagataaaatagatccagagaatactctagatttgctaattttttcaactcagcattcacctactggtgttattgttcaagagcaggatcttgtagagtggctttttcttccacatactaattcatggactttgactccttatttggatcaaatcactactgtgataggaaatgggagaactcggattgttaaattacatggatatgatcctggaaaaattattgtccctctcatgaaggcacaaatacagcaagcttttatagtcttacttggcaaacccatttagctgactttgtgggtattcttgataaccattttcctaaaatgaaactgtttcaatttttgaaattaactaattgggttctccctaaaataactaaatttataccaattgaaggtgctgaaaatgtcttcacagatgggtctagtaatggtaaagcttcttattctggctcaaaatgtaaagttttccagacgccctatactttagctccaaaagtggagctcgtagctgtaattgaggtattgactgcttttgatatgcatattaatgtgatttctgattcttcatatgtggttcattccacacaattaactgaaaatgctcagttacgatttcatacagatgagcaactgataactttgtttacccaattgcaaacagcagttaggagtagaatgtacccttttacatcactcatattagggctcatacacctcttccaggacttttgactgcagggaatcaaatggctgatc

SEQ ID NO: 475451 - DNA, 684 bp, Homo sapiens
tcagggaaggatggaggccacggtcaccctcctgggaggaggcgaagttgtacaagggaaacttttacttcagagacgagagcgtgaggaagcgggaagccacccttcctcgcgcggctccctcaagtgtggtctcaaccaggagggaaaaggaggcttctggggctcagaagaagactgggcgctggttatcctcgctgtgtttactcagaaacagcggccggcaggcaaaagaagggcaatttgcacttggatagtccctgacttcctgaaacagagagagggggcgttgacagagcccctttctgaaatagagcggcaccctttcttgaccttgactgcaagtctatttcaaaaatctttttcacgtcctccagctcgggaagaaggacaggaaagctgtcagcaggaaaactccgctttggagaattaaaattaagacgttttctgatcttactttctatgaatgctcatttgggtttattatgtacatattgtggttgtggcctttctttatatgtaacagaacaatgacacggttgttgcctaatatagaagtatcaaggggtagcttatgagaatttatgcccaaacaaatgtttttgtaatcttatgtgaagtatgaataaatatctttaggacacattgctatgtttcattgactagtaatttaaactctaagca

SEQ ID NO: 475452 - DNA, 701 bp, Homo sapiens
tcggatggttgccatgtctgtgtagaaagagcactttaaatatgtcatgccactctctcctgatctgtaaagtttccactgaaaagtctgttgctagacaccaagttagacttccaagtagaacattttggagcttcattgccctggtgggtccagaagtatcatccaagagtgagatactagagtcaaaaaccttagatgtctacttggtgttctattgtactgtgacttggctgccactcaaaccacaagacacagtcattcccagtctttcctcccctttccaaaggacagcactgagttcaatgccttacagtttctctggtctccctcccgcagcacccagagacactctcagcaccacagagctgctgctgggggttggggaggggtggcatcagagattccggactgtttttcttcttcagtgcctctttcagcaatacaaagttaacaccaggtcacacagtcagagaaaggcagagctgggggattgatggttgactgatggattgatttaggaatagctacttttttcaacatagtaattcaatctgctgaccttgaaaccatggattcaaatgccagctctattccttactatcagatcattttaaaccaagtttctcatagttaaaataataaattatagcatctaacctcatagaaagaaattttaacaggaatgttttgaaataaag

SEQ ID NO: 475453 - DNA, 744 bp, Homo sapiens
tgaggtagaccatcatctgtgctttcatcataaatccaaaatgcagaagcacctgaagggagtcacaactccctggattttcaaaggcgttagaacaatgatagctggtgcggctctcacctcagtctccccagtagctgtggccacaggtgtgcaccactatgactgtgtgtgggatatatatgctgtccctgcgatcagcctgactcacggaggggatgccttgctcaaacggacaatggatgacgggcttgggcttgtgttcctcttatcttctagtctatggtcccaggatttgggaggctccagatcccctggataccccgagaatgggtcaggatacaaatcccctgatgtgctcaccggggcagttgtgattgagaaactgcaagaagacaaatctcattggatggacatgatggaagaagagggtgacaggagacaggttggagagggggctgtgctggctgctgtggagacagcggatgtcactagggggcaaggacactggctagcagactattgcagttgtccaggcaggcagacagatgaccacagctgcgtggggagtggaagaccatagggagggtgggcacctgttctgtttggcctgggggctccggtttacaggtgttgtaatgattagtgtgctccttttcactctcacgtgggctccggtttggatgataagttatatgagcttcctagtccagtggtctcactgtgtggcctccgaaccaggag

SEQ ID NO: 475454 - DNA, 1599 bp, Homo sapiens
tctagggagggacctggtgggagatgattggatcattggggtggtttctcccatgctgttctcctgataacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggaccaagtggatggacttggaccatcagtggcagactaggggagtgtagcagacaggacatgttcagctgtgagtgggaaaaaaaacccaatgagaagtggtgtcaacagtctagacatcattatgtcaaattcaatgcccagaaccagaccagaggatatctctcttggacatcatacagtgactattcaacttcaaacaccacacaatgatgagtttttccaggacattccacccactttttaaaataaaacatattagtgttataaatcaatcgaatatggttcgtaatagcaataatgcccttgaaatctgttaatcttgccattgaaaaac

SEQ ID NO: 475455 - DNA, 509 bp, Homo sapiens
cctgtaaaatccagggcaaggacttctaattctatgttgaatagaagtgggctgctacggtatggttggggcccactccagtccctaggcaccttggattttccagaacctgaaggagtcttcagtgaaggctgcaaaacagcacagattgcagcctgtccttcctgggagctttgtcctgggaaggatatctggcagaagaaatttctaagtagcaaagcattcaagagggcagtgcagaagggagatgtggggttggagcccccacacagagtgcctactggggcaccgcctagtggagctgtgacaaggccaccgtcctccagaaccgagagtgatagatccacctacggtttgcagtgtgtgcccggaaaagccacagacaatgccagcccacaaaagcagcctcatgggtatgtctttttcagcagtatgaaaatggactaacacaaacatcttaaaaatggtgagtcagaattaaatatatatgattttactttaaaaattac

SEQ ID NO: 475456 - DNA, 877 bp, Homo sapiens
cacaggtcatgttggaggcagcatcggttcaggaactagccctgaaaactgtgaccgtgactcgcgcgcttgtccacaccacctccacgccactcccatggcttcccacacccctgaagatcgaaggtccaggggaggatggcaccgccttggagatggggttgggatggggaattgcacccagggaagttaggcttgaggatcctaggacacatggccggtggcagagggtgaagaaaaggcaaaaggcccaggatgacacgtctggctgtgtgctctgctgggtggatgctggttcctacccgctgcccactgctgactcagacgctttcctgtgcgtggcccgcgtagtcccatcaatctgcaaccggctccctgtcagaccccatgaaacaggctgcggggcatcgcatttgtccttgagacatcctccagccggtgaccccttcaagaggttcttacagggtcaccctggctgccatgcggaagacaggatgcagggcaaggtggtgcctggaggcagtcggtagggtttggagaatccaggggagagatgtccgttttaggaccttttcatcccctgcggaagaaagcccatgccctgtagctattatcccccacctcccctcctctcccccagcccctgccaaccacgagtctactttctgtccctgtggatttgttcattctggacatttcctagaaatggactcctgcagcgtgtgaccttctgtggttcatgtcacttcccatcatgttttcaaggttcgtccatgttgtggcaggtagcatgttgcagctttcgatggcagagtgatattctggtgttcagatcaaccacattgtcttcatccgttcatcagctgacggtgatttc

SEQ ID NO: 475457 - DNA, 1016 bp, Homo sapiens
gaagcttgctttgagctggccatccagcgtctgtccctcctggtccgctaccgtgagctcttgactccacctggctccacgccccctgccccatgtcttcccttagccaggagccagtgtccttgggcaagcacagtgcccataagccgagcagacccctggaaacccaccgccaattagaactgttcctcactggaaagactgcctagacaaaccacctaaaacccaggacgtgaggactcccagctccccacccagaccccagccagaagccacggcaagccgtcagtgtcgagcagagggcccctgcaggaagactgggaaggtctaaatctaagctcattaacaggccagagggtgagagagaacacagaggtgcaagacagggaggggatggaagccagcacgtgggtcaaagacgaggccatgggggaaacacccgctcatacgacacaagcatcctgcctgctgggctggaaatcccgaaatttccccagtattcctggaagcatcaaggctcccacagaatacagtggcacttcccataagacactggacccagatacctcctgtctcaaggagcccaccgcctccagggccccactgagcggcccccagagcccactggaattatttgaactggccaatccgaaccctgctcagcttgcctcgcccctcccttcccacagtccatgccccagctccttccaccccctgactgactccggtgcttccccatatggtcctgttgtgctgtcgaatcgtcagaaagctgacgtcatcaagagaactgagggtgttcgcagcaaggaacacggagttactctgaaacattctccagagcaagagttcttaacctgggctacaggaaatcttcacaacccttaaattacacgtgtgacttcccatcaatgcgcagctctgtccaagtccttggctttcatcagactctcaaaggagcctcagaaagccagaattttgtctcagtttctctcatcattgattttaagggttat

SEQ ID NO: 475458 - DNA, 771 bp, Homo sapiens
ccaggcacctcccttgccccgcagatagggcctgacctcagggccacatggcgggatgcccaccctctcacagccctctccacgatggggctggggactctggctcaggacagacagatggaaaaggccaaggctcttcacatagaaagtcaggaggctgcagggacggtgtggaaacatctagaccccggctccttcaccccagcacagaagggagagctctcagggcgaggtgcttctggcctaggccgtgctttgcctgtggatacattttacctgatcttcatttttcatgttaatgaagtttttcctatgagccttggacacattatctttttccattttgcactgagtgttttagataaagccttcgggtcctggggtctgcgcgctgtcctggctgatacaccagagaccctcccgtatgacacagaaccagtgtccccgcagacgctcattcctgtggaggtttgtatttttgaagtccttgtcagagatcatgaaaaggaagggtcgtagataggagaggtctcaggaaatagtggttgcagtcgtttccaaatttcatttcataaaccgaaaacacgttttaggtctcaaggggcaaaagacaccttcatccagttaactcggaaagtttttaatgtttatatggcacaaagttctttctttttttagacagactggaagaatccttcctttgctaagaccttattctttttctggtttgtttgaaatttttttgttgttgtggtaaaaaatacataacat

SEQ ID NO: 475459 - DNA, 882 bp, Homo sapiens
attttaagtgtagagttagatggatgttgacaaatatatgcgcccatgaccagcatctccaataagtacagaatatttttaacatctcagaaaattccctatgcccctttcttgtctccacccagagccagcggcagcaacctgcgtgggtccctcaccttgtgggatctttgttcttttgctcttcacaataaatctccttgctgctcactgtttgtgtcagtgtcatctttaagagctgtaacactcaccaggaagatggagtctcgctctggcatccaggctggagtgcggtgtcgcgatctcggctcactgcaacctccgcctctcgcgttaaagcagttctccagcctcagtctcccaagcagctgggattataggcgcctgccaccacgctgtggcttcctttttgaagtcagcgagaccacgaacccaccggcaggaaccaactccagacacactttgaccgtgaagttggacggactagcgaagatccggactgctcgggaagctccatccgaatgtgtctgccccccaggtaagtgaaggttgagctcccttctggctcctgcgttcggccgccgtttgcttgggattgctgagaacagcatggtccggaaggtggactggggtgtcaggctgtcgtcttcgtgcactggcctggggcctttctttcccacattgaccctggcaggctctctggtcggtttccagcaaagtaaacggactcggtttgctgggtggtattggtggaggagctaagacattgtcggagatgacttagctgcctgaagatttagatggtagggaagtagcagctggcccatttcaaagatggagaaaggggtgtgaactgatgggaggtgacagcctggaacccca

SEQ ID NO: 475460 - DNA, 675 bp, Homo sapiens
ctgccggttaagatgacctttagcacttggactagtaccctgcatgaaagttcatttcaaggcaaacagaacaatattcttggaatgggaggaaaaagcttcgagtttgaacagcctggccagaggctcttgatccccaagagaggccaggagatggcagagctgctggccgtgatgggatcctgtgggccgggacatcaggccgactggatgtggagtccaattactccccgctccctcctcccacctccctgtgctgtgttgctggtagatgctgcttctttgaagaccatgccatgtgtttccattttcttcatggggcttaactcagtgaagggcatcagaggtgatcagcaaacatgggttgattctctggttgttgacataggaatttgctttcctgtggaaggagcctggcctctctgccctggatctgccggacattgtctggctgagagcagagggtggttagagctgtgctctcttcagcgctatgctccttctcctccaccttttctgctgcccgcccaggcttgggaggaacagctggtcaccttcaagctgtctgtgtgtcctccctatggttttggtctttcaggctctgtgaagggtgaccgggtcctggaactcagtgtgccccagtcacgctttacagtgtgacatgctttacagtgc

SEQ ID NO: 475461 - DNA, 581 bp, Homo sapiens
gaaatggtgttcacataggaacacgtgagcagttcaggaggtgttgctcagctcctgtgttggtgatctgtataggatggtgttcagtacaggatggctctcggagaagtttgatcatctgaagccttcttctctcaacttatcaaagtcattctccgtccagctttgttccgttgctggaccctcagctgcaggtctgttggagtttgctgtaggtccaccccagaccctgtttgcctgggtatcagcagcagaagctgcagaacagcgaatattgctgaacagcaaatgttgctgcctgattgttcctctggaagtttcgtctcagaggggtacccagccgtcctcactgccaccctgcagttggatctcagactgctgtgctagcaatgagtgggaccctccgagccaggaaagggaattccctgaccccttgggcttcccgggtgaggtgatgcctcaccctgcttcggctcatgctcggtgggctgtacccactgtcctgcatccactgtctgacaagccccagtgagaggaacccagtacctcagttggaaatgcagaaatcacccatcttctgc

SEQ ID NO: 475462 - DNA, 661 bp, Homo sapiens
tggctttacagaactgactttacccgatgggaggacatggcgtagggtgggccgccatctgtgttgttttgcagccttagccattgttgcttttggcctctagggcgtctgagatgactagggactggagctgttcctcggcacagtccagcagctctaaggtgaagcagtcagactggtttttcatgcagatgctgaatcccatttctattcactgggtggaatctcccaaccggggtctccagtcatttccactggtgcctgagtctccagccaacccacactggggcaagccagtagaagctctgaaactccctgagacagagctcccagtgggaggcatgggttgccatctttgttgtcttgcagccctcacccttgctgtctccagactctggagagtctgtgaggaccaggggctggtctggacccccagcagagagcaaccacctcacagaaaactgtccacattgttctccatgcaggtcctggtcctcacttctccccactgggcagggccacccacctgggactccagtacaaccaccttgcccctgcctgatcactgcagtcagaggcagcccagcatttctccaaggaggaaattccagagtcaacccacaacctcttcaccactacagttgtagtggtactgacctaa

SEQ ID NO: 475463 - DNA, 580 bp, Homo sapiens
tttctcctccttttcctcctcctcctcagcctattcaatgtggagagaatgaggataaagacctttatgaacatctacttccacttaattataattatatcctaccttgaggcagaacagctcctgaatagcaacatcactggaaccacattgatatcccccatctgcagctgccaccactgctggccactgccactgggaccaaagcataagccactggcagtgaccccaatacctccagcaccaggatggtcatacatttgcatattccctgaggacaggctcccctgctcacagctgctgctgactgctgccaccagtggtggagtggaagccactgacagcaaccccactgctcccagccctccacagcaggacagccacagagcacttgccctgagtgtaggctccctgactccacgcctaccactgctgccctcacttgagcactctgccaaggccctgggggtcacccagtccctgctcaccacagcccagtgcttgtatgcaccaccaggtgcttgaggacaggcctgcccagctgagcttcacactccatagcacctaagcatgccatttc

SEQ ID NO: 475464 - DNA, 1760 bp, Homo sapiens
gaggtccctcacacggtgacatttgtcacatcgtcttcagagcaacttttggatcatgaggaggaaagggtaccttcccattgttgcagagcgaaaccgaggccgggcctggctggcaccggcatggagctgggctggctcagggcatcacagaggcctcacctgcatctaagtcaatgcggcccacctgaaaactctaagtgtgcggcttcactgcccttagagaaggcttccagctccaccactgcaagtacagctcctaaaagaggacagcgaatgaagaaacgcccagggacacgtataggcaaaagcacaaatcctccttccatcctggactgctcagcagctatcctcaagaagatgcgctcagccgggggcctcgaagctgagcccctcccgggcttccctgatgcctgccccgcaaccagctcccctctctggcctcgcctttcctacctcggccttcttaaggcctcagtgcaaacgctggacctgaccctctgtgactggaaccgcacagctccgctctgtttggagcgtggccatgtgcgtgctcggcttgtgttgagcgcagtgtgaacacagaggctcctccacccgtggctccaaatggccctgttttgtcccctaatcacaccctgatatcttctgaggtctgcaaaatttcagaagacagagaccccggacactctagagaattccctcccgggaccacggaatagtgttatatttgcaaatagctataaatgaatattatctgctcagtttccttatttgcagactgaagttcaaaaaataggtagttatgacaggtgctaatttggaagtgtgtcggatactcaatacattcttatttgattgaaaagtattcgcttgaaaattaaaaaaaaaaccttgggagaattatatatccattgttgttgattctgaaaaacttagattgttctaagagtttagtaactctagggaacaagtaagatgtgccagcatcgcagaaacatctatcagatcaaccagagttctccagagaagtaaatccaatagaatgtgtgtgtgtgtgtgtctgtgtatatgtttgtgtgtgtgtatacatatacacacacacacacacacgtctgttacacaccacataacaaggtcttggtgagcaacagtccatatatatgacagtagtcccataagattatactactatatttttacatattttttctatgtttaaatatatttagtttaatatatatattccatgtttaaatatatttgtataaatatatatttatacaaatacctaccattgtgttacaattgcctgcagcactcaggacagtcacatgctacactggattgtagcctaggagtcctagattaaattatacagcctagaggtgtagtaggctgtaccatttaggttgtctaagtgcactctctgatgttggcataaagataaaatcgcaatgcacatttctcagaaaacattccagtcatttatatttatatatataattatacatatatgtatatatgtatatatgtttatatatttatatatacatttttatatatgtttacctatagtatatattatatgtgtacatgtatatgtagtatatatatctgtgtgtatgtgtgggtgcatttagtttgctctaaactaaatcttagaaatgtaacaaattaggcttaatctctgccttcaaaggtgaaaatcacctgaacccaaaggcagtggagtgaggtcatgctggaggggtggggac

SEQ ID NO: 475465 - DNA, 889 bp, Homo sapiens
catgtgaatgtgtgagtgtatgagtgtgtgtttgtaagtgtgagagagaaagagtgtgtgtgtatatgtgtgtgtgtgttttgtgctggcctgcaccagccatgctgctccacgagaagggagtggtcccagctctgtgccccccactcaccgcccaatccaaaggtgtctgcagcatcacacgctctcccaccccagctcccggttccaggagggcagtgacccacagaccttgcctggagaagggtacctgcctggtgaggctgagcacaggctcctgtggcccctgagctgcacttggtgctgatgcaggaattgctacagctctgggcaatgcaggtgcgatgctttcacagagcactgtggcctctcacccaaggcctggaagtgccacggcagattccagggtcatcactgaggtggagctgtatgatatcagacagacccaagacctggccaagccagggaacagcaccaggtgcttccctcctacccctaaagatgccaactggtccacgaagaaggggacagccaaagccaggcgggctctgtctgagcgctgccaccacctcgtcccagggagtgcatcatgttctatgccagggaccaacagctcagctgtcgaggcggacaacatgaacacctccccacgccaagggcggcggtgggtgattgtgctaccctgcctgggaaaccacactttttccacggatcagtgcaaacgtggatctggagatcccccttgtgagcccacgacaccagggccttgggtctcaggcacagagctgtgcagattctaggcagccactcagctgaagattgcctaagactaccaagttcccagggggaggagcagccgccatcactggggatggctgctgcctaagac

SEQ ID NO: 475466 - DNA, 2514 bp, Homo sapiens
gaatatttgggggagaagcaaaagaagaaaaagatgaaggggaagaaggagaagaaggagaagaaaaaggagaaggagaaggagaagaagaagaagaaaagaagaagaagaagaagaaaaaggaggaggaggaggagaaggaggagaagaaggagggagaagaagagggaagaagaagaaaagaaggaggaggaggagaagaggaagagggaggaggaggaggagtggaggaagagggggaggaggaaggagaaaagaagaagaagaagaagaagaagaagaggaggaggaggaggacaaggaggagaagaaggagggagaagaagagggaagaagaagaagaaaagaaggaggaggaggagaagaggaagagggaggaggaggagtggaggaagagggggaggagaagaagaaaagaagaagaaggaggaggaggagaaggaggagaagaaggagaagaaaaaggagaatgagaagaagaagaagaaaaaggagaggaggaggagaaggaagagaagaaggagggagaagaagagggaagaagaagaaaacaaggaggaggaggagaaaagaaggatgaggagaagaggaagaggaagagggaggaggaggagaagaagaaaagaaggaggaggaggagaaggagaagaagagggaagaagaagaaaagaaggaggaggaggagaaaagaagaaggaggaggagaagaggaagagggaggaggaggagtggaggaaggggggaggaggagaagaaaagaagaagaaggaggaggaggagaaacagaacattttactagcagcatcgtttcaaaactattatcagaatatatataaggtaaaatttctcagtttaattattcttaaccacgtacaattctgtgacattaagtactttcccatttctgtactttcgccatcaccacgacccacctctagaacttctttcatcctctccacctaaaaccctgcacccattaagcattatctccccctcccctacccctgcctttgctacccacccttccactttgtctctgaattgacttctctggggacctcatacaagtggaatcaggcagtatttatctttttatgcctatcttatttcactggacacagtatcttcaaagttcatccatgttgtggcatgtgtcagaacttccttactgttgaaggctgactacagttccatcacatggacgtgccacgtttgttgatctgttcgtgcatcgccacatgcttgggttgcctccctgtcttagcccctgggaataacgctgttggaatgtggataaacacctgtttggggccctctttcaatcctttcaattatttgtgggtatacccacaattagaatggtaatttcatcttgaatgttctaagaatctcccatactgtattcgacaggggctgtgccatcttacattcccaccatccgagccattaccatcgatttaaaatacatgtgcaaatggcaacaggacgggccttcataagatcacacagcaatagaaaggtggctcctcacccactgcaaggctctggagttgaggggatgcagcaggaaatgggaatataaggggtaatataactaaatcaacaaggggtggagggcttcccccgacaagtgaaaatgatgggtcaaaagctgacgagtttgagtaatggaacactctgcactgccagaaattcaaaaccagaattgactcttttcatttcagaaatgttaatacctctgtctccctcttcttcatagcaaaagtaatcattagttaacaaattattttgcttggatacgtttctattttctcgttaggtttctggatttttttgaaatttgattcagctaacctaggcagatgcagaagagtccaaggaggaagacactgtcccccctgcagagcgctcagagccagcagtgtccccacgaggagctaccatcccaagtcgtccgcagtacccacacttttcatctgcgcaaaaagagacttggagagctcgtcctctgaaaaactatacagtcaagtgattcattattggcacaagaataaacgagttctctagaaaaatatttaaacagttatttctacctttggacattttcaaattgtctctgtacatattgtcaggtgaaaaaagcatgatggcagctaggaaaaaaaaatggtagaaagcaaccaatcaccaataaagtttcaaattaagcaacttacttggcagtattccttcctttccaaatcctaaactgttccctgcttcatacagctatggcttttggaggaggcctggaaagcattcatgaggaaggctggtaaaacaataatttgtttatgtggacattttctccagaacggtgcactggggaaacatctccaaaattaaatagtagaaaagcaacggcagctcatttgtttctttttctcctgcagatgcatgtccagcacaaatcgctaccatttatgatttatgtggcagttctggagctgacaggccagtggactgactccagaa

SEQ ID NO: 475467 - DNA, 756 bp, Homo sapiens
ctctttcctgatgcatgagcttcctgtggctgctggaactaaccatgctctgggcggacaaaaacaacagaagtgcatcccctcgcacttctgcaggctggaagtccagagccaaggtgtccactgggttgggcctccttccaaaggctccagaaagggcgctttcttgcctcttccagcctctggtggcccccgtgatcctgggcttgcagccagttctatccctgcctccctcttcaccctgccttctctgctgccttacacccaagaatctgatctgcaggtctgtgatgtggcccaggaatctgcattgtcaagatttccccagctgattctgtctcaagattctcagtggcagctggagcagcagggagaggtcacttttatcatctggctgggggcagaagcttccaggctagagacctcggatgctggctatgcctcccggagcagaaggagagcaatggcatgaaagaggaggaaacagcagcaggagggcatcaaattgcgaacatcaaattgcagaagccagctcttgacagaaaggggcttgttaatacttaatttgctttgcactaaaacataggcatccttataaatgttaactggatactgtaagtacaatgcgttaacctgttacagaaacagacttgtggaaggaaactattttctccgctacttgccaaacacatttaactgggccatagagccctctaaaagcacgtacgagtcagagaatgattctgccattgggac

SEQ ID NO: 475468 - DNA, 4880 bp, Homo sapiens
gaagccacgtgctcgtggtcagtgtcagtgggtgtgctgctgaagctcccagagctaaggggatgaggagtaccggtcccagaatgtaggggaacaaaccagcaccttctccctgattttgagaatgcccactcacatgcatgagtcaaacttggaaacttagacaggcccatctccaggagtgaaggaaggaatcttgaggatttctaattgatatcatcgtccccaaaatatcccaaatgaaaatcaagttctcgccctggatgaaaatcaagttctcgccctggatgaaaatcaagttctcgccatggataaaaatcaagttctcgccatggataaaaatcaagttctcgccctggatgaaaatcaagttctcgccatggataaaaatcaagttctcgccctggatgaaaatcaagttcttgccctggatgaaaatcaagttcttgccatggataaaaatcaagttctcgccatggatgaaaatcaagttctcgccatggataaaaatcaagttctcgccatggatagaaatcaagttctcaccctggatgaaaatcaagttctcgccatggttggagacacagcttccagacacattctctaatcttctgcccgcagccccagcacagagatttcagaaatggtgcttgttatccaccagctcaatccgagactgaccacccaactcctcacaggagcaaaaggcatgcagacctagggaaaggttctcccatcgcccctctgaggaccaaggtgccctcaccagcagggaaatgtgagctccgattttcactgattcatctgctgcgtacttcacattgaaaaccttgtttttgctatagctcttggtatgtatgttttgtttatgccaagaccataatgataaactgcaacaattatccatttgtagttacaaagaccctattttatattatttgtttagctggctattaatactgggcttttcattagaaaaaaaactaaacaaattctggttgactgtagtggacacaagtatgtgaagctttctaatcttaaagaagtctgttatcaatgcaacaatgacattttcgattgaaaaatcaattttttcctttcactccttttaacctctgtgccatcttcattccttcccagcatccagataacataactcaccatgaaagccagacagaaacagccctgggcgtgtctatgggaaactcacatgcatctcctctgcagaaggactcatttccctccagctactgggctttccccaatcatacgtttcaactccccttataagtccttacaattcctgggggaaaaaaagtcgagttgtttctgttaataatgcaagaaggcgtgaatgccaaccgggcagttctggaaaagaagtgttatggctcaattaaccagacgccgtactcagcctgaatacaagctgacgggtgcagcccagggtgctggaagcccactctggccccgcgagtgaagcctgcatcatcagagccttctgtgcttcgcaaagctccagaccctcatttcctttcctgagactgacctagaaggaatttgtgtggtcagtaaaggggttaagaccgaaggccctggagccgctgggtggatgccagtgagcacagaagagatgctccccgaggactgaagatactttccatgcattactgggtgctctgcccacagacggcacagcctcaacctctctgggaatctcctggtttgagaatgcctcccccaagatcacacatccactgcggcagcccacagccaatcccaggttagtgtgtgggtaacaaagccccctcaccagccccacgagcacagcccaggctcccgtgaggctggcggcatcccgcgtggagactgcatcccagcaaggtgcctgccctccacccttcctcccacaggcgttcctgcacggagctctcctgctgagcttcctgcatgctcacctccttcccagcatctgcttcccgggaacaggttgagcttaactttaccctctgcaaacgcatggcctgggcacgtcttgtaacttcacctcggtttcctcacctgtaaagctgtaaagccaggatcgtcacagtgcccacctcttaagactgcggtcctgatgcaggccaggtgcttgtagctcttcccaggacgcaggtctttgtagctacaagtggataattgttgcagtttatcattatggtcttggcataaacaaaacatacataccaagagctatagcaaaagcaaagttttcaatgtgaagaaggcaccagctgaatcagtgcaaatcagaactcacgccttcccctgatcccattcagaatctattagcgttgattcaggctcctatcacaaaactaccataaactgggtggcttcaacaataatcatttatttcctcacattcccggaggctgggggcggctctcaggtccaggccccggtagtgtctggtgagggccgcttgctggttcatggaccacacctcaggccgcagtctcacctggctctaccctaatggccgtgtcacctcccaaagatgctacctcctaaaccatcgcttatattatttcagcagaggaatttggggggagacacaaacattccatgaataataatcagttattactcatatgattgtagcatggcttgagcaggtaatttcagtaaagggctgatttttctcccatttgtgaaatggatacttcatgctcttctttgtaaaccacagtgaaaagtttatgtgttttgttttgttttgttttatggcaagaagcagccgtcaacggaagctcataatcacagcaataaagtgatatggtttatacttttaaaagccttccctggctgccttccccatccagtaaaagttcggtggcttttccaattatccaggtaagagaaggtggtgggttgggccagggcagtggttgcagaaatggtcaggagtggtggattcaagagagaccccggaggtggcgcacacaggacttgctgatggacaggccagggaatgagaggagaagaatgaggaatggccccaggtcttcagtctgagcacctggaagcagaggtcctgttcatttgaagagtaggaggggtgtgggacaggcttgtggtggaggtcaggacacctttggcctagagggcccttggacgccctgcgtggagccctgcacagggcagctggcaaggccagtgtctggctctggagccatctgaacgtggatgctgctcagagtcacctaggggatgagtcacccgggagagagtaaggagcggtgagaaggtgaaccttgcaccctacagaattagagggcaggaggagccaggagaggcagctggaggtagatggccagtgagcgggaaggacagctagggtgtaggcaagcccagaagccacatctaaatcatgctttcccgctacggggccagagaggccaagtgtgccagatgcgatggagaagctgagtcaggagaagaggcgccacacaccgtcggatctgcagaaatgaaggtctcggtgagcatggcggctgcaggtccaggtccggcggacaggccaggagtgcagcacccgaaagggagtggaggagaggtggagagatgagaccttggggtcctggataactttccagagatagttttaatgaagagtccattgaaaggggacacaggatcatgacaggggcgttgctgtgctggtttgttttagaggagagatactagaatgggtaaaaatgatcccagagagagaaatacataaataaacctgagaaagcagaaaagaaaggctgcacagaacaaagccaagtcttaggggatagaagggcataagacccgccgcaggaaggcagggtcctgacttagcacagagacacttcctctgctgtgatattaacaggagcaggtcaggaatatgggctggctcttgtctggctctggtggtcagctgggcatgaggagcttgcagccttcgagagggaggggaagaggaaagtggttatattgataagagagggaatccgggaggcactaacacagtggaccatccttcagtctcagcaatgccaccactagctggccatggttttgaaggttccaggaggagctgagtcctaagtgtgtcctttcttactctgcatatgtctgtagggaggacggctagattcccaggtgtaggtgggtccctagtaggtttgagccttgttgagcattccgaagatgtttacccagcctcatcaaatctcagagatggaaggggacggtcagcagacaccgtggtcagtgcctccctcatcctctctggctgtccccacccagccctgctccagtgacactcaccgcttcctgtaggcaaagccctcggaccatcccagaatctaacgtaagatgctaccatccctggcttccatgacaaattcaacatggaatgggatctagtctgggtcactgggacccaagaaaagaactgctgtgaggcttgtgggaaaggttctcttgcatctaagaaacaaagaggtcaggactctcttccttgaaggtgagatcacaggcatatggtccctggaactaatgagtcttcctgtgaccttgatgtgttcttgaggggacacatgtctcctcccacctggagaaagatggcacatccgaactctggcagccgcatggagatgttcaccaggccaggacactcctgccttagaggacggcctcgtgggagggtgaatgcagacagcatttcagagattccagactggcatctccttactgtagcacaggacacactgatggctggggtcactgctcagaacttgttctcatctcattgtacatattgtaagagtccttcttgtaaagtatatgcattggtgttt

SEQ ID NO: 475469 - DNA, 467 bp, Homo sapiens
gcttgatataactcctctttggaagatctgatggtttcatattccaatgaacggttatgaaaccatcgacgaggtgtgcatcactgggccagttccaggttccgttgcatggctccccttggtaagcagcagtgtttccacataccccctttctctgcagcatgctgtgccatctgtgcttttaacagaatgtatcccaccgacccccacacctataggtatttcctgggcccgtgtgagaggtgggcccggacagatggtgagaggcagtggccgtgtgcatcctgaggtcacgttgcacaaagctgagccccacctggcaccagggtgccatccaattggacctctcttcctgctattctggagactccaaataaagcagaaaataatatttatggaaaatgtttcctcagaaatgttggcctctctggcaggttggtttctctcctgatgctagtgggagaatc

SEQ ID NO: 475470 - DNA, 816 bp, Homo sapiens
gaacacgtaacaggacactgttcactcatgttaccagcactcacgagcagtcggctcatgagcaccgactcattaggtcggtggtgcaactgctgtcgtgacagcaaaattcattccgcatttgctctgtggagggaccgtgcttgttgttttgaaaatgtgcggtctccacatggcccacgtttgcagggtctgggagtggcttttgtggctctgagcactggaagcctcaggctcattctgctgaaactgccacggagagctggaattgaagctgatagagacggtcccggacttgagatgagccccaggcaccgagtcaactttggatccctgcccttgcatcctctttgggacaggcacctctttgatctcagcaaagacatgctcacagggaaaaagtcatgtgagcaggagaaaagagataaggagaacgagctgacaagcccaggaactccaggatcctggtatcagcaaggcacccaaaggccagccacagtgctcagaaccatcaaccctgctgacaccttggccacagacttctggcttccagaactgacacattcttgttggattcaggcctcctctactccactgtggtcccatcgtcactgattacatcttcaaggcccttatttccagaagatgtaaaataatttcatacacagttttgtcattctcctagaacatgctttccagaggcttgtccattgagtcttggaggatgatatacgatgtttgttgagctcacattatatgccaattactgtgctgagtagttcagggagattatgtcaaatggtgcaataaaagaac

SEQ ID NO: 475471 - DNA, 905 bp, Homo sapiens
ggcggctagcgttaccaggcaccatgttcggaacaacccttagagcccttcgcctgagtcccccaggagtctggggacccctgcattgacatgcagctcctaacatctgcagtgattgcccatcctttgttccatggactctttgcttttcctctcctgctgatccccatggatgacacagcctcacgttgtccaagtgctacaggcaagatccagtctagcctttcagatttgtttcattaccgagtcacagtaccctctcagagaggactgccacaaagtgcttctaaattcgcactcccccgtgaatctatatctccctgtggccctagtttgatctgtccacgttggaaacgccaagggtacccggtcagaaccctctgcctcaaggcaattgtgcttcgactcagcagaggggagccttctgtctccaggacacctggagtcctgctcctcctcaccatacctggaccagctgactctgctcaccgcctggctctcaccttctccgtagaaagtaccgaggggacagaagaacctactccttccatgattgacccaggtatccatggtgaggagacagagccatgtgcagcttctccacagcaaatcttcatttcactccacctaggaagcacagccttgggagaagtaaaacctccaaaatcctgtcaaggagaggtggactggtggctgaaaggccctgctctacatattaagaggctatgggatgtagcggtgcaggtggcagctcctgaggccatggaggggcctccgatgccaggccggcccgtgggcaatagccctgctctgctgacctcggctcccaagctcctgaaagcgagagggtaaaacccacaggagtattgacacccagtcaggttaataggaagggatgtaaatga

SEQ ID NO: 475472 - DNA, 1032 bp, Homo sapiens
tgaatagataaacttatgtcatgggggtttgttatacacattatttcatcacccaggagagtgcctcccagcaacaggacgctgcttggaggatgatgagagcatcggggagctctcctgaagaaagagcttttgagtccaggcaacattcatttgcacaacgagcgcactttgaaagactccagcgcaggcctgtgttcctggccgcaacaaaacacctgcttgaagcggagacaaaatgccaagctggagagagttcaaaagaacagggtgacaatcacacagtgttgaacaacagcaacggcaacccatcactacagccttttgtccgtggctgcttgattgggaaaggccctggctcggcacggctcggtgacgtttctagcagtgcattgaccttttctgttgaatcaagaccaaatcatgatgggttgaaaagacgtgtcaggtccaattcagacatactgaaccacacattcagagccagaaaacataaagagttccattgcccggggacaatccaattgacctattttttgtggcttttctttgcttctgcccatgcctggaggcacctagacagcccttatacactgaatgatggtccactgtttggatgtaccagagtttatatatccactcacctactgaaggacattgtgattgcttccagttttggcaaccataaacaaaactccatgtacaggttttgtttatcccggcatcatttgttgaaaagactgtttgcttgcttgtattgtcttggctcccctgtcaaagattaattgattataattatgtgggttgacttctaggttctctattgcattcccttgatctatttatttattctttcaccaatatgacactatcctgattactgtagttttataagtggaacatctattgtcaaatgcataatatagcattagaaatgcaaacttgctgtagccaatggtaatgtgttatttaaaacttatgaacccaaatgagggcttattttctccaaattgaaatttatagtttcatttt

SEQ ID NO: 475473 - DNA, 551 bp, Homo sapiens
gtttgtttaagtatctgttttggctaagatgaataatgctgctgtgatcattgatggacacgtttctgtgtggacagaagatcagaagcagcagattaaagctgccccagaccatcactatggaaagaagcaaggaggctgcttaatactgatgaaagggcagaaagaaaataaagtagcgtatgaatttggggaaaaaaaatatcaaagggcaagtagagtcatggatataggtccatccacatacctcttcgtcaaatttctttgtcaccaattttctaatcatacttcttccaagtccctgaccatccagccaaaccattggctacagcccatgaatcagtgtataattgtacatctggccatttctccttccatgcaaagggcacaacctgttgcactgctggaagttctgcccactgggaagatttggcttcatcactatccttcagttatgtcctggaaagggaccgtagtgctgcagctgtccactttcaggtggtgcctgcatatcctgcagaaccatttgtgaaccaggcctcagtcttctc

SEQ ID NO: 475474 - DNA, 1482 bp, Homo sapiens
gcagctcgtgctgttacaagaaaggcactggtctcccgggttcccacctccaacagctagaagagggggtgatggtaagaactgagctctcgttgcgcaaaagcatgatttgaatttctgcgttggtaggtggaaacctttgataaaatgccatgtgcgaacacgacagtgaaccttgcttgagaaatggaacaactcatcctaagcacccatcgttgcaggattcgggggtacctgaatctcagtttgccacactcgtcgacggcaggcgccaagctgatgaagacgagctgcacaactctgccaaattatgtctgatattcaatgtggaacaatttggggagtgttctgtgaccagtgtgctagtgagtgatgtctgtgaggggcaccttcctgcagatgagtggaaaaggtctgtgtgcatgggcaagaaagtttctccggagagccacgcagctgagcttggactacaagaagcatctatttctacaatcacaagaagcagcccaaaggagcttgttcaccctctactgcatgaagacacagttacaaggtgtcatctaagaggaatgaccccttgccagacactgaatctgatgatgccttgatcttggacttcgcagcctccagaattatgaaaacaaatgcttgttgtttacaagacactcaattttgtgattgcaacttgaaaggactaagacagtattgggaagttcaaaaatgtccatctgactctttttatgtactttattttttaacattctccatattttcattcatttttgttcttttctccaacatctttaacttagcatatttattttgaagactttttctgactaatctagtatctggattatgctgagtctgcttctgttgattattttgtcccttcatggtcaaacatttttttctgcttctctgtgtaatgatttctgactatgtaaactttcaaattctaaaataaaatataagtataaaattctacaaattttgatggagaaaattaaaaatatctttctgtttgatagcaaatatcttttaaacctttcttccatatgttattctattggttaattcttcttttgctgctaaaggaagtggctgtggatcaaagtactaatgcaagtgttcattgagctatttcaataataaatgaacaaattaattcattttttaatttggcaaattatttttatattcgtgttttaggtttgtaatatcacttgttattcagctaagcttttattaaatttgccaaatgtaaaatcttttaaagcttgatgataaaatttttttttagttttacagttctctaaatgttttgtcctactgaaaacaagtcacttaaatctgacccatttccactcctgatggtatttttctaatccttgctttactgcctaggtataaatttaaacagtagcttaagttcaggccaccaaggattgggataaatgcacattccactgcatgatatac

SEQ ID NO: 475475 - DNA, 1510 bp, Homo sapiens
cacccatctttggtgttctccagtgtgggagggaccgagatgaatagggcctgaaatgaacccccagcaaactgcagcagccctacaggagagggacctgactgttgaaagaaaaacaaacagaaagcaacaacaacagcatcaacaaaaagtccccacaaaaacctcatccaaaggtcagcatcctcaaagatcaaaactagacaaagtcatggagatgagaaagaatcaacgaaaaaatgctgaaaattcaaaaggccagagtgcctcttttcctctaaatgatcacaacacctcaccagcaagggcacagaactggatagaggatgagatggaaaaattgacagaagtaggcctcagaaagtgggtaataacaaacttggctgagctaaaggagcatgctctaacccaatgcaaagaagctaagaaacatgataaaaggttacaggagctgctaactaaaatgtctcatttaaaggggaacataaatgacctgatggtgctgaaaaacacagcacaagaaattttgatgcaaacgcaataaaacagtggactttttatattgacctgtatccccaaacatgctatactgtcttatcaattctagattttctttctgtagattcttttctacacaaacactcacagaacctgtgaaaaaagatagctttatttcacctatccaatctgtgtagattttatctattttttccttgttttactacactaaccaggacatctggttgatgttaactaggattagatagtgtgtctttagtggcatgacatttttaatcatttaagtacagctttttccaaaataactattaatttggaaataaatccttatgtattataaaaaattgtgtctatattcaaattagggttaaagtcaaagaaattttaaatattgatcttttactgtgctaagaaatgaaataagattatggtctttatcatttattttatatagcctacttacaagtattagaataaatgtcttttttttaaattttactattgtaaaattacacccattcacttatgctaaggcagagatagatttctgatagctatgtgatttaaatcttatttgttaaaaataccccttatgagttatatccagtgaaatttgtccttatgtgctgtatttatgctggcataagctgtggtatatttttatgaagtttaaaataatttcatcttcttagttttcttttcctacatgaattataaaatagaaataaaaaagtagaaaaggaaagatttactggggaaaaaatgcaattcaagtatgattgctctaaatatacaaattttctttgaccagtaaatgttggcaacataatttttttaacattatactctaaaagaaatcaattcttgcaatttaaaaataaggttatttctatgaattttaaaaattaaactgttttctgtgtttttgtctcctctgtgttgtcagtctttaatgacaaaaacagtcttattttgtaacatctctgctttt

SEQ ID NO: 475476 - DNA, 537 bp, Homo sapiens
agtacacagaatgagcccagcagacccaagcaaaactcaggcaaaggagtttctggccacaggtttccagccagaaaagcgacattccaaagattccataacattatggttagctctgatcaattatattaaatctctcttcaattccataaaggctcagagaggtgaggaaactgcagaaggaaagtttgaagctagtggaggttggttcatgaggtttaaggaaagaagccgtctttatagcataaaggcacaaattgaagcagcaagtgttgatggagaagctgtggcaagttatccagaatatatagctaagatcattgatgaaggtggctacactaaacagcgcatcttcaacgaagatgaaatagccttctcttggaagaaaatgacaagtaggactttcatagctagagaggaggttaatgccggtcctttgaagtttcaaaacttcaaaggacaggctgactatcttgttagaggcttatgcagttggtggttaagttgaagccaatgctcacttaccatttcagaaat

SEQ ID NO: 475477 - DNA, 1631 bp, Homo sapiens
gcaggggctgtttgcccacattctcctccccagggcaaaaagaggtaaatattcgctgatgttatgaatattctggcagtgcaaataaagagggtccttcaaaatgtgctgggattccaaggagaaattggcctaaacaaagggctacaagccctgtgcaagtccaaaatccagcaggacagtcaaatcttaagccccaaaatgatctccttagacttcatgtctcacatcaaggtcacactgatgcaagacttgggttcccatggtcttgggaagctccacccctgtggctttgtagggtatagcacccctcctggctaccttcgtggcctggcattgagtctccaggtgaggtcaaatccatctcctgcgacctggacctttagctttcccagtgaggatgtgcgtttcgaggcggcagatgatctccctttcacaccttcacactttgggcactcacagttttttggctgtctccttgagcctgcagcagcaattcacttccttcaaagcgtccatggattttctcagctttcctgggatgttcctgcagtaggtcatggacctaaagttcatgatgtgcctccaccacaggctgctctgtctatccaagtaggggcttcaaattaattctgtctcctatccatcattttctcccctaattccctcaaaaagtgtatatttttctatagcagaatgttgtaagcatttagcacatgtaaatcaagtacattttcataatgagttttttcttgatttatctatttacatgatttaagatgaagcaaccgccatctaggaaggtcactcagcacttataatcttatagtatggtaatataagtttaattttttaaaaacttgagctttcaatgactgttctgtttccttttaaagttaagagtgccaaattatttgatccaggtatcatacatgcacaattactcttagtggattaggctaagatatattcatgtagataaggattagggccaataatgggcaaaagaaagtctacatattggtagtggtcaaaacaagttggagccaaacctgggtctttccagaataaaatatcagattggatttattgattcacattgataaagtcagagactgctgtaagcaccatgtgtagttccagacagagataattgtttaaacatcccttagagaaatagtaaattactaacactatatggaaagccctaagaggtacatcccagagtgttgtggcaagaggaagcttttaaagacaaaaaggaggaatccatgcaagctgttttgaaagaaagatcatttgttacaagagcttattgcaggaggtaaaatctgttcattgatggtactgattgttacttgaagagggtcttcatagaagtggtttaactaaaaattccagttagaaaagttctccttggcagcttctgtgacacacatgtatgtatgagggcgtttccttcattggctctcagctacattttgttagggtttaagttaagtgactccattttggtactggcaattttaacagtatctcattgggaggtgcaggctgcaggcatttttcataccacaccctctgtcctcaatttcaagttgcaaaggctatacaagagctagtgtggctac

SEQ ID NO: 475478 - DNA, 558 bp, Homo sapiens
gggcggtgcaagatgtgctttgttaaacagatgcttgaaggcagcatgctcgttaagagtcatcaccactccctaacctcaagtacccagggacacaaacactgcggaaggccgcaggataaaattgatagatcattagcagcattaacccagaaaataagaaagaagatccaaataagctcaattataattgaaatgggagatattacaactgataccacggaaatacaaaagatcattgaaggctactatgaacacctttacgtacctaaattagaaaacctagagaaaacggacaaattcctggaaataaaggaccctcctagattaaaccaagaagaaacagaaactctgagcagatcagtaataagcagtgagattgaaatggtaataaaaacttgccaacaaaaaagtccaggaccagatggattcacagctgaattctatcagacattcaaagaagaattggtaccaatcctagtgacactattctccaagataaagagaaaatactccctaaatcattctatgaagccaatatcatcctaatatcaaaat

SEQ ID NO: 475479 - DNA, 533 bp, Homo sapiens
gttcaccctccacttttctgcatgcctcattcttcctggatgcaggacaagaactcaggcaaagatgccactggcaacagaggtttctggccagaaaatttacaccccaaagatcccataacacttatattttattgtcataaaatattgctttttaagaatataccaaatgtatttatccattctactcttgatagatgtctagtctatttgtgttgctatgccaaaatgcctaagacaggtgttcttcctggtattgaatctgtcagacagttaagaatggccagggtggttgtgctatgctttattccttgtaaacacccactgatgtttcacaaactggcatctgaaatactttctaagagagatttactgggagccaaaaacagcaagccagtgaacccaggaaggctgtcacaaggagagcagaggatactgtatgatttctgcatcccagatttcataaaatgtccaggaaaaaattaacttgaagcaacttatatggttaagatatagcattggcagtatttacc

SEQ ID NO: 475480 - DNA, 733 bp, Homo sapiens
cctgcagctgactgttagaaagaaaactaacagaaaggacatccacaccaaaacctcatctgtacatcaccatcatcaaagaccaaaggtatataaaaccacaaagatggggagaaaccagagcagaaaagctgaaaattctaaaaatcagagcacctcttctcctccaaaagaacgcagctcctcgccagcaacggaacaaagctggatggagaatgactttgatgagttgagagaagaaggcttcagacaatcggtaataacaaacttctctgagctaaaggaggatgttcgaatccattgcaaagaagctaaaaaccttgaaaaaagattagatgaatggctaactagaataaatagggtagagaagaccttagatgacatgaatgaaacgaagcgagaagagaagtttagagaaaaaagagtaagaagaaacaaacaaagcctccaagaaatacaggactatgtgaaaagaccaaatctacgtctgattggtgtacctgaaagtgacggggagaatggaacctagttggaaaacactcttcaggatattatccaggagaacttccacaacacagtaaaggcaggccaacattcaaattcaggaaatcaagagaatgccacaaagacactcctcgagaagagcaactccaagacacatagttctcagattcaccaaagttgaaatgaaggaaaaaatgttaagggctgtcagagagaaaggtcgggttac

SEQ ID NO: 475481 - DNA, 529 bp, Homo sapiens
aagaagagaaattttggtatgcagggtatgcagaagaggcatggaggtggtggtttatgtgactttcttggggactcatctcaattaataggtcatctggtagtcgggctggcaccactgcagacagattcggcctgtagtttcctggtgggggagaattctggagggtgcttggtttgtttcaagacttggtccctggatcttctaagcaaacatacagctaacaatgcttgtaggcactctggccagaggaaaggaagcaacctggatgagattggagattatactctaagtgaagtaattcagaaatggaaaaccaaacatcatatgttctcagtgatacgtggaagctcagctatgaggacacaaaggcataagaatgatacaatggactttggggacttggtggggaaaggggcctttatggtttatgtctagaattcatggctctaagaaaaacattgaaaaagatggaaaatgaatgtttctccttggggttttaacagttttaatttaaatagagtgtcac

SEQ ID NO: 475482 - DNA, 475 bp, Homo sapiens
ggagtttgagctcacttccaacaggaaagattagtgttttgttttgtttcctgcttctaagatggtagagagcagataccaaaatcatcataccagagacatgaatctccctcatttggcatcccaggaggcctggatcagtttcactgtgaatgctccgccgctcaaccacacaagcacccttcctccaggcccaggggatactgcagaagagaacagctggaatacctctgcaggaaactgttatcctctctttggaaaggtgtcaccaaagattcacttaaagtcagcctttgcccagctcccatttctactttgttgctatgcgaatgacccagtgaccccaactcctgacattcttctccaagcccagcatcctttacagcttgtacttatatttacagagaagaagatgagggtcccaacttgcctaaatttcgtctatcttgtgatggaattaagtgttgaataaaag

SEQ ID NO: 475483 - DNA, 558 bp, Homo sapiens
gaagccttgtgagatcctgagcagagcttcagttaagtcagctaagtcagttaaggctgactcttaatgaataaaaactgagatttacatgttatggctagttttgtcaacctaggtaccatggtaccttgtgggaaacttggggaaaagctcatgtatatggatgcagaggactttgaaattcaggtcatgagagtcgagcctcatgactggcatcagtgcttttatccacgaggcctcccccacagctccctctggccctctgcccctcgcggcacaggagaagggacaagaggcctcccaaacagctccctctgcccctctgcctctgaggacacaggagaaggtaccaggagctgtaagactgtgagtcttaaaagagcaaagggtctgagagttaaaaatgatcaagttctaaacctcccagcagttccaaacgacccagcaatttcactcctgggtattgatcccagagaaatgaaaacttatgttcacacagagacctctacacaaatgttgatagcagagttatttgttataacctggatctgaaaataa

SEQ ID NO: 475484 - DNA, 595 bp, Homo sapiens
tttttcctctgggcctgcctacacagggtcaggattatcaagatgtctctaggcactaggaatttttcagatctgatcctctggattttgacagtgtctcagaatttcatttttgatcgccttgacagtttggaggattattggtcagaagttttgaagaatgtctctcaactgacttttgtctgttgtttttctcatgacaagactatggtcgtggattttggggatgaatatgacagagctgttggctataaaagctttgggtatgtgtctgtcagtacagctaatgcccactgtgacaatgccagggtcagtgtcagaacccagattctgacacttgaaaaacttagattcagagtggtgagtgctacagtccaatgccgagtatttagtcgaactggagagaacgttgattttttgcaaagactagcaccaaggctcataagccataaattatatttgccctcagtcgcattcaccacttggctcagattccagtctggaataggctaagactttgtgtatctacttctcataaagatcagctcaggctacaaaactatctgcttgttcattttcttctgcagatttcaga

SEQ ID NO: 475485 - DNA, 720 bp, Homo sapiens
gaactgctaacattcttaactgtactacttccgccttaatgcatgtctaatgaggtttgctgtcagaacacagatgtcatgaaaaccacccctaaaaccaaagtgggaaacaaaaagactcatatcaatatcgttgtcattggacatgtagatttgggcaagtacaccgctactggccatctgacctacaaatgtggtggaatcaacgaaagaaccattgaaaatattgagaatgaggccactgagatgagaaagaactccttcaagtatgcctggtgtgaatatagtaaactgtcgagtgtgaatgtagtatcatcattggtatcgctctgtggaaatttgaaatcagcagtcaatgttacaactgaagtaaagtctgttggaaggtaccatgaagctttgagtgaagctcttcctaagaacaacgtgggcttcagttttaataatgtgcctgtcaagcatgttcgttgtggcaatgttgctggtgacagcaaatatgacccaccaatggaagcatctggcttcactgctcagatgattattcggaaacttccaggctaaatcagtgttagctacacccctgtactgaattgtcacactgctcacattgctggaaagtttgctgcactgaaggaaaagattgagcactgttctggtaagaagctggaaaatgaccctgaattcttgaaatttggtgatgcttccatcattgataagatt

SEQ ID NO: 475486 - DNA, 542 bp, Homo sapiens
agtctgagtaggtgagattgccatggttggtagtgtagaagagaatgacaaactgcatagctttgccgaaaaggtctcacacattcaaactccaacttatttctgtgggcagacattaacattcagagttgaaactgtgggacagaagatacagtatggggtgtttgcagaaaaacagaatggatatgactctctgcagcaggatcaagctatatgtatgagtacaaatggtgaagtttttgttaatggaaaagaaatgactaatgagttaacttcagttacttctgtgtgcactgtcacatttgacactgaagctgtcactctaggaaccaccaataataatgaaggcaggaacttcaagcttcgaaatatactactctactccttaagaaagtgtaatccaaatacaaataatggatatcatgttgtgttgatttcgtaatagaacaaatactttagagtttggtgtatgaagattatttccagtaccgacacttgctaatgagagaaattttcatacttacacttaaaaatgttatgtg

SEQ ID NO: 475487 - DNA, 2288 bp, Homo sapiens
agcacagcagtaggctgaagggctccccaagtgtggccagagtggacgccaagccaaggaggcaccgagagacttccagtactatgttgaatagaagtggtgagagagttactctggcagccctcctcaaggacccctgtgaaacaagtcagaaatgccttccctggggacccagagagcccacagggcttttcctgctgcttcttcgacccctgtattttgcttggctctctaaattgtctcagctccaggaaataagctgttacctaaattcaactatttggaacaggtaccaacccaacagagaaaattgcattctatatagaacactggtgtattcagtttgctacagcttaaaaagtcttggtgtggaagagccaagttcaaacaatctgatcacagaaggatcagagaaaggaggagtgatggaggaagactgcgagggcctttatattggtgattactgggaaagtacgggaaatcctgttagctttcgctcttcatgtccaatggtgaaatgtactgatttctagggttctcttgtaaggtactacggtagagaattccatctagatgctatttttcttgtgttaaaagagcattccaaaatttatcagcctttaccggattcaatcaggtactccagtcaatagtaggtttggtctttttacatagtcctgtatttgtcagaggttttatttgttccttttcattctttttttctcttatcttgtcttcctgccttatatcagtaagatgttattcaaactgatattctttcttctgcttgatcaattcagctattgatacttgtgtatgtttcacgaagttcttgtgctgtgtttttcagcattatcaggtcatttaggctcctctctaagctggttattctaattagcagttcctaggcctgaaacattgctagtagtttgagagttttttctgactttgttctttttatataactgacacatttaacttttcactgaagctgttatcaatgctaagaactaactagagttcaataaatttgaggtaagtttatggtattccttttgtagttacatagactttgctctgtaacttggtagttgtgtgattatgcaaaagttactaagcctcttaaacgctcagttttattgtttcttaagtggcaataaaactaatttgcagtgttgatgtgaatactgcaaatttataatttatgtaaactgactcttgcatatattcttctttatttttctgtatttaatgtgagatcttacaggctatttaggagtattttctcaactatataaaatatgttgaatccttacatttagtgactatgagagaaaaaaatatggatattttatgaaaggacttaaaaagtttgtggaaaaatgaaatcaaaagttaaaaatagaaaattatacatatacctaatgttaaatgacgagttactgggtgtagcacaccaacatggcacatgtatacatatgtaactaacctacacattgtgcacatgtaccctaaaacttaaagtacaataaaaagaaaagaaaattaaactttatttctcaacacaatctccatcaagttgaagacacttttgtaagtgatgataccagccattttatccctaaagaactgaggatcctggaatttaaccatgtcaatgcagtattttaaaaatattaactgaagaaatatggatgccctttaaatattttttaagattagaaaacaaaaagaagtcagaagaggctaaatcagaactgtaagctgaatgcctaatgatttttcattgaaattgtggcaaaattgcccttgttcaatgagaggaatgaacaggaatgttgtcatgattgaggactgtctggtaaagattttctgagtatctttctgtttaaagctttagctaacttttctaaaacgttttaataaaaagaagatgttattattctttggctctccacacagtcaacaagcaaaataccttgagcatccccaaaatccgttgccatgatcttttctcttgactaatccacttttgcttttagtggaccatttctacctcttggtagccattgctttgattgtgctttgtcctcaggataatactggaaaagccatgctttatcttctgttatgattctctgaagaaacactttattgatcgtccttgtttaaaatttccactgaaacctctgctgttgtcagcagctgatctggggtgtaaaggttttggcacatattgagtggaaagtttgcttaatgttaatgttttagtcagaattgtgtaagct

SEQ ID NO: 475488 - DNA, 587 bp, Homo sapiens
ttggtgttttgagttaggatggccggactccaaggaaagatcatcttctcacttgatcccctttctagctctgcatccatcctgctgagaaccacctccatcactcagcccaaatgttgccttttgacctgccacgcgccctatcctctacccataaaaaccccaaacccaatgttccataagcagatgagcagaagagcatcagagccacatggcagagaaggagagaagagaaggagcatccaaacatggagaggagttcgcctggggatggttggagaggagattggctgtgggatggccaaactccaggggaagatcatcttcccactccatattctttccaatttctcatccatcccgctgagagccactctctaccactcaataaaatccccacattcaccactcatcaagtctgtttgacctgattcttcctggacagtgggcaaggacccagagtaagagtttgatatgaaagtacaattcagggaagtggccactttttattttctaattattaagtaaaataagatctactcctatccgtcttgggtatgtctttatcagcagcatgaaaatggact

SEQ ID NO: 475489 - DNA, 794 bp, Homo sapiens
ggcctcacccacgtcctgctgattgggtgtggcatttcacttaaggccagaagaggaaaagtggcttagcatggataggctcagtgtgtgggatggaagccatggaggaacagcactacaagtcagactgcaccctgggaagcttgccaaaggcaacactggtggctatggaacgtgcaagggtgaggtgctggtggaggtggagctggctggctcgttgtctgccaaggctccatgtgcaatggtggggctgccccactggtgctctccactgatcaggcagtctgccagtgcagaagctacagtgcaggcccccagggcacctaagactaccctacaagcatgcatggccagactggggccacaggagaggccagcagtccaaggggtgctcaggtcagaccagtcccgtctgacaggcaagaccaccctacagagttcagatccaacagttccgctaggatcaaagtctcctatgggagcaaattgagcctagggcaatagctcagtggaagaaataatagaatgtttataagcttgcttattggaaaaattggtgtgtatgtgagtgagtgtgtgtgtgtgtgagagagagagagagagagagagagagagagagagagagaggaatggttattcctacaaagcaaatagagccagagaagtaaatgctatttccaacactatacatattcccctaacataatcaagtaagccagtacccaaccatgaaagttatattgatttggacagttttttaaacagtaagttaaaaaaaaaagtagtgtcttccc

SEQ ID NO: 475490 - DNA, 690 bp, Homo sapiens
ctgaattagtgtcattagtactctactgcaatcttgcgatgcattctgtgaactactatgggagaaaatgttctgagttgcaaatctatgagaggagtcttagaaaaggtggaggaaggagggagaaggagggtaagaaaacgaggagagaaaggtgaaacaggagaaagggagactggcaggataggaaagtttattgtcgaagaggtcttttccccacttagacttgaagtactacagggcacgtccatcagctgtgctgaaaaggctgtaatcaaggaggaccttcagggtgaatggactgctccagctggtgagttcactgcttcccagctcaaggtagcagatgaatctgaaggcttgtactatgtcccctacccctaccagggagagcaaaagttagccaatgaagacaacagctttagatcctttatcagccttgcgatgataccagagaaattcatattaccaagctttactaactaacttttatctgccattcgtttgccttcccttcaatttgctgcctgtaaagactccaagcccttttcctttgttttctcacttctctaaaaatgtactgttctttgctgaagatgctgtataagctggaatttaaatcagctcttagagaactgctcattctcgactatctcttgtgtttacatgagatatacatgttaataaact

SEQ ID NO: 475491 - DNA, 1644 bp, Homo sapiens
ccaacatttccctgtctgaaaatcacagagatgtcagtagtaagatttgaccaagaggagtcagaagctggcccaagggaaatgaaaactctgaaatctagaggaaagcaaggcaagaagtggaaggagcagacaggcatcaagcccaccaaggcaaattgtagaattgttattggaagcatttgtattgggcatgctaatgctagaggtagcccttcacttaaaattaaccacctaacagatttccttccgaagaccaaagagacgcagcaagaggaaaacagtcaaagcaaagaagctggctcgggtctgagctgtgtaattccgcccttgaccacccgtgtcattgcagcccacagatccttgaatggtgcttgccagaaatctgcattgaggggagcaacatctgcaagtagcaagagactcgcatttcctttgtgtgtgaacgctgcacagaccttaaaggctaaactggatctaccgcagtgtcctggctgctcccttttcttctgtccaatcttctacccatggaacttgggaaactctattgtcactttcttccgaggaggatgcagccctcaccagacaactgaacctgctggcaccttgatcttgaacttggcagcctccagaacagtgagaaaataagttgctgttctttacaaattacccagtctgtagtattttattatagcaaccaaaacagactaagacatctgtgcagtcagggtcatcacaagatgtttctgttgaaaatttcttttgttgtaaaatatccctgggaccattgggcgagaactgaaaataaaggtaggaaattataattcatttcatatactattgagaatgttagcaagtgtatcctgactttgtaaggcagttctgcatatttttagatcaaacattaatctgaaattatggaatgatttctcacaaaagatactaagtcaacattcatagcacattaaaaaaataaaaatggaagcttgaatgttagtgacttctgaaatggcagcaaatggatcttcagtttactccttggttatagacaacttagggccatacttcttcatatgctgaatgtagtttgtgtatattgactcaaactatcattggtttctttcactaataagtaggtaatattactaatattggcagtcaaaacctaggtgattgaagcgtttacatcatagctcaataatcttaggaaacctcattatattacatatcaaattaaaagttttgttattttcaacttgaatttataacttaaaggtatttaagatattaatacattgccaaggtacgtcactggattaagccaactgaaattgtggaaatgatacttaccagaatgaccatgatcatgaaagaatgttttcattatttactactcatttcaaacaatttttgtgagtaccattctgattgattggctgcttccatacttcaggatggatgtacagtctttgttgttggtttttgttttgcataatccctaaaaagcatatattaaatggttttggttttatcctcttcttaatctcaccaatgtgttcagtactaaaatgtacattagaaggcatacattgttgagtaaaacaaataaaacaagagtaaggacttgtaatagtctgttcttgc

SEQ ID NO: 475492 - DNA, 654 bp, Homo sapiens
aggggtggaatgatatggtttggctgtgtccccacccaaatctcatcttgaattcccatgtgttgtgggagggacctgctgggagtcagaccatccaagctgtcaggggttccctgagtagttgtttaaaggtcttttcattctccaagagagtctcctatatcacttgttccccttttgctgcagttgttgagcttttgctttcctctgcattagagagaatttatttctgtctcatgaaaatgaaatctgatgttcgtgatcctgggtatctatgggaaccccatgatatcatcatgcaccttggtgccctccagctcacttccaagccaccatgggagtaccgcccttaccgacatagttcagaatggctgctccagctccagcttctacacctgcactccaggaagcaggagaaaggaaaaggtggagaaatgtgtggacagattcacaaacagtgtctagaacacatggtggcctcccagtgttaacaagaaatgtctgaatcgcttgtaaacatcatcaaataatgtgaagatttgtcattttgattgctggttcttaagactgtggttaaaataatcttgttgactatggacctgctagattggaaggtgagatgctgtgacctgaccttatttgctgttgtgtcac

SEQ ID NO: 475493 - DNA, 1566 bp, Homo sapiens
gctcacctctggaagctctgcaaacaaagcggctgaaaagctcaactgggtggagcccaccgcggctcaaggaggcctgcctgcctctgtagaatccacctctgggagcagggcatagctgaacaaaagacagcagaaacttctgcagacttaaatgtccctgtctgacaactttgaagagagtagttgttctcccagcatggaggttgagatctgagaactgacagactgcctcctcaagtgggtccctgacccccgagtagcctaagaggcacctcccagtaggggccgactgacacctcatacagccgggtgcccctctgagatgaagcttccagaggaaggatcaggcagcaacatttgccattctgcaatatttgctgttctgcagcctctgctggtgatacccaggcaaagagggtctggagtggacctccagcaaactccaacagacctgcagctgaaggacctgttagaaggaaaactaacaaacagaaaagacttccacaccaaaaccccatctgtatgtcactatcatcaaagaccaaaggtagataaaaccacaaagatggggagaaaccagagcagaaaagctgaaaattctaaaattcagagcgccttttctcttccaaaggaatgcagctcctcgccagcgatggaacgaagctggctggagaatgactttgacgagttgagagaagaaggcttcagacgattggtaataacaaacttctccaagctaaaggaggatgttcaaacccatcgcaaagaagctaaaaaccttgaaaaaggattggacaaatggctaactagaataaacagcatagagaagaccttaaatgacctgatggagctgaaaaccatggcacgagaactatgtgatgcatgcacaagcttcagtagccaattcgatcaactggaagaaagggtatcagtgattgaagatcaaatgaatgaaatgaagcgagaagagaagtttagagaaaaaagactaaaaagaacaaagcctccaagaaatatgggactatgtgaaaagaccaagtctatgtcaattggtctgcctgaaagtgatggggagaatggaaccaagtttgaaaacactcttcagggtattatccaggagaacttccccaacctagcaaggcaggccaacattcaaattcaggaaatacagagaatgacacaaagatactcctcgagaagagcaacaccaagatacataattgtcagattcaccaaagttgaaatgaaggaaataatgttaagggcagccagagagaaaggtcgggttacccacaaagggaagcccatcagactaactaataagagagtttctggatctctcggcagaaactctacaagccagaagagagtgggggccaatattcaacattctcaaagaaaataattttcaaaccagaatttcatatccagccaaactaagcttcataagtgaaggagaaataaaatcctttacagacgagcaaatgctgagagattttgtcatcaccaggcctgccttacaagaactcctgaaagaagcactaaacatggaaatgaacaacc

SEQ ID NO: 475494 - DNA, 542 bp, Homo sapiens
tttcagattgatgtgtctacaagacaaagaatgccaaggactgcaggctgccaacagatgtagctcgtttactcagcccacagctctcaacccctcacaggagcaggagcacacgggtgagcagcatccaggaagaatcaggtcacatgaaccaattgaagatagtaaatgtggggattttattgccaatgaaagtggctctcagcaggatggagagctggaaaggagatggagtgggaagggtaaatctagtgttttaatacaggaatgtgtagcatcagaggagtggaagacacaagctggccctgacaagcactcaagcaattctgaagctttagaaatttactccaaaagcaatgagagtggccaagtctgtatgggttgcaggccaactgagtatctgggagttcaaattaacttccaagtagaatggattttttattaaagaatatggaatgtaaatgtgccaatttgaagcttacatatgtattttaaaaattcaacaattgcagcaaatgtttagatctgacaccaacaacacc

SEQ ID NO: 475495 - DNA, 584 bp, Homo sapiens
gtccatctggatgcccaggggatggtagggggaggtagaaagtgccttttttctttaataggacatggcatcagcaaagcatactctgtgatactcagttcacctatgggctggtccagagggtccaagatagctttcctcttggcaggcatggctgagggtttggctttgctggcacatttgatggcagaactacatgtgcctgtccggcaggatagccttagggccccaagtcagatatcctggctggtggctcagggttgcgggagattgtaccagggaattggaaagccaatcactgagacagtgccaaggaagaaggcttttttgggtgctgcagccaaggagaatgaaaggtctggctcaagatcatcacctcaaccaagtaaaattaggctttcttatagcaggaaaaaaaatgtaactatgtgtggaaaacaggaatttgggaaagggttgtcttggctattcaggctcttttttggttccatatgaattttaaaatagtctttctaattctgtgaaaaatatcaatggtagtttaatgagaatagcattgaatctataaattacttttggcagta

SEQ ID NO: 475496 - DNA, 764 bp, Homo sapiens
gaactgggagtccattaaacttctttgatttatagacgacccagtttcagagatctgtggaatgataaatggaaaattggacactaaagtatacaagtcaaaaaatacaaaaatgtcccttctctgagacaagttttgaagcagttgtagcatcattactgtcagttatagtaattctgcatgtttttatctcttcatccaggtcagtggttgtcaaaggcgacaatgcatcggtattgtctgaagaaattttcaaatacctgctcctttctaggatccagacacaggataaggttcagaggctatgtgtgcaggtttgtaacatgggtaaattatgtgtcgctgaggtttggtgtacaaatgattctgtcacccagatactgagcatagtccctgatagtaatagccattctgactggtgtgggtatctcactctgattagtgatcatgagcacatgtccatgtttgttggctactcctatgtcttcttttgaaaaatgtctcttcatctcctttgtccatttttaaatgaggttatttgttttttgctgttgatttaagttccttatagattctggatattaaatcttttttcagatgcattgtttgtgaattgatatggttgaatctgtgtcccttcccaaatttcatgtcaaattgtaatccccaatactggaggagggggtctggtgggaactaatttgatcatgggggcggtttctcatgaacggtttagtactatcccttggtggtgttcttgtgtt

SEQ ID NO: 475497 - DNA, 649 bp, Homo sapiens
agttactaagtgacccatttacatggtggagaatgttgattctgtgagaaggtcaaatcaatcagggttggtggtggtggttagagacccaggcctacagagacacgaccattttgtgacattggcatctcaaaaaatggatcactgtagcagaggaagagaacatggacaacccacacccactccagaagtggcacacttcattcccacacaggactcattgtccagaataggcacctacgtcctgctaaccgcaaggggactgggacatgttgagaaacacacgcatattgctgtcagttttctagcatgcgtggcaaaacccaaaatgtcttctgggcttggctggatttctgatggattgggttaccccaaagaggagccaaggaagcacttggaactagtgataactgtcagaacagatgaaagcaagaagtaactttaagctttgtttaaagatttagtgtttctgtttctttgttgacatgaaatatcatatgaaatactgaaagtcagaaatcaaatttgtgtgtttgaaatttagtaaaaagtaaagtgaactttgtccaaatgccattcgaatataaaataatttaactgtaactcacactgcccacattaagattaacttgggacacaggaattagtt

SEQ ID NO: 475498 - DNA, 860 bp, Homo sapiens
tcctacgtgcccatgctgcaatatggaaaaggaattcctaacatctgggggaacctccgttaaataccacaaggaaatcatgaagctgttgcatgcagtgcaaaaacccaaggagctggcagtcttacactgccaaagccatcaaaaaggtgaagaagaaaaggcagaaggaaaccatcgggcagatgctgaggccaaaattgctgccaggcagaacctcccatcggaaatacctacggaaggacccttggacaggaagatagatggttcctctcaggcaattaagggaaaaagacacaatgggtattcagatggaggccatcaagctacagatggtcttacaaatggaaccccaaatgagctcaactcaaaacttctactgaggacccctggatctttgactggcctagagagttcccctctggaggacactaccactgcagggccccttcttcgcccctatccagcagaagtagctagagtggtcattgcccaattcccaacagtagttggggtgtcatgtttagaggggggattgagaggtgaagccagctggacttctgggtcaggagggggacttgaagaacttttctgtagctagctagaggtttgtaaaatggaccaatcagcaccctgtaaaatggaccaatcagtgctctgtaaaatggaccaatcagcaggacatggatggggacaaataagggaataaaagctggccgccccagtcagcagcggcaacctgcttgggtcccctttcacgctgtggaagctttgttctttggctcttcacaataaatctgctcactctggatctgtgcaacctttaagagctgtaatgctcaccgcaaagatttaaggag

SEQ ID NO: 475499 - DNA, 573 bp, Homo sapiens
tacccttctccccagttcctgccacagtctgagcccaggtagttaccttagctatgtactcactatggtagtcagggttctccagagaaacagaacgaataggacaaatgctttggaagctctgtccccatgggaagggtcatacactagagcctttggggctgaggagcctctaagacatggcttctttggagtctctgtcttgtttgttttctcttggatccaccctaagcatgaccaccactggactacgatagaatttgaagagcccagtatatgtgagaggtcatttgcaacaaatgaaaatgggggccaaagggcaaggtttagttgtcagagtggtatctggtggcagcaaccctgccaggtcccctgggagcccaggtctgcccagcacaagttcctcagccatccttgctgctttgccttctgccaggctgggaagaggaaggggatggttactgtgccgtgaagagaaaggcaagtgggcattggccatagcctgtgcttaagaggcagtcgcacctatcgagtattcctgcccaaaatgcttaacctgaatcaaattgtgac

SEQ ID NO: 475500 - DNA, 793 bp, Homo sapiens
cggccagacatctttcaaagtccagatacgtatatctactctatttgaacagtgtctgttttcctccttgcatgttggctgatgcaggccccagccacaggcctggacaacagaagcaaaactctgtctcaaacaaacaaacaaacgaacaaacaaaaaacagcaaaagcggagggtgctagaagtagggggcctagaaacaaaattcccggggctccctccggggccgcggtctgggctgcgcatttggctgccgcgctcctcgcgaaggcagtggcttccaaactcctgcgcgcggtcatcctcagacccccctgctcgggcaagggcaccgagtgccagagcatcgcccagaactttggcttccaggatttctccagtgggcacttcttgtgggagaacatcaaggccaaaaccgaagttggtgagatggcaaaacagtatatagagaaaagtcttttgcttccagaccatgtgatcacacgcctaatgatgtctgagttggagaatagccgtggccagcactggctcctcgatggttttcctaggacattacgacaagccgaagccctggacaaaaatctgtgaactggatttacttcttcacagatgtgtaccaggtatccattaggggctcaataaatgttgaattaatgaatgtgtgaataaacaaaaaatcactaatcagtaaggtttttttgaatgcttatttttgaaaacgcactttaagagtaaattttttttttaaatagaaagaataagatctagtacttgatagtacaacagggtcact

SEQ ID NO: 475501 - DNA, 808 bp, Homo sapiens
ggggacagcagcagacatgaaaaggcctccgaggccaagtgtgaggatgccgggtcccagcactgaggtgtcctgcagctggacctgtcaggtgtccacccacccctggcagctgcatgtcctttgacggcctataggctgagcagcttctctgggccccgtgggggtgtgtcccacagcagggagcgactctggccccccatcacatgcctgtgacccagagaacggcaggtgagccttgcggcctcactgttgccactggtcaggtgctgatgaggacgggaagccaaatggggctgttcagccctaggcagagctgcttggagcacattcttaatacgccagccatcgctacctcagttccacagccgatattagggaagaaagatgcggggacacggcaacaggacagcgtgctgggcagaaaagatgtggacaggagcccatgcctggcagagacacggaggaccagagaggatggcgtcgcagagcagagggccgcagagaagggagtcactggtgtctgcagtggagaggacacacccctctggcaagggcaggggctgaggccctgggtgtggctttcagacgcagtgggcaatgagctctgtaaagccgagatggctccaagcagaccacaaggagcctggtcagcttctgtccctgcaactgttttccccactgccggaagtggcttcacttgtgtggatgtcctgcactcagcccaggactagatggattcacagccagattctaccaaacatatgaagaactaataccaatccttctgaaactattccaagaaatc

SEQ ID NO: 475502 - DNA, 926 bp, Homo sapiens
ctcctccttgctttctgccatgactgtgaggcctccctagccatgtctcagctatttggacagtctgctgttctttggacaatcactgcaacatgtgcagcttctcaaattaccccccatggcaactgcggccagcaggatgtggcttcctatgagccaaactgcaatgattgtaatttctcttctgaatctggccatccagcagaactaccaggctccaagctggcactggcaggagaaatctgcttccttcaaagagtctgtgaattctcttggctttcctggtatgttcctgtggtagttcctggagcagaagttcaggatgtgagtctccacacactgctgtgcttctttagattttcttcaatgaggtttaagcgaagggaaacttttgataaagtaaccatgtgtcaacatttgtattttaaagtgattgctgacctttgtttatggtagaagtggtaaaaattctgtactgtatattaccagcaggtagtagaagcaaatgtgagaacaaacttcagtgacatcgacatcataatttataaaaatatgagagttgagcatgtcagatattctccaactgtaccctttcacattccactcacatgtggccattgcctcataactgagaaatggtctttcattaaatcaccattgtcattgcaatctattgtaaaataaattaatttaacatctatttatttctatttcatcaatatcactagaggaattttccccacagaaagagtcactcaattgttgcaaattattatctctgtatttgcatatttatttttggaaatatgttttattgtggaatggaacaatacaatttctcttattgaattgccttattgaagatgaaaattttctaataaaactctaaaactctagtcattactgtgttgtattctgatatgtct

SEQ ID NO: 475503 - DNA, 940 bp, Homo sapiens
gggtggccataagtgggcctggacaaaccaccattttctgggttatatgtgcggaatgttccggtttgttacgcgagagctgccggaggcaagggtctccgatgccgtttcttgttctcatcatgtagacaaaacagccctgctgcaaagatggtcaacgtacctaaaaccggaagaaccttctggaaagtggcactatgatcggaagcagagtggctatggtgggcagacaaagccaattttctggaagaaggctaagaccacaaagaagattgtgctaaggctggacaatgttatcttcacagattctcttcaaagatatttgcatgaagaacagcctggggagatagagctagtgtctccctcaggagcaataagcaggtttgtttcctgtccagtaatacgtgtgtgtgtgcgtgcgtgcgtgtgtgtgcatgcacgcgcgtgtcttggtttttcaaaataccagttacttttggaagcttatcttttgccatgatttaacaaaacaacctttactgccttcctctcagaggtcaaactcaacaaacataatgtttatcttctctgttttcccagagactgatgatctctctgggagacagagaatgagagagagagggagacagagaaggggggagagagagagagagagagaatacatgtgtcatagggaaatagagagagtgccttccacttgcgtctttagctccttacttgtgtaagccgttgagcaggcgtctgttagctccttaccatgctcattagattgtggagattccaatgaatattgttcaagattagctgaaattctaaatattggaattccaatgtatattctgttacatcaactgtttctccaaatttgttgataatttagcagttttaagtggagctgtctgtaagttcactcagtgaacactaatcaagtgcttatgtg

SEQ ID NO: 475504 - DNA, 1092 bp, Homo sapiens
ataggttctcacaatgctagaatggctatgtcaacttggctcttacctggaggctccgggggaataaatctcttccaaagtcattcaaattcagaaaatttgcaggctgatgatgtgatatacaagaaaaactcattttctgaggagaaattcaagcctgctgcagaaatttgcataagtaatgaggaggtaaacattagtcaccaagacaatgggaaaaatgtctccagggcatgtcagagatctttccagcagtctctctcatcaaaagactggaggcctaggaggaaaaaatggttttgtgagctgggaccaccaccccccctgctccatgcaacctgggacttggtgccctgcaacccagccgctctaaatgtggctaaaagggaccaagatcctggtggcactgctgaggaacaccaggaattaagctgaaaataccaccaagacttgtcttaagtaagataactaaatgtcactaatgcttacgactatttgtaatgttttcatctgaaagcactagtgattgacactgtgtatcatgaaagggtcttcagcaggaacagtcaagttcgggaagtggttttggaaaatggtgagcaagagctggtaagcaggaaattaggtgtacctcataacactggaaaatatataggaaaagaaaagaattattttgaactctggaaaactgtcagtaaaagggaacagatatcgaccatgattgaggttgaatatggcatattttgaagaggtcgttaactgaaatgttgtaagttatttgaaaagaacagcatctaaaactaacgtatattaatagtatatcacatttgaattaaaaaaaatttagcattagtccatatctaaaatttttaatggtgaatgatttaatcaaatggtcttgtgttttaaagtgaactgcttaaaagttaaataactttctagatttagtttgattagtttattttttacagttattatttagaataatttaaatataatactttgaccttgtgttcacaattcatcctgaaagtttaaatagattcagctactcatctgatcatctacttaataagtactgcattttcactt

SEQ ID NO: 475505 - DNA, 1145 bp, Homo sapiens
ggcggttttgtggaatacaaaggggggaaaggagggttgctgaccacctttgaatctttccagggctgtgatacatttatgaaaaacatacaaacccgcggggacattagaagcaaagattataaggaagtgaagagatcaggcaagtcaatttctggggaggagcaagtagaggaagtaaccagagccaatgccactggcaggggtgaacctaggtgctttgtgaacagcaaagggcccagtgtggctgcagcaggtgaacaagggaaaactaaaaacaatgcaaccatttgtctcttatctgcctatgacctggaagccccctccccacttcaagttgtcctgccttttctgaaggaatcaatgttcatcttgaacatgttgattgatgtctcacgtctccctaaaatgtataaagccaaactgtgctctgaccgccttgggcacatgtcttcacagtccttgagtccttgggctgtgtcacaggcatgcatcttcaatcttggcaaaataaactgagacctgtctcagatgttcagggttcagagaccattgttaaaagctcttaagttaggtaaaatattatgttgtgtaatgatataagacaatttgcttgaaagacatgttcctcataaagcctgatctattagagatgcagggagagcttaataaaatagagttatactcagggaatgtaatatatctttttgaaaattagaaaggcctacaagaattaaataaatgagaacatataggaacagaatactgtaataaactacagtctgacataaatatctgatttgcattctatgaatattgaatacatataatttattggtatctgaggaatacttacaaaactgatcatgtacttggctataagtaaagccttaaagatttttaaagtacatatttcaaaggctataaccattgccataaattcaaaaaacttagaaataaattataaaaattcaaactacttcaaaataagaaacactttcataataatgtttagcttctgaataaaaaaggaaatacttctgaagttacaatctttaggaaagtcaatgaaaaggagtataccttaataatgaactaatgaaccacttacttgaaaatgtttaaatacctttatattcaacatt

SEQ ID NO: 475506 - DNA, 748 bp, Homo sapiens
ctcctcaagtgccgccaaagtgggagtccaggcagaggaggcgcccagagcgagctagcgagggctgtgaggactgccagcacgctgtcacctctcaccatgaggcaatgtggaaactcttggaagacaatttacttaacagctgcttctgtcaaaacccatcctgcggcttgtttgcctactgtcttgtgggttctaattgttctctgctgctacagctgctgtcccagtcccctgaggtgatagatcatgaaggctctgccctcatgaaagaactaatgctgtttttgcagaagtgggtttatcgtaaaggaatgagttttgatcccttcttctcactctctcatgctgtctttttcttacatcttccaccacgggatgatgcaacaagaaggcccttaccagatgccagcaccttaatattgaacttcccagcctgcagaactatgagaaaaaaatatcttttctttgtaaattacctagtttgtggtattctgttataccaatacaaaattgaccatttcctgagtcaatgaagaagccaggaatatgaagggctgactatacataacagaataaaagacaatctaatcaaaagtagaagaggaataaaaaaagtcagtgaagaaaaaaacctgtgaaaaagcaacattatttataacagacaggaagagaggatgcttcatctaatatagcttcagtaaatcaccctttttaaagcagggatttgatgagttaaattgtttgc

SEQ ID NO: 475507 - DNA, 494 bp, Homo sapiens
gggtgggcctcccgtttctaaagcacccactatggatgcacagcaggacagacccaagtcccaagactgcctgggcctactggcccccctagcatctgctgcagaggtctcctctacagctcccatgtctgggaagaagcacagaccaccaggacccctgttctcctcctcagatccccttcctgccacctcttcccactccggggactcagcccaggacacctcgctgattcctgcccccttcacacctgcaagcagggatgccggcatcagaagaatgtttcgtgctcgagaacaacaggatgctttggtcctgtatcagcaggacgctttttgggtagatcctactgccaccctactatcgggtagatcctactgtcaccctagctatgggcacatgtcagagtcccatgtaataaaggagacaaaaggaaaccaccacaagtataaactaagaaaagtactccaaggtttctaagaatggagctgtataa

SEQ ID NO: 475508 - DNA, 685 bp, Homo sapiens
ggactcatagtggttcctaaaaagaccttttccacgacaagcacagccaccatgctgggaaagaggtaccagaagctccctgtcaacccttctgacctcagtttccccagagttgagccagatgccctgaggtcctttcgctggataaaaaccgtggacctgagttctgatctggcctctggggctggagttcaccccacctttgcggactctgtggctgagagactgaagtacctgtcccaggactgcatccccacgaggctggactccatcatgactctcactcaccagcatttccacatcctgggccttattgaagcagcaggtgtcagttacagaaatgtgtccccaggcaccaccacccccaatacccacccacacccttgtctgccggcccagggccagcaaactcacaccccaacccagcagcatgcccctgcaaactgctgctcatccccccatcatgggttctcagtgggcttcatcatccaaaagaggccccaaggacagggcaaactggagcaagcttgcactggttctcagttcaagtccatgacctcagcctgagtccatgaccagtcctgctctgacctgtctcagacctatcccatgctgatccctgtgcatgggggcttggcagagagcacagacagaaaccctgagaatctctgaatccccacttcct

SEQ ID NO: 475509 - DNA, 2758 bp, Homo sapiens
agtgacatgatctcatttaggtttttcaaagatgagcctggctgctgtggtggagtgggaagcagggagacaagagtaggagtggggtgaccagtgaggcacctgccatggcagggcaggtagctgggggcagctgcagagcagccagtcacccatggactctgcatttgtcgttaaaacagagctggaaggagctgctgacagggaattttgctgtgaatggaagagaaaaggtgcgatatttggcggtaaaaatggactcaagtaagagtctatcatggctggagctagtgcccatgtggttcacagctgtggtccaaaaggaacatccaggccacaggacagtcattttcttctctgttctgagcagcatcctgggccagatcagggcaggaggtgaagggagggtctgtgaaaacttccaggacattcgggattttcctgctctagagtccagaggacacaggaaggccatatgggagcagaggctgggatggaggttgctgaaggggaatggggtgaggggccaatgacctgaggagtggagattacaggggtcagactattgccaggggtttacaggatacccctgaggagccccctcacctccattcccagagcagccaactcctgagccccatccagcctgtcttctctgcagcggtgggaaatgcatttagagaaaaacaaaccctctgattttgaaaacctgattattacgtatgtcttaatttgcattcctttttaaaaatataacttcatttttctttctgactataaatgtgatatatgttcattatagaaagtttggagaactcagaaaagcaccaaaaagagtacaaaaaccaccctcgatccagctcagaggtcattatttacttctgacacatcagtctgtgtctttcctgcctcccttccaatcacatcttctttttgttaattggagccataccttccattccagtttataaatttcataatggaatgtaggctccatgagaacaggggttttatcttctttgttcactgctgtttcctagtacatagtaggtactcaataaatatttgttggaagaatggattttgtaacccattttaatttaatgcagtgcagccatcttctggcattatttcccattctcatatgccattatttttactggctacatagtatttgtcctatgggcaatgtgggagggggcgtcactctgatttccctaattatcttcccatgacctgcttccccttctccagcaccccagccctcactgaaccaagagacaccggaaatggcttcttcttataatagatttttccttgttacaaaaatgtttattcattgtagaaaatttggaaaatacagataaatttaaagaagaaaaaagccttattatctcatcactcactgataactactattaacctttcttctattttttccgtgaatatataactgcttctaaacatcatttgaataatgctgactatactgttttataacctgcatttttcaattggccgcatgccatgaacatctctctgtgtcattgtgcagtctcctgcatcatcgtttttgtgggtagcaaagcatatgccatcctatagatatccaaaaatgtttccaaccttgtgattgggcattagggtagcttccaacttggcactaccgtaaataatattgcaatgacaatccttttgaacaaataattcctgattcccacccccctcaccacatacacacactttgtattaattcctgagcaacccaccattgatagtccaaaggtaagaattttttgaggtttatattactccttaccaaacacccccaccccccagaaagggctctcaggatgtcagaccctcagatacacagtttcttaacatctctatcctgcttttattgtttaaaatcatctggcctggttggtgggcttgagttgcttaggtggccactggggaaaagggtctggattcttagtgaagagaaaagtgattggggtgggtgagggggttccagatggatgagatggggcttatggaatgctggtcatctctcctatcacagggatcagcaccctgcgatgccaccatagtctctggaggagggagacaaaacatacaggcaacagcttcacatttcgcctgggtgggcagttcggctgagaaggacagcatttctttcttgaattgcctgtctatggcttttgctcttttgtctttttcttattgatttggattacatgtcataccctctgttgcctgtggcataaatatttttgcaagttatctattgattctttagatttttgtaatggtgttttttaacaactaaacatttaaaatttgcatgtattcagaccttcaaatctaccagtcttttcctttgtggtttctgccttctctgttgtgcataaaaagaccttccccatccccagatggtgtaaacattaatctatattttcttcaagttggattcattttcagtctttaaaatgtagtttgtttcccattcaattctgacctcgtgtgagtgggagacatatgcacaggcatcccctcaggaacctggaggtgccagtgctaactcccagccagttgacgattgctaacttccagcccagtggactcaggacaacttctaagagctctatctttgcctttccatagctctggggaaatcccagaagcccttcagttatttaattggcatttttttttaaaacgaatctcattggttttgtctgtctggttggat

SEQ ID NO: 475510 - DNA, 1566 bp, Homo sapiens
cctggagccctgcagtagctgactgtgaaccgggtttcctgacacttctctgttggattccagtgttctctcttggatgatctatttgaagtgtgattatccagtcactattttggttcttcttagtggaggagaagaagacaggaagatgtgggaaggtttggaacttcgtagagacttgttgaatagctttgaccaaaatgctggtagtgatatggacaatgaagtccaggctcagatggtctcacatggaaataaggaacttgttgggaactggaataaagggcatgtcagagatcttcacaggcctggaggcctaggaggaaaccatggtttttatgggccggccccgggcctttctgctttctgcatttttgggacttggtgccctgcatgccagctgtggcttaaagggaccaatgtacagctcaggccattgcttcagaggattcaagccccaagtattggtgacttgcaggtggtattagacctgtggttgcacagaagtcaggcagtgcagaagggaaatatagggtcagagcccccacacagagtccccactggggcactgcctagtggagctgtgagaagatggccacggtcctccagtccccagaatgatcgattcaccaacagcttgcactgtgcacctggaaaagctgaaaacactaaacgccagcctgtgaaagtaacaagcaactatccttcaaatggttcatgtggtggtcccctgataaaagatgtgaacaacagggaaggccgcaggagggctgaatctgggaatgtgcataagaacaagaaaaatttcccgaatgtcttaagaaaccttctcctcatgtctccttgcattgggctaagcctcgtgtccattcttgagccaattcctcttccacaaaatgggaaacagcattctgccatatctggaataatggatgtaaaggaccggcgacaccgctctttgaccagaggacgctgtggcaaagagtgtcgctacacaagctcctctctggacagtgaggactgccgcgtgcccacacagaaatcctacagctccagtgagactctgaaggcctatgaccatgacagcaggatgcactatggaaaccgagtcacagacctcatccaccgggagtcagatgagtttcctagacaagtattcttatttaaaacccaagacactgatcataaaacaaacacacttctcacatacaaccaagttttgcaaacacagttggatgactctacagatgctcagggtggaaaagaattgccagccagcaaaagtgatgggggcccagagtcagaccttgtccagttaccccagctggcccattcaagtatcaaatgcaagaacctgccatctcccagcaggagaaatgagccaggtgttcccatgagaagtttacggaagctcggtcaaattgtgcccatctttgcttgctttcaacacagaatcctcctctgccttcttctattgtggcttcttctcttgagtatgcaaatcacctgtctggcctctattatgctggatcctcctggtgtgaaagaagaaaattgctgaccttc

SEQ ID NO: 475511 - DNA, 1065 bp, Homo sapiens
atcactaaaaaaatatattcgtcagcataaagacaggcgaatgggctgcatgttgctatgcagacgacacagtttggaagggccttctgtttgcttatggattcgctctcccttgaagaaaaactattaactcatgctgcagcctgctgctctctgcttggtgttggctatgtcaccgagcccaaaatagaaagttcttttactgcagagagggaaggaggtttaaatttatcaattcaaataacaaagggtagaattatactggcttttctcgggtggggagtagggggagataatgcctatttcattaggagaaaaagtgatctgacattggcaggggctgggaccagaagacaagcttgcactgtggtgattgggcttgtttcccatcctggcccccctcactccctccttccaacagtgtcacctctttcaggacatgggaaagcatctgagccactgggtaatcagttccagaaatatcactgaaattatcagactgggaacgattctctgaaccaaatcccttctcgctcagcttctgaaacagtcagtaccttaccacaaagttaaacagcagggagatgttatctttctcctatgaaatggtcaaaaatcttttaaagattcccagtgttggaaggagtttggggcaatgggcattctcctgcattgctggaggagaggcaaactgatctaaccacctggaaagcaacttgacaacatagatcccaaaccatggaaacatcaataccagaggatatggatccagaggctctctcatccatggctgggggaagcgtcaattgattttctagagaaatgcttgcacggatgagaaaaccaagactcagaaaagttaggtaacttgccaaagttcacacatctaggcggttgcagaaccagaattcaaacccagttccatctgactccagagtcgtttctgacactggtctactttctgtctcagtaagtttagaagtcagggaactggaaggaacaacaacaaaaaaataaacctaacttaatgccaagagaattgctgacaagatatatctcattcct

SEQ ID NO: 475512 - DNA, 464 bp, Homo sapiens
cttggcattttcttggctggatcagacgatggagaagtttgcttttatgtctatggccaacagatccgatttgtggaacactgtcgatcccaatctgaggcgtcattaccaagatggagggcgggattcgaaatacatcatggatttaataatggagatttgtgggatttcatcttgcatgtctcagacccctgaggccaccccatgtccagatgagcatatgtgtgaagacaaggatatatgtccacagcactggggccaggaagctgcagctgcagcccagcttaaagaaagaaaggaggaaaaaaaccctgctggacgttggatgtacagccaaacacctgggttgggaatgcagaaaacaggcatggaatgccaggaacgcagcacctgtggctaagttgtggtctcacagcataactgtcaaagtcattctcatgttgtacaaaatgacaactgtaatc

SEQ ID NO: 475513 - DNA, 1061 bp, Homo sapiens
ggcaccatcgttttatgtctaatttatctattactttgattcttaccaattggtacttttcttccaagttggtacttttaatttctttatttgacagtttttcagaatgttcttgttataacagcaactcaggagcagttgattcagcgagggcttgggcagccttcagcctcactgagcagacgctggcgatgggcgatgagcacctgtgctgtgcaggtggcactgcagagaggcaggtagagttgttggtggcttggagccaagagtgcggcccagattttaagcacataatggaatcatatcaaaagcaaggaggggcagcaggaaccataaatcctggaagtgcaaaatctgtccattgtgaaacttgtgctgaagggaaaccagatgtggatgctagagagagagggcaggagggaaagtgtggtatggggactctgagaacgggcccctgtgtaaggctagatgtcctgctgtgtgttggcggaggcccgaattcaagaggctcagaaccacggaaagcagggcgggtttgctcctggtgtcgtggctgacggtccagtgtccaaggaagaaggcagaggccggagaattaatgttcttgtagctactgtttcagctggactaacagaagtattgtacaagtttttcctgagtttttgtctttgaagatgaaacatttgggggcagttctttaaacatgtatttgagctatcacaaagagactaaatttgtttatcctgtggaggaaaaaaagccactaacacatgtggaaatccatttggattgggatgaaaaacatgattatccaagttgccatccttggcctgaaatggggggtttattttattctgcttcacagagttggtcacataagtgggaagtcaaaaaaccaaccacagaagacactgaagagtgaagggctgaccactgtggggaggaagtgactagggaagttccgactgctgaggtcaccccatccgtgaggccactccatccatgggacaagtaagtcatttaatggctcttgacaccaaggtgttcattcgtgataataa

SEQ ID NO: 475514 - DNA, 532 bp, Homo sapiens
tgtctgtaatcccagcactttgggaggcccagcgcaaacagcaaaatggtctgcatcagattttctgctctcccttgcctaggatgcttggaagtgactcgctgtagctttctgaagggcacgggccagattcaagaacggcaagtctcctatggagagtccagccatggggtgcacagtcaaatcacggtgagccttgtaaactattataaggacttcaggttttttctcaaggtgattggagggctgaaaacaaaggtgtgctatgaattaccttatatttttaaaggctacactggttgttatacggatgatagatgctggagccagggcagaatcagggacctaactaagcagttgaccattagtcctgtagaaaggagtatatggtgcaaagctgatgaaaagtggtcagaaccaggacacactttgaagatagaaacaccaggatttgttgttgagcatgaaagaaacagaggaatcaaggatggcttcaaggatttgaagtaggagcaatgtggatacagaacct

SEQ ID NO: 475515 - DNA, 853 bp, Homo sapiens
gggagcaggaagagatggccctcccttcaggaggatctgaacccctgctggacaccacttcctgtcagccttatctttatgatttttaaatgatccatacccgtgctctactgcaactacatacagtaacaacattgctcaacaatgttgagcaaagccagccagacacaaatgagttcacactgtgtgattccatttatatgaagcttaaaaataggcaaacagaatctctggagtttaaatcaggaaatgggtcagccctggggggtggtgactggaagttgacactggaggtaagagcgcctgtgatgttccctgatcttggtgctggctacatgggcacgaccatcttcaacaaaaccagaacccagagtcacctcctgcctctggcctttgctggacccagcagaggaggctggctggagaaatgcagggcggagaaggaaccaggacagggctctgaggccgccctagagatggcctagatattcatctaaatggagtcataccatatgtgtccttttgtctctggcttagctcactcagcataatgtttgcaaagttcatccatgttgtatcatgtaacagaacttcattcttttttatggctgaataatatttcattgtatatatgcacgctacattttgtttatgcatttatccttctatggacacttgggatgtttccaccctttggctattatggataatgctgctatgagcattagagttcaaatatctacttgagtccccgccttcctttttgtgtttgtgtgtatacctagaagtgaaattgcggggtcatatagtaactctatgtttcactttttgaggaactgccatactgttttct

SEQ ID NO: 475516 - DNA, 2432 bp, Homo sapiens
gtactcagtttgaagacaaggaagatgaagacctttatgatgattcactgccacttcatgaataatagcatttgtggaagtgatgaagtgcatggtccacatcagccatatgacaaccctgaatctcttgacctgaccagccagattgaatatagatcatcatttcagagtaagagtggaaaactgttatggattgaattgtgtcccccagtgtataggctaaagtccttacccccagtacttcagaatgggaccttatttggacacagggtttttacaaagcagttacagaaacgtttattgtctagcaggatagccctggcttttagagcctggcaggcaagctttgatgtggaaatgcagtccattaggaactgggttcacccaaacatggagattcccaccgtgttcttcttgtccttgcctcaacatgtgcctggcaacatggccgcccccacatatccccacttgtgtagaacatcatggtgccctgcttttgcatattaaaaagctaggccttgagggactggctcatgatagatgctaggcttcttttgtctcttgctgcctatctctaaataagaaactcatttcatataacttgtagtatgtgagtatattgctgtatcactgaactcaaatatgtaggtaaatagtatattaacctgcattacagttcaaaatctatcattcaaaaaataaaaatgcacatttgaaagatttctatttgtcccacttattttcagtattagtccattttgcatattagctagttatgaatgtctgtactcaaatatagggaaaaagtaaattttttttcttgatttcaagtaactgagatttcaataaaaggcttttttcatgtcttctttttttccacattttgattctgtgattctattcttatgtaatagattaagtgctgagctagcagttggggaatgtggagtttattgctgtctccatcctttattaattttgtgattttatgcaggacacttaattgcactagaaatgtattttataatctgcaaaatgaaagagaacccataaatcaactccattgaaatctttaaataatctctaatgaatgagtcccctaaatgatatatacatttattttagctataaaatgacacattatttgaataaagaataactattggtttggtttacatgtataataaaatattcctcaaataaagatgtttgaccaatgaaacttgattatagatgccaatttcagaatctgaaataaaatattttattataaaataattagtcataaactaagtctttgagtatatatatgagtatatatattttatatatattttatatactcatatatatgagtatatatgtatatatatttatatataaaaatatatgagtatatatgtaaaatatatatatttcatatatatactttatatacttatatatactcatatatgagtatattttatatattttatatactcatatgtgttatatataaatatatatttatatataatacatatttcatatatactcatatatgctatataacatacatatttatatatataaaatatatatttcatatatactcatatatgctatataacatacatatttatatataatatatatatttcatatatatactttatatacttatatatactcatatatgagtatattttatatattttatatactcatatgtgttatatataaatatatatttatatataaaatacatatttcatataaactcatatatgctatctaacatacatatttatatatataaaatgtatatttcatatatactcacatatgctatataacatacatatttatatatataaaatatatatttcatatatactcaaagacttagtttatgactaattattttataataaaatattttatttcagattctgaaattggtatctataatcaagtttcattggtcaaacatctttatttgaggaatattttattatacatgtaaactaaaccaatagttattctttattcaaataatgttattttataactaaaataaatatatatgtatatgatttaggggactcattcattagagattaaagatttcaatggagttaatttatgagttctctttcattttacagattctaaaatacatttttagtgcaattaagtatatatatatactcatatatctgaaatatgtgtatatatactcattcattagagatgtgtatatatatgtatacatatgtatatgtcacttatcttttatatataatttataaatcaatgattggccttatgtgattggattcccttttagctattttagtgtctatgttctttatagataataatacacattaatatataaattaatatataatattacatatttaatataaaaataaattttgaagaac

SEQ ID NO: 475517 - DNA, 913 bp, Homo sapiens
tctctctctctcgcccacgctggagtgcagtggatgcgtggaaaatcctagatgtctaagcaaaagcttgctgccagggtgaagcccacactgagaacctctactagggcagtgaggagggaaaatgtggtgttggaggctctgtacagagtcccaaccaggacacttcctagtggagctgcgggaagagggccaacatcctccagacccaagaatgttaaatctaccagcagctttcaccctacacctgaaaatgccacagtcactcaactccagcccatgagagcagccttggaggctgcaccctgcaaatcctcagaagcagacctgctcaaggacttgggagcctacctcttgtaccagtgtgccctggacaacacaaacctcgccattgagaaagcaagcagactcaggtttttggcatctcagtatgttcctgtggtagttcttggagcaaaggactcacaaaaatgtgagtcttcacgtgctgctctgtctgaccaaatgggagctgcagactttagtcctgtcttctatccatcatcttaatcttcagtatccaattttagacactccttatgttgtagttatcagagtgcttctatagcgtggaagccttacaaatgcactctcctggacggcagagaagcccagagatgtgaggcagacacttggaaccactttttcgccaaggatttgctctgaggagggtggagatctgagaagctgaacagtcatctgtggttgagaagtaagaaacttaccagcgttttggacaattgcacagagttgatgagaggacataaattggaatttgaggctaacctgggagaaggatcctggattccacaccaaaatttcagttgggcccctgagaggatatgccttaggttaggtgaagagaaaatatgcc

SEQ ID NO: 475518 - DNA, 1456 bp, Homo sapiens
gacatcgcggagatggtttcacccaaatatcactggtgtggaggcagaaaacctactgaactgaaatatgacgttggtggaggagaacggtttgattctttaacagatcttgaagaacattacaagaagaattccatggtggaaaccttgggtacagtactacaactcaagcatccccttaacacgactcatataaatgctgctgaaataaaaagcagagttcgagaactaagcaaattagctgagaccacagacaaactcaaacaaggcttttgggaaaaatttgagacactacaacaacaggagtgcaaacttctctacagccgaaaagagggtcaaaggcaagaaaacaaaaacaaaaatagatataaaaacatcctaccctttgatcatactagggttgtcctacacgacggtgatcccgatgagcctgtttcagattacatcagtgcaaataccatcatgcctgaatttgaaaccaggtgcaacaattcaaagcccaaaacgtgttacattgccacacaaggctgtcagcaaaacacagtgaatgacttttggcagatgaagttccaagaaaactcccgagtgattgtcatgacaacaaaagaagtggatagaggaaagagtaaatgtgtcaaatactggcctgatgagtatgctttaaaagaatatggcgtcatgcgtgttaggaacgtcaaagaaagcgcagctcatgactatacactaagagaacttgaactttcaaagattggaccagggaatatggagagaccggtcgggcaatatcactttcggacctggccggaccatggagtgcccagcgaccccggggtcgtgctggacttcctggaggaggtgtaccataagcaggggagcatcacggatgcagggccggtcgtggtgcactgtagtgctggaattggcctgacagggacgttcattgtgattgatattcttactgacatcgtcagagagaaaggtgttgactgcaacattgacgttcccaaaaccatccagatgatgcggtctcagagaagaaatgatctgggaaaattaagtaacgacatcctagaaaagtgagaacaatctcatttaccgtcatgtatcgagtagtgtataattcattttgatggcttctatttttggccaaatgagaactaagccagtgcctgagactgtcagaagctgactggtctacttttgcattggcattaaagagtcataggaaaagaatcatggatatttatgaactaagataagaggcgtggcttttttattttttttcagtcgatgaccaattatagttcagctgttgactgagaaggttgtggtgggaaaacgtttgccatattttccttgcatttgagtaattgtcttgtacttagaaaaaaggcatctatgaatgaccagtgtttttggttgtcaagtattgctgacaaacttaccctaaaacttt

SEQ ID NO: 475519 - DNA, 528 bp, Homo sapiens
gttttctcctctttagtggttgccatggaacgctaccagtccattgctcagggattggggactgctgttctaatccaagttgggatcaatcagtgcccattaaattcgatgcttttgtttcccttgaataaagggcgttctgattacatatttacaacaaaattttcagaaagttgtttggctagagccaaagagaaagagttcatgtttaatgcaataagcaataaaaacgggctgctggccagatggccaaataagaacagctcaggcctgcagctcccagcgagaccaacgcagaagacgggttatttctgcatttccaacagaggaataggggagccccctcacccaactccacgtacctcagccaagggaagccgggaaggactgtgctatcgggcccagatactatgcttctcccaatttttttgcaatctgcagaccaggagattccctcgtgtgccttcaccaccagggccctgggtttcaagcacaaaactgggtggctgttcaggccgacactgagct

SEQ ID NO: 475520 - DNA, 1363 bp, Homo sapiens
aaactatacactcaagaaaggagagtgtgggtgtattcgagagagagagttgctcattctttcctcccttccttccttccttccttcctctctctccctctctctctttctttctttctttctctctctctctccctctctctctttctttctttctctctctctctccttccccctctctctttctttctctctctctccctctctctctttctttatttctctctctctccctctctctctttctttctttctctctctctccctccctctctctttctttctttctctctctctccctctctctctttctttctttctctctctccctctctctctttctttctttctttctttctctctctctccctctctctctttctttctttttctctctctccctctctctctttctttctttctctctctctctccctctctctctttctttctttctctctctccctctctctctttctttcttttctttctctttctctctctctctctccctctctctctttctttctttctctctctctctctttctttctttctctctctctctcccgctctttctttctttctctctctctccccctccctccctccctccctctctctctctacacgaacctatgaaataccagcaagagctatggaataaaactactgatgcaatgaagagagttgaagagatcaaacagaaacgtcaagctaaatttataatgaacagattgaagaaaaataaggagctacagaaagttcaggagatcaaaaaaagtcaagcaaaacatccatcttatccgagcccctcttgtaggcaaaggaaagcagctgtaagagaaaatggtacagcaattacaacaggatgtggacatggaagacgtttcttaaaaacctcacatttctacaaactgctgcctcgcaggtcaatctcagactgctgcactagcagtgaggaaggctctgtggaagtgggacccaccaagccaggcatgggagagtatttcctggtctactggttgctgagaccatgggagaagtgcagtatttgggcagggagtgtcccgtttttccagaaagccaaaagtgggaatattcgttaagcaactgttgtattgagaatactaaaggtattactgccctcaaccaagaaagacagtaatagaaataaagagagcttgaatagtattgatgcatagaaatgctacagatttttgtgcactgactttgtatcctaagactttactgaagttgtttatcagttctaggagcctttgggcagaatgtttaggattttctaggtatagaatcatatcatctgtgaagagacatagtttgaattattttcttcctattt

SEQ ID NO: 475521 - DNA, 739 bp, Homo sapiens
tttatgatttaccaagattgcacatgagaagactgtggaagatgtttttgtcaatccccagccccgtggctcgtgtgtgtaggcatgagcagactgggtggagcaatccactggcctccagaaggcatgcatgggaactaatggaagtcgggggagtcagatcaaccccaagctcccagataatgcacacaggcactggcaagaaagtgttctcaggtgctgacagcgggcaggctggatctgtttccaggtctcctgatggtgcacctttgtgcatcagcagtgataggcagggaaggctgatatctaggcctcacatccgcagtggtgaaaaggcctgggccttaggccaccaatggtatatgttggtacagtctgtggtacgtgggacgacacttgtgggcactggtagggacagcactggtcagagggggcctgtcctcaggctcactgatgatgcaggcaagcaccagctgtggctggcaagagggagtgtggcagttccctaacctggtcccagagaccatgatggctgaggctatctctgtggctagtaccacagtagtctgcagtgggaatgtgaactactgggatctgtcacttacatattttctgcactggaaggtttctcctggttcacagctggtcccagcctgggaggatgcttcacttccttttacttctctgcctaagaggttccctgacacttccctgctgaattttactgttctgtgttata

SEQ ID NO: 475522 - DNA, 1474 bp, Homo sapiens
tctccttccacactgtggtagctttgttctttcgctctttgcaatgaatcttgctgttgctcactctttgggtccacactgcctttatgcgctcttcactcctgaagccagcgagaccacgaacccaccggaagaaacgaacaactccagaggcatcgccttaacagctgtaacactcactgcgaaggtcagcagcttcactcctgagccagcgagaccacgaacctaccagaaggaagaaactctgaacacatccgaacatcagaaggaacaaactctggacacgccgcctttaagaactgctaacactcaccgcgaggggggtcgacactcagatcccaactcttggactgcatgttctaactctggggaacttatattaggacacgaatttgttctctggctcctcaatgttaagaattcactgcactgggcttggttcaccggcacagatgctatggattgggcccagacagaacttgagactgccctgcaagcaagtgtagccaggctggggccccagaaaaggccagcagaccaaggggtgctcagaacaaagcaaatgaatatcatttcaaaatccagtataaaaccagggcagaaaatatacaacatgagcctggagcatctggtagttccagaacttgaagatatgctcaaaacaaagagcaaacatacagataagcttaagggagaaaagccgacttctctcactagtgtggattggcatcatccaattgaaggcctgaatagaacaaaaggcattagaagagagaatttgccccttctgtctcactgcttgagccaggacattggtattctcctgcccgcacactgggagttacaccatcaaccccctggttctcaggccttcagactcggtctaaactacgccagtggcagtttgcagacagcagatactcagtgccagccagcccctgaaaggagccaggagtgggctatatcctgcaaagccacaggattggagcttcccaaggccatgggaacccacttcttgtatcagcgtggcctgaatgtgagacccggagtcaaagcagatcattttggagctttaagatttgactgccctactggattttggacttgcctgtagttcctttgttttggccaatttctcccatttggaagggctgtgtttacccaatgcctgtactcccattatatctaagaaataactaacttgcttttgattttacaggctcctaggcagaagggacttgccttgtctccaatgaggctatgtatggactgtgaacttttgagttaatgctgaaattagctaagacttttggggactgttgggaaggtatggttggttttgaaatatttttcaaaataaatatatttaatggttaaaaatgtttaatttcttattttttttccaacacttctctttttctggctgcctcattgttttttacaatgactgtgagtctataactatgtcctctga

SEQ ID NO: 475523 - DNA, 1759 bp, Homo sapiens
cccttttctcaggtacttaaagcgtgttgtttaactgagcatcctgtatcatggcaggaggttccacgtgtacaccgttatttatagtcagtgtcctttttcttatcttattgctgttgcaggtcaatccttatggctcctcatttattattgactttactaatatcttcacttcacttctctcatcacttaaaaaatttaaaccagacagcatttttcagttgatacctggaaaacgtatcaatgttgcagtatcagttggaatagaccatgctacatatattgtagcaacacaggcttccatatcagagtgggttgtgacagaacacactgatgacctaaccagtgccataggcctgtgcaagtcagactactctgattactgctttgagtgtgctgcccattatggtaaccacatccacattgacttcagttttcactgtgaggtctggcttacagagaagagtgatcacagagcacttcaaagatgccagggctcccttcacaaatttatttgtcaatcatggtagaattcatggtagaagaggagctaactcaaaaaaaagttatatgagatcttaccttgccctaagatttcaactaactggacaaaataaagttgctgaaaggattaattttttttttcagacagtaagaaggttttcaaatcttccctctgaactcattttaaaactgtctaaaaagcaaagcttggtatattggatttatagaagtctcaggctaacatcaattctgtttctatattaacatatgacaaaaaacaaccctatcttttggttgaatactgaaagggctaaaactcataattttcttcttcttatctgatttctaaatgaattctttacctcacttattctgaaagaacaaaagtataaatagttctatattctattgagtgttctattaaaagcacctttagacaaatccagaagtagatctaaaggttgccctcattcatctctcagagacacagcagatgaaacaactgttttacatccttcagatgtcagcaagcattaatctattttatgccaccctcaagtgattccacatagtttgggaaactgaaatgctttgtattttaaaaaattgagtaatgaaaatagctcaaaattgccatgtttattttgcctaaatgcaaaacatccctctccaagattcaataaatgtcccattttgatgatgtgcaaaattctttaaatttgcagcagtacttgaggaacttgtgctaacaagcagtgaatttatatacataaatcatacctatctcattttttaaaatctaacttttcaggtctttcagactttctcagagttttaaggtatagtcacggaatcatattgtgggtttccatgactatacttgaagtgcttccatacctgttagcatttgataggccagaaacacgagccctagaatgagtgtactttgtgatgtttattatgttatcagagatgagtgttctaacacccaaggcttcttcacattcccaatatgtgaaagtgtgtttgcaaccacagagaaaagcactcaatgcagacttgattttatatattttgctttcagtttcacaatgatttctttaggcatagagctcttttttttacctatactgtttgagatttgtggagcttcacgaatctatggatctgtatctttaaacacttcaggacaatttttagtaatgatattgtaaacactgcctgtgccttattcttccctcctcttatcttcttc

SEQ ID NO: 475524 - DNA, 468 bp, Homo sapiens
gtgagctgattgctcatctgagaaaggtgctctaacactgaaatgccaggaagagaaagaggaaaactaaaaataagtgacagtgaaggaggagaatcacgtgagtgggatgttccagaagccgaggaaaagtgttctaaggaggaagaattcaagagagcagaaaaaataacagaagtgatcatcaagcctctgctcatgtcacatccaatgacattccatcaggcaatcaatgatgcagccaagcccatattgggaacagccaagcctgttcccaatatgaacagggctgggaaatatacaccacaaaatctagagaaaggtccatataattcggggtctcaacagaaaatggttagtaaagaggaacagattattggtaagtttaataaagggacagttgttagttgttataaagagcctccaaatggacaaacacagtggaattcagtgaatctataaccccat

SEQ ID NO: 475525 - DNA, 721 bp, Homo sapiens
ctgcattaccagtgggccgctatgttaggagactattgctgtaccccaggggtgagatgacaatggaagcaaaggatttgcatgcagcaggtgtggtctgccaggaaaggagctatgatgagggcctccaggaagcaccctgcttgggcattcaaatatgccctgcaagcatgcgtgggcaggttggggccccaggaaaggccagcagacagggggccactcagataggacaggccttatcccctgggcaagacggccatgctctgtccaggtctaacactacccaaaagctaaagccagctaaaggagcttggcaagccttggaggatgagcctccctggccatactccactacaacccttcctgaaccaaattctttgggctccatacaggctggcatccttcccctgccaccttcccaaccaactcttcctgctagcttaagtgtccatgggatcgtgggttgtgcaccagaattccagaggtctgtgggctcaatgtatcaagagaagcctcattcagaaggagaatgggagctcaggttttcatgagaattatagaaaataggttaccattttgatatttttagacaaggcaaatgagttttatgtcttatcataaaatagatttaaaaaaataaaagatttcaaaaaaccaacaaaaggattgcacaaatctcaggaatttgtgaacatttatattctgagcactgagctaagaa

SEQ ID NO: 475526 - DNA, 511 bp, Homo sapiens
cacagtgtttgagctgcaacttcaaccagaagggaagaaggagagtgggggtatgtgcatagcacgtaatgcagctggaggattggctgagtctgactcagttggagcactggcatgactgggcctctctccatgtgctcttttcatctcagccagagcttcttcgcatagtggcagcagcattccaagagggtgcagacaacgtgtcagggcctcttgtggccttgactcataagtggcataacaccaattctgccatacaagtcacaagaccagctcacatcaaagagctgcattctctccatggcacaaggagactggaggccaagggcatgtttccacctagaatcctgccagagcccatttcttcttttggaccatgctccaggcatcaggatctccgatatttctacccaaatggcctgagtcagcctcctgagcctacctgggcctcttctctgcatttgttctcctggagctgaccatcctgcagcgtggacatccctaatat

SEQ ID NO: 475527 - DNA, 597 bp, Homo sapiens
agtgctaaaaacgtctggtgcttgcaatctcactgttcttatagctatggccagctcagggcggtggacctggacccatcagacacactcatacttagaatgcaagctaaacatgagaagaagcaggaagaacacaggagcaagtccagtaaatggtagaggcagcaccagcagcaccctctacttccagaggggagatgtagccagagttcagtctgcaggtctgctggagtttgctgggggtccactccagaccctgtttgcctgggtgtcaccagcagaggctgcagaacagcagatattgctgcctgctccttcctgtggaagcttcatcccagagggacacctgccagatgccagcaagagctctcctcagagcttgaacgctgtgctgggagatctgctgctctcttcagagctggcaggaaggaacgtggaagggaagactgtgagtgattccaagtctgagagaacaggggactttagtgcatagtgagtactgaaactttatcctaaaggatatggatttgaatttacaaggtcttctaattaaagagatttgaatatcaggatttatatgtagagtggaaaaaaagc

SEQ ID NO: 475528 - DNA, 774 bp, Homo sapiens
tccgagcccagctccgctgcccgctgcaatggaagaagagatggcggcactcattgacaatggctctagcatgtgcaaagctggctttgctgggggagctgttttcccctccatcatctggtgcccccggcaccagcacgtgaaggggggcatgagccagaaggattcctacgtgaatgacaaagcccagagcaagcatggcatcctgaccctgaggtaccccatcgagcatggcatcgtcactaactgggacgacatggagaagatctggcatcacaccttctacaaggagctgtgcatggccctggaggagcacatctggctgagacctgacccactacctcatgaagagcacggctacagcttcaccaccaagcacggctacagcttcaccaccaccgccaagggggagatcatgcgtgacatcaaggagaagctgtgctaccgcaacctggacttgaagcaggatatggccaccaccgcatactcctcctccttggagaagagctacaagctgcctgatggccaggagaccaccttcaactccatcatgaagtgtgacatggacatctgcgaagacctgtatgccaacacggtgctgtccagcagcaccacaatgccatgatggttaattatgtgtcaacttgactaagttaaggaatgtttggatagcggattaaacattatttctggtagtgtctatgagggtgtttcaggaagagattagaatttgaattagtacacagagtaaaaaagacctatcctcacttgcac

SEQ ID NO: 475529 - DNA, 693 bp, Homo sapiens
cagaaagcccaccttctctctaaatgctctagggacttggagttaaagaagacagcaacctggaaatgcccgaggatgtagacaaaataagtgatttcacacagtatccttcaccagaatttggttacacattggggagccactactgctcttttagaaatgagaaaactgaacccgctagaggatataaaccagcaaggtgctttgacaagacgcttgttaaatggagaatggaaccaggttattcactgtgtggcatcttaactccctctgagttaagtcctgatcatttggctggtgaatactttgtgccttcagaaacctatgtaaagaaacgcatcattgtgataacctctgagccctgcagccactttgtgaaatacagaattgttctgatttatgaatgcgatattacggctgcagcaagtctcttacctacacatgaagtttcagaccgggagtaccaaggaaagaaacagaaacattaaaaaagtacggattaaacttgaaacaatcctatatctatatctatatctatgtctatgtctatgtctatatattctctagtaaacattagtagctaatacttcctgaaaagcagagagagagagcagaagaaccatgctgctgagtactgtaagcccataggaccaggagaaatcacaaaattgttgttttaaccactcaatgttt

SEQ ID NO: 475530 - DNA, 3305 bp, Homo sapiens
aaaggtattgtatgaggacctggtatatgcagtatgatgtcgataacagtgatactgtcagatggaagcagcagcacaaaagaactctcagacccaatagccccatcctccatccacttctgctggctgccaatgggcaaagactgaagggagagaaggaagccaagcgggctcttttggatgcgaggcataactacttatttgcaattgtggcttcctgtttggacctgaacaaaaccgaagtggaggatgccattcttgaagggaatcagattgaaagaattgatcaactttttgctgttggaggtctccgacacctcatgttttactatcaagatgtggaggaagcagaaacaggaggggtaaatcttgtttctggaaagattaaaaaacctaaggtgttcgtgaccgagggaaacgatgtggctcttactggggtatgtgtgttcttcatcaggactgacccttccaaagccatcacccctgacaacatccaccaggaggtgagttttaacatgttagatgcggcagatggaggcctgctcaacagtgtgagacgtttgctgtcggacatcttcattcctgctctcagagccacgagccatggctggggcgagctcgagggccttcaggacgcagctaacattcgccaggagttcttgagctccctggaaggctttgtgaacgtcctgtcgggtgcacaggagagtctgaaggagaaggtgaaccttcgaaagtgtgacatacttgaactgaaaaccctaaaggaacctacggactacttgactctagcaaataaccctgagactttgggaaaaatagaggattgcatgaaagtatggatcaaacagacagaacaggttcttgctgaaaacaatcagctgctgaaggaagcggatgacgttgggccacgagcggagctggagcactggaaaaaaagactctccaagtttaactaccttttggaacaattgaaaagcccggatgtgaaggctgtgctggcagtgcttgcggcggccaagtcgaaactgctgaagacttggcgggagatggatattcgaatcactgatgcaactaatgaagcaaaggacaatgtgaaatacttgtatacacttgaaaaatgttgtgaccctttgtacagcagtgatcccgtgacaaatcagattatatctgcatgtaaagcctatattaccaataatggaaccgcttccatctggaaccagccacaggatgttgttgaagaaaaaatactatctgcgattaaactgaaacaggaataccagctctgctttcacaagacaaaacaaaagcttaaacaaaatccaaatgcaaaacaatttgattttagcgagatgtatatttttggaaaattcgaaacttttcaccgacgccttgccaagataatagacatctttacaaccctcaagacgtattcagtcctgcaagattccacaattgaagggctggaagacatggccactaaataccagggcattgtggcaaccataaagaaaaaggaatacaatttcctagaccagcggaaaatggattttgaccaagattacgaagagttttgcaagcagactaatgaccttcatgtaggttgtataataaaattcctgttgacagtcgtgtgtttattttttcctttctgtataatgccgttaatcattacccaatcagaaggcagaggtatcttcatcatggagaacgagttgcggaagttcatggatgttacatttgcaaagattcaaaacacaaatcaagctctaagaatgttgaagaaatttgaaagattgaatatacctaatcttggtattgatgacaaatatcaacttatccttgagaactatggggctgacattgatatgatttcaaagctgtatacaaagcagaaatacgatcctcctctggctcgaaaccagcctcccatcgctggaaagattttgtgggcccgccagctcttccataggattcagcagcccatgcagcttttccagcagcacccagctgtgctaagcacggcagaagccaaacctataattcgcagttacaacaggatggccaaggtcctcctggagtttgaggtcctcttccacagggcgtggcttcggcaaattgaagaaattcatgtaggtcttgaggcttcattattggtgaaggctccaggcacaggggaattgtttgtaaactttgaccctcagatattaatcttatttagagaaacagagtgcatggcccagatgggtctggaagtctctccactggcaacttccctcttccagaaacgagatagatacaaaaggaacttcagtaacatgaaggttcctggtttgccaaagctaaagcatcatgggaatgaggaaatggtggagccccatgctgattattcaaggaggacaccactcaggattgaaagaaaggcccttttggtgggtttcagcttttgggtgtcatcatggagctcattagtggaggaggcagtcaatgagcttgtaaatatgttgctggatgtggaagttttatctgaagaagaaagtgaaaaaatatccaatgagaatagtgttaattacaaaaatgaaagttcagcaaaaagagaagaaggaaattttgacaccttgacatcatctattaatgccagggccaatgccctgcttttgacgacagtcacgaggaaaaagaaagaaactgagatgttaggggaagaagcccgcgagttactctctcatttcaaccatcagaacatggatgctcttctgaaagttacaaggaatacactagaggccattcgcaaacgtattcattcctctcacacaattaacttccgggacagtaacagtgcctctaacatgaagcagaacagtttgcccattttccgggcaagcgtcactctggccattcccaacatcgtcatggcccctgccctggaagatgtacagcagaccctgaacaaagccgtggagtgcatcatcagtgtccctaagggggtcagacagtggagcagtgaactgttgtccaagaaaaagatacaagaaagaaaaatggctgctttgcagagtaatgaagacagtgattctgatgttgaaatgggagaaaatgaacttcaagtattttgaatatatcacttcactcctttctaacctgcaaggcttctgctaagaaatctactgatagtcttatgagtgttcccttacatacaatgaaacacttttcccttgctactttcaacactctttatctttagctattgacaatttgattataatgtgtcttggtgtgagtgtttttgaattaatcttatttaa

SEQ ID NO: 475531 - DNA, 568 bp, Homo sapiens
gtatctgaagtaggatcaggaatgagaagagaaaatagctatggtctggtactggggagtgtctgcaaagagccctgtgatgtgatccatcttcaggtctctcagctgtggataccagcacctgctccagtggaggaaacctcacgtttggtcaaaattgttacaaagttcaattggaagtttccttctccctgtggtctttccccaattccactggcagctctctccaaggacccctgtgaaacaaagtcaggaatggcttccctggagaccaagagtgcccacaggactcttcccgctgcttcctctacctctgcatttcacttgactctctcagttcatctcagctctaggttccgcagtgaggatgagtgctcgggagcagactttccccctctcacactttgggcactcggagtttctcagctgtctcatggggccggcagcagcaagccgcttccttcaaagggtgtgtggattctctcagctttcctgggatgttcctgcagtagttcttggagcaaaagttcatgatgtgagtctccacatgctgctctgtccattcgag

SEQ ID NO: 475532 - DNA, 531 bp, Homo sapiens
tcataaacagaaggctctcgtgtgcgaatgcccgatggcaagaacaaccacgaaagactctgcaaaatccacaaccttgcataaaagccattgcaacctcaaaatacttctgcaaggacatctgtccatcaactgcctgtctgacttccgactgactggctggggagccctcacaattatggcagaaggagaaaggaatgtctcacatggcggcggcaagaaagagaatgagagccaagcaaaacgggtttttcctaatgtgagatttattcactaccacaagagcagtgtgggggaaaccatccccatgattcaattatctcccactgggtccctcccacaacatgtgggaattatggaagtacaattcaagatgagatttgcttggggacacagagccaaaccatatctggcaccaacaaacaacagatgccagcccatagctctgtgccaggattaatttagtccttacattgctggataattgagaaatttaaaggattccaagtgagaagacagaatggacagggc

SEQ ID NO: 475533 - DNA, 634 bp, Homo sapiens
ccgtttcttgactattttccattaggtccctttagccacttggcggctcagtctgctcctcccggtctctcccagtcctgctttcatgctgataacagctaagaactccatgatgtgtgccatggcatctaggctgctactgccatgctgccttccacagacgagtggtaccaaaaggcacagtagtggatatttgtcctctttagctgactgccatccaaatcgccttcctaacacaagccagaaagggaaagtgaatttcaaaacgcctcatctttgtcaagctgctttgatgaaaagtaacagaaactcattcaaattgtcggaaggaaagagaatgaggtacagggaagatgtaggaagaatcacaagtaagggtgggaggaatagcatggccagccagaagcatccagccagcagcacctgtcagtggccccagtatgaccccctcctaatctctgcttctctctgcataactctccctgcagaccttggcttcgacatgcacacagcagaagcttgctaccccatgacatccaagttttaaaatccttagttcaaacacccacaagagacagactggcaagtgtgtcttaaccccaattcttggagggaatcttagggctgctgttca

SEQ ID NO: 475534 - DNA, 643 bp, Homo sapiens
aaaaggagttgaaaggaggtggtcatgaatgtggccaagtctgtggtggtcagaaagaccagaggagaaagtgacccaaatcagagcagaaggaagggatttggggctgaaggaagggctgctgctggagtggcagcccacagtgtctccttctcactgaaggtgacatccatggtgaggagagagcagggtaggagtggaggtggggagctgagacaagtgggaaggtttgacctcatctgcagagtccaggtcaaacctggtgattctgaagaaccaggggtccaaagtgccatcagggagaaaaagaggatggggcagaggagaacaaagagccccacacagcaccctaattgtcctctctatgccaggtaccagagggcacgccatacaatcaccattcagggtcaagcgctgtgccagtgttctttccagggacatctaagggagcccccagtcactgatttggaggcaagttgagctaaatcattctccctgccccaaatagagaaatatcacaggctccagcatgggggagacagaacagacagaagggccctctgtggccagctgaggttccagtagaagggtagagtaggaggtttctggagaaacttcaatgtacatagcatggggacaaaat

SEQ ID NO: 475535 - DNA, 662 bp, Homo sapiens
ctgtttttactataaacaagtcctatgttttacatgttgaagcctttcctggctcttgataactcagatattgctgctaaatctaaaggaattggtttaaatttaaggctaaatgttagagtagtgagggtgtggccctggtttccatcctataggtgtgaggtcatgaggcttcagggacactttatgccctcccagatgctgccactgaagtctgcagtctgtagtgtcaatgcttggatccttttagagcattggaatggactcaaatcacgcacgtttccattcaataatctcaaaaaacagttacacacaatctcaatatttaaactggtgccacataccataaagcaaggctcaaagaagtccagactcttgacccttgagggaggtcctttttctgatccaggagagaattaactaagagtgtggcacctttttaagtctgataagaaacattttacaatctattctcttggaagcctgctaccttcatgtgcataataaaaccttggtgtctacatctttttatcttaacccagacactcccttttattgactccaggtctttagataaaatctttgaaccaattgccagtcaggaaatcttataatccacctatgacatggaagctcctcccccaccctctccccacccctcc

SEQ ID NO: 475536 - DNA, 503 bp, Homo sapiens
tccgataagggaataaaagcaggctgcccaagctgtagtgaagaaatggataactctggatgcagtgccttaagagctgcaacaatcgctacaaagatctgcagcttgactcctgaaaccagggggaccacgaacccaccagaagaaagaaactctgaatgcgtcaaacatcagaaggaacaaattccagacacaccatctttaaaaactgtaacagtcactgcgaaggtccgtggcttcattcttgaagtcagtgaaaccaagaacccgccaattctggacacagtggatgttttggcaagtgtgatgatttgcgtccacatttcagctgagactgttgctgcaggggtctttgttcagcatgactttcagctggcatcacaccacactctcaagttacccattcatacatatttaagctctgagctaggttctagggattctaggtcagagttcctgccctcaaagagctcatgaactaggtatttttaaaaaataacttc

SEQ ID NO: 475537 - DNA, 1213 bp, Homo sapiens
tttcacgaaatgcaaattcaacacacaacagcttccttaatagcaaaggtagcaacagcccaggatgatataactggtgatagtacaacttccaatgtcctaatcattgaaaagctactgaaacaggaggatctctacatttctgaaggccttcatctcagaataattactgaaggatttgaagctgcaaaggaaaaggcccttcggtttttggaagaagtcaaaataaggaaagagatggacagggaaacacttataaatgtggccagaacatctcttcatactaaagttcatgctgaacttgcagatgccttaacagaggctgtagtggactccattttggccattaaaagacaagatgaacctattgatctcttcatggttgtgatcatggagatgaaacataaatctgaaactgatacaagcttaatcagagggcttgttttggaccacggagcatggcatcctgatatgaagaaaagggtggaggatgtatacattctcaagtatgctcttgcaaaagaacacatagtcactcttcacagagctaaaaggagaaatatcgaggggctgactcttgcttctggtgaggtagccctgaattcttttgaaaacctaaatcctgactgcttgggacatgcaggacttgtatataaatatatattgggagaagagaagttcacctttattgagaaatgtaacaatactcgctctgtcacattattaaacaaaggaccaaataagtacacactcactcagctccaaagatgcagtgctggtgctgtggaagtagcaatggcagaagccctgattaaatataagcccagtgtaaagggcagggcacagcttggagtccaagcatttgctgatgtgttgctcattattccaaaggttcttgatcagaactctggttttgaccttcaggaaacattagttaaaattcaagcagaatgttcagaatcaggtcagcttgtgggtgtggacctggatacagatgatgctgttttgactgtaataaactagggcaaaataatttgaagttttaaatgttgaatgggaatttcagatctttgtaaatgaaatggtccatgaactattatatcatcatttctgtctaataaagtaaccatttgaaaatcatttctgtctaataaccatttggaaaatattatttacccttttgaacaaattaaaatcttaattttaaatgttt

SEQ ID NO: 475538 - DNA, 1646 bp, Homo sapiens
aaaagccaaaatgggaaaggaaaagactcatatcaacattgtcgtcattggacacgtagattcgggcaagtccaccactactggccatctgatctataaatgcagtagcatcgacaaaagaaccattgaaaaatttgagaaggagactgctgagatgggaaagggctctttcaagtatggctgggtcttggataaactgaaagctgagcgtgaacgtggtatcaccattgatatctccttgtggaaatttgagaccagcaagtactatgtgactatcactgatgctccaggacacagagacttcatcaaaaacatgattacagggacatctcaggctgactgtgctgtcccgattgttgctgctggtgttggtgaatttgaagctggtatctctaagaatgggcagacccgagagcatgcccttctggcttacacactgggtgtgaaacaactaattgttggtgttaacaaaatggattccactgagccaccctacagccagaagagatatgaggaaattgttaaggaagtcagcacttacattaagaaaattggctacaaccccgacacagtagcatttgtgccaatttctggttggaatggtaacaacatgctggagccaagtgctaacatgccttggttcaagggatggaaagtcacccgtaaggatggcaatgccagtggaaccatgctgcttgaggctctggactgcatcctaccaccaactcgtccaactgacaagcccttgcgcctgcctctccaggatgtctacaaaattggtggtattggtagtgttcctgttggccgagtggagactggtattctcaaacccggtatggtggtcacctttgctccagtcaacgttacaacagaagtaaaatctgtcgaaatgcaccatgaagctttgggtgaagctcttcctggggacagtgtgggcttccatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgctggctatgcccctgtattggattgccacacggctcatattgcatgcaagtttgctgagctgaaggaaaagattgatcgccgttctggtaaaaagctggaagatggccctaaattcttgaagtccggtgatgctgccattgttgatatggttcctggcaagcccatgtgtgctgagagcttctcagactatccacctttgggtcgctttgctgttcgtgatatgagacacacagttgcggtgggtgtcatcaaagcagtggacaagaaggctgctggagctggcaaggacatacagttgtccctcagtatccatgggggattgattccaggacccctcatgaataccaaaatctgaggatgttcagttcctcatataaagtggtgtagcatttgcatataacctatgcatatcctcccatatagtttaaatcatctccagattacttataatacctaatgtagtgtaaatgttatgtaaatagttgttaaactttttatttgtattattttttgttgtattatttttaattatttttttctgaattaaaaaaaaaatcttcagttggttgaat

SEQ ID NO: 475539 - DNA, 946 bp, Homo sapiens
ctcctccttgccttccaccatgattgtgaggcctccccagccctgcggaactcatctggtggctgcaggcattccctggattgtggcaaagggcaaagaattggaagcagcaaggagtaggcctgtctggcagtttaggaactgtggactgaacgaggctgctgggacccccagtgcccagggttgtggacctgtactggtctgtggcctgttagcaggagaactaccagctttcaaggaaatgggtagcgcagagaatggctctaagccaatgaccttgcggcatttggaagcagaaattcacagtgtttcaggcactgcaaaagtggcctcattttcaatggcaggtgttagcagagtggtcatcctgtctgtgtgtgttccatgtcacccctacctgctggtagcctcattaactctggcatgtagcagcagaagagggcattggaaagagtccagtggagcagagaaaggtggggagtggacgatcaagggcagccaggttctagaggctatgacagcaatggcattctgtgcagctggaccctcaggggctccagtttccctggcggctatctggggtgggatgccacctggacgttagcataattacttgcactgtgagaactaaatcaaaaggaagaccccaactttccacacctaagtaacaaaaaaacaccttgctactcaccgccaactgctgcccgcccattttttgggtggcagacggaaaattgaaagtatctctgattggctggtttctgcaaccaatcagactgactgccggccaagtcttctttgcctagaagtgtaactttgtaacttcactttagcctctgattggttgctttccacaaccaatcagatgcttgcatagggtgtaatctttgtaacctcacttcagcctctgattagttgctttctgcaaccagtcagatgattgggg

SEQ ID NO: 475540 - DNA, 829 bp, Homo sapiens
acccgataaaggaggattggcgttttccttagacacttccggttctgtcttataatgtataatgcattcaaagggaggattgagaatacagaactgccagcagctgacagtgggagaaatgaccattggcaacaagggacaatgtggaagaaaagtcgagattatgagtttgtggatccctataatgaagacatagtggacaacgatggctattggagcaacgataaaagtaatgaaaaccacctaggagcatctattgtctaccaggcaaaagtagttggtttaaaagaaacagaatcagtgattgtggggtctggcaagtctgacgtccctagagcaggccgtcgggaagagccatctggagtctgtcaggccagagctgatgctgctgaatttgcctgggagcagcgagggcgtcatgctggccgaccacagcaacctttaaacctgtggtggtaaaactcagggtttgggatctgctgcatggaaaggaaaaattttaaactagcctctttcatcttgattgagggtggaaacataaacgggagtgtttgtgcttgaacctcttgaaaccagtttcttggaaagtaatagttaagtgttttcttaaaacatcatttgcaattgaaaatgcaaaccgtagggctcattagtttgtccatgggtggtcttcagaggctggaccaaggctggatgtttgggtgttgttctgtgtgagctgactgaggtatgggaaggcctagacacattgtttttggggaaacttaaaaataaagtttggacttctttattaaaggctgtcaacctaaggctttgaccacaaagattt

SEQ ID NO: 475541 - DNA, 1239 bp, Homo sapiens
ctgccagcacgctgtcacctctcactgtgtttgcaagggctgctcttgtttgtgcatgactaatgtgtcccgctcggttgcgtcatccagaggctgagtgtctggcatgccgggaagcgctgtggttccctgcaggcggtcttcaagatatgaatatctggaggtatcatcagtccacagcaagcatctggatgcggagccagggtgccagccctcgctttgctggggcaagcaggcagtgctgtctgcagggcagtgttgtcatgctgccacccagggtgaagacagctgcagccatggtcctctgagatgctgcagggtactctcccacatctgggcccacgctcccactgtggggagagagcagcagcaatcactggttgggacctgggaggtgggggtctggccttcctgttctacacctacaaaggactctttacactcagtcgttgccagaggacaaagacccaggtggctctggtagctgaggtggaggcagagaaagcttgcagctgggggctgtctgctgatggggctccctcaaatgagggcaagtccctcctccgagggcgatctggtgagtgtgttcctgcctcaggtagagcagctgatgagaacatttatcctgggaagaaagaagaagtttctggggcaataacacctatagagctgtcatctcatgataacactgttccttctggaataatacctgctgaaggacctgcctgagtcagctttacaactaacttaaaaaagtaagcagaagaagtacactctaaaagggatagcattgtaaatacataaaccagtaacagttgtccattatcaagcattatgtactgttcatatttgtatgcgctcaacttttatgcaactggcagttcaaattccctcttagtctcttgacaatttgactttaatgtgcctcagagaggacctttttgagttgaatccatttgggaacctttaagcttcttgggtctggatgtccatatctctcttaaaacttggggagtttcagctgttatttcaattaataggttttctatgccattctccatctcttctctttctggaattcccataatatgaacttttgttcacttaatggtgtctcataagtcttgtaggctttcttcactctttttcattcttatttcttgatttttatcctttgggtaatttccaacaatgtgtcttcaaattcggagatcctttcatagagaaacttttacctgc

SEQ ID NO: 475542 - DNA, 723 bp, Homo sapiens
agcagccggcagaactcccacattggctccctgactggtaggggattgtggagattaatgccaccatgaaggaattgaaagacgcaggggtggtgattcccaccacatccccattcaactctcccatccagcctgtgctgaagacagatgcatcttggaaaatgacagtgaattattgtaagcttaaccaagttgtaactccatttgcagctgctataccagatgtggtttcattgcttgagcaaattaacacatctcctagtacctggtatgcagccattgacttggcaaatgcctttttctccattcctgtccaacaggagaaggctctgcaacaggttcaggctgctgtgcaagctgctctgccacttgggccatatgacccagcagatccaatggtgcttgaggtgtcagtggcagatagggatgctgcttggagcctttgccagtcccccataggtgaatcacagcagaggcctctaggattttggagcaaggccctgccatcttctgcagataactactccccttttgagaaacagctcttggcctgttactgggctttggtggaaactgaacgtttgattatgggtcatcaagtcaccatgcgatctgaactgcctatcaagaactgggtgctttctgacccatctgggcataaagtgagtcatgtacagcagctttccaacatcaaatggaagtgatatacacgtgactgggctc

SEQ ID NO: 475543 - DNA, 759 bp, Homo sapiens
agctgctgtttggagccctgagagaagagatactagaaggaaagatttttctccatcgctttactttgactctatggctgtcattgcatgggaaaggctgtgggcaagtgaacgccagaaaagtggcacaggggaagctgtgatgaaaagagactgtgtgggctggtgtgcatcagcaggggtcgctctactggagctctctgatagtcaggcaaggtctgccgacaaaggagctatgatgagggttcctggaagcaccctggttgaacatctgaggctgcactgccgtcagcagctctccctgccagctcaagtgtccatgggggtcatggggttttctgctgcctggagtctggaggtccatggtgggagtgggctgctccttacctgttcaacccaccccttccccaggagtcgctgggggctaggaatgagtcccagtgatcagcagacctgtgcagggcatccagcttttttccccttcagcccgcatgtgtcctcactctgtccactctgaatgcctttcctctgaaggctttattttctaatcttctttgtgtcatgatttctccctcccttctattttgtatgcaactgtagccgatgcctggtgatccatacatatgcctaaagccattccagagtcatctgccagcaaaacctgcacactctgacggctctgtgcatctctttgcctgagggtggtctctgacagggggagcaagccaaaagacaagaattgaaaacaagaaagcaaag

SEQ ID NO: 475544 - DNA, 1841 bp, Homo sapiens
attactaccaggtcctgtttttccctttaccatcaatttcagaggatgtacggaaacacttggatgtctaggcagaagtctggggcaaggatggagcctttatggggcaaggatggaacctctactagggcagtgcagaggggaaatgtggggttgaagcccccacacagagtctccactgggggtctgcctagtggatctgtgagaagagggccatcatcctccagaccccagaagggtagatctatgaacagcttgcaccatgcacctggaaaggctgcaggcactcaatgccagcccatgaaagcagccatgggggctgtgcccctcagagccacaggggcagagctgcctaaagtcttaggagcccacttcttgcatcagcattccctggatatgagacatagaggctttccggagcccagtgtgatttgcacatctgatcttcatcgatcccagtatcagatgtgctgtggagaggtctcagccctgtcatttaacatatgacctgaaatgatatgagaactggagttactgctgtatgtttctgattaggaaattgcccattttgcaactctcatttcagaaagatgcctaataatgccaagagtactaaatagatattcaccaatcaccaaaaaatgtaagtttaactgactcatattcaagatgaatgtgctcagaactagacacctagagaccacctattaaaaccaggaaggctgacaaatggagatgcactctacaccccatggaaaagccctcaaagttttgtagtgatattgagaaaaattttttaataagttgaattcaataaacagttccttttcccttgtgctgcctagttacgcactcttattttctttgtccttgctcataagctgttaagagaaattgttgagaagctgagcagaccaatacactagaccaagagccttagaggccatcagatagcttagatagataggcaatatctgctgtattattacactacttggaaatgaggagggtcattgtaatgagaaatatcctttggactgttttgaaacactgcgattgagggggaggagaaaggggagctgttgcttagcagttatctattttgtcaattataggggcccagtatatccacattcccagtcctgagcacaacagattcttctcaaacaagaagaaaagagaaatacctgtgggcaaacactattctttttcttttttagcagctttattgaggtataattgacaaaaatgtatatatttagggtgtacaacatgatgattttatatacatacacattgtgaaatatttaccacagtcaagttaatgaacacatcaatcatgtcacataataaccttttttattttgtagtgagaacagaagatctagtctcttacaaatgtcaaatatacactatatcattattaagtatagtcaccatactgtatgtcagagtcccagaagtgacatcatacggtaacctgaaatcagccacgagagcattcataccacagaaatcagcaaatgctacaagtgagggcacttttcctagagagctggctattcaacctttactagtatatggctgtgtaaatgaagcaactaaacatggaatcagaggactgaaatttgaatcccagctctactacatactagttctctaatttgggaagatcatttcccatggctgagtgtcggttttctcgactttaaagtgagagggagaaaacccgtcatgaaggtggaatgacttcatttgcgagtacagaaaatccagtttcatggataaacaaataggaggttagatttattatttcatgtgataataagtcttaaataggc

SEQ ID NO: 475545 - DNA, 4275 bp, Homo sapiens
aatgtaaaaggtagaagatgtcaggaggcaagcttctgatagtaagacagtcctcataccccacaggtggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacgtgaggtcctgcagaacagagatgatgctggaccagtcatctcaggcggacctgaggtcctgcagaacagagatgatgctggaccagtcatctcaggcggacctgaggtcctgcagaacagagatgatgatggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgatggaccagtcatctcaggcggacctgaggtcctgcagaacagagatgatgatggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgatggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgctggaccagtcatctcaggcggacctgaggtcctgcagaacagagatgatgatggaccagtcatctcaggcggacctgaggtcctgcagaacagagatgatgatggaccagtcatctcaggcggacctgaggtcctgcagaacagagatgatgctggaccagtcatctcaggcggacctgaggtcctgcagaacagagatgatgatggaccagtcatctcaggcggacctgaggtcctgcagagcagagatgatgctggaccagtcatctcaggcggacctgaggtcctgcagaacagagatgatgctggaccagtcatctcaggtggacctgaggtcctgcagaacagagatgatgctggaccagtcatctcaggcggacctgaggtcctgcagaacagagatgatgctggaccagtcatctcaggcggacctgaggtcctgcagaacagactagtttaatccctggtgtcaccgcctgtaggggagaagagtgcagtcttgccttttaactgactccacgtaacctattcaggacttttatgtctgtatgtgacatctggagagactgctcatcccaattcaggcatccggaaaactactttgctgtgttaagcgctatttttcttaaaaatgggcaaatttccagcgtatagcaaggacaggcttagtgccacagccgaaataattgttgctgcgttaaaagctttgcaagtgagactgtcagtgcagaggttggtgagtggatgacgtcagcagtgctggagggagtttctagcgtcatgttgcaggtgtctgttctcatgcagaaagcctgtgagtggttgaattggtttggaaggtgtgtgtatcaaatctagacaagggcctgtcagatacgtcaggtgctagaattcagatcccaacagatctcagcaccaaatcaaccacagaaagtttcattaatcagttttaatatatgagtgttttgaatcagtacagagtaagaatcacataggtggcaacagcatgtgtttaatgaagaaatgagcttacatgtgttatttggttgagtccacaatgctgtcatgcccccaaataactccttccactgtggtgaccaagggaggccgtcgtcttgctttctggctgctgtttggatcacgtgggtattgtgtacagttgtccagtccctatgtcgttttgttttgcttaatgaatatcacatcaatttaatgtgtccacactgggcaaaactgacttgaggagtgtgagagtaataaaaacaggatatattccagaatgatcatctggtaagaacatgccctggaagctatagttataatatcctcgaacagattacactggttatttatacactctttagacttcttagtgctcaacaattgatgaaataccatttctggggagtcatgcttatgtttaattttcagtaaggactggccacagttctatttatttctactaaaaacatctccttggcaaggaaaatgccctttccattttcctgcttgtgtgtgcgtgtgtctgtatgtacgtgcacatgcacgtgaggatgtgtttttcctgcttgtatatgtgtgtgcacacacatcagcatgtttttcctgcgtgtatatgcatgtgcatgcacatcagcatgtgtgcttttcctgcatgtgtgtacacaaacatgcatgtgaacctgtttttcctgtgtgtatatgtgtgtgtacgcacatgaacatgtgtttcctgcatgtttatgtgtgtgtacgcacatgagcatgtgtttttcctctgatgatgtgtacgcacatgagcatgtgtgtttttcctgcatgtttgtgtgtgtacgcacgtgagcatgtgtttttcctgcgtgtttatgtgtgtgtacgcacgtgagcatgtgtttttcctgtatatgtgtatgcacatgagcatgtgtttttcctgcatgtttgtgtgtgtacgcacgtgagcatgtgtttttcctgtatgtgtgtacacacgtgagcatgtgtgtttttcctgtgtgtatatgtgtgcgcacgcacatgagcatgtttttcttgtgtgttatatatgtgtacgcacgtgagcatgtgtttttcctgcatgtttgtgtgtatgcacatgagcatgtgtgtttttcctggtgtgtatatgtgtgtgcatgcacatgagcatgtttttcctgcgtgttgtgggtgtgtatgcacgtgagcatgtgtgtttttcctggtgtgtatatgtgtgcacacacatgatcatgtgtgtttttcctgtgtgtttgtgtgtgcacacacgtgagcatgtgtttttcctgtgtgtatgtgtgtacgcacgtgagcatgtgtttttcctgtgtgtatatgtgtgtgcacgcacatgagcatgtgtttttcctgcatatgtgtgcacacatgtgagcatgtgtgtgttttaccctattattccatatctctttccttgctcttttttttaagtgttaaagacttttactttcagactattttagaggagtcatttcattaaaccttttggaatcccactgaagccgcagggcccaaggttaagctgtgctcttcccttaggaattgacagtcgtggc

SEQ ID NO: 475546 - DNA, 505 bp, Homo sapiens
gcttttctttttctcacacataaatgaaaagctacattaatattaaagctcacattactttgtccaacatctgtgaatatggaccagccagctgtgctgctagcaccccgtcacccccacatggaggatttcggaggcgggcacacaggtttgctctgcggcaaacctcacccgcttgccttgggagcccactgagcccccaggtgacctcagcatctcagttctggcttggaggcattttaggaaccaccatgagactggaacgcgtgctccctgagcgctgggactcgccttattccctggtgtctcccaggatcctcctcagtgctttgcacactgtcccagtgtgtgttgttcccctctttgtatccatgtgttcccatcatttagctaccacttgtaagtgagaacatgtgatacttggttttctgttcctgcattagtatgctaagagctctagctccacccatgttcctgcaaaagacataatcttgttcttttttac

SEQ ID NO: 475547 - DNA, 729 bp, Homo sapiens
ttctggtgtcacggtgatcctggtgctatggaaggtgctggtgctatggagggtgctggtgtcatagtgattctggtgctatggaaggtgctggtgctgtggaaggtgctggtgtcatgggaatcctggtgctatggaaggtgctggtgctgtggaaggtgctggtgtcatgggaatcctggtgctatggaaggtgctggtgctgtggaaggtgctggtgtcatgggaatcctggtgctatggaaggtgctggtgctgtggaaggtgctggtgtcgtgggaatcctggtgctatggaaggtgctggtgctgtggaaggtgctggtgtcatggggatcctggtgctgtggaaggtgctagtactatggagggtgctggtgtcttggtgatcctggttactggtgctctgaaggttgttggtgctatggaagatgctggtgctgaggagggtactgaggctctggaaggtgcttatgcacctagctatgctgccaggcctggttgtttccagcctgacgacagagcaagactcagtaacaacaacagcaacaacagaagaaccagtgtcagtgggctattattaaacaaacagcaacaagtaaaacaaaaataaaaccccagttgcagtttcaggctaacattagaaggtgtggatttttgctgtttcatccgctcaccgatccattccactctttgggctcctgcctgtgactagcactttatgtgcact

SEQ ID NO: 475548 - DNA, 827 bp, Homo sapiens
gctttcgccacctttgctgctgaagccaccttgcagggccaggcctggccttgtgagcagctggagggaagagagttgaggcacccgcgcacgttactgtgggaatggaactgaaatggcttcccatgggttcagcaattctatcttgagaatctgctatgtggtgggcacagctctgagcacagttaacccaacaggtgaaaagatgcatccctaccccaaagcactcaccttctggtggaaacacagagaacagaggaacacatccatgtataaggcattgggaggtcatgtttacaagaaaaacagagcagggaactgtagcattccagtgccaggagacccacacagcctgcgcacagcaagatcattcaagatagcaaaaccaggaacagcccaaatgtctacagagagtagaatgtgtgagaaaactgggctaccttcctccggggcagtgatgaaggtgaaattgtcagtggatgacattaatccttctctctccaccgttttccataggattgtaggtttaaagcaaaagagtgttccgtgggattttccatgggatttccccgcacttaaggaaggaacagccactgagctgtatgaacagccacccctgccctccaacagaggccctgttcttgacatgctcgtgcacctcacttttctcctggggtgagttctttcctctgctcttctgctgactgacacctagtcggccagtccaggcctgtctgaagccttgggtgagacccctggtgcatctcatgttgttgattcctctggccttttgctaagtcctctactcctctgccttttataaggtc

SEQ ID NO: 475549 - DNA, 878 bp, Homo sapiens
gcttttggaagggatattatgttaatatctcacacgagagtctccgatcatgcaggacgatgggcggccaggcctgggccatatgaaaaagagacttggtaattcactgagcatcacccaagaccgggcgcagacctacaccctggcgtataaaagacgtagtactcacgtcattcctgtttcacagatgcacagacttactcttggagaggctcctcccaaaagtcacccagctgagctgcgagacctggggcaagtccctttcttctctgggccacaggtattctcatgggcctccctcccaggcttttgtgccaatccaggaggcatgcaagcctctgggacggtgggccatcccatggaggagcctccctttgaggacaatgaaatggcaaagcaaaactgttctggaaccaaatggctgataacccacgctggggttatcctggcgattttcatccacttggctccccaagttgctgctcgaccgctctctgacctggattcactgaggacacatcaggcctttgccacgggctccatggagtggccggagcccagggctggttggatcctgggtgaagactcaggcctcgctcaagaagggagaccacccatatgtgctgtcacgtgtttccagggaggaggctggaagtccaagatcaaggtcctagtaggtttggcctctggaacagtgtccaagtcagtcccgactgctaatagaatcccacggactgagtggcttcaggaacaggaatttatttctcacagttctggaagtccaagatcagggtgctggcagatttgactcctggagcttaccatccatttggagtcacaagatcaagacccagaaaatggtcagtggtaactcacgt

SEQ ID NO: 475550 - DNA, 965 bp, Homo sapiens
gccacctgacatgctccaggcctcagcttggctccattccgggcccggggaccatggccatctcctgttgcccatctttcttgctctcttctgccccaggtgggagaggccttgcatctcaccagagggtcctattttacaactgcaaaccacaagacgttcccagcgtagacttaatgaggaaaagcagagtgccgtattacaatactccctttatgggggcttcatccaataatgtgccctgtgttttcatcacccctggcccaagtgtttatggagagatttgtgttgagaatggaaaccagacaaaatcatgcatctgccaggacgcagtgagaagagcacagcgtcacatccgggatgttcctgccaaaggtccagagtctgcattggatcatgaggaatcctcaggcaagcccaacttgagggatattctacaaaagatctggcctatagtcttaaaaaattccccaggaattgttctagattgaagaagacaaaagacacgtgacaactaaatgcaacgtgtgattctgaactggatccttttgttaaaaaggatgtagttaggacaactggcaaaacggaaataaggtctgaggattcgatggtagcgacacgctcacgttgctttcctgatgcttttgttgtggctgtgttgaggccatccttgtttgtacttggggatgatggggcatcgggtcggcaactgctttcaaatggctcaggaagaagttatttttatctgtattacaacttttctgtaagtttgaactcatttcaaagaaaaaagctttcagaaagttattaagtgtctactaacagttgggcatcttagatcagagttgtggttaaaagctagctttacaaaatacgatacatacatacaatggaatatattcagccttaaaagggaaggaaattctgacacttgccacaacacggataaaccttgaggacatttt

SEQ ID NO: 475551 - DNA, 722 bp, Homo sapiens
aggcacagatattctggcccatatggggaccaccatcatgatggccccaggacaaactcttttccttcccctagtggagaccaatattaacccagaagtttgggcaattcaagggaaaattggccaagccataaccactacaccagtcgggatccagcttaaggatcccacctccttttctaaccagagacaatatcccctgaaaccagaggttaggaaaggactagaagccatcattgataacttgaagatgcagggcctcctcacaccctgcaatagcctttgtaataccctgatactgggggaacaaaacacaaaggggaaatggaaacttgtccagaacctctgtctcattaatgaggctgtagttccaattcacctggtggttcccaatcgatataccctgccagctcaaatacttgagggaactaaattgttcacagtcctggacctgaaggatgcatctttctgcataccattataccatgactcccagtatttgtttgcatttgaggaaccctctaaccaaaccacccagctaacctggacagttaaagttttacaaaacatagatgacattctcttctgctcctcacctgaggaaatctctcaggaggacagtaaggctcttcttaattttctggccagcagaggatataatgtttcaaaatctaaagctcagctctgttagatttcagggaagtacctaggtttggtgttgt

SEQ ID NO: 475552 - DNA, 585 bp, Homo sapiens
aatggtagtcccactgacagcttgcatcatgtgcctggaaaagccactgacactcaatgccagcccatcaaagcagccaggagaggggactgtaccctgcaaagccacaggggcagagctgcccaagaccatgggcattaagcatgacctggatgtgagacatggagtcaaaggagatcattttggagctttaagatttgactgccctgctggatttcagacttgcatggggtctatcctacctctgagaggaaataaactaaacaggttctcttcagcaaaaaggaatttcactggaaggatattggaggctcaaagaacggaggaaaatgaaagctcacaaccaggcctgggaaatagaacatccaaagtcctgccctggaagagccagtccccatgtcactgtatccctcacagaaaagccaaagcccaagagtacattcttattgactctagctcatgtggaccacagatgagctccaagccaggtcaggctttggaggccacaagctcagtctcaggctcaggcactgattgtggcagaggggccactacccaaggtccagctaagcccaagacctagtt

SEQ ID NO: 475553 - DNA, 588 bp, Homo sapiens
accatcacaccgtgcaaccatcaccaccatctccagaacttttttcctctttccaaattgaaattccatgaccattaaatgataacttctccttcctcctctccccagcctgcccttggcagtgaacactctacttactgtctccatgaatttgactatcctaggtacctcatctgctcaatgtctgcatttgtgaagtatcaaagtacccaactaatgtttgacatgcatagactaaatctggggatgccaccagagcgaggacactattacctgtcacacagtcctgctgcagcttctttacctcacacggtcctgctgcagcttcgaggaggactctgcacctgcagatccttaaaaaagctctgtctgggtgtccagtggaagagcgaggccatagaaatgaacccttcaattggccaaatagattatgtcattttgactattgattctcccctacggctgctggttctaacccaagtttataacagtcactgcgttaacaattgcgtttaactcttgattgtcctagctttcatttgataattctttgagctggctgctgcttctttcttaagtgtttacttt

SEQ ID NO: 475554 - DNA, 562 bp, Homo sapiens
agatcaagttcttgtttcagtcgagaccatgatggtatctgattgtctattcagtcactatacaaatggactgcaaaagctaaagatttcttgttgctgggagcctgtaaaagactatgcctcaagctctgacagccattctcaaagaggaattctaaaagttaactttgaccaatgtcagagtcattacaatgtttttgcagcctccaagaagacgacttttgaaggagaaaacactcatttgaattcctccccaggtctgctggctgtcactgacacatctgtgccactcttggccaaagagaaagacattcccctgaatgctgcagtaccctggggcatctctgaactcggtctccctacttctaaaaatgcatacctccttaacagctctccacctccgacgcttagagaaccgaaacccaaacctacagcaggcacactgcccaggttccctcagtgacacagaaactgaatgaaaacttgttaaagcaggaagggttgcagatggaggggataccatattagtttaagtggtgggatgggtgggaaccacaggtct

SEQ ID NO: 475555 - DNA, 824 bp, Homo sapiens
gactgaatgtccttaagtgaagtgttttacacatagaaattattgccctacaaactctatcccaactcaagaacagaaaagattatcattttccaccttaaatgagggcacgagaaccagaggattattttttcagagtccctactggggcactgccgagtggacctgtaagaagagggccatggtcctccagcccccagaatggtaggtctatcaagagcatgcaccatgtgcctggaaaagccacggacactcaatgccagcccatggaagcagccgagaggggggctataccctgcaaagccacaggagcagagttgcccaaagttgtgggagcccacctcttgcatcagcatgacctggatgtgagacacggagtcaaagaagatcattttggagctttaagatttgactgccccactggatttcagactttcatggggcctgtggcccctttgttttggctaatttcttccatttggaatgactttatttacctaatgcctgtacccccattgtatctaggaatgccttttgccttccaccatgattgtgaggcctctccagatacgtcgaaccgtagaaattcagaaattcagtgtgtaaaatggtaaagtggattgaagttgaagatattagatcatttaagaagtcaataaatgaagtaataaacatgcgaatgagaagactgatgatgaagaggacctttaaaagtgtatttctgttacggttattttttttttaaagtgatttgaagccatttataatgattgctaagtggcatgctaaagttttaaaaacaaataaagcattaaaaaataagt

SEQ ID NO: 475556 - DNA, 570 bp, Homo sapiens
gctctctgcagtaaatcctactgctgctcactctttgggtccacactgcctttatgagcggaggaacgaacaactccagatgtgccacctgaagagctgtaacactcaccatgaaggtctgcagctttgctcctgagccagggagaccacgaacccaccagaaggaagaaactcggaacacacccgaacatcagaacaaacaaactccagacatgccgcctttaagaactgtaacactcaccgtgagggtccgcggtttcattcttgtagtcagtgagaccaagaacccaccaattccagacacactgaataaatgtgatgctatcagcactatagagcccatgggctctggcacctgcaagggcatcaaaatcagcagaggtcctgagtctgtccacatgacacctttattgcaagcacaaaaaacaatcgagaaaaccagtgcactaaacaaaactacaaccaaggaccttcacagaatccactgcattcccctgctacctccaccagaacaggtgctggattccatggctgagaggccttaagacaagtcatattataggactcttt

SEQ ID NO: 475557 - DNA, 1065 bp, Homo sapiens
agcagtcttcactacaagtcagtcccttgggtgatagagtatgtttctgacaatcgctgcagctgacctctctgatcccatactctatagcaatgtgaccttgccaagaaatgaggtctatttcttctcccttgaacctagatggactttgattgggaggttaaagagaagtacacaaacccagcaggatgacatcactggtatgcatgaaagagaatgtgcaggaaaatccttggtgttatctctagaggatcttcattgtcagagccttggagatcctgaactagataaaatgagccccaggacaggtgaggagagtgtggaacagaaatctgagaaaggactggaggagaaagattccagatctccagatccagattccattctctttcttcaaagaaaccacagagctcaggccctggacgtgagaggagatgaactggattgagatggtcagaaggttaaggtcaacctttccctaacctttcctctttcaaatatcgtgttctgagaacatcaaaatgctatattaactgctaatattttttctattgttaaagtgattttaagatcaaacacatctaaattctaagaacaatgtatttatgaataatcaaaagaacaacagagaaagctattttcctgtcttcctttttctcgtaagtattagatctaaaagaatcttaaaagggaaaacaaaccttgtaatttattactgcctttgttatgtgagtggttggttttgatgttgttgataggcttatttaatatcacatttttagcttcgctggaaaaaattctctgaatgttttggttccccaaaattattacgtataatataaaaacaagatttcaagtaagaacaaaatactgatctgaaccttcagtgcatgtagcttcagcaaatagaaacttttgtggtttttaaaatataattgtatcccttgcctgataaaattttcttataataccttatgcaacagcaacctgtgactgaaaatagaaaatggaatatacatttttaaagtaaaatatttctttttaaacatcgtgcatcaatacctc

SEQ ID NO: 475558 - DNA, 1674 bp, Homo sapiens
gcagctgactccttatggctagttgagataagatggaagactcttacaaggataggacttcactgatgaagggtgccaaggacattgccagagaggtgaagaaacaaacagtaaagaaggtgaatcaagctgtggaccgagcccaggatgaatacacccagaggtcctacagtcggttccaagatgaagaagatgatgatgactactacccggctggagaaacctataatggtgaggccaacgatgacgaaggctcaagtgaagccactgaggggcatgatgaagatgatgagatctatgagggggagtatcagggcatccccagtatgaaccaagcgaaggacagcatcgtgtcagtggggcagcccaagggcgatgagtacaaggaccgacgggagctggaatcagaaaggagagctgacgaggaagagttagcccagcagtatgagctgataatccaagaatgcggtcatggtcgttttcagtgggcccttttcttcgtcctgggcatggctcttatggcagacggtgtagaggtgtttgtcgttggcttcgtgttacccagtgctgagacagacctctgcatcccaaattcaggatctggatggctaggtgatgagggccttgttgtgagtgatggaggggagaaggtgtttatgggcaaattcctgaaccttaacaaccatgagctatgggtgcagggaggagggccatgtcatatggtactgggacctccagaccaggcgttatgccttaatacgcgagttctgagattgaaaaatactgtgatcatcacttttccagagcttctcatcctcagttcctaatcaaggggtgttagcatgcagacaagaaccagggtaaggagactcatcagtgacctgttagtagtcatggactacaaggtaaagaaagcatggaccacagagtctgttaccttagtgaggtgctgtcaggattggtgacaatgtacaaaaagcatctagtactagaacagtactaatcaatacatctcccactcattgtcaacctgctaccagaaagccaagtgactcaccttccaaaaatgccctgttccctcctttttcttccacagctgtcagtgctaatggtgtcctccaggatcactcagctttagtatctgccttttctgtcttttgcttccttcatattcccttgccttctctttctgttaatgtataaaaccagtgatggcctgatttgaatgtaagggaagatgatgaccactggggtcactgagagccacagatttaagagctcttaagcattcattgtttgaaacaggatttccctagaggaaatttgtgcatttattcaatgaggatggaatcactaggtggtattcagcatctgtctcagagctcatcctgagtgctacgctgcatcacactccagaccacacagagctgcatgcatagcagaatttgtactctgcagactctacggacacctggaacccttaagagtagatgtgaatgtttcacttccgccatgatagcatgagttctgtggacctgatccacagaaaaactgaaaattactaaagaacataaaactaaccacttaaagtatctggaaatggcctgtaaaccaaaaagtatctaagacaggtcttaatcaattttgaggtttatttgccaaggttaaggatgc

SEQ ID NO: 475559 - DNA, 847 bp, Homo sapiens
tacacgagagaatttgatataggcatttgattcgtaaaagccattctccaggctctgagattctttcctccacttggtctattctgctattaatacttgtgattgcattatgaaatccttgtgtgcttttcagctctatcagaggtggggcttgctgactgtgcccaccaaggcttcatctgcaatggtggttgctgggggtagcggcatacagcaccgttacatgctggcagggcaagtgaagcaaaatccacctatgcagacacacaccagcaaagtgatgtggggacttactgtgggcttgtgggaagctagagtatggggagggaatgtgagggctgctgcatggccacaggaaccacctcactggagctctccactggtcaggcatggtccactgacacagaaacctcaatgtgggccccctggacacccaagactaccctgtgagcaggcatggtgtgcccgagcagctgctctaccaagactccacatcactgtgtgtcagacagaaggccctgtggaatggattcacgaagctcaggtgggcatcacagtcctactgatacgtgatgtcacccctggaggcccagctgtaaaattcctctctttatactctctttatttctcagccggctgacacttatggaaaatagaaagaacttacattgaaatattggggtttttttgtagctgaattcagctcttggtgctttcaggggagaagggtgaagactctgtattttatgagttccttggttatagagagtctctgtatgatggctttctcaggtaattgttgcagtagcaatgtgctcactgtgtgagcaggctcactgtttcctat

SEQ ID NO: 475560 - DNA, 589 bp, Homo sapiens
tcacccctacaggatttactcaaaatgttgtttggtcaagcctatgtagtctgtcacggcttcccttggctaggaaagggaaatccccagatcccttgtgcttcctgggtgaggcaatgccccgccctgctttggctcaccctccatgggcttcacccactgtccaaccagtcccaatgtgatgaacctggtacctcaggtggaaatgcagaaatcacctctcttctgcatcaatcacgctgggagctgcagattggagctgttcctatttggccatcttctgtcagtagtcttcttaactggagaaagttaatgaaatcggtttcttgtccaatcaaagttgtagttatggctggtggaacagggtttcagttagtcatcatctgtgagtgtttgacagagaatttgagtccaatgacagtaacagctggccccttactgagaagaaaggtgacagctgccatgccactgggattggtaatttccatagaagatggttaggatgccaatctacaagttgattactttggtgaaaatgtatatttgttttcctcagtccttcaaataggcagtttacaaaaacttgtct

SEQ ID NO: 475561 - DNA, 758 bp, Homo sapiens
ccatttctagaaattctaactctctttatatgagaaagttgacatgccaaaaagtaaaggtatacttggagggctcagaatacagaaagatgtcggaaacttgggaattcctgaagacttgttgaatggctttgaccaaaatgctgttagtgatatggacaataaggtccaggctgaggtggtctcagatggagatgaggaacttgatggaaactggagcaaacgtgactcttgttatgctttagcaaaaataccggcaggattttgtccctgccctagagatctgtggaattttgaacttgagagagatgatttagagaatctgacacaagaaatttctaaatggatgtgtcctgatgtaattatgggtggcagtggacgggtcccccatgaacatggagaaggcactgaagcacctggatgcacagcaaataaagaaggagcacacctttgccagcagagttggatggacgtttttgattgtgctacaggaagcgcagtgtacactcagtccctgtgggatgcagggcaggaaactggccaaggtgcccagcttgggagagacaccagacaaccagaggccacatgtggaattgacaacccactggtcctacaccaatgtacagaaagtgctggtgctggttgacactggcacagattgtagcatcgtctatggaaacctagataagtttcaggaaagactgaatatatagacggctatcgaggacagtcagtcaaagtaaaaccaccttggcatt

SEQ ID NO: 475562 - DNA, 535 bp, Homo sapiens
tccaggaccccgctgctctgtgcagcctcaggacctggtaccctgcgtcctagcagcttcagctccagccatggctaaaaggagccaaggtgtagttcaggctgtggcttcagaggaggcaagttccaagctttggtcgcttccacatggtattggagcactgcctagtggagctgcaagaagagggccaccgtcctctagaccccagaatggtagatccattgacagtttgcaccgtgagcctggaaaagcctcaaaaactcaatgtcaacccatgaaagcagccatggggggtgtacctcacaaagcccctggggcagagctgctcatggccttgggagctcactcattggatcagcgtgtgctggatgtttggatacagctgcagctacccagccacggctgtggacttgggcattcctgtgctcttggactcccagaagttgcccctgcccctgcaggcttggaaatgcctattccctctgcccagcctgtccccactcctggtgcccactgagatttcagagcaaagttg

SEQ ID NO: 475563 - DNA, 1298 bp, Homo sapiens
gtttgaaggggacaaatgatgaagtcagatcaaagacatgctggggccctgtagccaacagggtgaacatgagaacagcagtggcaggtggctgaatgggttctcagactggcagcaccaagctggaagggactgggattcatacccggatgttgactgcctgcacttggccagtgctgatcacaacacccttcaaccccagcaggagaggtatgggagaactttccaagggctatgtgggcaaaggtggcttcaaaggaattccctatgtgtcctgtgctaacacacgtctgcctgagaatgtgcctgtcgtggaggctggttctgtttttgcctcctactctttccagacgtttttctttcaccttaacaaagaaagacccagccctatctccctggaagtaccaaacagtgacattcaaaacaccgatgtctgcaaagcctccatgtccccctcaacctgattaagacatatgttttcaatagattgtatgtatatgtttattactcatataccaaaatttgtaatatgtttacattgccttgatcaaatgtatacaaataatggttacaatgatattcaatccagaggaaaattattagcactcagatcctaatggtcccggaggtaaaaaggaaactagaatttcaacttatatacatttttttcttgcatagaattaggataacaatgtgattataaaagacttactagcacaaaattatattagaacaaataaatttgatttcaaagaggaaaaaggaaaaatgtaaaattttatgactcataaagaagagtttgttcttgtattttttaaaatagctgatggtgagtatcaaattactatggtatttagattccattggaaacatttaaaagagtaatgtaacagttttatttataaaatgtcaatatttacaatacagtgggaattgcatcgttcatattatttaaatttatgttaattttagatgtcaaccaaaaatgtgcaaggacttacttagtgtatcaaaattctttaggaggtaacatgagcttaaaagtttgaagactttaacttttaaagtgaaaagactgctttatgggaccttatgcacagtaagtgcttaaaaacgtttgtagttgaagtttgtaaaacattaggataaaaaaaatcagtgcctaaataacttcatgaaatttattagaaagacagtatgtatgtttggtactgtagtaccaacgtataccaagggtcatagtggaacagtttcattacatggcatttgttaatgaagtttatgtacaaaaatctgcc

SEQ ID NO: 475564 - DNA, 725 bp, Homo sapiens
aaaacggaccaatcagttctctgtaaaacagaccaatcggctctctgtaaaatggaccagtcagcaggatgtggtccccttccacactgtggaagctttgttctttcactctttgcaataaatcttggtactgctcactctttgggtccacactgcctttatgagctgttaacactcaccaagaacgtctgcagcttcactcctgaagccagggagaccatgaacccaccgggaggaacaaacaactccagatgcgccgccttaagagctgtaacactcaccgcgaaggtctgcagcttcaatcctgagccagcgagaccacgcacccccaagaaggaggaaactccgaacacatccgaacatcagaaggaacaaactctgaacacgctgcctttaagaactgtaacactcaccgcgagggtccgtggcttcattcttgaagtcaccagattgaactgagtttcctattacttgcatccagatgcaagggataataaagataacttaaggtaaggtatgtgaatgttccccagaatatagtgggagttcattaaatctatattttaaaattaacctgaactttgtaaaagggtaggttaaaatagccaatgaaaatattttaaaattctacctttcaaagtaaaatgaggtgtgattttcatgtatttaattagccaaaattaaataaattataatattcagtgttgccaagaggatagggaaat

SEQ ID NO: 475565 - DNA, 562 bp, Homo sapiens
catttcagctggagagaagacaaacatgaatgtcttcttctactattacaactctctttatgttcctctctacagtcttccagtattgaggggaaagtatactatggataaaataacaaagctgctgtatgtacactggctgccactcagagtaagatgcagcctgtgtctctattcatatacagaacgtaactccaatgtcaggctgctagaagagataagaatccctgaaagtaaaacaatgtgttttgaagataagaacttgcttcctgaattgcacccaagtctgagagtttcactctatatttgtgaatttagaattcatgtggaggcctctttcagtgtttttcaacttggatgcacattagaattacctggggaactttcaaaaatccagctgcacaagcgcatgccaggaatgagcagtgctttgccttccattggagggacattgtcttggccaccacaagtgtaaacagctcagctttataatgattcttatgtcaacagagcatttcattaccactgaacagtaaagcagaataaactattttttaaataa

SEQ ID NO: 475566 - DNA, 1085 bp, Homo sapiens
aggtaaacaaagcagcggggaggctcaaaattggtggagcccaccacagctcaaggaaggctgcctgcctctgtagactccacctctgggggcaaggcatagctgaacaaacaatggcagaaacttcggcagacttaaacgtccctgtctgacagctttgaagagagtagtggttctcccagcatggagtttgagatctgagaacggacagactgcctcctcaagtgggtctgtgacccccaagtagcataactaggaggcacctcccattaggggccgactgacacctcatactgccaggtgtccctctgagacaaagcttccagaggaaggatcaggcagcaacatttgccgttctccaatattggctgttctgcagcctccgctggtgatacccaggcaaacagggtctggagtggaactccagcaactcccaacaggcctgcagctgagggtcctgactgttagaaggaaaactaacaaacagcaaggacatccacaccaaaaccccatctgcatgtcaccatcatcaaagaccaaaggtagataaaaccacaaagatggggagaaaccagagcagaaaagctgaaaattctaaaaatcagagcgcctcttctcctccaaaggaacgcagctcctcgccagcaatggagcaaagatggacagagaatgactttgacgagttgagggaagaaggcttcagacgatcggtaagaacaaacttctctgagctaaaggaggatgctcaaactcatcgcaaagaacctaaaaaccttgaaagaagattagacgaatggctaactagaataaacagcatagagaagaccttaaataacctgatggagctgaaaaccatggcacgagaattatccaaactaagcttcctaagtaaaggagaaataaaatccttcacagacaagcaaatgctgagagattttgtcaccatcaggcctgccttacaagagctcctgaaggaagcactaaacatgcaaaggaacaaccggtaccagccactgcaaaaacatgccaaattgtaaagaccgtcgatgctaggaagaaactgcatcaactaacgagcaaaataa

SEQ ID NO: 475567 - DNA, 655 bp, Homo sapiens
gcagactgcctcctgaaattctactaagatgtttctcaggcatttcaaactttgtagtagcccaatagcgccacatcaatgatgggagcagccccagtcttgttttcagcagcatttgcccatgtctgctcgctgaccaaagtccacagtttgtcaaggttgacagttgggcagaagctctggttcctctttaagtgggtcatggctgtggatcacgtggccctgaagtttccgggtcttcctcagtctggatggcacgttggtggcccggacgaaagggcaattgctttcttctttgatggaacaggatggctacagtgggccaggatggagtctttcccttctccaagaatcattagggattttttctccagtacgtactgccggaacatggtcaagctcctggagatgattctcaataacttctgcaaacagattcctcttcaacagtttatatgcaagagaggcaatgggcatgcaaatgatgaatataagttcttgtgtcttgttagagagtagatattcttccttccttcatccttcttccctccttcatttcatttctttcttccctaatggtctccttcttaagcctccgaatttccggtcatcattgttaaagtcttatttgtctttactctaaatgttttacaga

SEQ ID NO: 475568 - DNA, 653 bp, Homo sapiens
tgacacagacatcatagagtgtttgaaatttacgatcatggcagaaggagaagcaaatatgtttttcttcatatggcagcaggagagagacatgccaagcaaaatgggaaaagcctcatataaaaccatcagatctcacgactcactcactgtcaagaaaagagcatgggattcactggacaaagtgataaaagaaaataatgagctcagagattctaactcccagcttcagaagcagatactgagcctcaactctgctaagattgccctgagtgagagtcttatctcctgtagagaaagagctgaaattgtggaaaaacagacactagctcctattatgggagcagctgacctgcagcaaaaggtgcatgcacagcctcaccagttgtcttttgttaaagtaaagccattgattgaaaaagtatgggactctgcaacttcgaaagtggatgtgtgggaggaccctgatgaagctgggtatactgagcttgtaaactatgatgaatctattttgccagaagaaacagcttctccatccccagtagtggcaacatcccctcctgacccatgctgttatcagcttttccacctttgtctgagggtataaaccctgcactgctgagagcaacagtgatggccttcgctgaggcagt

SEQ ID NO: 475569 - DNA, 1412 bp, Homo sapiens
tatccccagcagggagagcggcttccctggccatcctacgcaaagtagcccctgctttcccatctgactccctgtaactcctgccttggcagtccatgattccagaagagcctcttctcaagcatgagggagcatcggccctcagacccagcttacacaaaggagggggctgggggctggtccactcagctgtctcagataagatttctgaggttagagctgaccaggtcctgtgccgcttaaactggtcggggcttcccgttgccctcaagggcaagccaagcactggaggctgcccgggcctccattcccagcctcagctccctgggcgcctcacctttgccctagccttggacccagcaactacagagggtctgcaatgtgcaagtccctactacaccgaggctcggggaagcattaaagacctgaccacctacccaatggagcagctggaggaagatctgagaagagagtttaagacagagggagcagctcgtgcaaaggccctgagaaggtaagcaccatgaaggcagagacgatgcaatcacagtcgatgcctacttagcagttaccaagtgtcagactgcacctgctgcccctgcaccaggacatttaaacctcaggacaaccctacagacaaacactatcgttctcttcattttccagacaaggtccacagtcttagtcaacaagacacagaaattaaggagcagagctaagactgaactcaggcaggctgcattcagagccgagacttttatccagaggactcacctgcctctatttggtccaccactgcctggcacacagtaggtgctcagtaaatacatagcaaatgaaaggatgttctctagaggggcagtcacagggttaagaatttggtgtcccctgatgggaagggtaatgatgctggaagagcacagccgcatcattgaaataaaacacaaatgaaaatcaaaagataacaacatccaactatttgggctgtctatggcccaattgcccacctgttccctgtgccgccctgtccccattaagtgaaaagctctaggagtttcatctggttagagctgaaaccaagtccttaatagtgtttacagatgaggatagagccacctggagcaggagggctttcaacctgacagtttccccgcaaggaaatgaacgcgctggtcctgcaggaatcatcttcaaagccagacaacctggcttaagcacagcatttagaagaaacgaatcacgcccccaactcccaccaaccagatggctgggctgtctttctcttgtggaatgaggggcctgcttcacacagctgtccaagctgtgggctgaaatgaagatgctggaattcctcccctctgccctttcatcctgcagccttctggggcctgtggtcctgagtcagatgtggg

SEQ ID NO: 475570 - DNA, 1221 bp, Homo sapiens
ggatgagcagtttaggctgttctcccttcaccatgagccagaggaagggctccttcctttagcttccaccatgactagaagcttccagaggactcaccagaagctgagcagatgctggcaccatgctgcctgtacagcctgcagagctgctcatggcaaaattgagcagaaggtacagagatttcgcatatactcccgtcctcacatacacatagacttctccactgtcaacattccccaccagagcgagtggtgcatttgttacagtctgttaacgacactgacacatcagtatcacccaaagtccatagtttacattaggattcgcccttggtattggacattctgtgggtttggacaaatgtctagtgatagaataatatttcattctctggatgtattacagtttattcacttacctgctgaaggacatcatgcttgcttccaagttttggcaattgtgagtttggatgctataaacatccacatgcaggtttttgtgtggaaatattttcaattcctttaggtaaatgccaaggagcacaattgctaggttgcatggcaagagtatgtttagttttgtaagaagctgtcaaactgtcttccaaagtggctgtagcatttttcattttcaccagccctggatgagacttcctattgccccacatcctctccagcatttggtggcatccgagttttggattttggccatttaactaggtgtgtagtggtgtctcactgttgctttaatttgaatttctctgatgacacatgatgctgagcattttttcacaggctcgcttgccatctgtgtatcttgtttgtaagagagcaggcaggcagcctggggctgaatctaggaatgcagaggacagcttgacatttatatagtgaaaatgatatgctagccatgagcgcatgtgtgtggctgttttgggtgtgttgaagtgtatagaaggcagagagggtgtggctgtgtgttcccgtttgtagagacacccgtgaggctgtgggtgattgtccaggtgtggacgcgtgtgatggtgctgtgcttgcctgagtcaaggacataagcatgccagtgggtggaggaggggatgtctctgggtgggcggcccgggtggtcctggcctgataggcggtttgaggaagctgagtgggagctgacctcctctgcgcccttgatcagccagaccagcagagctcttggtcatttaaggc

SEQ ID NO: 475571 - DNA, 1362 bp, Homo sapiens
ccctgggcagggaggaagtctggcactcaccccactcccagcccacactcccctccctgtgcaacctgtcccctctgagttcagcaggccttcatgccccactcctctgagcagcatctccatcccctcctccgcctaaaatgggctgtccccaggacgcggtgccctgggtgtctcaggtggaagaagtttccccacactggggccctgggagctggagcggatggcactctggagcagctgagtgttgctgggtaaaatcccacctatcacagtcagcttggctgctctcacaaaatcccaccaactcagggcttaaacagcagactgttatttcctacagctctggaggctggaagtccaaggtcaaggcgctggtgacttggttcctgcgagaagtcaccgtctatgagaaagtggccctcaccagacacggaatctgctggcaccttgatcttagacttcccagcctgcagaactatgagaacttcgtctcccacctactgtgtcttccaaatgccgcaaaatcctccctccagccccagcgggcctgcctcttgcacttctccccttctgcccaccctccccagaaccctcccaaaaagtggagaggggagaagtggaacaaactaagccagcaggacagaggcaagaaaggctcagcatgcacccaggtggaaggaacgtcccaggcatggcctgacgccgatgtctgtagccgtcagaaaacttcctcttaggataccttccccaagtcctgtcttcctcatctgccatgtggtcatttgtttaagtgaagaaatatttgtggggtgcccactacgtgccaggcactgttctgagcaatagggatgccacagtgaactagatcttgtccctgttcttgaggagctgataggtactgaaggagacagagaagaaaatgcttacagattaatccagcccggtgatgtgggggcaggggtgaggtctgtcgggggaggctttctggaggaggtcatatggaaaccaaggtttggatggtgagcaggttagtcagggctcccacgatgtcctggttttaccctcgccagaacactggccattctgttgtaacatctgcttccatttctggccctggcccctggcaatgaggatggcctttgttgcattaaacaataataacttttttcttattataacaataaatgtttcttatagaatttaaaatttttcttacatgtagagaagcaaaagaagaaaattaaaccacttttatttcaccctcattgtacttccatccagatgacttttgttaacattttggtacattccttcagccttttattcccatgactaattgttcatgtatattttaatgtt

SEQ ID NO: 475572 - DNA, 928 bp, Homo sapiens
ccatcagttaaggcaggaagcagccatctggatgtgagtttctgctggagctagcaggccacgggggaaaagacctgtttcaaagtttgaaatgggtcgtaaagcaggggagacaactcacaacatcaacaatgcatttggccctggagctgctactgaacgtacattgcagtggtggttcaagaagttttgcaaaggagacagagccctgaagatgaggagtttggtggcaggccatcggaagttgacaacgaccatgagaccagtcatcaagctgatctcttacaactacacagaagaactacacgaatcgatgagatgcactgaaaactgcaatgcctgcagctggcattggtcaacagaaagggcccaattcttctccacgacaatgctcgtggagcacacattccacattccacgacacattccacaaccaacacctcaaaaattgaacaaattgggctaccaagttttgccttatccaccatattcaccggacctctcgccaaccagctaccacttcttcaagcatctcgacaactttttgcagggaaaacacttccataaccagcaggatgcagaaaatgcttttcaagagttcatcaaattccgaagccgggatttttacaccacagggataaacaaacttatttatcattggcaaaaatgtgttgattctaatggcatttttccccccaagaactggggaatcaatccacctttcctcttcgctatgagatttgggaaggaaaatgaaggagaaatgcttacagtcatataagcttgagttaaataattctagaaggtgcttcttacatcttgaagagtatccttcactgagaaagtaaatataaaagggaagcatgatttgagggaagaaggcctttggaagaatttagcttttgatatttttaagtgaattatcact

SEQ ID NO: 475573 - DNA, 1180 bp, Homo sapiens
ctgctagcacaacagtctgagatcgaactgcaaggcagcagcgaggctgggggaggggcgtccgccattgctgaggcttgagtaggtaaagaaagcagccaggaagctcgaactgggtggagcccaccacagctcaaggaggcctgcctaactctgtagactccacctctggtggcagggcatagctgaacaaaaggcagcagaaacttctgcagacttaaacgtccctgacagctttaaagagagcagtggttctcccagcatggaatttgagatctaagaatggaaagactgcctcctcaagtgggtccctgacccctgtatagactaactgtgagacacctcccagtaggggctgactgacacctcatacagccaggtgcacctctgagacgaagcttccagaggaaggatcaggcagtaacatctgctgttctgcaatatttgctgttctgcagcctctgctggtaatacccagacaaacagggtctggagtggacctccagcaaactccaacagacctgcagctgagggtcctgactgttagaaggaaaactaacaaacagaaaggacatccacaccaaaaccccatctgtacatcaccatcatcaaagaccaaaggtagataaaaccacaaagatggagagaaaccagagcagaaaagctgaaaattctaaacatcagagcacctcttctcctccaaaggaacacagctcctcaccagcaatggaacaaaggtggacggagaatgaatttgatgagttgagagaagaaggcttcagacaatcggtaaaaacaaccttctccaagctaaaggaggatgttcaaacccatcagaaagaagcgaaaaaccttgaaaaaagattagacaaaaagctaactagaataaacagcataaagaagaccttaaatgacctgatggagctgaaaaccatggcacgagaactatgtgatgcatacacaagcttcagtagccgatttgatcaagtggaagaaagggtgtcagtgattgaagatcaaatgaatgaaatgaagaaattcagagaacgccacaaagattctcctcaagaagagaaactacaagacacgtaatagtcagattcaccaaagttgaaatgaaggaaaaaatgttaagggcagccagagagtaaggttgggttacccacaaagggaagcccat

SEQ ID NO: 475574 - DNA, 728 bp, Homo sapiens
ccattactaattctgattttctaaattactcatttcaacaaatatttaacaaggtcctgttatggtcacggcatggcactatgccagatgactggaaagcaaaagctaaacattcttccgacaacaacaaaacaccacaagctatacatctcagcttgttcttcaacaagcacagtccatttctgagccagtgtttggaatttgaactgacaactcaacccaacaattttgctgctttgtctctctatctcgagttatttttttgtcacatcttagtccagggtgtgagaaacagagctcttacagattttttttttaatcttgctgaggaattatctctgtttcagctccacaacattccttttgaacattctcccactgagcatgtgttcagaggaacttcagcctcatcagtaatctatatctcagctgtcactacttttccagaaaaacctgaattctcagtttcaatggaacacacaaaataagttctcataagactaagatacatccaagtgtgtacacattcacacacccttattcattcatttgtttcagtgtgggcatatgtgtgtaaattttaaaataaataccttgctatatactctctctacaacttaacactttttatcaacaatgtgttgagggcatttttccctattagtacatataaaactaccttattcttttgagtatttatatagtattttgttatattggttgagcca

SEQ ID NO: 475575 - DNA, 1156 bp, Homo sapiens
ctctggcttggatcaaagcaagatgggacagagagctaaggctggtgctggcgaatgtaggctggtgctggcgaatgtctacaaagagtcctgtgatgtgatccatcttcaggtcttccagccatggataccagcacctgctctagtggagttggcaggggagcgaagtggactgtgtgagagtccttggatgaaatttgatccctctcttgatgttcagatttggggagccatattccaaaactcttggtactttcctccattgcgtaaagacacaattctaagaacatttgtgaaatgtaaaagacagagtccaagaccctgtaagcatggcctacacgttgcctctgcggtaatggctgcggtggaagtgctgggtcttggaattactccactattcctattgacaagcaaattctggagcacagccagagtggaaataaaggatgagttactatattgaaacaggaaatagaatttaagaaaataggtacaaaattcagatttttctctctggaggaagatgtttccgaaaagaaaataattagcctttggtgaggttggaatgtaaggaatgaaaagtttgcatgaggaaggtgaaaaggcatgcttggagggagcacagaaaagagcagacctatggatattccttggggtatagacatattgacagttcctatacagcctattgccataggtgtctataaaacattaagctctgatatgtggaaagaccagatttagaaaggcctcagctattcactcatgccttcctgagttcagtaaaacacatggagaaataacaatcttaaaaaaaattgttcatttattttctttttgtgcattcagtgtatgataattatagacacatcatttatgaatgacaaaactattctctgattatctgggttaaagccttggaataagttatcgtgtttacctgtgtttccttcatgatacaaactaaggactaaattgttattcaaaatgtcaatcgtcattccagaagaggctttgaaaaaattataatctagatagatccaccagacagataccagccaggacttttcttatgaagcatacaaaatatttaatggtgtctgtgcctagaattggattcaagtcagataataaggcaaattcagagaaaatgatt

SEQ ID NO: 475576 - DNA, 1470 bp, Homo sapiens
ccctaaacagaggaagctgcccagtgttacacaggtaatgacagggcaagtatccttgactaggtggcaagcagactacatcgggtcactgccaaagttgcaagagtatacacatacactaacagctgtgggcatggccacaggcctgttgttcgcctacccttgcagggtggccgaacagcggaacaccatctgggccctgcaacacttatgtgccctgtatggttgccctctggccattgggcgtgataggggaacatatttcactggacaacaggtacaacaatgggcacaaccaatggacgtaaagtggggattccgtgtgccatacaacccgcaagctgtgggtatgattgaacgatataatgagctcttgaagaataggttatgcttgcatgtcacacccccatctttttggggccgcagttcaaggttggacctggtgctccaaaccttgaatgaagagccacagaaatgtggctggtccagccctggtgaaggctttgttacactgggctgcccaccccccaaccaccttcagttgcagatacacaccaagaattacctcctccaaccaggtatggggatgaatggaaacctgttgttgcctgcccctgtggcctacccctgtggcccctgaaggcagggaacagaaaacctggctttggccatggaccctccaagaccccactgccagtggttggccatcatagctctcttgggggagggcctacatcatgacttgcatgtcactccttgggtgttcaatacatggcccctgcggttgaccgttcatagagaaatggccagggaaggaacccttctccaggggacatatgtactgtctgtgtggcctatcatgagcttccctgtgactttggcacagatacaagactcaaaggaaccatgcggagctgataaagtgtggcaccatctcccagggcaaaaactgttggcatctgcattgttatccagagatgaaaggttagactgtattttgcctgagggacatgatttaactctgttagtacctgtgcctgctctgtcatttcgaccgtaggttgacatgctccaactgcattgtggactgggcccacaccttcactgaggtgaccaatgtttccaactgttggatctgcaccatccttccaggagcagctgcagatggcttgccttggcacatacattcagcatctgcagagaaatggacatggctggagactttgagtcccatggccgacacctggaatgcgacagggcaagctgcagacaaagaattccgcaagacccatagcatgcctgccccatcttgcctgtagcatttatgatgggaggggctggctagtggggaaatatgtagtacccccagctcagggacggcagtgcatagaggaacactggggtaacaccactgtgggatggctaccctgcaaggcctgtgtaaacataacacatgtcaccacaccgaag

SEQ ID NO: 475577 - DNA, 789 bp, Homo sapiens
caccagaaaggacagcagtgtagggacgctagcccagagacctcttttaataaaactggggtggagaggttggtggaagggagggcgctgttaccaccgccacctgacattgataagtacttactggctgccagatcagtgctaagtgcctcacacgcatcgtcctttggactctcagagaaacgccatggggtgtgggtatgcaaggcacacttggtaccacgaagcggtctccatagaagctggcctcacctggctgttaagtcaagcagggagcggcgggtcttgctgctctaggacagtagttctcagccttatcagacataaaagcccctttctgtatgaaacatttcttctggaacctaagaagtccaagaggaaagtgccagatgattcagttcctggtgaggatcctgtttctggtttgcagacgactgcgttcttgctgtatcctcacatggaaaagagagttttctcatgtctcttcttaaaatggcaccaatcccaccatgaccgccctacactcttgacctcatgcaaacctaatcatctcccaaaggtcctgcctccaaataccatcacactggggctagggcttcaacctagaatttttgggggtgtcacaaaggagcccttaggaatgccgaagtcgagttaactgactggaacgggataatgtacttgttagcagaaaccagcaagggttgagttccttctgtttattccatttgagtctagcccccagttcatggatccaaataattttggatttctttaaacagaattgtc

SEQ ID NO: 475578 - DNA, 995 bp, Homo sapiens
gagttaatgggtgcagcacaccaacatggcacatgtatgcatatgtctgctggagtttgctggaggtccactccagaccctgtttgcctgggtatcaccagcagaggctgcagaacagcaaagattgctgcttgttccttcctctggaagcttcatcccagaggggcacccaccagatgccagccagagctctccttcaggaggcacagaggtcggggacccacttgaggaggcagtctgtcccttagcagagcttgagcactgtgctcggagatctgctgcttttttcggagccagcaggcaggaacgtttaagtctgctgaagctgcacccacagccacctcttcccctaggtgctctgtccctagaagatgggagttttatctgtaagcccctgactggggctgctgcctttctttcagagataccctgcccagagaggaggaacttagagaggcagtctggctacagcagctttgctgagctgcggtgggctccacccagtttgaacttcctggtggctttgtttacactggtcatcaggcagggacatttaagtctgctgaagctgcacccacagccgccccttcccccaggtgctctgtcccagtatatgggggttttatctataagtcccttactggggctgctgcctttttttcagagatgctttgcccagagtgtagaaaactggcagtctgcccacagcagccttgctgaggtgcagtgggctctgcccagttcaaacttcctggctgctttgtttacactgactccaagtttaagagttaagaatggcccctggactgataggggccagaaaactgaggccaaggagggttaataaatgttctaatgtcaaaaagtgaggcactggcagatccagtactcaccctgaggtctgatgtaatttcatgctctttcaactctaaagcctaaaggaacacaaaataaacttagtatttctttcacattatagtacatacttaaattca

SEQ ID NO: 475579 - DNA, 491 bp, Homo sapiens
tgaggaaaaactggagtgagctatgcactgccttaaatcagtgcctcgttatagcaccctgggggaggtcctcaagaccctgctccagaggtggctgctgcagccctgcccatggctggtagccagactcttgggaaagtcaagtctttactgcctattggagatcaggatggagcagctaaaattcctgctctacagcaaatctgctgactccctgggctgttttggaggagggaaaggaaggcgattttatcatgttgttctacaagaaagagaagaatcccccgagagtaaccagagaagctgcagcaagagtgccagccaggcagattctcttatctcctggactctgcttggagaggccgaggaacaaagaagaatggcaggggaggaacgggaccgctgcacagcctcgtcatcttttaaacatgtttcttggaaattcagaggcatataggagcaaatttagcttctaaatggcctattcccat

SEQ ID NO: 475580 - DNA, 815 bp, Homo sapiens
tgaataccagaagacaggtattaggggatactgctgttatctcctccttcacaatgagaggattgagacccagagagcttattgttccctgtttctggaatgttccttcttcatctctgatcatccacttcctactgagcacctttgactaccctcatccaaagggctcactctttcaagaacccttttatgattcttggagacttcccagctcacaggaggaggagttccagcttcaaggagagcaagaacttggcacctgtccctgggctgctgcagcagtagccttgcacaggctcctcctgcccagggacgccataaatcgctgggccacggacttgacagccagctgcgatgtgatcagaaagccaacaggagccactgcagaacctttggtggctgcttccttcatgggcctctcatccatcatactagatggaaaagccactgggatagtcaccttctttcccagtggggattcagggagcctaacagagtgcctggaattgagggttctcagtatatgttgcaataaaccaggcaacaagtcagattaatcaaatgatcaattatttaatcactgaatgccaagttagaaggcattttagctcacttcatacctaagctttaagcgttgaaaaaattataagctccttttcctgtcattcctttgtctctgaatcaaccaatgggcatctcatacactcaactctgtggcatctaagttatgttcctataaattatctgccagctctgatttttagtactgatgggctttctaaggctgtgtctcctctctctgctgccaagtgagt

SEQ ID NO: 475581 - DNA, 518 bp, Homo sapiens
ttcaacgaggccaggaacggggaggggttttttggatacacaaaaatgcataatgtgctcatagctgaaccttataagtttcaacaatgccagggctgcaaactactattaaagccaattattccatgtctgatcagtagtgacttaaaagcgtcaaacggtggcaacctaacttcaccaagatttaaagccctgcttcaacttcttgacagagatgcagataaatggaatgctgacagaagaaagcagaaagcaaccaaaaatgttgaattattatgtaatagtgggcacttaaatgtaccaactttgtgccaggccttggaaaaaggcagaggctgtgatgtcacagctcctccaatgacacagcatcaggggacagccagaaatagacatgtggaagcccttgccactggcactctcttgtactctgaaacaacccatttctctcagctcagacaccaggctgctggagaattggagaaccaaaatagactgaacgtctagtcaccctcctagaa

SEQ ID NO: 475582 - DNA, 806 bp, Homo sapiens
tgaataccagaagacaggtattaggggatactgctgttatctcctccttcacaatgagaggattgagacccagagagcttattgttccctgtttctggaatgttccttcttcatctctgatcatccacttcctactgagcacctttgactaccctcatccaaagggctcactctttcaagaacccttttatgattcttggagacttcccagctcacaggaggaggagttccagcttcaaggagagcaagaacttggcacctgtccctgggctgctgcagcagtagccttgcacaggctcctcctgcccagggacaccataaatcgctgggccacggacttgacagccagctgcgatgtgatcagaaagccaacaggagccactgcagaacctttggtggctgcttccttcatgggcctctcatccatcatactagatggaaaagccactgggatagtcaccttctttcccagtggggattcagggagcctaacagagtgcctggaattgagggttctcagtatatgttgcaataaaccaggcaacaagtcagattaatcaaatgatcaattatttaatcactgaatgccaagttagaaggcattttagctcacttcatacctaagctttaagcgttgaaaaaattataaggaatttatagtctggatgggaaagcagaaaaaatacacaaataattagtgtgcagttaaactaaactgagaatctttgcataatgcagtgggttctctgaaaagggaaacagccatgtgggtgagggttgggcatgtactgcaggaatgtgtgcac

SEQ ID NO: 475583 - DNA, 1522 bp, Homo sapiens
tctggccagtttcatccaagaatgctccagcgcatctggctggcagccatgaagctcctaggaatcaaggctcccaggggcaagccaggcatcagcctggtgcaccagacctacacatggccctgccaaaccctgccccgctcctcctgccccttgccccatccttggccctggttgtttagcagtatccccagcctctacctgccagatgccattagcaccaccactcccaagctgggtcagccaaaagtatcttcagacattgccaagtggtttcgggagttttccaccatgactattgccctgctgggttttgccatattcttgctccattgtgcgacctgtgagaagcctctagaagggattctctcctcctctgcttggcacttcacacactcccattacaatgccaccatctatgaaaattcttctcccaagacctatgtggagagcttcgagaaaatgggcatctacctcgcggagccacagtgggcagtgaggtaccggatcatctctggggatgtggccaatgtatttaaaactgaggagtatgtggtgggcaacttctgcttcctaagaataaggacaaagagcagcaacacagctcttctgaacagagaggtgcgagacagctacaccctcatcatccaagccacagagaagaccttggagttggaagctttgacccgtgtggtggtccacatcctggaccagaatgacctgaagcctctcttctctccaccttcgtacagagtcaccatctctgaggacatgcccctgaagagccccatctgcaaggtgactgccacagatgctgatctaggccagaatgctgagttctattatgcctttaacacaaggtcagagatgtttgccatccatcccaccagcggtgtggtcactgtggctgggaagcttaacgtcacctggcgaggaaagcatgagctccaggtgctagctgtggaccgcatgcggaaaatctctgagggcaatgggtttggcagcctggctgcacttgtggttcatgtggagcctgccctcaggaagcccccagccattgcttcggtggtggtgactccaccagacagcaatgatggtaccacctatgccactgtactggtcgatgcaaatagctcaggagctgaagtggagtcagtggaagttgttggtggtgaccctggaaagcacttcaaagccatcaagtcttatgcccggagcaatgagttcagtttggtgtctgtcaaagacatcaactggatggagtaccttcatgggttcaacctcagcctccaggccaggagtgggagcggcccttatttttattcccagatcaggggctttcacctaccaccttccaaactgtcttccctcaaattcgagaaggctgtttacagagtgcagcttagtgagttttcccctcctggcagccgcgtggtgatggtgagagtcaccccagccttccccaacctgcagtaggggtttgagggccaatggaacgaaaacgtacgtagaggcctaatat

SEQ ID NO: 475584 - DNA, 1217 bp, Homo sapiens
gacagcaccacccagaagttctgctcagagcgatgccgctggatgtcacgatggggactgactccagcaagaaagggctgactgatgcagatcctgctctgcagacccagaattggaggtgtggaggcctcgagctggaggaattggaggtgtggaggcctcgagctggaggaattggaggtgtggaggcctcgagctggaggaattggagcattgcttgcacaacgctcaagtgtcccaatgcgttcctgggtcacatggctgggggacataccccctgtggggctagtgccatgtgctgtggctgcaaacacagggcatctttgcgagatcatccagataacagcggcagccagctcttcaaacgtgccaggcccagggcccacagccatcttcccacacgttctcacagcaacccctcgagggaggaatccatgctgatgaggaaattgaagttcagagaggcagggagactgctcaaagtcacacagcagcaagcactgagaatggatttgaactcctgtctgcctgattctcaagtcaggcctcttgatcccatgctgtgctgcaaatggggctgactgagaagggacataggcacttcccactgcgcatgggcgacagctaggggctggcatacagtgtcctcagtgcgtcccgattaggggacagaggttgagaagtctactcgtggggcagggatggacagagcccgagtggcccaaggcccactggataagcagaggtccagctgcagagagggcttagggggaaagggtggacagaaaaggccctgtggcccaggctgggtcagaaagcctgtgatctggggtccagttgtgcctctttccagctgtgtgccactgggcacgttacctcccatctcgctgcctctgcttcaacatctgcacagcaggaaagttgtggaggactagcacctctgtccaaaagtacctggagggggtctggctggaggacaggcccggccaagcctgtgccctctcccttccttccctctctatgtccattctccctccctccctttcttctctccctttacctcccttcctttattttctccctctccaaccccctttttggaaattccttttcagaggctttgcagagacccagtcctccttccagggtgatctcagtgctcccagtggagcactgactctgaggccacctttcaaggggtttggggggtggggtgg

SEQ ID NO: 475585 - DNA, 841 bp, Homo sapiens
gtacatgtgcaggatgtgcaggtttgttacacagaaaaataaaaagatgcctttcaaaatattacttctcactgacaataagcctgatcacccaagagctctgatgcagatgtacaaggaaattaataccattttcatgccagcaaacacaacatctgttctgcagcctatgaatcaaggtgtaatttcaactttcaagtcttattacttcagaaatacattttataaggctatagatgccatagacaaggattcttctgttggatatgggcaaaataaattgaaaatcttctggaaacaagtcaccattccagatgccattaagaatattcatgttcatgggaggaagtcagaattctgctctgaacttcagctttctcgttcccaagttctaatcatttccagctggcaaaaattcatggtggttgaaacgagaaagagaatgaatttgattgaaagattaaaaatgtttcttggagacagtggtttcaaaggtgggataggatcacaggaagaaaggacaaatgctggaggaagtaacagcaacagccaagctacaaagaaagcaatgggggatgacttaggggacaggtcctatgttctccattttggctgctgtgttttggtgcatcttatataacacccaaattaatttgattagcctattttgatttcactgattcgtatctaaactttcttgaattcacttgtggatctatcaaaggcgtcttaaactctattttcatatttttatctctagcattgtaatttttctgtttcttatggctcctgaaattatccatatgtttatagattttgcctaccttttccagtagtcttt

SEQ ID NO: 475586 - DNA, 445 bp, Homo sapiens
tgcagttctcacataaccaggatgaaatgtatgaatgagtgtaggacctctgggattggtgagtggcataaggtgagtacttataaatgtggactcttactgatatgtggttaccactgggggccacagagaccttcccgctgtactttccagaaggcaaccattgtggacattgtggggctgttaggcagcctttcagttggtgaaaaattgctcctggaggcttcccaagttgtcagcatagagttcctgctactgtttcagtgtccacaaagctggccctggtcctatttgtggctgctggccccttcctatttggtcaccatcagtgatccacagataacatccctgagggccctgtccagaccttggactatgagtgaccctcaaggctactttgtttggctgacgaccctgacgaacccctgattttatattttctagg

SEQ ID NO: 475587 - DNA, 1577 bp, Homo sapiens
agcggatgcgaaagcgggagcagcagatgcgaaagcgggagcagcagatgcgggagcgggagcagcagatgcgggagcgggaggagcagatgcgggagcgggaggagcagatgcgggagcgggaggagcagatgggggagcgggaggagcagatgcggaagcgggaggagcagatgcggaagcgggaggagcagatgcggaagcgggaggagcagatgggggagcgggaggagcagatgggggagcgggaggagcagatgcggaagcaggaggagcagatggggaagcaggaggagcagatgcgggagcaggaggagcaggtgcggaagcaggaggagcaggtgcggaagcaggaggagcaggtgcggaagcaggaggagcaggtgcggaagcaggaggagcaggtgcggaagcaggaggagcaggtgcggaagcaggaggagcaggtgcggaagcaggaggagcaggtgcggaagcaggaggagcaggtgcggaagcaggaggagcaggtgcggaagcaggaggagcaggtgcggaagcaggaggagcaggtgcggaagcaggaggagcaggtgcggaagcaggaggagcaggtgcggaagcaggaggagcaggtgcggaagcaggaggagcaggtgcggaagcaggaggagcagacgggggagcaggaggagcagatgcggaagcaggagaagcagatgctgaagcagaagaagcagatggggaagcaggaggagcagatgggggagcaggaggagcagatgcggaagcaggaggagcagatgcggaagcaggaggagcagatgcggaagcaggaggagcagatgcggaagcaggaggagcaaatggcggagcaggaggaacagatgcagaagcaggaggagcaggtgcgaaagcaggaggagcaggtgcggaagcaggaagagcagatgcggaagcaggaggagcagatgcggaagcaggaggagcacatgcggaagcaggaggagcagatgcggaagcaggagaagcagatgggggagcaggaggagcagatgcggaaacagaaagagcagatgcggaagcgggaggagcaggtgcggaagcgggaggagcaggaggagaggctgtgggttgagtatgagaagatgcaggaggaggaggagaaggtccgggggcaggtggagaagatgcgggagaagaaggagaggatgggagagcaggaggagaagatgcaggaggagcggtgctcagagccctgcctccctccctccaaatatccttgtgatatgagccatgctggcagcctgaagcctgcacgagaggctgggaagggctattcccatgacaaccgcactgcacagcagatcacgcagctgccccctggaatgaagaacacccaggagcacccaggcttaggcagcacctcctgcatcctattcttctaccgaggagacaagaaaaagatcaagatcatcaatatctaaaaagaacggtcaacaaggcctacagaagtgtaagccgccacgtgaccttgtgaatacagtctgagaacaaacttgaaaaaaagaaaatttattttaaattgtggcaaaata

SEQ ID NO: 475588 - DNA, 581 bp, Homo sapiens
caggggtcacaaggtggaattcttgataaatcactcctatgattatggtcaacttcctgtttttcctcctggagatgtcagtttgttttcaaaacagaggtatcagtcaggagcgctattgcttggacaaagtctgctgtgggtctgggttcctgtccgggtgcctgccttacgggctgtggctcaggctttcagaccacttgcttggatcctggacatctccatgtgaacatgtgcacccaccatcgtcacaggagaataagagagaaatggagagacagcgccagcaaggacagctccagcctggaggagcacgtggtactgcgctttgctcttctgtagctagaaaaatggctgccattcactttgagggtggggagtttactcctggaagtagagaagaaaggatcctgctacctaggcttgccctttctttgccacagtcgtcttctgagaactatcatgtgaccctttcaaatgaaaacgtggtcacatgatactcttaaaaattaattttcctactccagcatcatttgatcgtgttctcacctgcaaagaaatggaatcgaagccctcacctt

SEQ ID NO: 475589 - DNA, 537 bp, Homo sapiens
gcaatttccctgtcttgataaatcagctctgtgtaggcggcctgcacaaatgacagctgatcaccacattgtactcctggaggaggagattaataggagcatgacagacaagtttcagaaactagagttcctcaagctgaagaagagagaaaggcagaatatttcagtagtgattttcaattcagggcacttctttaacaaatatggaaaagttgatcttggagtgctttcatccccgttcaaaggcagtgatagacaacaggaagaacaagaaagggaaggcttcttggaggcagtaactgagcaacatattccccgacaaaaaagggttgttgaaatgatcagctatagcacttatctcataatcaagaaaatatcatctttctgctctggaatttcctcagtcataaaaagatcaagaattcctgggggtatgctcaagttaactggtcaattcctcgctacaattgcctagtaagttgaaaactagaaattctaaccaatctgctagttgattctgttgtctgctggttgctc

SEQ ID NO: 475590 - DNA, 670 bp, Homo sapiens
gcaggggggtgcccacccccctgcaatatggattgtaatatccaggggaggagagggggcgttcgagttgggagtttgccctgcaagagacagtcaaccactgacttcagtcgaacgtacttggaaagggaagaacttaaaccagccatgaacagaagaaagccaggttttctggaaacatcgccaaaacccagcaatttctcagaattttcagaggcgccaggggggtgtttgcatttcaatggaaaaagttctgaaagctctggaaacttttctcagttttactttctcattgaaaggcaaaaaccatggctggatgcagctacaatccaaggaacaccaaggattgccagcaactaccataaactagaaaataagcatgaaacagactcttcctcagagctcctggaaagaatcaacctgaagacagctttgtttcagattcctggcctcctgaattgaatcagtagagagggtcagggcagtgatcagggaagagacaatggccaatgtgaggatgcaatatctagttggttgccttaaactacagaaccattagaagaaagaacgttaacaatgtttttatactgtctatttaagagagaaaggaggaataatatatccacatggtcacatttccctttgattaaaagtttacccatgggacatt

SEQ ID NO: 475591 - DNA, 596 bp, Homo sapiens
tcctcttggtcccccgccaagggaagctgtgagtgattgtgccatgagcaacggtgcattctggcccagatactacacttttcccactgtctttgcaacccacagaccaggagattcttttgggagacacctcccagcaggggttgacagacacctcatacaggagagctccaactggcatctggcaagtgcccctctggaacgaagctgccagaggaaggaacaggcagcaatctttgctattctgcagcctctgctggtgataagcaggcaaacagggtctggagtggacctccagcaaattccaacagacctgcagcagagggtcctgactgttagaaggaaaactgacaaacaggaattgcatcaacatcaacaaaaaggatatccgcacagaaaccccatccgaaggtcaccaacatcaaagaccaaagaacgcctcttctcctccaaaggacaacaattcctcaccagcaagggaacaaaactggacggagaatgagtttgacaaattgacagaagtaggcttcagaaggtgggtaataagaaactccctccaagctaaaggagcatgttctaacccaatgcaaggaagc

SEQ ID NO: 475592 - DNA, 856 bp, Homo sapiens
aaaatcaaggtgccagcagggccatgctctctctcatggttttaggagagaaatctgccttgacggctgtattaggccattcttacattgctataacgaaataccggagactgcatgtattagtttgttttcatgctgctgataaagacatacccaagactgggcaatttacaaaagaaagaggtttaattggacttacagttccatgtggccggggaagcctcacaatcgtgacagaaggcaaggaggagcaagtcccatcttacatagatggcagcaggcaaagagagaatgaggacgatgcaaaagcagaaacccctgatgaagccgtcagatctcgctgtacaggaagcatagcaccagcatctgcttctggagaggtcttaggtttttactcatggttgaatgcaaagagggagcaggcttcccacatggtgagaaaaggaacaagagaaggcagtgggggaggtaccccactttgcaataaccagacctaaaatttcttccttttatgcctatcttacctgtatattaaagacatacttaattttcatgaaattttttttaatgtttgttatctcatatgttgttagggtaactggcaataagcctatcttcccaattatgatgaatatttgaagtgactctgtaagtaatttacaagtaaagatttttatctaaaaaaaagttatccacttcatttcctttttatcagttctctgaatgtctttttccccccaaatatttacacttttttgggtttttttcaaggtttatactcctatggactttttagaaataaatattctataaactctgaaagtttcaaaagagggctaaaatgtatttttataat

SEQ ID NO: 475593 - DNA, 574 bp, Homo sapiens
tgagtttgacgaattgacagtagtagcttcagaagaaactttcgaaaacaaagacttaaccttctgagcaaagacagcttcagacctccaggatacctgcccttttgagaaaagaaagatgaaagcccctattacggagagctgttctgttcaagttatctattgctatgccatgaaagggactcagtgtcacttccagtgtactctattcattgaggcagtcacgaagatccactcagtttcaagaggaggggccatggactttacctcttggtgggagaagtgtgaaagaatttgtggacgtgttttaaaaccaccacaagagcatataagaaagaaggaggaggaggaggaggaggaagtgaaggaggaagaggaggatgaggaagtgaaggaggaagagggagaggaggaggaggaggagaagaaattacttgtttttcagttagattctttttctcctctatgtccacccatgaccaccaggctgctgagaactatctcccttgcttggaaatcctctgtaaagctctcctgctctcacttttggtcccactgtcccaaatcctgatca

SEQ ID NO: 475594 - DNA, 562 bp, Homo sapiens
ggctccactgacgcccatctggaagagagtgttgtggggagagcatggccgtgagggcctctctccactccacgctgggactttcttggaacaactctatgaaggaggcagaggccactcttcttcagggaagctcctttgaaatgcaagacaaacgttttgtctttgttaaatggggagatggcggggtgtttttgtcttctccccatggacttccccttgctccctatagaggctggcacattgcttttgcacaaagagatacttccctgcttgtctctgagacagtacatccaattctctgggtcctcatctttggaaggagaacatctaccatctatcatgaagaagacagaggaggaggagaaagaagagggggagaaggaaaaggaaatggtgtatttttaaagaaatggttacattatgggaatgaatacgcaaaaatgtcaataaagcatactgagtttgaaagttcctatgtcttaacaaggccacaatgagtagcatttaaatatttatgaatgcattaataccttggaaagtgaggtgacttatgtcacac

SEQ ID NO: 475595 - DNA, 937 bp, Homo sapiens
cgctgtgttaggagccaccggggtggctgcagtccaggtggatgtggaaatgtcactcagcctttctcaagtccggcccggcttggagcagattggcagcagggtcgacatctctcaaagtctctgatggaccccgaattttcccaaactggttgccaagacccaaggggcaggagttaggctggaaccacgcagaaacccgccctggggaacaggtttctccttcctgggatgaatccccttcccacgcccatgacccatgcgttcctgcggactccccgaccctgagtgaaatggactcacactggcgcttattgtctctgatctccatgcagatgatcagacagtcgggaacatcatatggaatcatttttgttccaaaacaaaacaataaatgtgctacagcttctggaggtgtgcagaggggtcttcactggaggcatagcagaaccatggaaattaggctaagggctacttctgttttgaaaccgaaagtcttctctcatgaaaatttatggtaaattttccagccctgcaaatgagtactcttaaaaacccttccagacagactaataaaatagaagctcattcaaaaaaaaaaaaaaaaaagctctctgctttcatgaaaaatgatctaccattaagactcctgagattctatgaaaaagatgaaaaaaagaggctaataaattctgggggaagacttaggtgtcagagatgtcaaagctgaataaaatggacagctgagcattcttgccaacaagaaatgatttacagatgagaaagggatataaaggagtaataatgaggccattatgcctgatgctttggaggcaaagatgcttatgctcaacgtattctagcaaggtggggccacagctggtgcacgggctgactgtgattgcaggttaattatagacaatcaataagtgtagac

SEQ ID NO: 475596 - DNA, 678 bp, Homo sapiens
ctgcagcaaaattcacagtgttgtccaagactacaataatcttaagaatggaatgggattggatctaattcccaactcagttacacagatgggccctaatccaattatgagtgggatccttataagaaaaggaaagagacacagacgtgcatcctcgcaggtccacttccgagcaagatcagacacaagggaagtgtaccacggaaagatgagccttcagaggcagcaaggccctactgacactttgatgttgggcttcagccttcagaagagcaagagagtacattccaattgttcaattgtacccagtgtgtggcacttccttagaacagttccagaaactagaacagtattcaggcaggctgctcagtcagggcagcataatactccaggaaccatcaagagaaacaaacctgaaaatgcagacattcagatctttctcccagtcctgggtttgttaatttctacgtgggccttactgaaagctgatgagatgctgtgtcctgtgtgcatccaccctatcttggccccatgctgtagatcacatagggaggtcttttccattcgtttctttcaggccagcatgtttgagatgcacacgcaattccacagcattctcacaggttcacctccaaggtggatcggccactggtgacactgagtcttttctgttaattt

SEQ ID NO: 475597 - DNA, 541 bp, Homo sapiens
gcattgtggggcattgctaaacctggccaaagtaatgagaaaggatgatgatgatgatgatgatgatggtgatgaagatgatgatagtgatgatgatggtgatgatgatgatggtgatgataatgatgatgaagatgatggtgatgatgatgatcatgatgatgaagatgatggtgatgatgatgatgagttctccagagtcccagacaatccaatggtgccaggatggcgggtctggaatacccgatccctacctgagttcagaggtaacgagggaggccccccagcaacagaactattttgtgatgtgaaaactaaccatttaaaagatttcttcctcagatgcctcataggtcaatgttcaatggatgaaatacaattttatgacaacatgttatcacaacttttagaaaaatatgtaatatctccttgtactaatagtttatgttctctggttgataccccactttcagacctaacatcaggaactgatgtgttcctggtagtgtagacagctctagtacccctggaagtctctttc

SEQ ID NO: 475598 - DNA, 847 bp, Homo sapiens
ggtccctgtctgcctagaatttctctgcctcctgcctctattaataggtacagaaatcctttgcaggccaagatggtggaaaagtcaggggtgggaacctcaaagcaaagtgacagccacattttctgcagcaagccttccctgagtaaaatccacaggcagcatagccaggaaggaagccaatggactctggccatgatcgctggcctggccccaggacctagctgcatacttggtgtgcctcagaagtcacagcttctacctgagtttgtagtagaaaatcagtgtgtttccctacacaggctgccgccagtctccaacgtccacattcagcatatcgaaatcaccctcccatgtcagcacatttggattgaacccactgtacaggagcagcacagtagcttgcagcagctgtacctgggaagcccaccaaattcaggccaggatgaagtcagtggaggcgccaaagctcctgttgaggacaggggtgtcttgctcattggcctgaacagaagtgagctagagggatcatctgtcaatcatggtggcttcttagaatacccatttgggcattccctcaaataaatggcaactgaaaccccattgtggctgagtagttatgcttcaaaaatggtcttcattccttttatgtgttatccttatgttgtaaaaaaaatataagaacatgaaaataaattcaaaagaaaacgattattttctcaccccaacactaggttgtttttgtatattccctcctagtctcatccacacatacacagatacttccctaagttgtaatcaaagagtataaatgtttctgtattctgcatttttatttaacataagc

SEQ ID NO: 475599 - DNA, 936 bp, Homo sapiens
aatggaatggaatggaatggaacggaacggaatggaatggaatggaatggaatggaacggaaaggaatggaatggaatggaatggaatggaatggaatggaattaacccgaatagaatggaatggaatggaatggaatggaacggaacggaacggaatggaatggaatggaatggaatggaatggaatggaatggaatcaacccgactgcaggggaatggaatggaatggaatgcaatggaatcaacccgagtacaggggaatggaatggaatggaatgcaatggaatagaatcatccgtaatggaatggaaaggaatggaatggaatggaatggaatggaatggaatggaatggaatggaatggaatcaacccgattgcaatcgaatggaatggaatggaatgcaatggaatggaatggaatggaatggaattaaaccgaatagaatggaatggaatggaatggaaaggaaaggaacggaacggaacggaacggagtggaatggaatggaatggaattgtatggaatggaatggaatggtacggaatagaatggaatggaaagaattggaatggaatggaatggaatggaatggaatggaatggaatggaatcaaaccgagtgcaggggaatgtaatggaacggaatgcaatggaatggaatcatccggaatggaatggaatggaatggaatggaatggaatggaatggaatcaacccgtgtgcatggaatggagtggaatggaatggaatggaatggaacaaccacgaatggaatggaatgtaatggagagtaagggagttgaatagaatcatacgaatataatggaatggaacggtatggaatggaatggaatggatgcatggaatggatcaccgagtacatggacggatggatggaagtattaatgaatgatgaggaccagctcatttccgc

SEQ ID NO: 475600 - DNA, 1222 bp, Homo sapiens
gaatacaatggaatggaatggaatggaacggaatggagtggaatggaatggaatcgacccgagtgcaggggaatggaacggaatggaatggaatggaatggaatggaatggaatggaatcgacttgattggaatggaatggaatggaatggaatggaatggaattaacccgaatagaatggaatggaatggaatggaacggaacggaacggattggaatggaatggaatggaatggaatggaatggaatggaatggaatcaacccgactgcaggggaatggaatggaatggaatgcaatggaatggattcaacttgaatggaatggaaagaatggaatcaacacgagtggaatggcatggattggaatggaatggaatggaatcaacccgagtacaggggaaaatcgagcggaacggaacggaacggaacggaatggaatggaatggaatggaatggaatggaacggaacggaacggaatggaatggaatggaatggaatggaatggaatggaatcaacgcgagtgcaggggaatggaatggaatggaatgcaatggaatggaatcttccggaatggaatggaatggagtggaatggaataaacccgagtgcaatggaatggagtggaatggaatggaatggaatggaacaacccgaatggaatggaataatcgatccgaatgtaatggaatggaatggaacggaatggaattgaatggaatggaatggaatgcaatggaatggaatcaacccgagtgcaatggaatggagaggaatggaatggaatggaatggaaactacccgaatggaatggaatgtaatggagtaatgaatccgaatgtaatggaatggaatggaacggaatggaatggaatggaatggaatggaatggaatggcatgcaatggaatggaatcaaccgagtgcaatcgaatggaatcgaatggaatggaatgcaatggaatggattcaacttgaatggaatggaaagaatggaatcgacacgagtggaatggcatggaatggaatggaatggaatggatcacccgagtacaggggatggatggatggatgcatggaatggatcacagtatggatggaaggatggatggatggatggatggatggatggatggatggatggatcactcgttgcatcgatggatggatggatacccgatagatgatgatgatgacgacgatgatgatgatgatgtccgccc

SEQ ID NO: 475601 - DNA, 4512 bp, Homo sapiens
tgaatagaacggaaaggaatggaatggaatggaatggaatggaatggaatgaaatggaatggcatggaatgcaatggaatcaacccgagttcaatggaattgaatggaatggaatggaatggaatggaatcaactcgattgcaatggaatggaatggaatggaatggaatggaatggaatggaatggaatggaattaaccctactagaatggaatggaatggaatggaatggaatagaatggaatggaagggaatggaatggaatggaatggaatggaatgaacccgaatagaatggaatggaatggaatggaatggaatggaatggaatggaatggaatcaactcgatttcaatggaatggaatggaatggaatggaatgcaatggaagggaatggaatggaatggcatgaaattaacccgaatagaatggaatggaatggaatggaatggaatggaatggaatggaatagaatggaatccacccgagtgcaggggaatggaatggaatggaatgcaatggaatggaatcatacggaatggaatggaatggaatggaatgcaatggaatggaatggaatccacccgattgcaatggaatggagtggaatggaatggaatggaatggaaacaacccgaatggaatggaataatcaatacgaatgtaatggaatggaatggaacggaatggaatgcaatggaatggaatggaatgcaatggaatgggatcacccgagtgaaatggaatggaatcgaaaggaatggaatggaatggaatggtttcaacccgaatggaatggaaaggaatggaatcaacccgagtggaatggaatggaatggaatggaatggaatgggttcaactcgaatggaatggaaaggaatggaatcaacccgagtggaatggcatggaatggaatggaatggaatggaatggaatggaatggaagggaatggaatggaatggaattaacctgaacagaatggaagggaatggaatgcaacggaatggaatggaatggaatggaatggaatggaatgcaatggaatgggatcaacccgagtacaggggaatggaatgcaatggaatgcaatggaatggaatcatccggaatggaatggaatggaatggaatgcaatggaatggaatcaatcaacccgagtgcaatagaatgcagtggaatggaatggaatggtatggaaactacccgaatggaatagaatgtaatggagttgcaggggaatggaatggaatggaatgcaatggaatggagtcatccggaatggaacagaaaggaatggaatggaatcaacccgtgtgcaaaggaatggaaaggaatggaatggaatggaatggaatggaatggaatggaatggattcaacacgaatggaatggaaaggaagggaatcaacccaagtggaatggcatggaatggaatggaatggaatggaatggaatggaatggaatggtaccgaatagaatggaatgcaacgaaatggaatagaatggaatggaatggaattgaatcaacccgagtgcaatggaatggagtggaatggaatggaatgacatggaaacaacccgaatggaatggaatgaaatggagttgcaatggaatggaatggaatggaatggaatggaatggaatggaatggattcaacccaaatggaatggaaagcaatggaatcaacccgagtggaatggcatggaatggaatggaatggaatggaatggaatggaatggtacggaatagaatggaatggaacgaaatggaatggaatggaatggaatggaacggaatggaatggaatcaactcgattgcaatggaatgtaatggaatggaatggaatgcaattaacgcgaatagaatggaatggaatggaatggaacggaatggaatggaatggaatggaatggaatcgaatggaatcaacctgagtgcaggggaatggaatggaatggaatgcaatggaattggaatggcatggaatggagtggaatggaatggaatggaatggaatggaatggtacggaatagaatggaatggaaggaaatggaatggaatggaatggaatggaatggaatggaatggaatgaacccgtgtgcaatggaatggaatcaaatggaatggaatgtattggaatggattcaactcgaatggaatggaaaggaatggaatcaacccgagtggaatggcatggaatggaatggaatggaatggaatggaatggaatggaatggtacggaatagaatggaaaggaacgaaatggaaaggaatggaatggaatggaatggaatggaatgaacacaatgcaataatggaatggaatggaatggaatggaatggaatgaaatggaatggaatggaatggaatgaaatggaatggcagggaatggaatggaatcaacccgagtgcaaaggaatggaatgtggaatggaatggaatggaatggaatggaatggattcaacccgaatggaatggaaaggaatggaataaacctgagtggaatcgcatggaatggaatggaatggaatggaatggaatggtacggaatagaatggaatggaacgaaatggaatggaatggaatggaatggaatggaatggaatcaacctgagtgcaatggaatggagtggaatggaatggaatggaatggaaacaacccgaatggaatggaatgtaatggagtagaatggaatggaatggaatggaacggaatggaatggaatggaatggaatggaatgcaatggaatgggatcaacccgagtgcaggggaatggaatggaatggaatgcaatggaatggaatcaatcaacccgagtgcaatagaatgcagtggaatggaatggaatggaatggaaagtacccgaatggaaaggaatgtaatggagttggaatggcatggaatggagtggaatggaatggaatggaatactacggaagagaatggaatggaacgaaatggaatggaatggaatggaatggaatggatggaatggaatggaatggaatcgaatggaatggaatggaatcgaatggaatcgaatggaatggaatggatggaatggaatggattcaactcgaatggaatggaaaggaatggaatcaacctgaaatggaatggaaaggaatggaacggaatggaatggaaggaatggaatggaatcaatctgagtgcaggggaatggaatggaatggaatggaatgcaatggagtggaatggaatggaatgcaatggaatcacctcgattgcaatgcgatggaatggaatggaatgaaatggaagggaatggaatggaatggaattaacctgaacagaatggaatggaatggaatggaatggaatggaatggaatggaatggaatggaatggaatggaatgcaatggaatggaatcaatcaacgcgagtgcaatagaatgcagtggaatggaatggaaaggaatggaaatttcccgaatggtatggaatgtaatggaggcaatggaatggaatggaatggaatggaatggaatggaatggaatgggttcaattcgaatggaatggaaaggaatggaatcaacccgagtgcaatggcatggaatggaatggaatggaatggaatggaatggaatggattcaacccaaatggaatggaaaggaatggaataaacccgagtggaatggcatggaatggaaatggaatggaatggaatggaacggaatggaagggaatggaatggaatggaatggaatggaatggaatgcaatgcaatgggatcatcccgagtgcaggggaatggaatggaatggaatgcaatggaatggaatcaatgaacccgagtgcaatagaatgcagttgaatggaatggaatggaatggaaagtacccgaatggaatggaatggaatggaaatggaatggaatggaatggaatcgagcgcaatggaatggaatggaatggaatggaatggaatggaatggaatggattcaacccgaatggaatggaaaggaatggaataaacccgagtggaatggcacggaatggaatggaatggaatggaatggaatgcaatggaatggaatggaatggaatggaatggaatggaatggaatggttcgattcgaatggaatggaaaggaatggaatcaacccgagtgcaatggcatggaatggcatggaatggaatggaatggaatggaatggattcaacccgaatggaatggaaaggaatggaataaacccgagtggaatggcatggaatggagtggaatggaatggaatggaatggcatggaatggaacggaattaaccctaatagaatggaatggaatggaatggaatggaatggaagggaatggaatggaatggaatggaatggaatggaattaacccgaatagaatggaatggaatggaatggaatggaatggaatggaatcgactcgatttcaatggaatggatggatggatggatgaatgaatgaaggaatgaaagaatgaatgaaataccaaatagagtgg

SEQ ID NO: 475602 - DNA, 560 bp, Homo sapiens
tagaatcaatacgaataatggaatggaatggaatggaatggaatggaatggaatggcatggaatggaattaacccgaatacaatggaatggaatggaatggatcggaatggagtggaatggaatggaatcaacccgagtgcaggggaatgtggaatggaatggaatgcaatggaatggaatcatccggaatggagaatggaatggaatggaatgcaaagaaatggaatcaactcgattgcaatggaatggaatggaatggaaaggaatagaatggaatcaacccgagtggaattgaatggaaaggactggaatggagtggaatggaatggaatggaatggaatgcaatcaactcgattggaatggaatggaatggaatggaatggaatggaatggaatggaatcactcgattgcaatcgaatggaatggaatggaattaacccgaatagaatggaatggaatggaatcgaacggaacggaatggaatggaatggaatggaatgaaatgaacgaacgaacgaatgaatgaatgggggatcctatagatcgacctacagcat

SEQ ID NO: 475603 - DNA, 1590 bp, Homo sapiens
tggaatcaacccgagtgcaggggaatggaatggaatggaatgcaatggaatggaatcatccggaatggaatggaatggaatggaatgcaaagcaatggaatcaactcgactgcaatggaatggaatggaatggaaaggaatacattggaatcaacccgagtggaatggaatggaaaggactggaatggaatggagtggaacggaatggaatggaatggaatggaatggaatggaatcaacttgattggaaatggaatggaatggaatggaatggaatggaatggaatggaattaacccgaatagaaaggaatggaatatggaatggaatggaacggaacggaacggaatggaatggaatggaatggaatggaatggaatggaatggaatcaacccgactgcaggcgaatggaatggaatggaatgcaatggaatggattcaacttgaatggaatggaaagaatggaatcaacgcgagtggaatggcatggattggaatggaatggaatggaatcaacccgagtacaggggaatggaatggaatggaatgcaatggaatggaatcatccaatggaatggaatggaacggaacggaatcggaatggaatggaatggaatggaatggaatggaacggaaaggaagggaatggaatagaatggaatagaatggaatggaatggaatcaacgcgagtgcaggggaatggaatggaatggaatgcaatggaatggaatcttccggaatggaatggaatggaatggaatggaatggaatggaatggaatcaacccgagtgcaatggaatggagtggaatggaatggaatggaatggaacaacccgaatggaatggaatgtaatggagaaatcatccgaatgtaacggaatggaatggaacggaatggaattgaatggaatggaatggaatgcaatggaatggaatcaacccgagtgcaatggaatggagaggaatggaatggaatacaatggaaactacccgaatggaatggaattgaatagaatcaatccgaatgtaatggaatggaatggaacggaatggaatggaatggaatggaatggaatggaatggaatgcatggaatggaatcacccgagtgcaatcgaatggaatcgaatggaatggaatgcaatggaatggattcaacttgaatggaatggaaagaatggaatcgacacgaatggaatggcatggaatggaatgcaatggaatggaatcggaactcgagattgaggggaatggaatggaatggaatgcaatggaatggaatcgatccaatggaatggaatggaatggaacggaacggaatggaatggaatggaatggaatggaatggaacggaacggaacggaatggaatggaatggaatggaatggaatggaatggaatcaacgcgagtgcaggggaatggaatgtaatggaatgcaatggaatggaatcttccggaatggaatgggatggaatggaatggaaacaacccgagtgcgatggaatggagtggaatggaatggaatggaatggacacaccgaatggatcgattaatgagataaggagtgataggaccggctgattacgg

SEQ ID NO: 475604 - DNA, 620 bp, Homo sapiens
ctgagggggtgttggtcaaagggcacaaagtttcagcagtaagatgtcctgtggaatatctgagctacctgctcagacctacagggagtctgggaggaccaagctggacaggggtgcactgggcagccatgcctacatttccccagtgacaagcataagcacgagatccaagttggagactgggggcagttgccgagcacccagagatgtgctggggtatgaagtggagaaacttctgctgttgaacgttctctgctggaagggaggactagcatcaattcctaacctagaagagtgggtaaacgaatgcaccaaatgcctggaaatattcctgggcatggagcagacagggcactgctgcaccaagatctctgcacagaaagggaggggtgactcaagttgctcatccacacaagcagttgcaccaaatgtctggaagtacgttgcccagagaacagcagagtagccactgcagagcagagttaccaccattgcaacagggtctttgtagcggaagtgaagggcagttcaggcccctattcctggcagtgagtgcacctaatgcctggaaatatgcccaggtggtgagtggagggggcaccattgcatctggttcttgt

SEQ ID NO: 475605 - DNA, 597 bp, Homo sapiens
tggcttaagcttcaattgccaatactgtgaaaagttctcttggtccagttggcttggataaaatgttggtggatgatgttggtgatgtaaccattactaatgatggtgcagccattctgaggttaccggaggttggggctatggcaattagaagagctttaaaaagggaccttaaatgcattgctgaaacttctggagggactgttctgtcaaccctggccaatttgaagggtgaagaaacttttgaaactgcagtgtcgggacaggtggaagaagtggtacaggagagaatttgtgatgatgagctgatcttaatcaaaaccagtaaggcttgtgcatctgcatcaattatcttacatggggcaaatgatttcagcagtgctgtccaaacagaactttctgcgatgatggaattgctctatatcttcactgtccagtaaggtgtccattagccacaggtaactattgagcaattaaatatggctagtgcaactgagaaccttaatttttattgtactttatttaatgaatttaaacttaaatatcaacatgtggctgtgagtttttacatgtggtttttgattaactagtatgatc

SEQ ID NO: 475606 - DNA, 750 bp, Homo sapiens
tgctgattggtttctgagcatgcaaaaaagttaaaacaaagaacccccatactaccagtacagaatggctatactggtatacaattgcaccaacagtggcttcacattcagtttttctttccagctgcctgcccgactggcctacagagacaataggccacaaccaaacacagcaataacatccttccatagaattgtatcccaactcctacaaatattcagtgccctgtatcagttcccagaggcaactgacagcctctctgccactgttgctgcagccgtacctgtcccagcaagactaatggcagcaagggagggtactgctacaaagctttggcagagagcctgtggattgtctccgggaagtccagcccagagaaatgcagagccacacctggctgaagtgatccacttgttaattactgtgataaactcctggattgcaaatgcacagacttcaagactggtcaattttcttgggtcattaactgcttgcaatgcctatcagctgcacaaggcatccattaatgactcttctttgccttaaacaggcagggactaattggtgaactcatctgggactgaggagaagtctaaaaaatcttagtatctacacaataaaatttctaagtgataagaaagtaaacaaaatcatagtgcattttaaaattgatgctgtcttaacatttaaagaaaatacgataataacacttaaatgtttcatataaagtgtgtcttgctgaaccctaa

SEQ ID NO: 475607 - DNA, 1001 bp, Homo sapiens
ggttcacaaaacacaggtcatgttggaggcagcatcggttcaggaactagccctgaaagtctgtggagcctggcttcccagccctgcccttcttgccgctccctccagtcagcggcagaagtacaggtcccataccggacaccttggaggttcgcgcctgggctgcactgagaacggcagtcagttctgcggaacccaaacgagggcgctgcccttgtcctgtgcccatctcacagccatggcaaccctgtggtgttactgctgctgtgcccattttatagctgagaaaaccaaggccaggagaggcaccaaacccagtgggggtccaagggcacaaggccagctgagtcagcaactacgccctcggactaaaaactttaataagaaacagaaaacctggaggaaacggcgctcctgccaagtgtataaattgtgccagctcccagccacatcggagcccagcaccactctcctgggcaacactctctcgaagtgcctcccagcacgccccgctgtctgccagccccctgcgtcagccccgtctttggagtcacccctgctgccccatcaccttatttcttccagaggaaccagaaatccagagttgtgtgtgaaattgcctgatttttaactctgggctatgagttcccgtgttttaaaacactctgcagaccagacaaaacatctgtgggtcacggctgtcactgtgcagcctctaatctagaaaggatcctggatttcctatcgcagacttggccaggctcaatttttcttttctaaaatccttcttaactaacttgttagatttcagagctgtagttcaagctgagtcagaaggatttcactctagttggcaacagctagaaaatgaatgcttagaaacatttctgccctcagattcacttcgtggagccccctggggcggtgggggctcagctgggtggccgagagtagatgacaggaagggaaggcgcttctacattggtgggaagctcaccatc

SEQ ID NO: 475608 - DNA, 827 bp, Homo sapiens
cttaggacctacattttcctgcaaggatgaataacatcgtgtttgttgatggggtgtgcgggcacaaggtcatgctgtctgagtggttccttgaagctcctctcacttggctcgggggtaacagtctccactaccccatagcaagacatggagtgagggaaacagggagaagagaaacaccacagcattccaaactgcctccaaagaaaatgtctaaaaactcttcatcagtttcacagaactatgccatcttcttagcctgccctgcagattggggtctaacatctttggcagcttatccacagacccaagcagcagtaggagagaaagacattcgtaccaatgcctggagactcgaagaaagacccatagacattattaatagtgaaactcacacccagccctctttaatcgtcataacattagcacagggacctagaccgtgcaccagatataagaaagccagtgggtcctgggaggaactggaggagccggagccggtgctggcagtgcggggcttcaaggagctgaatcgcagaggggtttccaggctgttccattgtatgttatatgatgtaacccccttcaaacgacttcagtgcaacagtgtgataagcactggagtaaagacttgtaaaaaaggaaaaccatgagcacaagagggaatagttatttttatttaaagacagaaagcaggacacaatgtcaagagtataattctagagtcatatttatagggttggaatcttgttccaccacatattagctaatgattctgaatctttgtgcctgaattccctcacctggaggtgttgaaagcccttccc

SEQ ID NO: 475609 - DNA, 2738 bp, Homo sapiens
ctgttttggtgtttgtttatttgtttgtttagcagtcatcattgccccttctctggaaaaaactaagaaactcaagaggagtcatcagaattcctgccatgtgggagtcatcaacccaatgggtgacttcttttctgctccacatataagagccaaggagcgggagctgaaggtggagggggcagaagaactcgggttgtggtcatcacccacatcagatgcctgtgcaactggggcccctgctaggcctactgaagagcctgcccatgccctgcccttcagcagtgtccagacatctgccacaggcacagttggccatcccgtgtgcaccacagcagcagcagctaagcagatgcctgtcctttccttcatccctgctccaagaccccaacactccaggagatacagaaaagacgaaggaagagcgggaagcagaggagcaggagagaagcaatgtacacacaattcccccagggtaggaccactggcccctggtcacacctggactgacaggaagagtgaaaaagtggatataatctgacactcgagatataaacttaactttttaaacctgaaagtgtctgaaatgccacagacgcttcctgagacgtcgtgaagggacagaaaactctcatcaaagcatgcctgaaaacaatgtaggagaaatcaaataaaagggcttcatgttagtatcccactgactctccaataaactggttacacagcaaaagaaactgacttccatctccatcttaaagataaattcacatgatcttcgaattcgaaaggcagcagtaaggcagaaattatttctcttctttctctggcagcagtagaaggcatagcatgggcctcctaaatgattacttagaccgagccaggacaatgagattcaatcctgaaatttttttcaaacttggaaagaggatctcttttccatgggattgaaaatagagctcctgagaacctgcctgatggagagtgcaacatagagaaaagcagaacgaagacacagagagaaggagttccattttgacttctagatccaaccttgcctgcagctgagcttgttcactgagtaagattatcactatacttttcagttttatgagccaataaatccctcacttttcttcagctaatttgaattggtttctgtctttcacacctaaaacagtgctatcaaaatgtaacaatcaaaagtacatagaatttgggatcagacaaactagattctaatatatctctgatacagtttccacctctagagataataattccctcttcctaggcctgttatgaggattaaatgagatgctatgtctagtacttttatgtttggctttttgggtatggtttaaggcatatgtctaaatgtatttctttcaaaatggataaccaatcacccctaactgtattgctttgaaaatggataaccaagcttcaccctaatttgtaaagtaattcattttcctacttaattgtttgccatttttattattaatagcagcaagcacttacgtagttctgaccacatttcaggcactcttctaagtgctttctgtatattaatgtatttaatcttcacaacaaccataagacgtaggtagtataatgatccctcttttacgcataaggaaaccaaggcacaaagagtttaagtaacttcaagaacgcacagctactgtgtggcctggcttgagatccagtgctctttactatactaaaccctgatgtgcatactgctcctcctagattccatccaatcttattaaccaatatctctgcctatacctgcgcaaaccctatacttttatattttcaaatttgttttaatttttgaaagacaagtttccctcattttttcttctaggagttttccaggttacttgctattttgtctaccatttgaccaataaaatagcatgttaagtttcataaataatgattaggattgcattacatttctaaattaacttgaggaggactgatatctcaacaaaaattgtcttctgtttagaaaagtcctgcatatctgcattattggatttttttctatattttacagttttcaacatatgaatcttacaactgttagggttttttattattattgtaaataggtttttttctctgtttcattctttagtatattattgataatatataggaaagcattgatttttttctatgttaattttgtatctgtcgtactgaattttactgattctaataattttttcagataattccttggatttgcatggcaatctttagtttccaaataattatatctgtgtcttttctttataatatttatgtgtcatgttattcttttttggtctgtatatatttgcattggttagagttaggacctctattacaaggttaaaagacaacagttctggcagcaagtttatcttgtctctaactttagtaggaatgtttctaatgatttacatcacacatggtgtttgttcttgttttatgctaatctttattagttcaatgaagtttccttctattgctagcttaccaacacttattgtttacttgtttttaatcacaaatgattattgaattttagcaaatacatttttgcccatattgaaatgtcataaattttttttatctatttatatagtaaattatattaatggattttcttgtgttgagtcatccttgtattaataatagctacatttaatgtattcttcctatgtgccagaaatgatgtt

SEQ ID NO: 475610 - DNA, 1352 bp, Homo sapiens
ggtgaagagggaacagacaaatgagattcagagcaggtagaatgaacagaaaaggccctgggaatgcttttggtacatgggcacaccttgccttcttcctgaggagttccgcgaagctcttgtttacccctggaaaagctgtcttcaccagacaaacaaaagctgaggatttccatcacacgggtaatttgtctacgagttgttgctggattgatgtgtttgtaggagaagacggagctctccagtgggctggcagatactttgtccgatcagcatcatggtctgacagcgcctcacgtccaatccttactttccccttttctcttcacaaacgttactctccagtgcagaccttgaaaacagctgtcatggagcagacaggccatttagcaagaggcacagatacggggactggcttgggccatttgcttcttttcatttccagaaaagctccagcagcccctccacagcacaacgctgctcacacaagccacgaaaccaggaggctactgccaccagtgccagttccaacctatggcctctgccatcaccaggaagttgacaaatcaggtgctatggttgcacatttagactccagagtcctgctgtactgccgggcccagagctgcaccagcaaagtaacaacctcagaccctggctttttcccaaataattcagttctggacccagattttgaatctggcacagatgcagttgactggtggaatcaaaaccacatgtctgcaatctcacaactggaaaatgacctgaaaaatcttcatgctcagatgtgtccggagtttcttccttctgctgggtttgtggtcttgctaacctcaagaatgaagctgcagaccttcaccgtattgcagctcttaaaggtagcgcatccagaggtgttcattcctcctggtgggttcgtggtcttgctggcttcagaagtaaagctgcagaccttcacagttagtgtcacagttccaaagcgcagacccaaagagggagcagcagcaaaatttattgcaaagaccaaaagaacaaagcttccacagtatggaagggtacctgagcggtttgctgctgctggctcccgtggccagcttttattcccttatttggtgccgcccatgtcctgctgattggtccattttacagagcgctgattggtccattttacagagtgctgattgggattttgtgagctgattgttaaacatagccattattacaaaataaattatatcaacttaaaatgaaataaatcatgttagaaatgaagttaataaatattcacaacttatcattcatattactttgatacattttactactatcaagacttctgaggttattta

SEQ ID NO: 475611 - DNA, 665 bp, Homo sapiens
tgaggggggcacaacaaagacaaggaaaacgccgggatccttcttgccttcccaccttagaatgaaacaggatcctcatctctcaccttatacaaaaatcaactcaagatggatcaagaacttaaatctgagacctgaaaccataaaaattctagacaataacatcagaaaaacacttctaaacattggcttaggcaaagatttcatgaccaagaacccaaaagcaaatgcaacaaaaacaaagataaataggtgggacttaattaaactaaagagtttttgcatggcaaaagaaacaatcagcagaataaacagacaacccagagaatatacagatggccaacaaacatatgaaaaagtgctcaacatcactaatgatcagggatatgcaaatcaaaaccacagtgcactaacaccttactcccacaagaatggccataataaaaaaataatagatgctggcgtggatgcggtgaaaagggaacacttctacactgctgcttgatttatattgtacttgcttcagtttcttctaagagtggagttttgttttgaaatgaaacttctgtttattaattttaagagtttataaacccaggtagctccagaatagtcagactttattgtaattatagcacacttgcattctcttacaaattgaacct

SEQ ID NO: 475612 - DNA, 624 bp, Homo sapiens
ggactgcagtggcgcaatctcggctcactgcaagctccacttcccggccttcactggtggtgatacctcctggtatgggaaaaactaagatgaccagggtctggagcagacccccagcaaactgcagcagccctgtggaagaatcaaaggtagataagcccacaaagataagaaagaatcagtgcaaaaacaatgaaaactcaaaacaccagtgtgccccttttcccccaaatgaccacaatacctctccagtaaggactcagaactgggttgaggctgagatgactgaaatgacagaattaggcttcagaatgtggataaaaacaaactttgctaagctaaaggagcatattgtaacccaatgcaaagaagctaagaatcatgataaaacaatgcaggagctgacagccaaaatatccagtttaaagaggaacacaaccgacctgatagagctgaaaaacacactacaagaacttcacaatgcaatcacaagtaataatagcagaatagaccaagtggaagaaagaatctcagagtttgaagactatctttctgaaataagacaagcagacaaggatagataaaaaagaatgaaaagtaatgaacaaaacctccagtaagtac

SEQ ID NO: 475613 - DNA, 659 bp, Homo sapiens
gatatgaatattgtataagaccatataattttccatgatatttcattaagatttaaaaggacacatatcaagatgaagaaacaacccaaaggttacggcctccactgccacagggccatcatcaccatctgcagtatcatttgcatcaaagacatgtatgccaaggtctctgggtccgtcaatatgcccaacctcacctggggcctcttccatgggctctccagacagaaaacccatcaacagctggctgttaagaagggcctccatgctgtggaaatccaggaggaatgtggccctctgcctatcctggttacctcctcccggggggccttaagtaaagatccggagacaaatgatgaggttccagacatcaaactggactggaaagatgtgaagactgcacagggagagaaacgctctctctgcatgcttcttttgacggtgctggtgtgggatggggcactgcctcgttactgcctgggtaaggtagttatttcctaaaagttacctgtcttgttagtttatcttctttccttaaatacctaataaatatcaagacaatgagctttaagcaacaaaggacaatgatcctgtggagaggggaaacaaaattatctgtacttactatctggagaaagtccatggctccaggaagggct

SEQ ID NO: 475614 - DNA, 660 bp, Homo sapiens
ggtttatatgataaaccatgtgcctaggagatggaaatcctgtatgaatgtggaagccattagcagagtaattgctgtctgttaccatgacaaccagccgctgcagtcacctgcccgaagtcctgccagactgcaccagctcagctgcacccgtggtgaagacggtggaggattgtggcagcctagtgaatgggcagccgcagtatgtcatgcaagtttcagccaaggacgggcagctgctgtcaacagtagtgcggactcttgccacccagagagggccatccacttggtggaggtttccagcccagtgaccagcaggtgcccctccttctcttgcagccccttcaatgaccggccgatgtgcaggatctgccacgagggcagcagccaagaggacttgctctctccatgtgaatgtacagggaccttggggacaattcatcggagctgcctggagcactggctgtcatcctcaaacaccagctactgtgaactctgccacttcaggtttgcagtcgagcgcaaacccaggccgttagtggaggtcagtaagtggggcacgtcctgaaaacttagctctaatgagcaaatgatgtctgtttttatgcctggatcacaagccctgtacagctttactgaagcacggtaatagctatgtga

SEQ ID NO: 475615 - DNA, 1311 bp, Homo sapiens
aaaatatttgacttaacatgtattttatctgatatgactctctgtaaaatggaccaatgagcaggatgtgggtggggccaaataagggaataaaagcaggccacccaagccagcagcagcaacccactcataaggaagtaagcaaagaaatctccaaaggcccacaaaaacacctgggctatcggttatgtccccttcaagctgtagggggagaggaatttggcccaatctgggtacacatccctttctccctgtctgatttaaagcagatcaaggcagacctggggaaattttcagatgatcctgataggtacatagatgtcctaaagggtctagggcaaaccttcaacctcacttggagagatgtcatgctactgttagatcaaaccatggcctttaatgaaaagaatgtggctttagctgcagcccaagagtttggagatacctggcatcttagtcaagtaaatgatagaatgacagccaaagaaagggacaaattccctaccagtcagcaagccatccccagtatggatccccactgggaccttgactcagatcatggggactgtagttctcatgtcatcaccctccctgagtcctgggtttgcttaaccattgagggccaggaaattgacttcctcctggacaatggcatggccttctcagtgttaatctcctgtcctggactactgtcctcaagatccgttaccatccaaggaatcctgggacagcctgtaaccagactcatcaatgaggcagtaattcctctaaatccagttgtacccaacccctataccctgctctgtcaaataccagagaaagtagaatggttcatggttctggacctcaaggatgccttcttctgtattcccctgcactctgactcccagtttctctttgcctttgaggatcccacagaccgcatgccccaacttacatggatggtcttaccccaagggtttagggatagccctcacctgtttggtcaggcactggcccaggatctaggccacttctcaagtccaggcactctggtccttcagtatgtggatgatttacttttggctaccagttcagaagcctcatgccagcaggctactctagatttcttgaactttctagctaatcaagggtacaaggtgtctaggttgaaggcccagcttggcctatagcaggtcaaatatctaggcctaatattagccagagggaccagggccctcagcaaggaacgaatacagcctatactggcttatcctcaccctaagatattaaaacagttgcaggggatccttggaatcaccggcttttgcc

SEQ ID NO: 475616 - DNA, 583 bp, Homo sapiens
agagtgtgttctttaatgaagatggctgcacaaagtggatgcacacaaacgcatatccagaatggttcagagggcatggtgttcttgtccttggacccccaagcagtatatgtgggcacccatgatagcaggtccaggtgggctgattcatggtcccctacatggcttgctcaggtgccagtagtggcagtggttgaccagatgagtgagcagctcctcagagccctggcagtacatgtggtagagacaatgggaatagtggtggcaggacaatccttgggctcccaggtagcactgcttaatgttaacagtggccaaaatgggctagaggagtgcacaaatgccagaggcagtagactaagcagagtgattcccagtttcacaagcagtgtgctcaggcctggggaggggagagagttttacaatttcaggttttatgtttacatctttaatccatttagagattggctgtacaactttgcgcctaaacttaatttaaaaaagaattactaaatatgtgtatgtgtatatatttttatttataatatctaatttttatattgattacaacttgaaatacttt

SEQ ID NO: 475617 - DNA, 1020 bp, Homo sapiens
tgagtcagggcagagcaggccatgttagagaccttcacagctgtccctcccaatcacaggcctggaggcccaggaggaaaaagtggttttgtgggccaggcccagggtccccatgctgtgtgtagcctcgggacttggtgccctatgacgcagctgctccagctgtggctgaaaggggtcaacgtacagcttgggctgtggcttcagagggtggaagccctaagcctagacagcttccatgtggtgttaagcctgtggaatgttagatccaacaacagcttgcactgtgcacctggaaaagccacagacactcaatgccagcccatgaaagcagctgggagggaggctgtatcctgcaaaaccacaggggcagagctgcctaagactatgggaacccacctcttgcatcagtgtgagctggatatgagacctgaagtcaaaggagatgattttggagctttcaaatttgactgccccactggatttcagacttgcatgggccctgctctaattgtgagtggacgagatgggatctggtatacaagtggaggaatttgcctcagcaaggagcatgtggagttcacctatggtgacaaaacgtaaggcagagtattttgggcacagatgttggtgggtggatggatagacaataagaatgtgtgtaaatactcttgcaatggattccattttatcaatgacataagaaaattattggctaagaatgaatatgagacagtagatattggagatatgagggaaaaatgaagtgtgaaatggttatccacagtctttcagtgtaagaattcttagattctttcagtctaaggatgtgtctcattctcatatttgagttctgggttgttgctggcgaaaatcttcgtgctgtatatttgttttaggttttctttggggagtagtgaagcccgtttacttctacactgctattttaaaaccttcttcctggcttattcacaaatgagccaagggaagctgtgacagactacctggaaaaacaggaca

SEQ ID NO: 475618 - DNA, 786 bp, Homo sapiens
cctggtggtgtaggcacctgagggaatctcctcgtctgcggaatgcaaaaattgtgggaaaagtgtagtatccagggcagtcaggcccctctgctgcaggtctgctggagtttgctggaggtccactccagaccctgtttgcctgggtatcaccagtggaggctgcagaacagcaaagattgctgcctgttccttcctctggaagctttgtcccagaggggcacctgccagatgccagccagagctctcctgtatgaggtgtttgtcaacccctgctgggaggtgtctcccagtcaggattcacggggagatgccctgcccagagaggaggaatctagagaggcagtctggctacagcggctttgccaggctgtgatgggctctgcccagttcaaacttcctggtggctttatttataacgtgtggggaaaaccacctactcaagccccagaaatggcggacacctctccccccaccaagctggagcatctcaggtcaactttagactgctgtgctggcagcgagaatttcaaaccagtggatcttatcttgctggtctctgtggggcgcctcaaattacctgtgaaaggaagcaagctataaacctgaacataatatcaaataactccaaatataatactttttcccctctgctgcagctgcctgtcatggtagtctgtgatatatagaaaaggtaactcagtttctgtagtctttgattcaacattcaaaggaggctgtgatacattttttaaaggtttacttttaaaatggttaaaataagca

SEQ ID NO: 475619 - DNA, 581 bp, Homo sapiens
ttatcactggaattgaaagcgatgtcggctgggggatgtgcgtctcgaagactcttttttcaagggaggcttttggcttcgtgtcttgctggaagtggaattgctgggccacggaagaccactaatacaagattgaatagaattaataataggcaatcttctctcatttctgactttaaaaggaaggctctcaacaataccattaattatgatgtttcctgtggatatacgttatcaggttcagtaaactttggttcctactcatggtgggtgcactactcagatccccattcaggaatgaagcacattctgcagctgctgggagtgctccctgcagaaagccctctgccatccacccctcatgtggatggtcttgctggagagagagccaccccacccctcctcctggggcagcctcctccactgatggattatgacagccaagcgaccctgatacatcatatagttttgactgcttgtaacagaatagtcaattaagggtaggtagtagcaagcacatttattttctcatacaccaagaaggaatgatctgactactccttgaaaccatctgtaacagc

SEQ ID NO: 475620 - DNA, 1010 bp, Homo sapiens
acatcaaagaccaaaggataacaactcctctccagcaagggaacaaaactggatgaagaatgagtttgacaaattgacagaagtacgcttcagaaggtgggtaataacaaacaactccgagctaaaggagcatgttctaacccaattcaaggaagctaagaaccttgacaaaagattagacgaattactaactataataaccattgtagagaagaacataaacgacctgatggagctgaaaaacacagcaccagaacttcgagaagcatacacaagtttcaatagccaaatcgatcaagcggaagaaaggatatcagagattgaagagcaacccaatgaaataaagtgtgacatcaagattaaagaaaaaagagtgaaaagaaatgaacaaagcctccaagaaatatgggactatgtgaaaagaccaaatctacatttgattgatatacctgaaagtgacaaggagaatggaaccaagttggaaaacactcttcaggatattatccaggagaacttccccaatctagcaaggcaagccaacagtcaaattcagaaaatacagagaacaccacaaagatattcctcaaaaagagcaactccaagacacattaattgtcagattcaccaaggttgaaacgaaggaaaaaatgttaagggtagacagagagaaaggtcaggttaccaacaaagggaagcccatcagactaacagcggatctttctgcagaaaccctacaagccagaagagagtaggggccaatattcaacattcttaaaggaagaattttcaacccagaatttcatatccagccaaactaagcttcataagtgaaagagtaataaagtcctttacagacaagcaaatgctgacagattatgtgaccaccagggctgccttacaagagctcctgaaggaagcagtaaatacggaaaggaaaaaccagtaccagccactgcaaaaacatgccaaattgtaaagaccatccatgctatgaagaaactgcatcaact

SEQ ID NO: 475621 - DNA, 3257 bp, Homo sapiens
ttcttgtctcccgcaggttgcgacatgtgcgcggacaaccgcaacggcgagtgccctatgcatgggccactgcactcgctgcgccggcttgtgggcaccagcagcgctgcggccgccgcgcccccgccggagctgccggagtggctgcgggacctgcctcgcgaggtgtgcctctgcaccagtactgtgcccggcctggcctacggcatctgcgcggcgcagaggatccagcaaggcacctggattggacctttccaaggcgtgcttctgcccccagagaaggtgcaggcaggcgccgtgaggaacacgcagcatctctgggaggccatggagatacagtatgaaaaacagacctggtatccggaaccctcctgtgactgttggggatggggtcctgaggcctgggtctgcaaagcctcttttgatggaggaggagctgagtgtatgagtctacagcccagcagcccaaaatgaggacgtggaagccaatgaactacctaccctatagttatctgctggagtgccccggctcaaagcatctggtttggaaacattttggtttttgtttctgactaattaattgtaacctccaatgtggtttaaagtttataaaacacttttaggacataatctattttttttaattatctgtaacaacagttagaataaggtacatttgggaattgaagggattttaaaactttagccatacaaaatgtgtcagtctcctgggagatcacgtgaaatgcgactaactggggccaggtaacttagtgccaatatccatttgtaaaataaaatacttactttataaaataggtttcagatttttattagcataatgatttttaagatatagaatatgagtttaaaatttttaagcattatgatttatttttatgaaacatgaccgtttgaattgttacatttataatacaatattccaaatgttagattgttccttaaattttagttctttctttcaaagctaaattttcttctgaaatttaaaaaaatcatcatattattcacattagaatcagtaagtagaatacattgtaggtctatcggaaatgtttggcaataattgtttaatgactcatgtaataattatccatttcaaaaacttattcttttagatgtcttccagaatagcaagtcaacaaaatgtattaaaaaaattaaaagcagttgaatcatgattattttattttaaaaggcaactgtaatcatttctcttcctcacattttttcaagtcatttgctgatgaagaaaagtctttttatttcaagttcaatactcaggtcctgatggatcttaccagggttacttatctttatttcagtacaataaatggattgctaatcttttcctgtcactatttccaagtagatgatggatttttgtttcagtttacacttcattgtttttagtatggttgtactttattatacacatgaaggcttattacagaaacaatcagattcaccttagttactccttttatttaatcattagaagctctattttctttgtagaaaaatgactttttgttatttaacatacatcagccatggagagcttgtttggtttgtaagcatgcaatcattgttttagttaatattttctttgtgtataatcatagttcttcaaaatacagcaatttaaaggaagttaaatatcatttcattatattcagtacattttgactcttctaggtatttataggaaattccaagagagttgttttttctctttttgcaataagccaaggtaattttttattttttatagtttaagaagattacaagctaaaagccaaataattagtcatttatttttgctagtttcttttagaatcagaattttaatgtgttttttaaacaataataaattcagatactttaaaacaaaacattacaaggtgcatcagacaatgacttgccttggttatatatatttattccaagacttggatgcatgatacatttctagctatttggacatcatatgaaataaaatctttctcaatgttttccaaagaaaacaatctttctcagcaattaggtcttattgatgagaatgagataattttatcctgatgtgttttccaataaagaagtgaaaaggcacatttgattccaacatttatgaaaacattatctcaattattaatgtgccccctttctcttgagataaattaatctagttgcacacggtttcctctttctgcttaacatcagaatttaatatgactggacctgaggaatgtacccagtgtatacttaaaattctactggaataaaatacggaagtttaaaataaggttacagtttaagataggctagaattactcaggcctttcaactcagtgcctgacttgacaagaaattttagcaagaatgacaaaataaattgcacttattttcaccctagaaaaattatcctgctaattgaaataatgtagtgacttgttagtaatacagttaagatactagaaagggctttaattttacagaacctgtcttctctttgcctgagtaaatttgagtgtctcgttttcatttgcactatgtggaaaccttcattatttttcttcagaaaatcaagggggataacataatgtgagcctttttgtgatttggttttgtgccataatattttagatttaataagagttttgctgttaagcaaatggtctatttttcatcattactgcttagcttaagtcaaaatatattaatgaaaaccagtattaaaaatatattacacattgctaaatgtttatatttcaaaaccatcataggtaattggttctagaagaaaatgaattgatttcatattttaaatatattatgtatgtttctataaatgactcaatttcatatatacagtactatacccacttatatgtatttagatgttgaaaaaattattttaaattaatcattttcaattaaattagaatcacttaaaagttgtcgcagtgatagtactgtaattatatattccatattctgctttatagactttggctcattttggcgtgattcaccaagacactaggggatagaattatgtagctgtcgcagttatattgaagtaaaaatcatgtttttcagcaatttatcatttaatataatagtctgcctgtcagtttggttttgaatatgtcaaatttgtgaaattcaaataatttctccttaaaaataaaccatagtaatgctactattatgttttaaattatgcagagtaa

SEQ ID NO: 475622 - DNA, 869 bp, Homo sapiens
gagaaagaacacatgcatctcgcaggcagactgactctgaaaaaggccaacaaggcctacgtcaagcacaccaagctttttctttcaaacttatcactcagtgcctgctgtcctttttggagagaggaatattcaaagttctctgtggatgttgttgttttcctgaataaaaaggtagtaacagccttgagagatagtggtataggagagaacccctgtggagatggcactggtggctcctcaacccactgcattgcacactgctatatgtgtcatcagaaagtaatgacatcctgtgggaatacgaatgatgtgagcaatgaacccctgattgcagaaatcaagaaaggcttcatggaggagatgttaatagtgagccttccgggtacaaaagcaagagggaactccttcagtacatacccatcttttgaggatcctcacccagctgctacccccagtgaaccctccagctgtgtagtcatttggcagggtgcactgttatgcataacttaaagctatgtgtgtgtgactctaaaacaactggtgaatacagattgttcacatgaaaacccccaaatgatctgcaagtgaaaaaaaaaatgtaagcaatgatttgatgaccatgaaaatgacccaaatttcagatttagcattggctgactctatccatcaccaacatatttatttgtttcttatctgcctttgctctaggtaacccaaaaatgctatctggttagccaaaaagttgtgacttagagaaatatatgctaatatggatcatatattaattaatgcaaataacatcaacagctatgtaaaaacagagctaataagtactgtgttttataagatttaagtacaataaatct

SEQ ID NO: 475623 - DNA, 831 bp, Homo sapiens
cagagcctaagaattaaatctcagagatggggtggagatcaaagacataatgagtgtcagaattagttcaagccttaagaaattgttgaaggttaataatggagttaacttcaaggaagaactgaagctcagtgatgaggactcagaagaagataggaaaatgtgggaaggtttggaacttcctagagacttgttgaatggctttgaccaaaatactgatagtgatatggatagtaaagtccaggctgaggtggtctcagatagagatgaggaacttgttgagaactggagtaaaaatcactcttgctgtgcaaagagactggcagcattttgcccctgccctagagatctgtggaactttgaacttgagagagatgatttagggtatctgggggaagaaatttctaagtggcaaagcattcaagaggaaacacagcataaaagtttgaaaaatttgcaacttgacaatgcagtggaaaacaaaaaatgattttctggggggatattttggccagcagcagaaatttgcataagcaatgaggagtcaaatgcgaattgccaagacaccggggaaaatgtctccagggcatgtcagagaccttcacagcagcccatctcagtgggaaaacgtcaacatttccccattcagtattaatgttggctgtgtgtctgtcatagatagcttttattaccatgaggtatgtcccttctatgccgatcttgctgcggttttaatcataaagcgatgctgaattttgtcaaatgctttttctgcatctattgagataagcatatgacttgtgtttttaatcctgtttatgtgatgtttca

SEQ ID NO: 475624 - DNA, 1808 bp, Homo sapiens
tctaaaatcttgaacagctgagcatgatgttttggtatagctgcaaaattcaacctctgctccagaggtcactgcatgcttctgtcctgacagcccaaattgttaagcatgtgactaatatgcatacagaacacaggctgcctgacgtctgctacaagcttgatggctgtctccatcttcctgtccccaccctgatttctaccaaatgtaaatctctgatgaagatgcactttctccttccctgcccccagtgtgtggattgggagccctattatattcttccactctgtgtctctccacctttaccaacagaaaaattaggagctaggagaaacactaggggaaatagaaaatctacatattgtaatcactcgtatctcaaagttggcagtggttctgataatcaaagaggcacttactgttcttgtctccaagattttccataacgcaaatataaatgaaattttttcatgaagtgcttctatgtctgcagatgaatatctttgagtatcaacaagggtattacacaaatatgaaatgaacccagttcatcgagagagagctttgtttgtttccaagccgaaacggtctcacctaagataaggctgcctggttatttcacttttcacaactatcctaaaaggaagaagcaaaaacaatttacagtatgtgctgggtttaattcaatattttaaataatggaaatagcatcgatggcaggtttttattcctgacggttaggtagttttacattagtatctacctaaaactttcaagaccatgtttcgagtattttattattcgaattaacaagaagtaaagtaaattatagtatccaggccataaacacattttgatattagtgagtggattcttatataacttaaaatttaatcacacattatttactgtaaaatatagctcatcagctaattttaaaaacaaatttgagcatttgtgttgtactttagcaatgatattaatatagaaaaataagaaaatgagaaatgaatattaaaagttagctgtgtgttgcacaaaagtggaattttacaaaattgcacttatattaactatcaggatatttaacttttaattttaatgttattaatacattttagaagcatcagtaatctgaaaataaagataaacatcataattttatgttttgtttatattcagtttattgtatgacatttgcaatacatctaataattcttatgtgagaattgcataacagaatttctatcagatcttgccaaattaaaaactaaatattcctacattccacatttttcttattataattttggctatattaacattttacaaagttactcaaattcattactttattaaattttcaatgtagaatttggacaattttaatatgaaaataaaacgggaattaaaaggaagagcagaatatggaaatttttatactccttttattttcccccttaagttataagtttttatacggcataaagaaaacatacacagggttaatcttaatacgaatatttttctttaatatatttaagcaatgtgttaaactgtgtgttggataaaaacaaaatcaaaatgcttcttgatgcatatataagagagatttaaatatatagacaaatagggggaatggttttaaatactggcaagttatgtgttaggagcaattgttctgcaacacaactttttgaacaggttttatgtactttgtgaataaaactttgagctgacagtctttctgtctataaatgcagtcccaacattctatccaaattttactgtatttttgagaaagcaag

SEQ ID NO: 475625 - DNA, 905 bp, Homo sapiens
ccccatcagcgcctccctgctgcagcccgtcacgctgatgcaacatgtgggatcccatggccttgggcagctccacccctgtagctttgcagggtacagcccccctcctggctgctttcactggctggcattgagtgtctgcagcttttccaggcacacagtgcaagctgtcagtgggtctaccattctggggtctgaaggatggtggccttcttctcatagctccagtaggcagtgccccagtggggactttgtggagatcaggaatgagtggaggagcggaaagcagagtgattcactgaaggactgtttccagagcagctgctctggtcatctctctatcctttctctcaccctctttacccaaaccaactggctgtcttctgtttaccctgaggcaggacatggacaactgttctctacagaaaatgaaccatctgtctcagaaaagctaggactgctggtgagggtactggagccccagagagaaaacctctttattttagcaaaagaagggctttctccatatccacactaactaaagagttatgaatagatgattcctttctaatatttgtgcttaaaaatgcctacaagattataagctcttaaaagacaaaatctgcgtctaatttatttttacattcctttctgtcattagcatagtatctctaagcagtacgtggttgaaggtaattgaataaaattatgagtagaagggaaagcaaaatgaaacaaaaaaggttaataaaaacatatgtgttaaaagaaagaggaaagatgactaaaacttaggactgctaatgttaaactctaaaaagcattgggaatggctcttattgaaagatttaaaagaatatcaataggtataatagactagaatggtaaaacaagtggaaaataaa

SEQ ID NO: 475626 - DNA, 512 bp, Homo sapiens
ttctgcaactttgtagttctttcctacggactatggcggtttttcagactctccttgtttttgatgacgttggtagttttgaggagtacccatcagggaaacggttctcacccaatgccagatctgctggcaccttgatcttgggctttgctgtctccaaaacaatgagaaataactgtcagttgtttaaggacataggcatgggcaaagacttcatgactaaaacaccaaaaacaatggcaacaaaagcaaaaattgacaaacgggatctaattaaactaaagagctcctgcacagcaaaagaaactatcatcagagtgaacaggcaacctacagaatgggagaaaagttttgcaatctatccatctgacaaaggtctcatatccagaatctgcaagaaacttaaacaaatttacaagaaaaacaaacaaccccatcaaaaagtgggcgaaggatatgaacagacccttctcaaaagaagacattcatacagccaacaaacatgaagaaaa

SEQ ID NO: 475627 - DNA, 546 bp, Homo sapiens
caccgagtattttttgttgcgactgaatgttattggtgcccttaaaaatgactcttgagagctctttctgtccaccatgtgaagctgcattgagaagccagcagtctgaaacccaagagagctctctcatcagaacccaattacgctggcactctgctgttggacttccagcctccagaactgcctggacccgagagcagagagctattcagttgtggatgtgtgctattctattcttcaaaattaaggaaggggggctcaaaggggatttggagacaattacagctgctacttttagcaaaaatccagagggtatggcaaggtgggccatggttgcctccattctgatttcaaaggacagaaatgatgctcagaggagctgtgtgggagggccatccagtgaagccctgggtgagtgacctcagccctgacaaaaaactgtgccataagtgggtccagtgcatagagtcagcagcgagcagtgcctcactgagctgtcggggactgtctggaagaagcttaactctttttatttgtttcttcaaa

SEQ ID NO: 475628 - DNA, 931 bp, Homo sapiens
tgctcatgtacatccttaccgaggaaggctttctggatattccaaagggttttggtgttgtgatataagctgtatctgctttagggtatgccccaagcccaggtggcactcaaaccaaagacacagtccttcccattattcctccaccccttggcaaaagcagagcagtcttatcctgtggccaccatcaccagaggcccatggggaatactgccagactactgtcaatgttccctcaaggcccaagggctgttaaatcagtctgtggtgagtaatgtctggcctaggattcacccttcagggaagtggactctcctctggccagggccaagggtcaagtcctggaatcaggtaccccaagacatgacttggtattctattcccctgtggccaagctggtacctgaggtcagcaagtctcagaagcccatccaaggcccttgctgtattacctgggtatcgctgctgcttattcagggtccaagattcttcagatagcaggtgatgaatgttgccaggactgggtccttcccttcaaggcagtgggttcccttcttccctaagatatgtctagaaatgtctccctggagctaggaggttttgctttatatattttgaggctgtggtgttagttgtaactatgcttataattatgtctttctgttaaataaatcattttatcactgtaaaatgtttgattctaacagcaattttgtgttaatgtctattttttcagatgtatttatagcatcttcagctgtctcaggcctgattgattgagataaaagcagcactgtttatctaaaaagatgcacagccttcctttttcagcagtgagcaaattaagacctctgtgattttgaaggacaactgcggctaaggagtctacctgtgattggagggttgaaacagtgttagctatgtctttttaa

SEQ ID NO: 475629 - DNA, 640 bp, Homo sapiens
ctgttacccctcacccattatggtctccaccttcctttttctccatgtatcggtatccagaatttgccctttggatgttctaactctcagcacctctcaggttgctagaaaaagatctcaaaatggagaaagattaggccaagttacaccacataaaaggaatgaaaagggagagaaaaaggagacaagaaaaccaagggcaggagagagagggagagaaagagtacaagaagtgaagtgggacactgggagagaggtgtctcctggggagctccaaggacaccaatacaccaaaggagacatggcagcgctcatcaacattgaatttcactgtgaaagtgtgtcagaatatgtgagatatggtttggctgtgtccccaccagaatctcatcttgaattcccacgtgtagtgggaggaacccaggggcagatccctcttcatcttttcccctcacctccagaaggctatatgaattgaatcatatagtatgtacatttttaagattacctttttttccattcactcagcataattcccttgagagccatccaagttgttgcatatatcaataatttatttgtttttaagtagtagtctatggtatggatataccaccatttgtttaagcattcatctatt

SEQ ID NO: 475630 - DNA, 2130 bp, Homo sapiens
ctgccagcatgctgtcacctctcacttccaaaggcttcacttggctctgcattttcttacgtacaatgaaagacagaagacaacaaagagaaacccctttaaagttctcagatttctactggctgctctccatcccttcacactacagattagccatccagacagttttaacttcacttccattcaaagaacacccaagcgcatctgcagatcttgtgagacttactatcatgagaacagcacaggaaagaccggcccccatgattcaattacctccccctgggtccctcccacaacatgtgggaattccgggagatacaattcaagttgagattttggtggagacacagtcaaaccgtatcaccttactacagttgtctttctccgatattaataggaacgtttctattgtttccccattaaggaagacgctagcttcagtaatagggcatacatgttttatcatggaaaaaaatattcatcaattgctatttgcttgactgcattttttcaggaatgcagtgaattgtgttggaagctttttcagtttctatagagacaatcctttgatttttttcttagatattatttatattatattgatggatttttaaatattgaaccatccacacattcctaaaataaatctcatggggtctttatgtattattttcttatagtaatgccagattctatcaatatttcacttggaacttttgcatcaatattcattggtgatagtggtctataaatttctttttcaggtactgtcttattaactttataatatcaatgttacattcacttcataaaagcatcagctaattttcctgttttcagtactccaggataattcatggagcactgggatcatctgctctttgaagtttgctaaaattcccctgtgaatttccacctggacatgttaaccttttgtagagtagttcttggataactttctcagtttctgctctaattgagtcaatttggtaaattataacttcccaggaaattacccatttcgtcaacattttcaaattcattttcttagactctccaaaatagtctcatgacattttaaaattatgtctgactcaatttttttccatgtcatttattattttgtatatttgtgattttttccttttgtttcttgattatcttatctacaggtttgtctatattaatgtttcaaataagttttattaattagatctactcttattaatttctgctttcatcattttaatttctttgagctttcttctgatttacattggggttttctctaactttttgtgctttgaatttattttcattctttcatttttatcaagtagagtgttttgtgctacaaatttcactctaatacactctgaatgtattctgccagtttaaatatgtcgtgttttcattagcattgttagaaattatataattttatattgtatttgctcttttaatcaagagtggataacagaaggttatgaaattgaaaggttaaagaattcttttaagttaaataaagtaaaaatgaaagtttaagcaagttttggaaggttaattgtaaaggaaattctgtgtgtaaacatattgactaaagatgaagggttatcgtctagtttttctgtaaattgatcattaaaataaaagcacaactggtttctcttaaagcactaacctgttctttaacaaaaattataaagggttaaaagggtctataaaaaatcttaacttacagtgaaacattaaaattcggtaactttgtctacaaggtttcattaaaaattgagtttaacattaaaagcacactaatataaaggtaaaatttggcttatttggtatgaaatcatacaggaagtattgtcaaatataaaatggtgtttggctttctttgggctatatttgtataaatatgttattggtatgtgttccaaagttatgggagactcctataattctgatatatcttggcgtacattaacatcaataattataattattatgttaaaattattgtgtgtcacaaaggtaacagatatccttgtcaattgtgtctttaactatggctaccctaaaactttttgtcatccataaacaattgtcttcttttggtcctctttagaaggc

SEQ ID NO: 475631 - DNA, 1751 bp, Homo sapiens
gcagcgacctggatgagactggagactgttattctaagtgaagtcgctgagacacaggtccagttcgttgcagtccagcttgtcgcggaggttcccccccttgctactgccttggtcatggtgacaccggctgggcgggtccctgctctggggttccgactggtggaagaaaggagctgaaatgccgcttgtcagttcagcgggcccccacccaaccgactacccctgagccctccgtcgccgccggtgcgatactgcctccgccggtccgcccgcctgccgcactccgagccccgcgcctacctcccaccggtgcccactctatgtctttttattggagagacagcaagctccccctatctctgggcaggtccagtgatgacgtctgtgacaagggcctggagttggaaaccttaggaatctacctggtgctctcttctactgaagctgtgctggcacccatactgcaagacaaagttcttctcactcttccctcccctttccataaccagaggaatctctctccatggccatcaccaccccagtcctgtggtgagtactccctggctattgctgatggttcactcatggcccaagggttcttctgtcagcttgcggtcaatgctgccaggcctgtgtctctcccttcaaggggattgtgctcccctctgtcccagggcaggtccagaaatcttgtccaagagtcacagcttagaattgggagccccaagaggctgcttgttgttctacctcactgtggccaagctggtacctaagctcaagacaaagtttccttcactcttactgtttctttccgaaagcaaaaagagtctctccctgagccaccgcagctgggaatgtgctgggtcacaactgaagccagcacatctttgagtcttactccagcccatgatgattactgcctaccattgctgattattcagtgaccaagggctcttttttaaaactttcaagttttgggcatataggtggtttttagttatagtatcttatcttaggataagttctttagtggtgatttctgagattttggtgtacctgtcatccaaatagtgtacactgtagccaatatgtagttttttatgcctcaccaaccccaacccttctccccgagtccctaaagtccattatatcattcttatgcctttgcattctcatagcttagcttccacttataagttagaacatatgatatttggttttccattcctgagttacttcagttagaaaatggcctccagctccatccaggttgctacaaaggctattatttcattcagttttatggctgaatagtatcccaaggtgtatatgtaccacattttctttatccactcgttggttgatgggcatttaagttggttccatatttttataagtgtgaattgtgctgctataaacaggtaagtgcagtgtctttttcatgtaatcattttcctctgggtactcagtagtgggattgctggatgattggtagctctatttttagttctttatcaccatagtttccatagtggttgtactagtttacattcccactagcagtgtaaaagtgtttcctttttaccacatccacaccaacatctattatttcttgatttttaaattatgaccattcttgcaggaatatggtgatactgcattgtggttttaatttgcatttcccttataattagtgatgttgagcattttttcccatatgtttgttggctgttggtgtattttatttc

SEQ ID NO: 475632 - DNA, 1043 bp, Homo sapiens
gttccctgagactccccaactagtcaatttgccagccagggacctctggctggtgacgcccctcactgggactcactcagacccgctacctgctgcaggaggcaccctgcccacttgcctgacctgggctaagtttggctttgtggctgagtccagggcttttgtgggcttagactatgggagtatgtgctgactggtttggctcagaagacaggaagatgtgggaaagtttgaaacttcctagagacttgttgaatgtccttgaccaaaattctgatactgatatggacaatgaagtacaggctaaggtgctctcagatggaaatgaggaacttgttgggaactggagtaaatgccactcttgctatgctttagcaaagagactggtggcattttacccctgccctagagatctgtggaactttgaacttgagggagatgatttaggatatctggtaaaagaaatttctaaatggcaaagcattcaagaggaagcagagcataaaggtttggaaaatttgcagcctgatgatgtagtagaaaagaaaaacccattttctggggaggaattcaagctggctgcagaaatttgcgtaagtagttgggagctgaatgttaatcaccaagacaatggggaaaatgtctccaaggcatgtcagaaacctttacagcagcccctctcatcgcatgcccagaggagaaaatggttttatagaccagacccaggcaccccctgctctgtgtagccttgagacatggtgccctgcatcccagctccttcagatccagctgtggctaaaaggggccaagtatttagtgaagaatgtaaatactggaaaacagaactcattcagattatctaactattccttcctgaacttaactcatctttttgtcagaaatataaagtgaacaagagttgaaaatgtcattgaagcataccttcacttctccctctcatttaattttttttaaaaaaatctcccctttactgttaccctctttaccttttctttggaataatttcttggttcaaaactatt

SEQ ID NO: 475633 - DNA, 2400 bp, Homo sapiens
agactgaaggaggagccaagatggccgaataggaacagctccggtctacagctcccagcatgagtgacgcagaagacgggtgatttctgcatttccatctgaggtaccgggtttctctcactagggagtgccagacagtgggcgcaggccagtgggtgcgcgcaccgtgcatgagccgaagcagggcgaggcattgcctcacctgggaagcgcaaggggtcagggagttccctttccgagtcaaagaaaggggtgacggaggcacctggaaaatcgggtcactcccacccgaatattgcgcttttcagactggcttaaaaagcggcaaaccaggagattatatcccacacctggcttggagggtcctacgcccacggaatctcgctgattgctagcacagcagtctgagatcaaactgcaaggtggcagcgaggctgggggaggggcgcccgccattgctcaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaaccggcagactgcctcctcaagtgggtccctgacccctgaccctggagcagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaaagcagagcgcctctcctcctccaaaggaactcagttcctcaccagcaacagaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaacaagggaagtttagagaaaaaggaataaaaagaaatgagcaaagcctccaagaaatatgggactatgtgaaaagaccaaatctacgtctgattggtgtacctgaaagtgatggggagaatggaaccaagttggaaaacactctgcaggatattatccagggaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcaggttaccctcaaagggaagcccatcagactaacagcggatctctcggcagaaactctacaagccagaagagagtgggggccaatattcaacattcttaaagaaaagaattttcaacccagaatttcatatccagccaaactaaacttcataagtgaaggagaaataaaatacttcacagacaagcaaatgctgagagattttgtcaccactaggcctgccctaaaagagctcctgaaggaagcgctaaacatggaaaggaacaagcggtacccgccgctgcaaaatcatgccaaaatgtaaaggccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagccaatggaaaacaaaaaaaggcaggggttgcaatcctagtctctgataaaacagactttaaaccaacaaagatcgaaagagacaaagaaggccattacataatggtaaagggatcaattcaacaagaagagctaactatcctaaatatatatgcacccaatacaggagcacccagattcataaagcaagtcctgagtgacctacaaagagacttaga

SEQ ID NO: 475634 - DNA, 743 bp, Homo sapiens
cattttcctcttgatacttatatcgctgatttattgaaatgagcaaaagcttgtaccgcagagcagcctaccacgtttggctctggcgaggggaggtgcggaatagggtagagggacaggggaccactctggacagagtcttgcagggcgttcaactcaagggcttcccagcaaggcctcctcagctgcttctctcagacaccccagcttcagttttgctgctccaaacaggccaggtggcatctatatcttcacatcacagctcacaacactggctgaatgccaagtggacccagaaaactgacagtttaggctcagtctcaggatttctttgcgtaaaatttcagaatgaaaatgtagctctgaagagatgttctcctgggtgcaagttcacccttcccaccacagacgtcagacctctccaagatctgcgccacgtgaggacagcagtgagaacagcttcccgtgaatctggaaacgggctgtcaccagacactaaacctgctggcatctcaatcttggactctccgacctgaggaactatgagtaataaatttctgttgcttataaattacccattttaaggtattttgttatgtaacagaccagatggacaaaaacacagcctgagcttctagccagggcatttcattcccatggagtatggactatttcatggttcctgcatctgtacactgttctattgcaaacttttgttgctgattcttacagaggtcatcatg

SEQ ID NO: 475635 - DNA, 682 bp, Homo sapiens
acagcaacaacaggccaattaaacaggaaattcttgtcctcttcaaagaggagaagatgagaacagagactaagaaggataaaggagagaataagaccaggaaatacttcccagaaagaggaggcaggatttcgcgttcaacagatgagaaagaggacagagaagagcagaaaactattaaaagatccaccaaggatgtgcagctaggcatctgcaaggatcttagcatacttgagcttagtgcaccgcctagtgctgaaacagctgcagtgaccgcaagcttagaaaaacagaatccaccaagccgactaaataaggcaccagtgcccaatgctggagtgatggagatgtgtgacatctcagacagggaattcaaaatggcagttttgagaaagcacaacaaaccgcaagatagtacagagaagaaattcagaattttatcagtgttatttgaaaagacacagccagagggagaaaaggaaatagtataaaaaagaaagtagtatgcctataagagctagaaaacaacattaaaaaagtaaaactaatagttactggccttaaagcagacatagaaaaagagattgaggttaaaagtttattcaaataaatagtaacatagaactttctaaacctagaaaaagatatgaatatttaggtacaagaaggtcaaagaacgtca

SEQ ID NO: 475636 - DNA, 525 bp, Homo sapiens
attcacaggagagtaccatctgcaccgtgcgtctgaagactctcagtctgagtgagagagttagaatattctgtggataaaaccgggggcacaggactcagcagcgatgcacgtttgtcacacaggtgccctgacccaaattttccagttagaaggcagagaatatgagtgtgggtaccacgggacaaccacaaaatcctcccgagacttggatcaggtcagcaccaagcagggtcctgtgaagtgtgcggagcctgctagccctttgccttcatactgcatcctgtcaggagggggacttggagggttaagccacatgctcggacgggagctgaggaagggtgcagctgcaactgatgccaagctctttgctccaagcctaggaccccaagtgagtcatatagtgggcgttcagccacgttgccgtgcagctcagaaggagcctgacacaaggaggggctggccatctgtggaggtggacggggcagccaagtcagactccagagtgagggacaggggttaggt

SEQ ID NO: 475637 - DNA, 618 bp, Homo sapiens
ttttcagtggaaaggattgtaatgattctaaatgaacacttgccagttatggatttattacctgtcaacttcaaattcaacctttgtgccttgcttcttgaatatggatctggggcctttaaatatttcccctttgccagtagacatgatgttaagctttgtctagggacagcactagagagacgctgcaggaggaaaggggttttgcgtctcggttcaggtgttcttgcttctcatgttcccttagcatgggcattttctccagcagttgacaactggggcatgggtggcttcttcagcactaaacttctgaagcactcacagatgctccggtacatggtccccacaatgtcttcatgcacccacctcaggaaattttggactggagtgcttccagggaaaaagaattggatatggttgttttcacgtagaatacagcgctagagctgacagcagagcaaatttatttgctcgtttatgtaatcatttccaggtattagcacattacttattaacaaatgatttaaggacgttggtggaaaaggggcctgcatggggatatttatttagattttcaaatagtttgaaaaattaaagcataagtctaaacttggtgtc

SEQ ID NO: 475638 - DNA, 932 bp, Homo sapiens
agttatgaagacctgctcaacgtgtgccaatcttcttgatggtccagtctcttgtatatcatgatatcagagaatatctggagctttagggaagagaagaaattcaactttagggaagagaagagaatttcaacttgcaataaacacagtgacagagagaggcaccggaatgcatgttccacgaagagacagaaattttttctatcattcatcagtgtacccaggaccttgccagataaacagtggagactacatgcatctgctgaaatctgcatgcaaagtcctataaggagtctctcctcacggccaccactgcccatgtggcaagtgggttcccttctgccccaggatgggtctagaaacgctgtccaggaaaaggagtgtctctgtggccactacagctgggaatccactgtcacaccggaaggcagcacagtacagggtctcacccaagtaagcgcccatggcactgcttcttggatactgctgatgtttattcaaggcccaatggctccttaataagcaggtgatgaatcttgagggaactggctcctcctgtccaaggcagcagttcccttctggccgacagtgtgtctagaaatgtcagattgcctttctaaaacacgaatctaatcatgttcctctcttcctgataaacagccatcaatgtttcatatatatgtctacaagaagtctgtgttcataaaccacttggcattcctcagcctcagtatgtgaactgtgtaatacatattttcaaaaaacatcttctgcttgtttctgtgacaaattagcttactgttgatatactgaatcaagaacagtttatttataagcttctttttatctattattgagcatttaggaaaaatcaaaacctgaactgagaaaaatctttttaagtgcttggctgcctcagaaatgaggacagt

SEQ ID NO: 475639 - DNA, 1105 bp, Homo sapiens
gttcatcagctcctggtactcacgcagctgccgcgctatgtcctcctgctgggccggctgcggggcagcctccagctcggacagcttgcggttggcatccttaacggacagctccccactctgctcggcatctgtgatggtggcctccagggaaacttctggcctttgaggccctcaatctcagcctgaagctagctgatgttccggttcatctcagagatccgagtctttgtgcgctgtaggtcacccccatgcttcccagacagcgtctgcagctactcatacttgatctggtacatgctgtcagcctcagcctggctgcggttggccatctcctcctactgcgcctttacctcagccatgatgctgtccatgtccgggagtggctgttgtccatggacagcaccacagactcagcccttccacacgagactccagctctaccttgttcatgtaagcttcatccacatccttcttgatgaggacaaattcattctccgtctctgtacgcttattgatctcatcctcgtacttgttcttgaagtcctccaccagcccctgcatgttgccaagctccgcttccagcttcagcttctcctggcccagagtctccaactgcctcctaaggttgttgatggtcttgatctgctccttctcctgggtgcgcacggcctggatgttggggtccacctccaggttaaggggactcagcaggctttggttgaacgtgatggcggtgatgcctcccatgccgctggccccaccatagcctccacccagaccacccaggaagctgctgctgctgcccactcaggagaagctcaaggagctgatgcgggcactgggcccacttgtgtaggaacagctgctgaagtcctgggagccagaggtggacaccttgtaggacttctgggtcaccctgatggacaaggtggaagcaggagtggaggcaggcgggtgggctaaaccagacggagatcccagaaagagcagagaagctgcttcttggtggaaaatcgttttatactttaggatttgtattccaaagtatcagtagttttcaaaaatgttaactatgacccatgataagaggtaatattacagc

SEQ ID NO: 475640 - DNA, 2189 bp, Homo sapiens
aggacaggaactgcctattttcacctcttttgtggttcttcagttgcttcaggacatctggatgtatattatctgattcggaaggcgaggtctaaagaatctgtgtttctaacaagttcccaggcgatgctgctgctgctgctggtcttggactgcactgtgagacccattggtctatatcccagtataccccactatattctaaccccactaaagattcctctcagcctcctggcagatttggaaaagttgaaacaaatgggtgctagagttaaacaggatgaagaggtgcagagatgctctgggctgattgctggcgctgttgttgaagttcagaggaatagctcatctgtctctatttcaggcatctggcaaatggagaactgtttcagcattctccattccactaaacgcttacagatgacttccatattctggagcatctgctggttatctcattttgagttacttttcccgttgtgttttgaaaagactctctctctagcttttatttttcttccagctttacccaatgataacgtcttaataactttaaaagaataatctaatacagaaaattgacaatggtttaatactattaactacataccttaatttggatttcaggagtttttactggagctatttttggcatattataaaattttatcacatttgtagatttgtgtaactaccaccacaatcaagacacagaatggtttcatcaacctcaaaaactcccttgtgttagcttttatacttacactctattctccttggtggccactaatccttggtggccactaatctcttgtctacttccatagttttgtcatatcaagagagctatataaatagaatcataaagtatgtaatcatttgggataggctttttttttactcagcataatctcattaagatcaatccaagttattgtatctatcaaaactttgctccttttattgctgagtagtattctattatatgaatgtaccacaatttgtttatctatccattcacccattgaagtgtatttatttccagtttggtattattacaaataaagcagcagtgaagatttgtgtagagtagctcctcagtatctatgggggattagttccaggacaaaatgaagaaatcataaagcaaagtaattggttagtcaatctaggtgtaattattagaggaaattgctaaaagtagaagcactgaaaaattactacaattagcagacatttgtgcctttaaggtgataggcgaggcagaccatggatttttaaaacatgaaatgaaataataacttttgtacttttatgatatgttgaacacaggccatcctggcaacttgcgaagtattaagattctagtttcttgggtaggtgaagtataatagattttagatgattacaaatcacttcacttgtgatttggcacttacttctcagattaacaaatcatgtaaaaatgattcaaccattgcatattaaaagcttggagataaagttgattgtatctatttcactgagtttaaaaagattttctataactgttcacacagtcctgcaacattacacacaattttcacaagttattgtggaaatacaaggtaaaggcttatttcattaatacatcatttggagaaaacatgaaaagtgctttaaaatgctaattttgttcaggcatgatctgaacaagaatgacttagatgttagacattgtggtcattctcatttttaaagaataccagtgagtcatatttttgcaagttgatctcaaagaatttgtctaagagattaaaaagtatatattacattggttattaagaacttgattatttagtagagttggctgtgttttacagaatatcactctaaaagataggacagataataatgataagaataaataactgttagtttctatgttccatcttcttttcattcaagcctctcaacacacattgaacatgatggctctagctaagtaatcaaaagacaatttaaaaaattgcctatttagcaatgtttctatcaaaatagtaggctatctcctagaacattaaaaaaaagccggctaattattgaaataaacagctcttaaatatcgatcttatttcagtgaagatttgttgcttgctcacatcacatagtccatggcagtctggcatatctcttcaaaatagtgatgc

SEQ ID NO: 475641 - DNA, 1115 bp, Homo sapiens
gaatggagttgaatggaatcatcatcgaatgagatcgaatggaatcatcgaataacatcgaatggaatcatcgtcgaatggagtctaatggaatcatcaaatggactcgaacggaatctggaatcatcatcgaatgcaagcgaatggaatcatcatcgaatttcatcgaatggagtcatcatcatatggaatcgagtggaagcattgaatgggctcaaaagaaatcatcggagaatggaattgaatggaatcatcaaatggactcgaatggaatcatcatcaagtggaatcaaatggaatcatcgaatggacacgaatcaaatcatcgttgaatggaatcgaatggaatcatcgaatggactcgaagggaatcattatcgaatggaattgaatgaaatcataatcgaatggagtcgaatggaatcatcatcgaatggagaaatcatcgaatgggatcaactggagtcatcgaatggaatcgagtggaatcatcgaatggatttgaacagaatcaacatcgaatggaatcgaatggaatcatcgaatggactcgaatggaatcatctaatgcactcgaatggaataatcatcgaatgtaatcgaatggactcatccaatggaatcaaatggaatcatcaaatggaatcgaacggaatcatcatcaaaaggaaccgaatggaaaatcatcaaatggattcgaatacaatcatcgaatggactcgaatggaatcatcatcgaatggaatcaaatggaatcatcaaatggactcgaatgaaatcatcatcaaacggaatcgaatggaatcattgaatggaatggaatggaatcatcatggaatggaaacgagtggaatcactgaatggactcgaatgggatcatcatcaaatggaatcgaatggaatcatctaatgaacttgaaaggaatcatcatcaaatgaagtcaaatggaatcaccaaatcgacatgaatggaatcatcattgaatagaatcgaatggaatgattgaatgggctagaatggaatcatctttgaatggaatcaaagggaatcatcatcgaatggaatcgaatggaaatgtcaaccaatggaatcaaatagaatcatcatggaattg

SEQ ID NO: 475642 - DNA, 785 bp, Homo sapiens
atcaaattgtcaatgaacggaattgaatggaatcatagaacggaatccaatgtaatcatcattgaattgaacccaatggaatcattaaatggactcgaatggaatcatcgaatggactcgaatggaatcatcatcgaatggaatagaatggaatcatcgaatggaatcgaatggaatcatcatcgaatgaaatcaaatggaatgatcatatggactggaatggaatcatcctcgaatggaattgaatggaatcatcgaatggaatcgaatggaatcatcctcgaatggaatctaaggaaatcaccgaatggacacgaatggaatcatccaatggatttgagtggaatcatcattgaatggaatcgaatgaatggaattcaaaggaatcatcaaatggacttgaatgaaatcattgaatggactcaaaaggaatcatcatcgaatggtattgaatggaatccgaatggaatcgaaaggaatcatcatggaatagattcgaatggaatcattgaatggaatggaatggaatcatcaaagaaaggaatcgaagggaatcatcaaatggaatcaaacggaatcatcgaatggaatggaatggaatcatcatcgaatggactcaaatggaataatcttcgaaaggaatcgaatggaatcgaatggaacaatcaaatggactccaatggaatcatctaatggaatcgagtggaatcatcgaatggactcgaatggagtcatcatccaatgaaatcggatggaatcaatgaagggactcgaatgaaatcatc

SEQ ID NO: 475643 - DNA, 1506 bp, Homo sapiens
gaatggagttgaatggaatcatcatcgaatgagatcgaatggaatcatcgaataacatcgaatggaatcatcgtcgaatggagtctaatggaatcatcaaatggactcgaacggaatctggaatcatcatcgaatgcaagcgaatggaatcatcatcgaatttcatcgaatggagtcatcatcatatggaatcgaggggaagcattgaatgggctcaaaagaaatcatcggagaatggaattgaatggaatcatcaaatggactcgaatggaatcatcatcaagtggaatcaaatggaatcatcgaatggacacgaatcaaatcatcgttgaatggaatcgaatggaatcatcgaatggactcgaagggaatcattatcaaatggaattgaatgaaatcataatcgaatggagtcgaatggaatcatcaccgaatggaggaatcaaaggaaatcatcgaatgggatcaactggagtcatcgaatggaatcgagtggaatcatcgaatggatttgaacagaatcaacatcgaatggaatcgaatggaatcatcgaatggactcgaatggaatcatctaatgcactcgaatggaataatcatcgaattgaaatcatcatcagatggaatcaaatggaatcatcactgaatggaatcaaatggaatcatcgaagggaaagagatggaatcatcatcgaatggaatcaaatagaagcattgaatgaaatcgaatggaatcataatagaacacaattgaatagaatcatcatcgaatggactcgaatggaaacatcgtcaaatggaatcgaaaggaatcatcatcgaatggagtcgaatgaaatcatcaatgaatggaatcgaatggaatcatcagagaaaggaatcaatgatcatcaaagggaatcacaggaaatcatcgaatgggatcaaatggagtcatcgattggaattgagtggaatcatcgaatggatttgaacagaatcaacatcgaatggaatcgaatggaatcatcgaatggactcgaatgcaatcatctaatgcactcgaatggaataatcatcgaatgtaatcgaatggactcatccaatggaatcaaatggaataatgaaatggaatcgaacggaatcatcatcaaatggaaccgaatggaatcattgaatggaatcaaaggcaatcatgggaatcatcatcgaatggaattgaatggaatctttgaatggattcgattggaatcatcatcgaatggacttgaattgaattatcgaatggatttgaatggaatcatcatcgaatggaatccaatggaatcatcgagtggaattgaatggaatcatcattgacttgaattgaatggaatcatcaaatggactcgaatggaatcatcatagaatggaatcgaatgcaattatcgaatggacttgaatgaaatcacctttgaatggaatcaaagggaatgattgaaaggaatcgaatgccatcatcatctaatggaatcggaaggaatcatc

SEQ ID NO: 475644 - DNA, 1568 bp, Homo sapiens
atcaaattgtcaatgaagggaattgaatggaatcatagaacggaatccaatgtaatcatcattgaattgaacccaatggaatcattaaatggactcgaatggaatcatcgaatggactcgaatggaatcatcatcgaatggaatagaatggaatcatcgaatggaatcgaatggaatcatcatcgaatgaaatcaaatggaatgatcatatggactggaatggaatcatcatcgaatggaattgaatggaatcatcgaatggaatcaaatggaatcatcctcgaatggaatctaatgaaatcaccgaatggacacgaatggaatcatccaatggatttgagtggaatcatcattgaatggaatcgaatgattcgaatggaatcattgaatggaatggaatggaatcatcaaagaaaggaatcgaagggaatcatcgaatggaatcaaacggaatcatcgaatggaatggaatggaatcatcatcgaatggactcaaatggaataatcttcgaaaggaatcgaatagaatcgaatggaacaatcaaatggactccaatggaatcatctaatggaatcgagtggaatcatcgaatggactcgaatggaaatcttctaacggactcaagtggaatcatcatcgaaagcaagcgaatggaatcatcatcgaatttcatcgaatggagtcatcatcatatggaatcgagtggaagcattgagtgggctcaaaagaaatcatcggagtatggaattgaatggaatcatcaaatggactcgaatggaatcatcatcaagtggaatcgaatggaatcatcatcaagtggaatcaaatggaatcatcgaatggacacgaatcaaaacatcgttgaatggaatcgaatggaatcatcgaatggactcgaagggaatcattatcgaatggaattgaatgaaatcataatcgaatggagtcgaatggaatcatcatcgaatggagaaatcatcgaatgggatcaaatggagtcaacgaatggaatcgagtggaatcatcgaatggatttgaacagaatcaacatcgaatggaatagaatggaatcatcgaatggactcgaatggaatcatctaatgcactcgaatggaattatcatcgaatgtaatggaatggactcatccaatggaatcaaatggaatcatcaaatggaatcgaacggaatcatcctcaaaaggaaccgaatggaatcattgaatggaatcaaaggcaatcatgcgaatggaatcgaaaggaatcatcatggaatagattcgaatggaatcattgaatggaatggaatggaatcatcaaagaaaggaatcgaagggaatcatcgaatggaatcaaacggaatcatcgaatggaatggaatggaatcatcatcgaagggactcaaatggaataatcttcgaaaggaatcgaatggaatcgaatggaacaatcaaatggactccaatggaatcatctaatggaatcgagtggaatcatcgaatggactcgaatggagtcatcatccaatgaaatcggatggaatcaatgaagggactcgaatgaaatcatc

SEQ ID NO: 475645 - DNA, 819 bp, Homo sapiens
gaatggagttgaatggaatcatcatcgaatgagatcgaatggaatcatcgaataacatcgaatggaatcatcgtcgaatggagtctaatggaatcatcaaatggactcgaacggaatctggaatcatcatcgaatgcaagcgaatggaatcatcatcgaatttcatcgaatggagtcatcatcatatggaatcgagtggaagcattgaatgggctcaaaagaaatcatcggagaatggaattgaatggaatcatcaaatggactcgaatggaatcatcatcaagtggaatcaaatggaatcatcgaatggacacgaatcaaatcatcgttgaatggaatcgaatggaatcatcgaatggactcgaagggaatcattatcgaatggaattgaatgaaatcataatcgaatggagtcgaatggaatcatcatcgaatggaggaatcaaaggaaatcatcgaatgggatcaactggagtcatcgaatggaatcgagtggaatcatcgaatggatttgaacagaatcaacatcgaatggaatcgaatggaatcatcgaatggactcgaatggaatcatctaatgcactcgaatggaataatcatcgaatggaatcaaaggcaatcatggtcaaatggaatcaaatggagacatcattgaatagaattgaatggaatcatcacatggaatcgaatggaatcatcgtaaatgcaatcaagtggaatcatcgaatggaatctaagggaatcatcgaatggaactgaatggaatctttgaatggattcgattggaatcatcatcgaatggacttgaattgaattatc

SEQ ID NO: 475646 - DNA, 1590 bp, Homo sapiens
atcaaattgtcaatgaaaggaattgaatggaatcatagaacggaatccaatgtaatcatcattgaattgaacccaatggaatcattaaatggactcgaatggaatcatcgaatggactcgaatggaatcatcatcgaatggaatagaatggaatcatcgaatggaatcgaatggaatcatcatcgaatgaaatcaaatggaatgatcatatggactggaatggaatcatcatcgaatggaattgaatgtaatcatcgaatggaatcgaatggaatcatcctcgaatggaatctaatgaaatcaccgaatggacacgaatggaatcatccaatggatttgagtggaatcatcattgaatggaatcgaatgattcgaatggaatcattgaatggaatggaatggaatcatcaaagaaaggaatcgaagggaatcatcgaatggaatcaaacggaatcatcgaatggaatggaatggaatcatcatcgaatggactcaaatggaataatcttcgaaagaaatcgaatggaatcgaatggaacaatcaaatggactccaatggaaacatctaatggaatcgaggggaatcatcgaatggactcgaatggaaatcttctaatggactcaagtggaatcatcatcgaatgcaagcgaatggaatcatcatcgaatttcatcgaatggagtcatcatcatatggaatcgagtggaagcattgaatgggctcaaaagaagtcatcggagaatggaattgaatggaatcatcaaatggactcgaatggaatcatcatcaagtggaatcaaatggaatcatcgaatggacacgaatcaaatcatctggaatcatcaaatggattcgaatggaatgatcatcgaatggaattgaatggtatcatcgaatggactcgaatggaatcatcatcaaatggaaccaaatggaatcatcgaatggacacgaatgcaatcatcattgagtggaatcaaatggaaccactgaatggcatcaaatggaatcatcatcgaatcatcaaatggaatcatcgtcgaatggattcaaatggaatcatcgaatggactcgaatggaatcgtcatggaatattcgaatggaatcattgaatggaatggaatggaatcatcatagaaaggaatcgcagggaatcatcgaatggaatcaaacggaatcatcgaatggaatggaatggaatcatcatcgaatggactcaaatggaataatcttcgaaaggaatcgaatggaatcgaatggaacaatcaaatggactccaatggaatcatctaatggaatcgagtggaatcatcgaatggactcgaatggagtcatcatgaaatgaaatcggatggaatcaatgaagggactcgaatgaaatcatggaatggactctaatggaatcatcatcaaatgaatttgaatgggatcatcatcaaatgtaattgaatggtatcattatcaaaagaaatccagtggaatcaccaaatggactcgactgtaatgattaaatggactcgaatggaatgatcaaatggaatcgaatggaatcatcgaatggactcggatggaactgttgaatggactc

SEQ ID NO: 475647 - DNA, 1711 bp, Homo sapiens
atcaaattgtcaatgaacggaattgaatggaatcatagaacggaatccaatgtaatcatcattgaattgaacccaatggaatcattaaatggactcgaatggaatcatcgaatggactcgaatggaatcatcatcgaatggaatagaatggaatcatcgaatggaatcgaatggaatcatcatcgaatgaaatcaaatggaatgatcatatggactggaatggaatcatcatcgaatggaattgaatggaatcatcgaatggaatcgaatggaatcatcctcgaatggaatctaatgaaatcaccgaatggacacgaatggaatcatccaatggatttgagtggaatcatcattgaatggaatcgaatgattcgaatggaatcattgaatggaatggaatggaatcatcaaagaaaggaatcgaagggattcatcgaatggaatcaaacggaatcatcgaatggaatggaatggaatcatcatcgaatggactcaaatggaataatcttcgaaaggaatcgaatggaatcgaatggaacaatcaaatggactccaatggaaatcatcgaatggactcgaatggaatcatcatcgaatggaatcaaatggagtcatcaaatggactcgaatgaaatcatcatcaaacggaatcgaatggaatcattaaatggaatggaatggaatcatcatggaatggaaacgagtggaatcactgaatggactcggaatgggatcatcatcaaatggaatcgaatggaatcatctaatgaacttgaaaggaatcatcatcaaatgaacgaatggaatcatcatcgaatttcatcgaatggagtcatcatcatatggaatcgagtggaagcattgaatgggctcaaaagaaatcatcggagaatggaattgaatggaatcatcaaatggactcgaatggaatcatcatcaagtggaatcaaatggaatcatcgaatggacacgaatcaaatcatcgttgaatggaatcgaatggaatcatcgaatggactcgaagggaatcattatcgaatggaattgaatgaaatcataatcgaatggagtggaatggaatcatcatcgaatggagaaatcatcgaatgggatcaactggagtcatcgaatggaatcgagtggaatcatcgaatggatttgaacagaatcaacatcgaatggaatcgaatggaatcatcgaatggactcgaatggaatcatctaatgcactcgaatggaataatcatcgaatgtaatcgaatggactcatccaatggaatcaaatggaataatgaaatggaatcgaacggaatcatcatcaaaaggaaccgaatggagtcattgaatggaatcaaaggcaatcatggaatcatcattgaatgcaatcacatggaatcatcacagaatggaatcgtacggaatcatcatcaaatggaattgaatggaatcatcaattggactcgaatggaaacatcaagtggaatcgattggaagtgtcgaatggactcgaatgaaatcatcatcgagtggaatcgaatggaatcatcgaaaggactcgaatcaaatcctaaaatggactcgaatggaatcatcgaatgcactccaatggaatcaacatcgaacggaccctaccggaatgatcaaatggactcgaatggaatcattgaatggaaatgaatggaatcattggttggactcaaatggaattatc

SEQ ID NO: 475648 - DNA, 1085 bp, Homo sapiens
tcgaacggaccctaccggaatgatcaaatggactcgaatggaatcattgaatggaaatgaatggaatcattgattggactcaaatggaattatcgaacgggctcaaatggaatcatcgaatggactcggatgtaatcattatcgaatggaatcgaatggaatcatcgaatggaattgatcgaaatcattatcgaacggaatcaaatggaatcgaatccaatcatcatcgaatggaatcgaatggaatcatgatcgaatgcaatagaatggaatcatcaaatggaatcgaatggaatcatcatcgaatggaatcgaatggaatcatcaaatggaatccaatggaatcatcatcaaatggattcaaatggaatcattttcgaatagaatcgaatggaatcattgaatggaatcatcatcaaatggagtccagaggaatcactgaattgaatggaattatcattgaatggaatcgaatagaatcatcgcatggaatcaaatggaattatcatcaaatggaatcgaatgatatcatcgaatgcacttgaatggaagcatcaacgaatggaattgaatggtatcatcgaatggactcgaatggaatcatcttccagtagaatctaaaggattcactaagtggactccaatggaataatcatcaaatggaatcgagtggaatcatcgtacatactcgaatggtaacatcgaatggaatagaatggaatcatcaaatggatttgaatggaatagtcatcaaatggaatcaagtggaatgatcgaatggactggaatggaatcatcatcgaatggatttgaatggaatcatcgaatacacttgaatggaatcttcatcgataggaaatgaatggaatcatcaaatggacacgaatggaatcattgtcgaagggaatcatatggaatcatcaaatggactcgaatgcaatcatcgaatgaactcgaatggaatcatcatggaatggaatcgaatagaatcattgaatggactcgaatgtagtgatcaaaaggactcgaaaggcattaacgaatggactcgaatggaatcattgaatggacccctaatggaatca

SEQ ID NO: 475649 - DNA, 674 bp, Homo sapiens
tggactcgaatggaatcatcatcgaatggaatagaatggaatcatcgaatggaatcgaatggaatcatccatcgaatgaaatcaaatggaatgatcatatggactggaatggaatcatcatcgaatggaattgaatggaatcatcgaatggaatcgaatggaatcatcctcgaatggaatctaatgaaatcaccgaatggacacgaatggaatcatccaatggatttgagtggaatcatcattgaatggaatcgaatgaatggaattgaaaggaatcatcaaatggacttgaatgaaatcattgaatggactcaaaaggaatcatcatcgaatggtattgaatggaatccgaatggaatcgaaaggaatcatcatggaatagattcgaatggaatcattgaatggaatggaatggaatcatcaaagaaaggaatcgaagggaatcatcgaatggaatcaaacggaatcatcgaatggaatggaatggaatcatcatcgaatggactcaaacggaataatcttcgaaaggaatcgaatagaatcgaatggaacaatcaaatggactccaatggaatcatctaatggaatcgagtggaatcatcgaatggactcgaatggagtcatcatcaaatgaaatcggatggaatcaatgaagggactcgaatgaaatcatc

SEQ ID NO: 475650 - DNA, 1671 bp, Homo sapiens
atcaaattgtcaatgaacggaattgaatggaatcatagaacggaatccaatgtaatcatcattgaattgaacccaatggaatcattaaatggactcgaatggaatcatcgaatggactcgaatggaatcatcatcgaatggaatagaatggaatcatcgaatggaatcgaatggaatcatcatcgaatgaaatcaaatggaatgatcatatggactggaatggaatcatcatcgaatggaattgaatggaatcatcgaatggaatcgaatggaatcatcctcgaatggaatctaatgaaatcaccgaatggacacgaatggaatcatccaatggatttgagtggaatcatcattgaatggaatcgaatgattcgaatggaatcattgaatggaatggaatggaatcatcaaagaaaggaatcgaagggaatcatcgaatggaatcaaacggaatcatcgaatggaatggaatggaatcatcatcgaatggactcaaatggaataatcttcgaaaggaatcgaatggaatcgaatggaacaatcaaatggactccaatggaatcatctaatggaatcgatgatcgaatggaatcgacggcaatcatcatccactggaatcaaacggaatcattgaatggaatcgaatggaatcaatgtcaagtggaatcgagtggaatcatcgaaagaaatcgaatggaatcattgtcgaatggaatggaatggaatcaaagaattgaattgaatagaatcaccaatgaattgaatcgaatggaatcctcatcgaatggaatcgaagggaaatggaatcatcatcatatggaattgagtggaatcatcgtatggactcgaataatcatcgaatggactcgaatggaatcatcatcgaatggaatccaatggaatcatcaaatggactcgaatgaaatcatcatcaaacggaatcgaatggaatcattgaatggaatggaatggaatcatcatggaatggaaacgaaatcgaatggaatgattgaatgggctagaatggaatcatctttgaatggaatcaaagggaatcatcatcgaatttcatcgaatggagtcatcatcatatggaatcgagtggaagcattgaatgggctcaaaagaaatcatcggagaatggaattgaatggaatcatcaaatggactcgaatggaatcatcatcaagtggaatcaaatggaatcatcgaatggacacgaatcaaatcatcgttgaatggaatcgaatggaatcatcgaatggactcgaagggaatcattatcgaatggaattgaatgaaatcataatcgaatggagtcgaatggaatcatcatcgaatggaggaatcaaaggaaatcatcgaatgggatcaactggagtcatcgaatggaatcgagtggaatcatcgaatggatttgaacagaatcaacatcgaatggaatcgaatggaatcatcgaatggactcgaatggaatcatctaatgcactcgaatggaataatcatcgaataattgaatggaatcatcacatggaatcgaatggaatcatcgtaaatgaaatcaagtggaatcatcgaatggaatctaagggaatcatcgaatggaactgaatggaatctttgaatggattcgattttaatcatcatcgaatggacttgaattgaattatc

SEQ ID NO: 475651 - DNA, 588 bp, Homo sapiens
tgggatcaaatggagtcatcgaatggaatcgagtggaatcatcgaatggatttgaacagaatcaacatcgaatggaatcgaatggaatcatcgaatggactcgaatgcaatcatctaatgcactcgaatggaataatcatcgaatgtattcgaacggactcatccaatggaatcaaatggaataatgaaatggaatcgaacggaatcatcatcaaatggaaccgaatggaatcattgaatggaatcaaaggcaatcatgggaatcatcatcgaatggaattgaatggaatctttgaatggattcgattggaatcatcatcgaatggacttgaattgaattatcgaatggatttgaatggaatcatcatcgaatggaatccaatggaatcatcgagtggaatcgaatggaatcatcattgacttgaattgaatggaatcatcaaatggactcgaatggaatcatcatagaatggaatcgaatgcaattatcgaatggacttgaatgaaatcacctttgaatggaatcaaagggaatgattgaaaggaatcgaatgccatcatcatcgaatggaatcggaaggaatcatc

SEQ ID NO: 475652 - DNA, 3003 bp, Homo sapiens
atcatcaacgaatgaaatcgaatggaatcactaaatggtcatgaatggaatcatcatctagtagcaacgaatggaatcatcgaatggactcgaatggaatatcatcgaatggaattaaaagcaatcatcgaatggactccagtggaattattgaatggactaaaatggaatctttatcgaaaggactcaaaaagaatgattgaatggcctcgaatggaatcatcggttggactcaaatggaattatcgaatatccgcaaatggaatcatcgaatggactcgaaaggaatcattatcaaatggaatcaaatggaaccatcaaatggaatcgaatggatcatcgaatgcaattgatcagaatcatcatcgaatggaatcaaatggaatcatcaaatggaatcgaatgcagtcatcgtcaaatagaatcgagtggaatcatcatcgaatacaatcgaatggaatcatcaaatggaatcaccatcgaatggaatcaaatggaatcatcatcaaatggaatcgaaaagaatcatcatcaaatggaatcgaatggaagcatcatcgaatggaatccaaaggaatcatcatcgaatggaaccgaattcatcatcgaatggattctgatggaatcatcattgaatggaatcgaatggaatcatcatctaatggaaaatattggaatcatccaatggaattgaatggaatcatcaaatggtctcgaatggaatcctcatcaaatggaatcgaatggaatcatcgaatagaatcaaatgtaataatgatcgaatggactcgaatggaatcaacatcaaatggaatcgaatggaattatcaaatggaatcaaatagaatcatcgagtggactcgaatggagtcttcgaatggaattgaatggaatatcgaatggaatcatcatcgaatggtatcgaatggaatcatggaatggaatcaaatggaatcatcatggaatggaatcgaacggaatcatcgaatggagtcgaatggaatcttcctcgaaaggaatcgaatggaatcatccaatggacacgaatggaatcatcatcgaatggaatcaaatggaaccatcaaattcaacagaatggaaccattgaatggacttgaaatgaatcccctcatcgaatgtaataaaagagaatcaccgaatgcactaaaatgggatgatcgaatagcctcgaattgcatcatcatgaaatggaatcgaatggagtcatctcatggactcgaatgtaatcatcaaatggactcaaaaggaatcatcatcaagtggaatcgagtgaaatcatcgaatggactcgaatgccatcatcgaataatcatcctcgaatggaatctaatgaaatcaccaattggaaacgaatggaatcatccaatggatttgagtggaatcatcattgaatggaatcgaatggaatcatcaaatggactcgaatggaatcatcttcgaatggaatcgaatgaaatcacaatcgaatggaatggaatggagtcatcatctaatggaaaacatcaaatcaagtcgaatggaatcatcatcgaatggaatccaatggaatcatcgaatagcatcaaatggaatcatcgtcgaatggattcaaatggaatcatcgaatggactcgaatggaatcgtcatggaatggaatcatcgaatggaatcaaacggaatcatcgaatggaatggaatggaatcatcatcgaatggactcaaatggaataatcttcgaaaggaatcgaatggaatcgaatggaacaatcaaatggactccaatggaatcatctaaaggaatcgagtggaatcatcgaatggactcgaatggatggaatcaccaaatggactcgactgtaatgattaaatggactcgaatggaatcatcaaatggaatcgaatggaatcatcgaatggactcggatggaactgttgaatggactcgaatggaaatcatcgaatggactcgaatggaatcatcatcgaatggaatcaaatggaatcatcaaatggactcgaatgaaatcatcatcaaacggaatcgaatggaatcattgaatggaatggaatggaatcatcatggaatggaaacgaatcgaatggaatcatcgaataacattgaatggaatcattgtcgaatggagtgtaatggaatcatcaaatggactcgaacagaatctggaagcattgaatgggctcaaaagaaatcatcggagaatggaattgaatggaatcatcaaatggactcgaatggaatcctcatcaagtggaatcgaatggaatcatcgattggactcgaagggaatctttatcgaatggaattgaatgaaatcataatcgaatgtagtcgaatggaatcatcatcgaatggaggaatcaaaggaaatcatagaatgggatcaaatggagtcatcgaatggaatcgagtggaatcatcgaatggatttgaacagaatcaacatcgaatggaatcgaatggaatcatcgaatggactcgaatggaatcatcgaatggactcgaatggaatcatctaatgcactcgaatggaataatcatcgaatgtaatcgaatggactcatccaatggaatcaaatggaatcatcaaatggaatcgaacggaatcatcatcaaacggaaccgaatggaatcattgaatggaatcaaaggcaatcatgggaatcatcgaatggaattgaatggaatctttgaatggattcgattggaatcatcatcgaatggacgtgaattgaattatcgaatggatttgaatggaatcatcatcgaatggaatccaatggaatcatcgaatggaatcgaatggaatcatcattgacttcaattgaatggaatcatcaaatggactcgaatggaatcatcatagaatggaatcgaatgcaattattgaatggacttgaatgaaatcacctttgagtggaatcaaagggaatgattgaaaggaatcgaatgccatcatcatcaaatggaatcgaaaggaatcatc

SEQ ID NO: 475653 - DNA, 2063 bp, Homo sapiens
tcatcatcaagtggaatcgaatagaaggattgaatgaaatcaaatggaattatcatccaacggactcgtatggaatcatcatcgaattgactcatatggaatcatcaatggaatccagtgtaatcatcatcgaattgaacccaatggaatcatgaaatggactcgaatggaatcatcgaatggactcgaatggaatcatcatcgaatggaacagaatggagtcatcgaatggaatcgaatggaatcatcatcaaatgaaatcaaatggagtcatcgtatggactccaacggaatcatcatcgactggaatcgaatagaatcatcgaatgaactcaaatggaatcatcatcgaatggaatcaaattcaacgaatggaatcatcgaatggactcgaatggaatatcatcgaatggaattaaaagcaatcatcgaatggactccagtggaattattgaatggactaaaatggaatctttatcgaaaggactcaaaaagaatgattgaatggcctcgaatggaatcatcggttggactcaaatggaattatcgaatatccgcaaatggaatcatcgaatggactcgaaaggaatcattatcaaatggaatcaaatggaaccatcaaatggaatcgaatggatcatcgaatgcaattgatcagaatcatcatcgaatggaatcaaatggaatcatcaaatggaatcgaatgcagtcatcatcaaatagaatcgagagtcatcatcgaatggattctgatggaatcatcattgaatggaatcgaatggaatcatcatctaatggaaaatattggaatcatccaatggaattgaatggaatcatcaaatggtctcgaatggaatcctcatcaaatggaatcgaatggaatcatcgaatagaatcaaatgtaataatgatcgaatggactcgaatggaatcaacatcaaatggaatcgaatggaattatcaaatggaatcaaatagaatcatcgagtggactcgaatggaatcttcgaatggaattgaatggaatatcgaatggaatcatcatcgaatggtatcgaatggaatcatggaatggaatcaaatggaatcatcatggaatggaatcgaacggaatcatcgaatggagtcgaatggaatcttcctcgaaaggaatcgaatggaatcatccaatggacacgaatggaatcatcatcgaatggaatcaaatggaaccatcaaattcaacagaatggaaccattgaatggacttgaaatgaatctggaatcatcaaatggattcgaatggaatgatcatcgaatggaattgaatggtatcatcgaatggactcgaatggaatcatcatcaaatggaaccaaatggaatcatcgaatggacacgaatgcaatcatcattgagtggaatcaaatggaatcattgaatggcatcgaatggaatcatcatcgaatcatcaaatggaatcatcgtcgaatggattcaaatggaatcatcgaatggactcgaatggaatcgtcatggaatattcgaatggaatcattgaatggaatggaatggaatcatcatagaaaggaatcgcagggaatcatcgaatggaatcaaacggaatcatcgaatggaatggaatggaatcataatcgaatggaatcaaacggaatcatcgaatggaatggaatggaatcatcatcgaatggactcaaatggaataatcttcgaaaggaatcgaatggaatccaatggaacaatcaaatggactccaatggaatcatctaaaggaatcgagtggaatcatcgaatggactcgaatggagtcatcatgaaatgaaatcggatggaatcaatgaagggactcgaatgaaatcatggaatggactctaatggaatcatcatcaaatgaaattgaatgggatcatcatcaaatgtaattgaatggtatcattatcaaaagaaatccagtggaatcaccaaatggactcgactgtaatgattaaatggactcgaatggaatcatcaaatggaatcgaatggaatcatcgaatggactcggatggaactgttgaatggactc

SEQ ID NO: 475654 - DNA, 619 bp, Homo sapiens
ccctttgttttggccaatttcttccatttggaacagctgtatttacccgatacatgtacccccattgtatctacagccgacacagaatcctcgttctccttatccaagtgacctgccctggcatttgggcatttggctgtatgctttttcttacctatgcacatgtgcttgcccttctggtgggccaaggtgtttttccagaattgagcctgggaatggacagtcacaggcttccagatgatcagcccatctttgatcagcttccggatctactgacgagagttggcattggcgatttcattgatctcatcggggtccaaccagaccttcttcttgccccagtggaggacactagaggcgagcctcttctgaagccgaagcatactcatggcttgtatcttattcacatccgtagtttaaactaccatctgtatgataagaaccctgaaatggatatttttatctcttagctccaattttgcaaatccacattgtgcttattgaaaagtttctctttagatgtttcaaaggtgcctcaaactcaacatgtctaaaacggcaccaatgacctcccatcccaaactcagtcttctgtgtttcctgttgctgtgaacactac

SEQ ID NO: 475655 - DNA, 2222 bp, Homo sapiens
ggcctgcaaccacttggtgttggctgatttgtccctcctgaaatgggtgtatttactcaatgcatatgcccccattgtatcttggaaaagaagataagatgtgggaaagttctgaatttcctagagatgtattgaatggttttgaccagaatgaagacagtgatatggatgatgaagtccatgctgaagtggtctcagatagagataaggaacttattgggaactatgttatttcagaaaggagaaatcagaattctgtccatagaataagggcaagggtggttggaggccacaactggaaggaccaacccaataaggaggaatggatcagggtcccacttaaagaagcagtctggccatgctgtggcaaagcagctgtgctgtgctgggggttctttcctcatatggggggtcctttcctcatttggagagaccatttgggcaagttccttagcctctctgggcctctgtggcttcactgggacaatggggagaattgtagctcgtacctctgggtggctgtgtaaaaatgaacaccagtagattattaccaagtctatttttaattgccttctcacatcaaattactaaaagtaatcagcagatttcaaaatatctatctcatacaaaactttgcaatgtttatctgactaattctctcgtatattcagaacagtcaaaagtttgtgaaagtgcataatagggattcaccttagataaagtgaaaagagaaaataaattgagaaaatataaaaactgctgactagcacctctgtctttcagtaagggaagtaggagaaaatatgaaaggaatttcagcatgaaggatttggaattacttcctgtcagcaagggcactaaaatatatgtttttttgattgaacaataaacttaggcaataaagaagtaaaaaatccaataacgtctgattacacaaatattttatgtaccataggtaagtcaatacccaatttaaagcaaaaacaaaaccaccaaattttactgtaccttaggttaaatattttgaccattacactttaccataaatagcacattaataattgttaatcactgtacaatgtagtctttgacaaaacttttaaactatttcatttggttgaggggtgtacaatgcttaatagaagctaatttatcttatgatgcttccataaacctttcactgaaggtgataccaaatctatatcagagataaaatgtttaacactatatttctatttgctacacaatagttcattctcccaattaacgaagggaaaatattgtctgcaattatctgattgctgggtgttctgattgctgatattctgatattacagacactacctaactgaaagaaaatgatcctatttgtttttaatagcctctgagggatatactaatctaatgaaattgaaacaggaaagaaaatggctagcatacagtttttgtagtaaactattttaagaagaaaaaatatgatatgattaatcttctaaaccttcttcaatggtgccaactcagtgaggggcattaaagtgcaattaagggcctaaataatctcttatggtaatatccttaagggaggctactgattaaactactaaatgtggacatacagaatataaaactggaaataatcaagagcttgctaaactgctaatttgagcttatatttagattaaataattggctgaaacattatgttgttcttaaatttgttttttttttttttttgtagctcaagaacacataattgctgatttggggtcttaatttttttttcaaagaagaaatattaaaactttctatcatatattttcatgagcttttaaaactcattctattctattaaataaatctcagaattgaaatgtctgtactaaggaggcacacatggtaactgggggcccataattgagtgttttgtttctactaagctccagtagcaagcctaaagctgtttcttgaatcattatctgttaaatgagaggatttttctccaaaatcctaaaggtctacacttgattcacctataaaaggctgccaaagatccagaacagtgtacttgcctctgatacttcaatcacagtcagatctgctgtatcaatacggatcaagtggaagatggcttgcatagcaaatggcaatgcagactttttggacagcctttttatgtcctgggcctccatcaaattatcaccttttcaagtcactaggaaaac

SEQ ID NO: 475656 - DNA, 584 bp, Homo sapiens
gttgctctggcaacccttcaacctggatttgagcccccacaatggacgccacttgcctagaccagctcggtcagggagatcctaacccattggtgctagaggaattaaagacacacacacagaaatatagaggtgtgaagtgggaaatcaggggtctcacacccttcagagctgagagccccgaacagagatttacccacatatttattaacagtaagccagtcattagcattgtttctatagatattcgattaattaaaagctttgagctgatactgaggagtgtctgcacagtgtccagtgatgtgacccatcttcagatccctcagccatggatatcagcacctgctccagtggaggtagtaggggagacacagaaaatcaaaatcccaaagaaatattacttcacatctgttagaatggctattatcaaaaagacagaagataacaagcgttgtgaagggtgtggagaaaagagaaatcttgtgcactgttagtggtaatgtaaactaatacagacattattatgaaatatataaaagttcctcagaaaagtaaaaataggatgaccatatgatccagga

SEQ ID NO: 475657 - DNA, 549 bp, Homo sapiens
aaaagtcataaacttcaatgatcaaagaaaatgagtttgatgaattgacagaagtaggcttcagtaggtgggtaataacaaactcctctgagctaaaggagcatgttctaacccaatgcaaggaagctaagaaccttcagaaaaggttacaggaactgctaactagaataaccagtttagagaagaacataaatgatgtggtggagctgaaaaacacagcaagagaacttcgtgaagcatacacaaaaatcaatagccaaattgatcaagaagaagaaaggatatcagagactgaagatcaacttactgaaattaggcatgaagacgagattagagaacaaagattgaaaaggaacaaaaaatgcctccaggaaatatgggactatctgaaaagaccagatctcctattggggtctctgaaagagacaagaatggaacgaagttggaaaacacacttcaagatattatccaggagaacttccccaacctagcaagacaagccaacattccaattcagaaaatgcagagaagacaactaagatactcctc

SEQ ID NO: 475658 - DNA, 1270 bp, Homo sapiens
aggaggaaagaagaaaaagacgatggggaaacagtttttgggtagatggagggggaaggagggtggcgagcagcaggagtggagagaaggctttgctgtggtcatggacatgttcacccatgtggacatcttttatgccggcttcaagaggaaagcagctttgtacatcatcgtggacgggagtaaagtcaagtacgttctgcatatgtgtgagcagacccgcatgcacctggggcacctcaaggctgaggccagggaaggcttccttgatgtctgcacagttgaagtggatttgaggcacatgagcagagtagaacctttagggtggggagaaaccacggaacagaggtggatcagagacggctgccagtggggtcaagctggggcctcatatccacctggggcctccatgccaaactgcgacctgatgtccagcggaggcctgatgtccatgcaggaactggagtccctctgggacctgttgtccacccggggcctggtgtccaacgtccaccttgagtccagtgtgcacttggggcccgacgttttcctggggcctttgtgtccgctggggccttatgcccacctggagggggtggatatatggcctcagggggccatcgggtcccgggtgcgcactggacttgacgtatacatcaggcacgaggtttacacccaggccccaggtgcactgaatgtcacagatggacttcaggcccaaggaggataccaaggcttcaggcggacacccaggcctcacgtggatatcaggtcttaggtgaaactcaggctctagttggataccgagtcttcaagtggacataacaatgccccaggtggaacccaggctttagatggataccaggctccaggtggacattaggccccagggtgacaccaaggctccacgtggacagatgtttattttttaaccttctatttgtctgatgtctgggctctatggggagtggcaagggaaagtggtatacacttaatgacacagaggagactttgacctaaatggtgagaccctgaagtgtgaatgctttggaggagaatatagatcagaagtttatgatcaaagtaattatttacaaatagatattttccattactttatttttaatttaaagttctatataacattggaagtaatattctttatgtacaactacaatagattttatcctttttctaatacttctgttctagttacagaaccatgaatgacctctttgataactggaatgaaaatgttgtagctgcttat

SEQ ID NO: 475659 - DNA, 1278 bp, Homo sapiens
gatcctacccgcaccccgcgcctacacgcttctccccaccagtaccccgccctgtcatcctgctcctacccacaccccgctcctacctgcgtccagccccggagcacctagctcctacatggacctttctcctacctgctgccctgcccggcagcaccgcatcctacaggcgccccaatccgccagcacccaactgctaccagtcctacagcacctcctacccaactgctaccatcctacacatgctcgccccgccagaaccccagtcttacccgcactccactcccacccatgccatgccccgccagcaccctgcttttacctgcgttctgctccttccagctccgtgccctgccagcaccccatcctacacatgcctagcccagcaatcaccctactcctacttgaacccggctcctactcgcagcccactgctacacatgccccaccactccagcgccagcccctacctgaaccctgctcctacccacaccctgccctaccagtaccccataccacccatgccccaccccaccagcaccccaatattacccacacctagctcctacctacaacctgctcctatctgtgccccaccccaccagcacccgactcctaggagcaccctgctctgactcgccccccacacctacccccacccctgccccaccagcaccccactcctactggagcccatccgcactgcaccctggtcctgcctgcaccatgatcctacccctgcccagctcctgcgcgcttgatgtcttcagactattaacgtttagacaaccacacaatccattagatccattcaaaatgtttcttgataaactatttatgacatgaaagtcacacacaacatgttgcaggaaactgaggactggagagactgatatgagagtacaggaggattgtttattttaggtacacattggctcagtggattcgcatccaaaaagctgagcattaaacaaagacagagtggggtttttgtaagtggacttacaataaataaaacaaaagcagctaatcatatgacaggtcacataatctagagcatagcacaacttgtggccttgcatagccagtggccttgtagctgcattgaaagaaaaacaggaactggctaaatacggacatttgtaaaacataatcatgcttaagaaggctggggaaagagtaacagtaaaataaattgtctttttcttttttttccttcatccttgctctggaagagggggtgtctggagcccattcctttggccttggcttctcaaa

SEQ ID NO: 475660 - DNA, 638 bp, Homo sapiens
tcttcatctatagcccagagaggggctgggggtagaggtgcagcatggcctccgtgggctgtgagtgtcccctgcagctgggaaccacagcacatggccagacgcttgggcctggagctgccctcctcacagacaccccagcagaccgtcacatgctacccacaggccttaaattcctggagctggccaagcaggtgggggagttcatcacctggaaacaagtggagtgtcccttcgagcaagacgccagcatcacccactacctgtacaccgcccccatcttcagtgaggatggtaaggtagccctgcagccctcctgcctactgggccacggaactctgggagcttacgtggggagtgccaagcacagcactgactgtgtaggcgtgtacgtgtgtgcaggtgtaacagacacaggcacgagtcaaccatatgtcttcagagactgctgtgtgccaggcaacaatctagcagttaacacagacaaaactgtggccctcctggagccccgttagagaggggcatcttccatttttactgtctcttccttctgtccctcccacaaccccaaaaaagtggagggaagtaaggcttccctggcagggcccacctggcaattagtcagacttgaatctcct

SEQ ID NO: 475661 - DNA, 842 bp, Homo sapiens
taccggaagaggatgcatcagctcctacaggctctgcaccagaagctggcggctctgcgccaggggccagaaggtctggtgggtgccgacaagcccatctcctacaggaccaagccaccagcctccatccacagggagctccttggtgtctgcagcgacccctacacactggcccagcagctgacccacgtggaactggagcggctgcggcacatcgggcctgaggagtttgtccaggcctttgtgaacaaggaccctctggccagcacaaagctcgggggcgcaccacgacaaccgagtcccgagtccccggaaagcctggacgtgcgggacgtgggggtcacccacccagcgagggaggaggagtgggccaggaaccaggccgtgggccgcgctgctcgggtgggccaggaccctgggcagggaggagggtggagggccccctggcgcgctccgggaccccgtgcgccttcccggtgcgtttcggtgggcgccggtgccctccagcggccacgcggggaagcgcgggttgctgcccgctgcccgggatgggacacagcccacgcacccggatttcgatcccgcccttctgggagcccaaccagcagggtgccggtgcctcccacgggctaaatccaagccagaattgcaaacattgtgccttctgccctcacacctaataaaagtacaaactatgagattgcattttcacttctcagataagcaaaaatcacctagttaagtttcatcttttaaatggtggtatattatacagtggaaagttctaaatccatttaaaaattttttttccaaaggatatgttatggcacagggaaaggttc

SEQ ID NO: 475662 - DNA, 1095 bp, Homo sapiens
tctgtcctttatcctcctggaggagtcacaggtccacggctctacccccaacacaaactgcccagctgggtcccatggctgtccaggtagatgaggactacacctgccatcccttggccacaggccctgttcagctgcttttccctgtgacatttccactacggtctggggagggttatgtggcccatgatggcttcaccaccggcccccaccaccaccccggggctgaggccacccagtctgtggtgtcctgttgtggcagccaaatggacggggaagatgctgatgaagtgctcaacccaggcctggccatggagttcaaccctcagcagagggtgtctgcactgggccgcttgagggctgtatgtgatggacctgtatacggctgctgttggcagggggtgaggagctcacacagtcaatgggaagccctgagaacctggctcaggaaatcagcagggttccagggcagcctggtgtccagagtcctccaggacagcagcctaggaagggggctctggctggctgcacaagagctactgtggccagcaaagggccgcgtctgcatgctttcccaggaagatgcacgtgtgctctggggttacagcagccctggccaggagccctgggggaaggagccccgactgggcacccccttacacctgcacactcccatcaagaaatgctcctcaatcactgtgtccaaggctgcagcctcggggcaccagctgtctgtgtctgtccaggactgtcctggttctaacactgaaattcccacgtcccagggaacccctcagtcctggacgaaccggaacacttgtcactctggctgccgcctgtttccttgcattcttgtctaggacttctgcaccatttgccctctcctctggcctttgctgccctgggcctggcagtgtttagaggtcttccaagcagcctgcccagtcacttaggcattccttatcttcatgcacactgcacggtggaggtgggcccttcccttctgggaagccttcctgtgatatggtcttcaagcactgatctttgtgaaattcctcgaggtttctcatgggatgctggtagcactaccacctg

SEQ ID NO: 475663 - DNA, 1078 bp, Homo sapiens
agtcaaaaaaattagccagggtttagcaaactatgaacccgatttgctctgccatctgcttttgtaaacaaagttttattgggacacagccacactcattcgcgtatggattgtccacggccacagccaagctgagttgcaacaaagatgatatggctcacaaaacttcagtatttactatccgatactttctggaaaaagtcgccaaccctgctgttgctatcaggaattactgtcccccgactctgaccagcctccagcccagctccttctctaagccccagatacatatccaagtgcccatgtacctctccactgcagaatggggtgtccactggcacctatccaaccaggcgcaaccatgttcctcacctccccagcctgctgctgcctttgttctgaaagccagcctcggcgctcctggtgccctccagggctggatccatggggcatgccacgcttccttccctccctcccctccccagcagctctgggacccagtgtatgagagtgccagctgcctccgtctgatgcaagaggagaatgccagaggctcgaagccgcagggagtcaaggctcggccctggccagcccaactatggagccaggactgtccacaccctgcagccgcctcttgtgggcaccggcatttctacacatccctcccttgtcttcacatctccggccactctgggctccgggccctggggctgctgcttttccagcagcacgtggtgcccacacagtctcagtgcctgctccgggccaggcaggaaatggacattcacgggagcacagttacagagggtttgcaggctgtaaaaacacttgctactctcagaccaccccaagatgggagagcgaatggcatggggaagttgtgaaagttctcatggattccgtattttacaagtcttagaaacacactagccatgtgtggatactgtttgtacactgatttgaaccaacaagctgtaaaaagatgtttttgagacaatcgaggaagtaggaataggaacattgtgtctaaaaaatgcacatattttaatcttaagatactttattgctaaaaaatgct

SEQ ID NO: 475664 - DNA, 950 bp, Homo sapiens
tggccaataaggaccccgcccacatctgcgccgtggtctgctgcgtggaaagccggtgatgaaagccagcagcagctggtgatggtgacatgcctgcccatggatttatcccagaggccagggagatgaaaggcactgagtggctgggcctggatcacatgccatcccaactgtcacagaccaacgcaactccttccccaagtggcaccagggccatgtcctcctaccacgggcaggagaggaaggacaaatgggctctgttttcagagggaagaacagatgctggccaggcagaagccgcagaggccatggccttggacagctgcagcagggctgagccttggcaggggtcccggaaggaagcccggggctctgccctgcccgtggtctgctgcggcccagccgggcagattgcgcaggcactcaccgaagagcttttgctggggctgctgggactaaggaaggttaaaaatggagccgatgaacagcctgtgtctttggggaagctgctggggactgctcaggctcgggaaatgtcccgagtgtggccctggagtggctccttcaacaagcaccgaaatgcaggttcatggcctgagggtcctgagcccaaggccgggctcttagcaggactcagggggctgcacatggcaggacttgggttctcacaccatctgctcctggtctggagtgtcttccaggatggcggctgggtccctggtgtggagccctgggcagcaggtgctggccgctggggcctttccccacctgagctgccagggtccctctgtgtggagaccctctcaagtctgaagcagagtccctgtgcctggcaaccctaaacccactctcagaagatgataaaacccactatcagttcaagtctgcaagaggggtgggacagtctcgtgacctcatgttctagctgagtgacatacatagcacaggtc

SEQ ID NO: 475665 - DNA, 916 bp, Homo sapiens
agcaagggcaaaggaagagaatggctttagcaaatgtagacgggaatgagcaagggagcaaacagaccactctagctagagcagagtccataaaggcaggaggccatggctggatctggggaggctgcagcgacaatgtggaatttggggaaaggatctccaaactctttgtggacagtttggagaaggggaaggatgccagagccctgatgaatcttcacaacaacagggccggcagactggcagtgagagccaccatgaaaaggacatgcaaatgtcatggcatctctgggagctgcagcatacagacatgctggctgcagctggctgaattccgggagatgggagactacctaaaggccaagtatgaccaggcgctgaaaattgaaatggataagcggcagctgagagctgggaacagcgccgagggccactgggtgcccgctgaggccttccttcctagcgcagaggcggaactgatctttttagaggaatcaccagattactgtacctgcaattccagcctgggcatctatggcacagagggtcgtgagtgcctacagaacagccacaacacatccaggtgggagcgacgtagctgtgggcgcctgtgcactgagtgtgggctgcaggtggaagagaggaaaactgaggtcataagcagctgtaactgcaaattccagtggtgctgtacggtcaagtgtgaccagtgtaggcatgtggtgagcaagtattactgcgcacgctccccaggcagtgccagtccctgggagctcgagactacagtgaggtgtgattgtgccattgcactccaacctgggcaacagaactgagaccctgactaaaaaataaataaataaataaataaataaataaataaataaataaataaataataaagagaaaagaaaataaa

SEQ ID NO: 475666 - DNA, 943 bp, Homo sapiens
tcatcagttaaggcaaggaccggccatttagacttcttttgtggtggaatgtcatcagttaagttggggcaggacacattcacttcttttgtgattcttcagttacttcaggccatctgggcatatacgtgcaagtcacagaggatgcgatagcttggcttgggctcagaggcctgacaggactgcctccagttccacactctagagcatgtatgattggcagttcctgctgccaattcaaactcttgctcagttctcagccccacccctctccccagattcccttgtcttttctcggaatggtcctcagagggtccttccagggttccaacactacagttttcaagtgaaagagtctatggagaaagacacctggtgttctcagtccttccccaactcaactcttcccccaaaactttacagcagtggatcactgtgccctgctcgaccatcacagacacagacagccacagctctgcaagtgcatgggagagatagcccagttgtggtaaaggtgcaggacccactgagctacatcgtggaaaatgttgaggcaatgacctggagaatggaaatgggatggtggagcatggtggccagctcagagcaggcagctattgaatcaggtcctaaagatgtgaagccaccacagcagtcattgggatagaagaagggtgggaatggggaatgaggagttcaggaaatactttattcaaagggtccacaaaagaggtgaaaagagtagggaaagaaggaatgcaaggtgaggcatagaggaggggagaggcactgatcctgccccagggtgttttccagaacttgcatggctccctaattacctagtaatgctgagagcttatgaaaatgctgtcatttgtgtgaggaggggagggaagactgaaagaagaagaagaaaaaaaagcagatagaaaatgctgttaaa

SEQ ID NO: 475667 - DNA, 1132 bp, Homo sapiens
atccgtgggaaatgcgtggtttcctgggcaagaataatgacctccagccccattattgctgcaaaacatattacacaacatgaatgctactcagccataaaaggaacaaaagatattatttcacaggtgacaagaaagagagaagagagaaggagagaagagctgcagccctttggaggacccagacctgagagctccccaaaccagggctgtgactccccttttgaggcctcgtggttcctggagtctccaagctcccgggcaccaccacattccccagtgccagcagtggaggcagcttgcagtgtgcctgtcaaaattatcaatacagttcttaaccaatgtttgtctctccatacaagtgttatgggatctttgatggtgttgcttttcgggctgaaagcctctgtggccaatgacacatttgcccaaattttgctcgggtccactgggcccactcgtcctggtaggctgtgcttggctcacactactgtcctggatcctatgcttctgaagagactggaaaggagtggcgaggggtgtgaaaatgagcaagtgtggggtccgggcactgtgcacagtcaggtgcactgcaaggtgcttctactgctggcaccaggggacttggtggtgtccgggagcttggagactctaggaaccacagggccccaaagtaggagtcacagccctggttcagggagctcacagctcttctctccttcttgtagccttcaaggtggtgagaagacccagtgtcaagcagaattgtatccagccgctatgaggattactaggaaaaactgagaaactgttacttgtaatcaaggatggctgcataagttgcagacgccggtgtcaagtgaaaatacatggcctatttttttttaaagcaggaaaaatttgtggttatagtacacaaaacttttgatttgttcccgcagtcctgctctcaaattgattttttaaatttgttttaatattactctaaagaagaaaaaattaaaatgtcaatcattagcttaaattttaccttttgtccttgtgttgtacaacgccaattctaaaggcaaatagcatgtttaattcatgtgatatcacgaccaggacaatttctatttcatggcttgtccct

SEQ ID NO: 475668 - DNA, 827 bp, Homo sapiens
tgcaacatttggacgcgaaaacaggagtgcctattctcacttaggtccgtgggcacaggcctgagggtggagccctcaccagaaaccctgcccttgtctacccagcagttccctgtccccctcctgtatcaataagacctttcaatagctaactaattccgagcagaagactaatcagccaaggaaacatgagaaactcaagagcttcaggaagagctggaggagaacacgcaactgggtcagaatgcccaggtcaccagcatccaggtgcaaaagcaggcaattgtaaattgtcagacaaagaagatatgtttcattttgttgatgacaacaagccaaccagctgcaatcctggaattaatggatggggagaggaaaatgaggcactcttcaagcagccgtcagccacatcacctgaggaaagtccatcccaagacagggccccattgaaaggattcagctgtacatcccttagacagtttaaaacaggaatatggttcctaattctgactcagctgccaccaacacatggaaatcagaggttacaagcacagacttggattcaagtctgcattttggattttttgtttgtttaagttatgatcctagtctttaactctgaagtcttcatttctttttgatcaagaaaaaggagtaaaattggacatttctataaaactttccatggacaattgttttacatgatattttcagaatagcatcatattggatggtgtcggtgttaaattgtgtccaaaaaatatgttgaagtcttcacttctggtatctgtaaatctgaccttatttggaaacagggtctttgcaga

SEQ ID NO: 475669 - DNA, 991 bp, Homo sapiens
tttcgtgtgtgtgtgtgtgtgtgtgtgtgtgtgtgtcttgggcatggttaggtttgctcttgccctaggctccaacatagcagcgccaatttctgtgagttgtgcctatgaaactcttccccctgttcggtggcccatcctgcctgtcactacctggacttttctgatggcagagactacgcctcagacacccaagcactcttgcataatgtttggcaaggatggccccatctatcctaatctggaggcaacagagggacaattcagatttcctcacaaacgtttcttggtgatgtaccactggcatttcacatcaaaccaaacttcacttcttaatgaggggaaaacaccatgtgcagggcagtatgcaaagagcattgtcatagctcctgacctcagtgaccttgcaatccagtctttgaggaatcgccacactgccttccacatggaaaggacacaaatggttgaactgatttacactcccaccaactgtgtataagtgtgcctttttctccacaaccagctttgttaacagcgtgaagactagaagaaaaagaatggaagaaagaagtgaaagagaaacaaatagggaaggggatccctcggatgactgggaaggaaaggaaaaccagaaaaagcagtcaggatgaatgcctgacaaaaaactctgctgcagtgacactttgacatgaagcagattcaaactttctatgactgaacaggacattttccatttattgctcctttgatacccaagctcctcaatgggggtattcttcaatgagacacttttaccagtgaccatattcttgcttgttggtttcttttttttttaaagtatgttgctgctgtacttttaagaaagttgtgttttatcttagtactttgatattcataaatggtataaagcataattttaccacatagctttaatggaatactttttacaaacaaaataaaacttgaccttcttccaccctatctccacatc

SEQ ID NO: 475670 - DNA, 1202 bp, Homo sapiens
agctgaacaggaacagctcgtttacagctcccagcgtgagtgacggagaagtcaggtgatttctgcatttccaactgaggtaccgggttcatctcactggggctcatcagacagtgggggcaggacagtgggtgcagcccactgagtgtgtgctgaagcagggcaaggcatcgcctcacccgggaagtgcaaggggtcagggaattccctttcctaccaaagggaaggggtgacagacagcacctggaaaatcgggtcacttccaccccaatactgtgcttttccaacggtcttagcaaacagcacactaggagattatatcctgcacctggctcagagggtcccaggcccatggagacttgctcattgctagcatagcagtctgagatcaaactgcaagggcagcgaggctggggaggggcgcccgccattgctgaggcttgaatatgtaaacaaagcagccaggaagctcgaactgggtggagcccaccacagctcaaggaggcctgcctgcctctgtagagtccacctctgggggtagggcatagccaaataaaaggcagcagaaacctctgcagacttaaatgtccctgcctgacagctttgaagagagtagtggttctcccagcatggagtttgagatctgagaatggacagactgcctcctcaagtgggaccctgatccccaagtagcctaactgggaggcaccccccagtaggggcagactgacacctcacatggctgggtacccctctgagatgaagcttccagaggaacgatcaggcagctacatttgctgttcagcaaaattcgctgttctgcagcctccgccactgatacccagcaaacacggtctggatacccagcaaacacggtctggagtggacctctggcaaactccaacacacctgcagctgaggatcatgactgctagaaggaaaactaacaaacagaaaggacatccacaccagaaccccatctgggaaaaacagagcagaaaagctgaaaattctaaaaatcagagcacctctccccctccaaaggaacacagctcctcaccagcaatggaacaaagctggatggagaatgactttgatgagatgagagaagaaggctacagacgatcggacttatctgagctaaaggaggaagttcgaacccaatgcaaagaagctaaaacattgaaaaaagattagacaaa

SEQ ID NO: 475671 - DNA, 635 bp, Homo sapiens
gaaaatgcagatgggaaacttcagcaagcgcccacttggatgctgagtttccagcgatcaggggcccggcccccattccagagctctgtggatgggagagtaatgggaatttactgtggaaggaaggctgaccggaatctccaccattccgccacgtgtctccgaaaagccttccggaaaggccacccagccaggcctcatgaaaactggattgaagttcaggaactggaaggtcattcaggatacagctctgtgactgggttatctcgctgccccctcagcagcaggcatctgccgatccccactaacggcttagccgccaaggtgattcagctcctctctcgctgttttcccctgggtgtcctttggcttctgctcctgctaccaactgctcagctctcagttgatctcacatttaaactcctttagtgaaaggatctagtttgtcctgctagggattcaccaggggatcaaattgtctcattgtccactaattttgtttttggctcttgaaattactttgtgaaatttctcttttccagagataaaacttcaatcagatgagataataaaccagattttctgagttcataagttactccctgggaataatttatattgcacaaatactttcc

SEQ ID NO: 475672 - DNA, 827 bp, Homo sapiens
tgactgagacggtcactgtgaaggatttacagaaaggcccatggggtggtgctttgcaggcagaggctctacatctggccctgttactttgaagcctgatgatgcagtagaaaagaaaaacccattttttgagaagaaattcaagctgctgcagaaatttgcaaaagtagcaaggagcctaatgttaatccccaagaccacggggaaaatgtctccaggccacgtcagagaccttcacaaaagtccctaccattataggcatagaggcacaggaggaaaaagtggtttcgtgggccaggcccagggtccctgtgctgtgtgcagcctaggaatttggtgtcctgtgtctcagccgctccagccatggcagaaaggggccaacaaacagcttaggctgtggcttcagagggtgaagatgtatggaaatgcctggatgcccaggcaaaagtttgctgcaggggtggagccctcatggagaccctctgctaggggagtgtggaaggaaaacgtgaggttggagcccccacacagagtccctactggggcactgcctaagtggagctacacctatcattagcctgactttggggtgggtggaacaggctgtctttatcagctagggctgccacattttacgtgtgtctagggttatgtattttccatgcaatgttgaggacacacttacactaaaaaattatttattgtttatctggaatttcaatttaactggtatccagtattttatctggtaactgtatccccagccccattaattataagtggagaggaaggtttgaataaattgaaatatgttaatcatacttttt

SEQ ID NO: 475673 - DNA, 725 bp, Homo sapiens
tggaaaaactggatgtacaaatgtccccatgcatcacactcacatcatgacaaatgtttccagccaaagcctggggcttaatcttaaaccccaccccaacctcagccccttgatctccctgtcagcttcagggagcttccataaattgtggagacattttatgccaacctttagaacactcattcctcagatcccccagcaatcggcggtcagttggatagcaggacggcaaaatggagaaatggtcatcaacactacgtcagtcaacaaacatttcctactacatgccagaccctatgtcagaagctgggaactcaatgtttctattgctctcaatgatatgccaatgagaagtaaaggaagacccagttgtaatgaacacttaagagaagtcctacaattccgacataagcagctacagaaattatgtagacacttcaggtttaaacaggtttggctgaaactgccaaggtcactgcaacagttagccagactccccatatgcgaattaccaagttaccgacctcaactactggacttcaaaaatacatatacactcaagagtttaacagacaccaggagagcttaggcagagctacactcgtcagccacctctccaaacacagagagctcagactctgtgctctgtcatcctgtgacaggatgacaccctgtagccttcatgctaatctctgaagactggccctagagggacctcacctgtc

SEQ ID NO: 475674 - DNA, 607 bp, Homo sapiens
tgctaggagatgggtgagaagattgtccaggcctctcataaggaacatattgaggggagatggtgtcctagagattgggttggcattaataagtggttaaagaatggggaggaaagactaggggacactgatgttgtcaagaggcccataagcaagtttccaggggctgggctgtggcagcaccttccactgaggagtggagagaaggtggcagattctgctttcctctctccagatactattggcagggtaggcacatttaggagaaatttcaaggaagtgaaaacggaactatttttcacctctgggtgtcctgggcttgtttcggaaacctctggcctgattgaaattcctcagagaggagaaattactgtgagtgatgttttaaagccaaatgcacatggttctatccggggagaatggtataaggaacaggaagaacaagctccctgaggggcttggttcatcttgcattctagcggaggagttcagcatactaaacatacaagctttgtcatcaaagctggtcccaaacctaggtgcattatatacaaggcttgtgacttcaaacaacaacttgattgttttaagctgtggctttccccag

SEQ ID NO: 475675 - DNA, 498 bp, Homo sapiens
agtgggtgcagcacaccagcatggcacatgtatccatatgtttgctggaggtccactccagaccctgtttgccagggtatcaccagcggagggtgcagaacagcaaagattgttgcctgtttcttctggaagcttcgtcccagagggacacctgccagatgccagccggagctctcctgtatgagggggacccacttgaggagacagtctctcccttagcagaaatcgaacgctgtgctgggagatccactgctctctccagggctggtaggcagaagtgtttaagtctgctgaagctgcacccacagctgccccttccctcaggtgctctgtcccagggagatgggagttttatctataagcccctgactgaggctgctacctttctttcagagatgccctgctcagacaggaggaatctagagaggcaacctggctgtagtggctttgtggtgctgccagtgtaatttaattcttagaagcattgaatgattacat

SEQ ID NO: 475676 - DNA, 991 bp, Homo sapiens
ctggactgtgtgttgctgagaaggcacgacagaagttcatacatactaaggtcatgcctgatgcttgtgttctcaaagctctctttggtctagtgaatttgaaaaaggacacaccattattaccacactccttaacctctctcccagcttcccatcttgcattcatcctccattctcctcactgttgtcaagggatcgttcaaaagcacaagtcatgtagtgccactgtgttgtctaaaaccctcccctatcctcttactacccttgatgatgtctatgctttgaaccagagccctcgaggccatcctctttacagtccctgctgttctccagccccctatttctctcatcctgaccacacttcttgtacttcctcagatgagctgttccctttcttctctccaggtcttcacatatgctgttcctgtgcctggaacatccctttctcctatggccactctcccccacttttaagccacatcctagacagaactctttcaaaggctgtgtgacaatgacatgggctttcattcccttcccctgggttctgccccatgatcccagagcaccttggccttcttctatcatagcactgcttctttttgtactgtgactgaggcttgtgtaaggtaaacaatttgtgaagtgtgccaaattatgtcttaatatgcatctctagaacctagtatagtgttagacatctgaataggttagaggttaagacagtaaactccctgtgtttaattctggattccatcaattattagctgtgtaaatttgagaaagccatttagactctccaagcctcagtttcctcgtttgtgaaacaagaacaataacaggacccacttcattgaattatgttgagaattacaattaattcaccttaagttcttagtacagtgcctgttctgtatattgtcttcaaatgttacctgttattaagatgctcattgaacaaatatatcaaacagatgaaaagctaagatat

SEQ ID NO: 475677 - DNA, 595 bp, Homo sapiens
tgaaggtcacatgacttgcccgtcacttgatcagcttggggccagctggggccagacggggtctccaggctgcaagtccttgccagtcctgtccctgctgccctctgtgacaatttctgccgattcagcatcaacggtttgtcccgcagctgccaagccaaccgagctgtgcttctgggcagtgctctctcacttcgtggccaggacgtcggctgtgactctcctctttcctgaggagcatcttcagctgatccacgtcctgcatggtgctgcaggtggggcagcaagatacgcttgtgacatgagagtcttgacacatgtgagccagcatcataagaattctgagagctttcaaaatcttcagcttagctctaatactagctcaactataattattgtaattaaaaacaaaaaagaaaaaggcaaagccacagatttaactgttggtaaaaacaacagcttggatgggaacagtttagatgggaagagagtggtagtggtcaccatcgaaatcacctagaccagtttattttcaagacttagttctatataattttaagattttctcagaaaccatataggggctgcctttgcc

SEQ ID NO: 475678 - DNA, 494 bp, Homo sapiens
gcgtttcaatcttaagttagccatgaatgaactacacggtgatgggcaaatcactcagtgtttgtactttggtttcccgtcaaaattggcagagtgtgatagggcagtacagaaaggaaatgtggggtcagagtccccacacagagtccccactggggcactgcctagtggagttgtgagaagagggccaccatcctccagaccccagaatggtagatccactgacagcttgcacagtgcatgtgggaaagctgcagacattcaaccccagctcatgaaagcagctgagagggggctgtaccctgcaaatccacagaggcaaagcagcccaaggccatgggtccacagcctcctggtttacatcatcagggatttttccatctccattactctggcccttctggttcaagcttttagccttaaaaaccaatagcatcctgacttgtgactcagctcaaccccatcacctgctttcaaattctcctccatattaa

SEQ ID NO: 475679 - DNA, 804 bp, Homo sapiens
gtttgtcaattttggcttttattgccattgcttttggcattttaaatgttgaatattggcccccactctcttccggcttgtaaggtttctgcagagagatctgctgttagtctgatgggcttccctttgtggttttgttcccttgctggcaaggagttgaggtcctttcgaggagaagaggccttccagtatttggaattttcagtttttcctcatcttcgtggattgatctacctttggtctttgatgttggtgaccttcggatgcagtttctgtgtgaacgccctttttgttgatgttgatgctattcctttctgtttgttagtttttcttctagcagtcatgcccctctgctgcaggtctgctggagtttgctacaggtccactccacaccctgcagtggagggtgcagaagagccaaaattgctgcctgttccttcctctggaaacttcgccccagagggtcacccaccagatgccagccagagctcccctgtatcaggtgtctgtcaaaccctgctgggaggtgtctcccagtcaggaggcatggagttcagggacccacttgtggagacagtctttaccttagcagagcttcagcgttgtgctgggagatccactgctctcttcagagccagcaggcaggaacgtttaagtctgctgaagctgctcccacagccgccccttctcccaggtgctctttcccgggggagatgagagttttaatctatatgcccctgactgaggctgctgcctttctttcagagatgcccttcccagagaggaggaatctagagaggcagt

SEQ ID NO: 475680 - DNA, 770 bp, Homo sapiens
tccccagaaggtggtgcagggtttgcatgctaagattctctcccttaattttcacctttttggggcatagtgaaggaaaaaaggggcagaagaaatctggacctcttcccgctttgacagtgaaggcaccagcagctttcctgctttgcattttgaacacaggctgtgctttgtggctgtcatgctatggtgtttcagacttactttttataagaggtacctttttggagtgtgcttacagatttatcccctttagggatgggccttctttgaacatgctctacctttattccaaatgtactgccaactggcattgtgactctttctctttaagccccagttttctcatctataaaatgggaatggttatacctaactatggactatgtaaatatcctttcattctagcaagaatctgcatctcagagctgggtcctagcaaagaaaagccagcaaatcaaaagaactaaagttcttgattagaattccagttttttcaagcccactactgaagacccatctcttgggacctcatcacctcgcagtttgctctggtttctcccctcctcccttcctcattacacatatgtatgaaaattcaatcatactgaatatatattaatatatatttcatattattgagctattttacaaaatgattgaatagagttttatcataagatgtacaattttaatttacctcatctctcatgatttaacattcaggcaatttgaatttttaaaactaattaaatttatgatgaatattt

SEQ ID NO: 475681 - DNA, 527 bp, Homo sapiens
cagtggccacatgtgacaacgaatgcaggctctcccaaaagagtttggaaaaccctctagacaaatcaatgactgcagctttcagaaatcagcaactgcaaatcctggagaaggtagaggatctaatattcagtgttaccacattaccacaatcaaagacctagttttcagcagcaacaaaagaatccaaaagcctacaagggaacttgaaagatgtacagaaggcaactggatgtttcagtgtggtgctcagcaattactttcagaccaggaatacacgtttgtgaatcctctcaacaatcagtcaggcgaagccaggagccggtcacagctcttgccaaactacacgttaaccattgatttctgcttctcatctcccaaaaatacatcaggttatcagtgcttttcaaaagtctcaaccaattagtggacatgaatgttactcatgtacatttggaaataaatagaggtaagtgtacataaagtggacgataaatggtagttttgaaaaaagactttgttggcat

SEQ ID NO: 475682 - DNA, 806 bp, Homo sapiens
gggaaaatggggcggcggaggcgaaagcggcccggggatcctcccgccgcctgcgcggccatcgcggtcatgggcgccagccgcgcgcagtgcccccgggtccaagtcggggtcgggagccacgcggcggccaagaggtggctgggaaagttgcggcggaagcgccggtggcggcgggcccgggaggcgggctccagagatccgctgccctccgcgccactcccggacccgccggcgcccgccgagtcccctaaggagctggacctgggcgcacagcgggagcgctgggagacgttcaggaaactgtggggcctcagctgcgagggcgccgccaaggtcctgctggacaccttcgagtacccgggcctcgtgcatcacaccgggggctgccactgcggcgcggtccgctttgcggtctgggcccctgcagatctgcgcgtcgtggattgcagctgcaggctgtgcaggaagaagcagcaccgccacttcctcgtcccggcctcgcgcttcacgctgctccagggcgcagaaagcatcgtcacctatcggtccaacacgcacccggcgctgcacagcttctgcagcaggtgcggggtgcagagtttccacgcagctgtctctgacccccgcgtgtacggcgtcgccccgcactgcctggacgagggcaccgtgcgcagcgtggtcatcgaggaggtcggcggtggcgacccgggggaggaggccgccgaggagcacaaggccatccacaagacgtcctcccagtcagcccctgcctgtccccgcgaacaggagcagtgattggggcc

SEQ ID NO: 475683 - DNA, 581 bp, Homo sapiens
ggagaggagagaggacaagagatggtccctgaagtcagtggccaccgcccagtctgcagcacgacagggttgttggcaccacgggcctcactcgggctacagaggccagcagaagaggcagagagcggggctttgttcagtttcctactgaggggccggggaacagctagtgggagagacccaggtttgaagcccctggcactggacttggggaggctggggtggctctgctgccttcttcagcaggctcagataggaagaagctggaaggcagctcttgaccagagaggaggctctatctaccgtgctcacactttcctacttccttgggatgaaaacaacttgatttttatcaaggcagatagcatccccagggtacattctggtcctcccgccttcttctaccccctcactgtgggggagctccatcctaccccaggctttctgtacactgagagctcccaagtctcctgagtgcctaacatatttaaagtagttaagggtcattctagttcctcgtaaaccattataaaaagttcacaaataatcctgtgagttaaaaagtgaattcgaatgggtac

SEQ ID NO: 475684 - DNA, 532 bp, Homo sapiens
tcttttttttttttttttttttttgagatgaggactcgcgtcattgcccaggctagagtgcaataactgagttagaatgagaccttcaagacataagtgggctcatagaaaaaatagaaagggcagcttgatggctgtctactggaatatatgcagagttctcatcaggaggacactgagcaaacggccttcatcattgctaagaacaacaggaaatagccttaagtttaacaattgtgttaaactgaacctccaaaggctacaccttagctctataattcactctctttatgacaccttgctagactgggagattcaacctagcaattgtttgtggtcagaggtgagagttcaatccaggacaacttttcctgtttctctgacctccctaaagaatacatggaacctgaatctcccctgcagaggtgcaaaggcagctaataccccagggcagcaaacagatctccagaattttccgcaaagagactagttcagcatctccagggattgtcaggcatttttaccactgcac

SEQ ID NO: 475685 - DNA, 1001 bp, Homo sapiens
aaccacattctaccctacaatggctagaggcctctggctttcacatcatacctcaaacctggaaattcaggtactggtcctgtctgtattgtggaggaagtctaattcttcctcaactgttgaggaacacctccaacataaggagagagcaaatagaaaacccttggtttttgtcctgactgagaaacgcttaaacgtctacatgtacaatcagataatccctaaaatgcctttcccctggtctaactcaattcagataactgtgtttgtctgtgagaaaccctcagagaatatattcaagccaaatgatctcatgcctggattttgcaaaacaatatgtgcacaagaccagaatttatgtcatcatcgaatatgtgcctttcccaaatccagccccgggatgttcttcaacaacatggcttctttgccacatctgagtcacttcctgggcctggatccaggacagcctgcagacccctggccaccaacaagccacataaggaagcaggaggtcagagaaacaggaaaagttgtcctggattgaactctcacctctgaccacaaacaattgctaggttgaatctcccctatccaaaaagtttggaaccagagtgttttagattttttatttttttcagacttcggaatttttgcatatacataatgagatatcttggagatgggacctaagtctaaccatgaaattcacttatgtttcatatatgccttatacatacaacctgaatgtaagtttatagaatattttaaaaattttttggaaatgaaacgaagtttgtataccctgaaccatcagaaagcaaagcatcatgtcagcactttaaaaagtttagattttggagctttctagattttggatttctggattagggatgctcaacctgtaacacttcttggtacttgtgtgtattagactacgcctttgcagttgaagagctttgactccgtttccctggttgtcacttccagaagggctgccctct

SEQ ID NO: 475686 - DNA, 1510 bp, Homo sapiens
ctccctgtgagaatggtcaggcaggcagtctttggaggaactggaaagcatggggtgtgtggcttgaatgttcctcagtcctacagcaatggtggtggaacctgtttagagagcaagagagtgccttgggccccactcattccctggcctgacaggcaacagcatcaagaacctgctattttcatatatctcaccatggaaaactctattaaccacaatctagcagaatatactagtaaaatgtctgggcctgagagcaatggaaacgtaaacagaaagaactcagatcctgccaacatcatgatcctacttggcagaagaaaagaaacctctcaggagcgaacaaacacaatttctgaggccctgaaagaactgcacccattcccaagaaagagtcaggctgtagctgctgaaagaaatgcagatatagagaattcatctaactgaaactgaacagaatgagaagttggagagaatacgtttggaatttaagttgggatttgaggctttactttctttggattcatactgctcaacaaagacagcaggaatttttcagactttagcttttacggattttaagatcaaagtaaagacttagtttggcagctcttcgagcataggccctgggaaagaggctggaaatcaagtatgctttttatgccctctgaactgtctgtactgaggctttccagaatttccctcacttgctgctactttgcatacttgtctctggaaaatgaataactaaaattagaatttcctggctgaaacagcattgagcctgactgtcaagggaaggagtttacactttaacaacattctaaaggaggaataaagagggtttacttgatgatttcagaacaccaaaggaaataaagtgggcctgatttagtcaatgattctttaacatatgaagaaggggagataaagtttttactttaaaaaaaaagtttttacttttacatcttcaaaatacaagatgacactaatttcccattttaaaattttaacacattgttcttttacatatttttttcaagattttaaactgttaggggaggtatggttacaacctttcctcaaatatggactcatggaatataaaactagtattactgcactaaacaagaatccatagggggaataagatttctaattttcattgcttatatcagggctctaatgattataaggtagaatgtttagtaattttgttcacaatgcagattgtatctaattactaattttctattatgttagaaatggaatttgcatttcccaaaatgcccacaaaatagaatttggctaaacatttccatgatcacattttctatgatgttggttttaaagtgacttgagattgtgaaatccttctatgttggttttatagctctgaggctctaaactctcataagttttgagtaggacctggaaatgatgtgatggcatcagattaaacatgtctgttagagttaattttttttttctatattagtctacaagtgtt

SEQ ID NO: 475687 - DNA, 611 bp, Homo sapiens
gtttgttgtcccttgcttgaggaggaattaattcttctgaagtctgggcaacagaaggacaatatggataagcaaagaatgcccctggcagaactaatagccctcactcaggcactagaattaggagaaggaaaaagggtaaatatatatacagactctaagtatgcttacctagtcctccatgcccacgcagcaatatggagagaaagggaattcctaacttccgagggaacacctatcaaacatcaggaagccattaggagattattattggctgtacagaaacctaaagagttggcagtcttacactaccggggtcatcagaaaggaaaggaaagggaaatagaagggaactgccaagcagatattgaagccaaaagagccgcaagacaagaccctccattagaaatgcttatagaaggacccctagtatggggtaaccccctccaggaaaccaagccccagtactcagcaggagaaatagaatggagaacctgacgaggacatagtttcctaccctcaggatggctagcaaccgaaggaggaaaagtacttttgcctgcagctaagcaatggaaattacttaaaacccttcaccaaacctttcactt

SEQ ID NO: 475688 - DNA, 620 bp, Homo sapiens
ggttggctgcctggcagggaagtttttctaagagcacacctttttaatggtattctttccccttctcgatgcacattgcatccttgggaagctgcaatggacaactctggaggcttcactgttaggaagcacaccttggaaataccacacaaggagagtagggcctctggtgtttctgactgacatgaatgagctcaagaagaacctgattaagggaaccagggccctccttgagaggttcgggggagcatggatcatacggcagttttgtttggaagaaaagctagtcaaagccacagggagtccttgtgtttggctgtgtgcagaatgtcatattcctgtcccctctgttgataaggatgtggctttgtgtctgtggatgcctgtgtgtgcagaggctgggctctctgaaggcagaaagcagtcactgcctctgtggctgctccctcgtgatccctgcatcctacacacactggtttcccaccactggctgtctggtgacaatgtgtctactgtgcttgaaactgtttaaatccagggtatcatttggacactgtcagttactccaagattcaacagtatgggtatgcctgctttagacatggcaggaatcatgtaaa

SEQ ID NO: 475689 - DNA, 537 bp, Homo sapiens
acattccatccagaattcatgtttgtgtatgataaaaattctcattggatttttagctacattaagaaatcagagtggccaggcgcagtggctcacacctgtaatctcagtactttgggaagtcaaggcaggtggatcacctaagctcagaagttcaagaccaccctggcaagatggagaaaccccgtctctacaaaaaatacaaaaattagccaggcgtgaagaagaagaaggtgaaaggagcaatttccctgaaataagtgatgcttggcttaactcgcaagcacaaaaacagacaattatttccataaactctgtcctgagctacatctacaaaacctatacctgtgatgatggagggaggttccagatttcagagaaaatgaaagaaatttgtgccataagcagatgatcagaatatcctttcaagactctcctcaagccaaaataataacctttcgacatctcaggtctaggaaagttctaaagtaagcaatcaataccatggaaacaatcctttgacatcattccagtaaa

SEQ ID NO: 475690 - DNA, 798 bp, Homo sapiens
agctgcagtaacagaacacctgactgacaccggtttgaacagcggtgctcctcaccactagggaggcatctgtgacgtggcttacgttcactactatgcaacagtgcacacattacccagcagcgacttgtattgcctgctctcgtacagaacatgggcatagacccctagcgacgacggcagctctattccaccagatcacgttacgccgcgcaacatggcccagagacatcaagcaacttcacgaacaaggacgaaacatactagcttaactactcacaacgtggctcagacagcctacagatacgagcaggtacgagacgtcatgacagaacgcagtgcaactaagcgcaacgacgtgcaggtaggcccattgcgacagaaacgacgtgacagtcacgagccttataaaagcaaaggccaggaatgcccatgtttggggaaacacccatcattgtgtcatcatgaatggcatgtagtcaagccagaactaagcccagtggtttaccccaagaagcaagggtatctgggggaggtaattgtccctaacatttacattgctaccctcaaaaaaattgaggttctattaataaggatgaaggtgcgaatggattatacttagtagtgtttgccacagaggggaaaaaggaaatatgagcttgtctccttcaattaaatgagacaaaccatatgaagcatttagcacaatgtctagcttatagtgtgtgctcaaaaaaaaaaagtttactgctgctgctgctatcacaactactagtactgttaataaaatatattatt

SEQ ID NO: 475691 - DNA, 530 bp, Homo sapiens
tgcttcccctttgccttctgccatgattgtaagtttcctgaggcctttccaagccatcctgacctgtgacacatttgccatgaaaataactgttattgctgttgccactcaatggtcaatgccttacagtatgaagagggggagttacataaattatgtttataccaggttccttgaaactgacaaggtggaggtggggggtggtggggaaacccaggttaaattatccccatgttcagtagttgttgttagggggaaaaagctgaaatggcagtgcacatcagggtgcaaatgtaagcaatctttcacccagtctgttaataaagagcaaggttttcttgctggtgccccagggaggtgggcacattcttcttggatgaaaggatctggtttgcttgctttgctgattgctgctgctgctgctgctgctgctgctgcttcaatctgaattgccagttcctgaaccaagcctttacctgttgactccagtaggttgcgtttcaaagctagtttctcctgaagatttctat

SEQ ID NO: 475692 - DNA, 649 bp, Homo sapiens
agcccaggattctttacaaagtagatacccaatagggcagagagagctgctcaaggttggcgttaactctgcatgcgctgcgccagccagggtcccagaaagggctgtgcagacgttgaagcaattcaggctaagaaaggtgaggaatttgtagacgaaaagctggaagccagcagagattgggtcatgagatttaaggaaagaagctatctctataacataaaagtgcaaggcgaagcagccaatgttgatgtagaagcatcagcaagttatccaaaaggtctagaaattgctgcagctaccacagccttcagcaaccaccagccttatcagtcagcagccatcaacaatgaggcaaggttctccaccagcaaaaaagatgacagcttgctaaagacacagatgattgttagcatttttagcagtaaagtgtttttcaaattaagcctcaatttattcatctgttaactgggggtgatactaatagcaataacagtgattagcttatagggttgttatgaagattacataagtcaatgtaaaacacctatagaagagcttgacacatggcaattgctcaatagaggtattcgctgtgatttagaaatgaaactctgtggagagaattgaggattcggtgactggggga

SEQ ID NO: 475693 - DNA, 595 bp, Homo sapiens
agatcagtgaaatgaatgaaaactaaacctgcttaaaggaaagcattaagaattgaccttctaattatataatgacctttatttttacagtttttgatttaacatctgttttatttaagtatagctactcctgcttccttttggtttctgtttgcttgaaatatcttttccagtttttcactcagtctatgtctgttcttataagtgaagtttttagcttctttgtgatgggttcgaacatcatcctttcacttggagaagtttgttattactcatcttttgaagcctacttctgtcaactcatcaaagtcattctccgtctagctgcaggtctgttcgaatttgctggaggtccactccagaccctgttttcctgggtgacatcagcaggggctgcagaacagcaaatgttgctgcctgatccttcctctggaagcttcatctcagaggggcacctggctgtgtatttaatccagtcctcacagcctgatttggttctttcagtagtgggcctgtccagagattaagggcagattgactggtgaggaccctaagctctctgcttagggcgggttaattggtgaggaccctaagc

SEQ ID NO: 475694 - DNA, 525 bp, Homo sapiens
tcccagcggctttctttacactgtgaggtaaaaaccacctactcaagccttagtaatggcggacacccctctctccaccaagctcaagtgtccaaggtcgacttcagactgctgtgctggcagtgagaatttcaagccgatggatcttagcttgctggactccgtagtggtgggatctgctgagctagactacttggctccctggtttcagccctctttccaggggatgaacagttctgtcttgctggcatttcaggtgccactgtggcatgaaaaaaaaaaaaaacttctacagctagcttggtgtctgcccaaacagccacccagttttgtgcttgaaacccagggccctggtggctcactgaaaactaagctgtgctttcataaagccctgcaaactgaagctagacaacttaaacctcagaagaaaataacagcaacctatttacatacataagccactttcatacctacctaatgatgtcaagagaggcttcatctattcatttccttttgggaagtttt

SEQ ID NO: 475695 - DNA, 606 bp, Homo sapiens
ttatttgcaacttctctgggaacctaactgtgggtccctgaagcgtgtctgagctgactccttgggtgggtttcgctgcagctgctgtgggggatagggatgagatccccaggtcaatggaactgggcattgcacagaaaggaagtggaatggtggggcttaacggctgtcaacaatcaacataaaaaatggcctaagactcttcattccacaaggaattctatacatttggcagagcacaatctacaaggtttgttccacgacactctgctcaatagaaatccagcagcttacatggatgttctggttcatggttgccgtcaaaactgggcaggggctgcagtcatctcaaggttagaccagttgttgaccagaagcttcagttccctgccacatgtgcctttccacaggcctgcttcccacatggcagctacttcacccagagacagtattgagagagagagagagcacactgatgtctcaacatttctatgccctgtctcagtcacacatcattaatcccattttgttagaaataaaacaataagtctagccctgttcaagaaaggagtttcaaagaatgtgctgacattaaaaaaaagttgt

SEQ ID NO: 475696 - DNA, 2002 bp, Homo sapiens
tcctatagcacaaccattcattctacagatgaggagacaaagtttctgcaaaattcactgaatttcttttgtctcagaccaaatatttcctcttccaggatttcttctagattgcctcatccaatgtcaccagattccctagaattatgtggatcaagagtaggaaggagctcagttcttgccatattggcaatcagaatatggatttttcgaagaagagttcctacctcaccggtgcggcctttggagggtttccgcaatacacacagagacggtgaagagtggcttaggaggatttatctcagctttcctgtcctcctcaccatcgctgacagcggttacctgcatttgacaatgacacattgtgtctcaggcttttggagaccaagagaagtctatttaataagaaaagatgatctggagggcataaaaaagctatctaacagtttaattcatgaatcaaaaaggggaccaattcatatgaatgtacttaattatttcccatcctttaaaactgcactgtgtatgaaattatttacagaatagtcttatggaaaaaaatgcaattattgaagactgcttcttatatgtgtgtgtgtatgtgtgtatggtagtggtggggtgattctattatgccttcttaaatctcctgaactgtattgcaggcatcttagctgacctatttatcgtcaccaagaatatcatcggatgagctgggtcaattttaataacattttctgtaggattatcatgttagagtaaaccatagacctcaccaagcaataaaattaaccattaggagatatcgtatagctctataaaactgacctagtaaagttagtattacctctagatattatatattcacaatatgtttgagcaaggaaaccaggctcttttaaatgatgacactcaatgattgaaagataatcgatgccaacaaaaatactagaactggagacagagacaattttctattgaataatcatgagttcctaaatgtgattcttatccattggtttttagtagaattttaaggtggatattgccagttttatattagatgaccaatgatatatttccaaaaataggtcagatgctctccctttgagtctggaaaatactaaccacatgagttaactttgaagggctcttctgacttataggagatgaacaatgtttcctatggcctacaccgaggaatttgtttccattcagaccacaagctgtttcagtgtattgtccctgtcatgtaataaatacaaaacaaatattatttattgttattacatagcaagttttaaattattccttctctgtatatatccttttcatcctgtgttcttacatctttacaatgtcttgcttctttctaccaggacaaattaagtaaagcttatcctagggcagagatattcttttcattttgtttaaaaccactacatctttcaggaaattcaaacagagtcagattctatttggctacccctttcccctagaacactttcaactattttgttttgagtttattgaaaagttttagaaaatactcaaagaagaaataattaagaagccttgaaggtggaaaaattatggaccaaattttgaagtcgagaatgttctcattcgtgttacatttgttttttataattttacttgctgtctctttgtagaattatagttatgccacagctataaatataaaacaaaggcttggttttatagtttattttctcttgtctaacatttccattggaaacactaagtttctggttataaatttcctcagtagtattaaggaagtctgcttaccatctcaacagctaagtctgcaggacctgagatgcgaagcctcactcagatgtttctgctgaacccttctgtgggttattactcctgagtgaataactctatctttgggaattgtattcctgggttactcttgtttttgttccatagattttctggtaagggaaggagtaaagaaaacgtcctagtgtaa

SEQ ID NO: 475697 - DNA, 1021 bp, Homo sapiens
tcattgttctcttttttgtctcaatatgacccgtgccagcagaaggagggctctgggagtcagcacagctgggaaccagtactatctgatcgtgggcaagttgctctacctctctgcagtcagtttcctcacctataaaccagtgaaacaatacataacaacccgacatataaagctaagaacagcaggattgcactgctgccagaggatgctggggactcaaacctggatgcctgcagggaccagagcagaactatgcaaaactggaacttgtgtggcacaaggaaggcgaattagagagggtgtgccccttgtgaaggggctgatgctggttattgagctccagctggttctggctgtgcaggaatcctatccagctgtggctggatatttttatttttcaggagaaactggaaaactggagttttagtggactctctcaatttagaaatgcatgttgaaattttaaagtaagatactgtatatgaaccaaactgatgtatccatgcactaggtatggtctcagggtcatatatttgtgacttgggtttaactccagagtttcatttttccttgagcttggtccttaaggctgtcggtgacttatttcagattttgctcttgggtaggagctgcggttgtgggcttgagttttgtgggagtggggaatagaggaggggagaaaagagaataaaaggatataactgtgtcctgacattaaggtaggacatctgcaagccaacaagcttttatcctgcaggataaaccttctcttagtataagtcctgtgcatgattttactgaaaaggccactgttgttttctccaccatgaattatgttaccaaagcccccttctcttatctaaatgccagtgtggctcaggctctaagaatcggggtggaggggacctataccaccaaacgaccatgaagctaggagttttgatgcaatttcccaggaaattgccatcctgtttgacttaattagtgctgtgaagacaccagttttgtctaggagcac

SEQ ID NO: 475698 - DNA, 670 bp, Homo sapiens
ccacgggcaggcccagaagaggcatcatgggtccccgctccagtctacaggactggcagcccagccctcagccatcaggcccttcctggcctgaaggtgggccttactggggacccaaccttgcccatccaggactctgcctcctgctgccattcaaggccctgcagcttggccccaaccctgctccaagactgagtgggcaccagggtagaagagaggccaggcagtggaagcagataacccgagcctgctgggacagaggagggggccttcttgggcccctgagggtgcagactgcagagatgcctgagagggtggccacagctgtacccagggagctccagttccacaaactcaggaggggtagggttcctgcttgtctctggctcctgcccactccacaaagtgggaggcccaggtctgcagccatgggtcagagagtttcagctgcatccaggagggcagatactgcctgttcctgcccccctgaaagaggacagggaggatcctgagtcatgagaaaaatacaattgtgttggctagagttacgaagacagggaagcatactcatacattttggaagttttttcaacaaaagctgaagagggaaattctatttaatccctcaattaatcagagaagtaaaatcactagaatgttcctcttagag

SEQ ID NO: 475699 - DNA, 614 bp, Homo sapiens
tgggcacatcacttcctattatctgagcttccatttcccacgtgcagaagggccaggcagtgggcggagccgtagagctgccaaaggactgtgtcatttgtcttatgctaccagggtgggtagagaaagaccatcaggagacgcataccactaagcccttctctttattttgcgatgaagaactggaggctcagagagactacgtaattgcctatggtcacacaaataatgtagtaaaggccccccgggaaattgtcatgtccaggctccctcagctgataagtggaggagcaggtagtctagctgcagaggctgtgctcctaaccactctgtcctgctgcctcaactttataaacccatctttagggaccttcacagtctgcacgcttgaacaattcacctcatattcttccactctgagcgatttgactcctctgacaaactcttatctcctggacagtctttgccatccttgcctgccctctcttacgagggttattaaaattggagcatggctcatggtgattgatggcccagaggctgatcattcactacctctcctggctcatggtaaatatttactttttgttacagaggaacaatgaggtttcata

SEQ ID NO: 475700 - DNA, 537 bp, Homo sapiens
gtgaaggagcacaattactggattgtgtggttcaggggaacatgtgcaggtttgttacatggggaaattgtcacagggggttggtatacagattatttcatcacccagggtacactcaccagcagttttgccatgacagtacaccgaacaaaggagacagggtcatttataacctgatgcgtccaccctactgctgtgtccagtttccattggctggaacgggacctcacattctgtgtttgtcccgattggctagcaacttagaactttttaaaacaggcaaaggcagaggagaacaaaagaaggagcaagtgtgtcgtttcaaggaagttctacaattgcttctgttgagtattcccaaagtattaccatctcaggatgactttaaggcttatgaattcctagatcatttgggttgtttacattcaaatctccatttcaattggagtaggccagtgactatgatatcccattagaaactttttacttgattttatttttcagtcaatgcttagagagggaagaactgccttgctg

SEQ ID NO: 475701 - DNA, 1042 bp, Homo sapiens
tcaaagcctagcaaagatatgacatctgaaagtagccaagggctgccatgtgggaaggattagacttgctctgtgtagttctaggaaacagagctaggaccagggagtcagtggaacttacagtcatgcaaatttcagctcatcataagcaagaacctgctaacactcagagtagcctgagtatagaaaaggttgcttttggaggttggaagagcctttcctacccactgaaatcccatctcctagcaactgcctacagcactgcagggatgagcctgactctgcttttgaacttccaagaggagagaagacacactgtttattacttctccagtcaaggactaaaagtcaagttgattgatgcccgtgatgaaattgcgaaggaagtacaatgtgtgctgtggtggttggacatggatgaagctggaagccgttatcctcagcaaactcacacaggaacagaaaaccaaacaccacatgttctcacttccatctctaaacactcagccaagctctaagctgtggctttctccttcctgctcatcatctagtacttgttcatctctttttgcatttatggaagttgtcaaaatattctttgattgtccttcctttttctctcactatcgtggattgtaacttaaaaattttttaaattaccatggtggtgatggtgtctccgaatgggaagtcgataactattgatagatttttaaaatatccaggaaactcctttgcatgaagattcactctgatttgtatttagtgtaaaacccaatttaaaaaatcttatcaacttagtaataactattcctctaaatattcctctaaacgtttgtatagtacttacgcaagcggtaaatcaatacttattaatttaacaaattatatctccccaaatacttaaacattggttgcaaacttatttaataagctctttaataaactcttaggaagtttattacaagtttgctatattagaatctcttcaatgctttataattttgcaatggctgtttcaaggtcttttgtgggccaataa

SEQ ID NO: 475702 - DNA, 741 bp, Homo sapiens
cttcgtaaccaggtccagatgatggaataccggtttggagctagagttcagaatgggctgcctgggctcaatcctccttcctactagctttgtgactttgatttcctcatctaatgaggatggtggagccatcctaatctggggcagtgaattccctggcactgaagatgaacatggaaaggctaaacaatctctgcccagtgggaagcagcctgaggccctcaccagaagccaaggagatgccagcactagcttcttgtacagcgtgcagaacccggactcatacaggctgtcccttcaaagacaaacatctccacctagtagttgttctaagaaggggcttcgagcatcaaatgatggtcatttatgcctgtcagcatctttgaaccttgaagatggtctccctggagctaaagtcagcctggcctggaaagctcatgaaacccctagaaaacatcctaaagaggtgagagctatgctagaaggagctctgatccagaaacataaatatgtggggtcaggtgcaatttaaaaactgtaaatgacttatatgcttatgaaaatgttctctcatgctggtaatcaaagaaatggaaattaaaacgagatctcctttttagcttatcatggcatagactttttaaattagagttggccatggaatatggaaatcagtgcatttattccctacctgggggagctaaaattcatacagcctttcagggggcaatttagaaatgt

SEQ ID NO: 475703 - DNA, 483 bp, Homo sapiens
gaaagcgagcgagggctgcaaggggtgccagcaggccatcacctctcaatgctatggctaaaccaagaccagacccaattcctaatcttgggttctttgcactggttgaggatggcaaaataaatgatattcaggccacaaaaatgctaaataataataaaatggatgccttacctgaaaagatggcgagtgaaaaagttgagaagccagatactagggagaagaaacctgaatccaagaaggctgatgctagtggcaacgtgacaaagggaattggcagatattcccgacctgctatgtgttccagaaaggcacgtacaaaaggaagtattcagcggctaaatccaagattgaaaaggagaagtttcttgcaactgttacaaaaccagttggtggtgacaagaatggtggtgccccagtggttaaacttcacaagatgcctagctatcatctaccggagatgtgtctaaaaagttgttgagc

SEQ ID NO: 475704 - DNA, 685 bp, Homo sapiens
cttccctgctctctctctcctgccaccacgtaggaaacgccttgcttcccttttgccttccgccatgattagaatccccttaaatgttcctcaccagcaggtcagcacttacccaccggatgcctcttcaggatccccattcaggttccctttcagttttgttccagcctactccctgccaggtgcaggagagcagggagcagctctggctcaggtggacagagctgtgaatggttcctgccagcaaccccctacctcctcagggcaaacaaagcactcagaagcctgccagggcttcaaggctgtagagcctggggagaaacaggattctaaaaggcgaaggcattccagcaagagagaactggggaaagcaggggttcccagacccattcaaaccacatgcagctcagcttcctcatctgtaaagttaggattcccaaatatgccctgcctagaaacagacaccacttactgagcattttttatgtgccaggcactacactacacatgtttgcacatgatttttaaagaaccccatttggcaggaataactgtctccattttataaaaggcaaaactgaggttccaaaaggtaaagctggttcaagagccagtcctggttcacatggttagcaaatggctgaaatgttacttcctaaatcccatgctcttagctaccagctgg

SEQ ID NO: 475705 - DNA, 738 bp, Homo sapiens
gcaggccacccgagccagccgcgaaaacccacttgggtccccttccacgctgtaacactcaccgctaatgtttgtggcttcactcctgaagtcagcgagaccacgaacccaccaggaggagcgagcaactcccgttgcgccacctttaagagctgtaacactcactgcaaaggtctgctgcttcactcctgaagtcagcaagaccaaggaagaaactctggacacatctgaacatctgaaggaacaaactccggacacaccatctttaagaacggtaacactcactgctagggtccacggcttcattcttgaagtcagcgagaccaagaacccaccggaaggaaccaattccggacacaatagtaggcatttgactcttaatatctgtgatgagcagggatgggtcagaagacagttctgctcaggtcacaacctgcacatccaaggatggcctgtgccacaatttcatcatatttcaacattctaatgtggtcacattttcaccagcatccacttaatgccacttaatcaggtgctttcccctggtttttctctccacctataaaacttaaggttttatgtgaaaactcaagaaaatattaaatgatcatggatagtcggcatacttgtcttatacctgaacttagcaggaaacaccagagcttcactttaagtatggtgatacctgtggcaaaaacaataaatcagcttattcaacaattcccttctcttgcattt

SEQ ID NO: 475706 - DNA, 654 bp, Homo sapiens
taattagttcttgttataataatgattctgtttttagaaatttatcttaatgaggagaagctttccgctgtctcaggcaatggactaattcatggagtgtactgtagtctgagctccctgatcagccgcggggagatgatcaaagaaacacacattgagaagcatcaatctaattcagatgtctcagctgacacccagatagggacagtggatgcatttaaggtacaaaccacagctgtgatgcaagatgaagaaactgagtccagaagggcagacaggaaagggtccaagggcagcaacattaaagccagttatgaaacagctctggactctattttcggggtgtttgatgtctatacttttgaggttattgatagcttactgtgttctcctccattcctcgtcttgtttttggtgggaattgaacaatgagatcacatggacacaggaaggggaatatcacactctggggactgtggtggggtggggggaggggggagggatagcactgggagatatacctaatgctagatgacgagttagtgggtgcagcgcaccagcatggcacatgtatacatatgtaactaacctgcacaatgtgcacatgtaccctaaaacttaaagtacaataaaaaaaaaaaagaaattatttgt

SEQ ID NO: 475707 - DNA, 759 bp, Homo sapiens
ccctaccctatgtggctctcaggtgggctgctgcaccacactgctcttccttcctctccatgccagcttcctgtacaaaaagaagtggaagaacatttgggatactggaagttattcatgcagaataatccagggtcatgttttggtaataatcccaaaccctttgagccaaatgagcacaggagacaattagcgattcactgctgtggctgcaggcaaaggtctccctatggggataagaagaggcatcctcaagatgaaactccattcagcttggaaagagaccaccaagagggaaaggaattgccttcccaaagggtcttaatatcaaagctggaagttgaagaaagtgattacaaaagagacaccttgggggtcagaggaaaagaaagactgtgcctggctggaacccagtggacaggagaagaggtaggagctgaggtgggaattgaacaatgagaacacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctgcatattgtgcacatgtaccctaaaacttaaagtataataaaaaaaaacattatgaggttttttgcaattttcttctttagctcatcagctttcgttagtgttagtgtattttatgtgtggcccaagacaattcttctttc

SEQ ID NO: 475708 - DNA, 575 bp, Homo sapiens
cagcagtcccgtggccgatctcctctctaactgtccctagccaaactcctttcaacgttcagatgctccttctcttctctccttctctgccatgccagtctgctgctctgccgctcttctgctcttctgttctggagcttgagcccagtggggagcaggagccgccatgggtgccttactggatcagaagcgcagtggacaccctgccggatctggaggggtggaagtcagcaatgggtgcttcactgaatcagaagcacagcagacaccctgctggatccggaggggtggaagtcagcggagggacctggggagcatacttcagtgatgaaaatgttctacaggcataccttggagatattgaaggctcggttccagagcacaataaagggaagatgaatgccaaaatactgaaacaatattttgaaatattgaaatctgggattggtagatcacagcaccaactacaggaaggtagcttgaaagaaaatgggtccagaagtaagagacataaagaaacatttccttggaggagaagataaacaatgtgcattagatcatttttgcattgctat

SEQ ID NO: 475709 - DNA, 779 bp, Homo sapiens
gcggaggacgcatagtcaaaggacaccagaggatgtctaaaagaagctcggtgggaaagctgagcactcggaagaaccaggatgatgaggcagattcagatgaggaagaggatgagtgtgaaaaactaacttcagattctgagtgtgagggacagctactggaggagattaaagaaaagaaaggaaaactaaaaaaaaaattaataccatatgattgggatactttgacaaaatctgttctcactacatctcagtacttgcagtttaaaacctggtggtctgatgaaactcaatctcagacaaaggaaaacacacaagcacagccacctgtgcctgtttcctttgaacagttaatgggagttggccataattggggtcgattagagaatcaagcagtaatggaggatgttgccattgttcagctgcactttgtgtgcttacaggcatgggaaaggataaatgttacgggtgagaaatatccttctttcagttctgtccaacaaggacctaaagaaccatatattgattttattgctgtgctccaagaggctgtgtataaagtcataactgataagacagctcaggatgttgtgatacagcttcttgcatatgataatgctaatgcagaatgtcaaactgctcttagaccactgagagggaaggcttatttagctgaatatattaaggcttgagatggcattggaggtaacttacataaggctttttcagatcaggctatggctggattaagagtaggaaagaatatgccccatttctta

SEQ ID NO: 475710 - DNA, 943 bp, Homo sapiens
ccctgacccaggactgggccagcgagtcagggccacagctgctacaactctttcagtcagcggcctggccccctagcccactctttcactgaatatcagtgtctgagtacattattcatctgttgtgcagctgggtctgcgggacggacccccacagagaggaagatctgccacttcgcactggcacagcatggcccataacccataaacccattacctcatggctgacaccgttagggctccaagataaagttcccctcatctcatgttgctctgaaagctgggagaggctgcgagtcacagccccgctgctgtcagagatggacgggactctgtggttttttccttgtctgatttctcgcgctttgaatgtgctacgcctatgaatgggtgtgtgtgtcttttggcattaatcctgcttggtgttctctgagcttcctagattcggggcttagtattatctttaattttggaataatctgggccattattactttaaatatttcttctgatgagttctctctttcttttccttctgatattccaattacacttatgttacaacttttgaaattgtctccaaatttttgggtgtttgtttttgttgttgttatttttgttgtttgcctgtttccttgttttgtttttactcttctctttctggaagtttctatggacatagcttcaagcacactgattctttccttggctgtgtctagtctcttacaagcccatcaaaagcattttaaaatttcggctacagcgctcctgatttctagcatttccttttaattctttcttagaattttcatccctctgcttacattacccatctgtttttgcatgttttctgctttttccactagtgttcttaacatactaatcatggttactttaaattcagtgtctgctaattccaacatctgtgtcatctctgagtctg

SEQ ID NO: 475711 - DNA, 648 bp, Homo sapiens
tcaagcattagtaaggcggtaaagaagtgagcattcacacttctggtgagatgataaagttggcacaatttggaaagcgtactgcgcatttcaactgtagttcgcattaccctgaccttattcatgaagctttcctgcaggacaacaaacagcctggaagaggaaggcgtgagactgcaatttcagaaagtagcacaaacctgacgttcaatgtttccctaagcacggatttgactgtgggagaaaggagcaggtgtcagcacccttcccacctgaagaagagactgagtcttgtaggttgctgtggccgccatgaagatgcacactctgctttcctgcttcagggggcaatgctgactggcagggtcagtgctggccctctggacccagcactgcattcaggccacagccatgctttccttgggatgctccagccagtgcctgagcatggcaggaactctgcaggaaggaaccaacggtggccacagccccttgcagttccagcaatcctattggtgtggttctgacttcatattggcccagtttaccattgtatactgtgcaaagaagcaacgactctaaataagtttgctctgcaagccttcacaccattgtcctttgtcaggtattcttttttgaatctaagat

SEQ ID NO: 475712 - DNA, 599 bp, Homo sapiens
gccgagacactgtataggagcctgcagtcacctggtagagtatgaggtcgtgtcacgtcagctacaaccctgggggtctccagagcaggacagcttgcttgtgctggggtgtccctgccaaatgtgacccccactgggtctcttctgagctgaaatcatctgaaatggctccagcacacacggatagggaaggatgttatgacattggatggagtccagagaagcacaagcaggttggaaacacagtcctgccagaggctccacaatggagctttgactgggatagtaaaattaaacatccaccaaactctgaacagttcagaaaacacaatcaaactgccccaagacaaaaagtaaagaatgatcagtgttctgaataccaggaggacagcccaccagcagaagttgaggaagaaagatgttggcagggggtggacacacaaggattgagaaatggtagagggctcctgaattgaaacactggatggctgaaagcctcttttccagcggcccagtaacatgctacatttggcaaagtcccttggagtttcaaagcatcagctctctctgctgcattcttcactatttaataaaatagc

SEQ ID NO: 475713 - DNA, 610 bp, Homo sapiens
gggaggaaaggaaaagacaaagatgaggaatttgagggacacgagtgtcaaaagcacagtcaaccccacaatggcagatcaactgacagcttgcaccatgcaccttgaaaaagctgcagacactcaatgccagcctgtgaaagcagctgggagagagaccataccctgcaaagccacagaggtggagctgcccaagaccatgggaacccaccttttgcatcagcatgacctggatttgagacatggagtcaaaggagatcattttggagctttgagatttgactgccccactggatttgggacttgcatgggacctgtagcccccttgtttcagccaatttctcctatttggaacagctgtacttatgcaatgcctacacctccattgtgtctaggaaccaaatctcatcttgaattcccatgtgttggaggaacctggtgggaggaaagttaaccaaactcaagcaaagaagaccattattaattttgtttttaaactaattccaattgtattggttggaacacttcattctaagagtccttcccacagatgatcaaagaaaaagaagtgtgccataatagcaaataacaacttctgtaaagacctctt

SEQ ID NO: 475714 - DNA, 574 bp, Homo sapiens
ctaaagaccctatatgaatttgggaggacacaagtttcaacatgtttgggaatatcactgagggatggggtctagcagaccagctccaaggcatccatcccagtgttgggtggagggtgggaaaaaaaccctctcttatgaaggcaagatcctctcacagcagcatttgctgtctcgtttctgtgctggccctgctgttacagattgggattggggacatcatccatcaagaacaacaacaacaaggtgttgtttgtaacaaatcaaccttgaccggttgtcatggaccctctgagggccaccttgatggacgggcatgtccagagtccctaggtgtctcacagaccaggttggttcttatggtgaccagctctcctattcctccacttctcttttgtgatacttcctggtacactgcataccatgatgtcagaattgtgcctgcccaagacggtgttctaagcagaatgtctggcatgcaatagatgctctgtgatctggggaagtttcaggaaagctgagaatttctctgggttgaaagctctcagaatgtcagagtacttctatgattggg

SEQ ID NO: 475715 - DNA, 857 bp, Homo sapiens
ttcctctcctccatgcaacaccccctcttgttcccttgccgtggaccaagcccgtgctgcttctccactcgcgggccacacactccccagatcccgtgctgctccgaatatatcaacacgcaccccagctgtccccttccactccatctccgtgttatccctgtgttagcttttggatgcaaatgtcttaccatgtcacttcctgactttaacccccaacaggtctccgattacttgacagtaaagtcaagtgaaaatgaaggtcacagaatccctcactgtgtatctcccatctgctgtgccaggcacctcctttcccctgacccaggttcctgctcctctcagcctaaccagactcactcctggggcctccgctcttggttcaggctgccaagaggctctatctgcagtaagtccccatttgttaaagggacaggcgtggagctccacaccggtcctgggattaaagggaagcaagaaaaggaggaaagggagaaacaaggaaagtgggacaataggaagcaggaggagcctggggagcaggtggaaggcatcacacgctccatcttgacttacaacggagctgtgtcccaggggccccctccaagcatccaccggccccacaagtcctgagcatccaccgcagcactgatccccagtctggcaggaccctgaacacaacagcaggaaatggtctcttcagttgaggcaagtccagcatgaaccgtgtaggtcttcctattattaagatatggtgatatgttttccagcatgtaacatctaaatctaaaattcaaaggataaaactttgagaattacaagatagatgctttctgaagacacaagaccattgtgat

SEQ ID NO: 475716 - DNA, 661 bp, Homo sapiens
cctgctgacttctcagctggtaccagtgtggattttgcgtgggtctctctgactgtgacaaaggaacgcggactgtccctggaggaaatgttgcacgcatgtagatttcactgtggttttcttctttcgagggtcaagctcctctagtttatgctaatttttagctctcagattttctgggcaatgggaatattcttgcattttgagtggacagacatgcttggcaatatctctaagggccctcgggcagatggagttatacctgctgtcctccgacctgtcacagaggtgaacgcagggtctgggggcctgggagcagtgcctaaccagattgtcatctcttcctgctcaccttcagcactgcaggtgcagataactctggaaatccatgtggaaaaggccgcaaagagtaaagctgagcttttttgctggagggagttgcatctccagaaaacaggatgggcaagcctggtaagggaaaggaaacaaaccttcctgtgtcccctgaagacagaaactctgaaggagggaaagacgaaggatgggtctaagagtggttcaaagtaattgaggatagagcatagaaggatttcagtgactctagtggagtcagtttggtctgtttttgaatcttggaaaaggggaggagcaagtctgttgc

SEQ ID NO: 475717 - DNA, 558 bp, Homo sapiens
caaagacagcaagcctgttctatcacttcttgttgaaagatggttacaacaagtgttggaataacaaagaacccccagataacacaatcgccatttctccaagcagaatgcttgttaaagatgcttttggacaaattgaatgctttaaatgtttgtgacatggttgaagttgattttgctgaacaagtttactttcagactggtgacctccagaacggtcagctactaaagctgtactggtttaaccatcaggttcgtggggatttgttacagcagccatcggaaactagcacaccaggaaccgaggccggcagggttggagcgtgtgggcctccctgcaccatactgctccccagttctccgactctgctgcttctccccatgcacccccacctccatgaatttgccttgaaaaaaccccacgtttacctcttgcctttcttcagtctattgatgtagccaagatgcacaaaggaaaataattcaagtttacaagatacatttttttttccagccgattttataagtccaggcctcaggccctcatgggtgaaaaca

SEQ ID NO: 475718 - DNA, 1629 bp, Homo sapiens
agcccttcagctttatggttatttttctaagtatggtgattatggtgttggagcctttggatctgatgatttgttttctgttttttaaactgaagaattccctgcctctggaatcagaggcagggctgcacagctccgagggtgcacccacactgccaggacagctcccagagcagcaggcatcaccagatggaagacacgacgggggttgcagaggtgccacatcgtgcccgggccctgctgtaaagaaggcagagatcagagtgcggccgtgcaaacctaggaacgccaggatgcgcgggagcccccagacgccagaggaggtgaagagggatcctgctggagctttggagggagcgtggctcaccaacagcttgatcctggacttccggcctccagaactgcgagagaatgaatctgagtttgtcccttgggggatccacagtcagtgtgtggccctagaggggagcaccatccacctgggccactcacatcggccacactggccatttaggacactgtccacagcaccacagcgtgggcctcacccagcaggaatgcgtttggaaggctgctgtgctcccaagaaccaggcattcgtgcacagctgtgaggggctcctcctccccgtccagcccagcctcttacggggtgtgctgtctaccaggcagaaccaaggtgccctccatcctggcactggcactagcctctgttagggcactcagcgcatcacatgggagatctgtttacccacctgtctaactaggccagcaatcccaaccttgcatactttacacctgggagattttcaaattacccatgtctgagtctcacccaagaggttctagttcattggccctcagggagccaagcaccagttttttccaagacagccccacacccctgtgcagcaaagtctatcatattcaacaaatgttaattaaataaatgaagagtgaatgaatgaaacttttatttattagtcaggttaaaaggaagagttaaattcttaggttaaaaggaagagttttaaaagttacctgcttattgcttattctgagtatgtaaatacaaagactgctttcccgtcaaattttgatttgctagaatctgtcatttgacagtaaagggaaatgctgtagaaaaaaatgaacaatatctttttcacacctgcaaaattgactaacagcagacctcatttgattcaaataaatgaaaaatcatttgactttggaaatagatgaaatccggagagttgcagacataagctacaacttgtaaagatgggaaacggatgaaaactggcaaataaaagggggtttccaataaaaacatctgtaagtgtacctgtgacatcgagcgtgctgtggatcaaatttggcagtactgcagcttaacttttctcattcttcataaagtaaaagccctggttaaatgatggcttatttgtcaagcttcaggcaaacagctcataaaaatcaaccagctagactcaaacatttacacagtaggaaaaacctccttcggacaagcaagagattaagaactagttttgaaaatgtgtaagtaaaggaggaaaacaggaatcgactaggtgatatcagccaatggaggagtcccaaatttctc

SEQ ID NO: 475719 - DNA, 1514 bp, Homo sapiens
gaatagcatctgagagatgagtttatcagaaaaagataaatgggcatgtgtaatgggttaagagtaaggctctcaggtgaagacctgagaaagggccagagtggccaaaagggcagagtgaagattgggggtgtgctgctggagccctgggaggagggggttgggcagtcgctggcgctgccgctggtggtccctgtgcttgaagtgccggtgtccactcgccgccccaggttctccacgtgtgtcctgggggaccagcagcacagggttgaggccaagcctgtgggtatctcctacgtggacatcgaggtgctgaagaaactcgacaggaacaagaagctgctcaacaagtatgatgcctttctggcctcagggtctctgatcaagcagatcccacaaatcctgggcccaggcctaaataaggaaggcaggttcccttccctgctgatgtacagtgaagacatggtggccaaagttgatgaggggaagtccacaatcaagttccaggtgaagaaggggctctgtctggcatggctcttggtcgtgtcaagatgacagatgatgagcttgtgtacaacgtccatctggctgtcaacttcctggtatcattgctcaggaagaattggcagaacatctgggctttacacatcaagaacaccataggcaagccccagtgcctgtattaaggcacattctaataaatcttagtgccacaaagagagagacagagagagaaagagagagagagagagagataaacaaagagagagagagagagagagataaacaaagagagattcgggattcagcaatctcctttctagacaagggctgctccccctgacaccacagaggagatggctgatgttccaggagtctacaggcccaagagacctgggttcatcccatctcgttggagaaggacagcaattctacagagggacccagcgggaaaagctggtgaaacacaaataggctgccccagggaggagcctctggctcttttatagggtaactgaatatggtcaccagcttttatcaaaattagccaggtactcagagtttccaacggcccaggcacaaataatccacaaaccaatcacttcaaattatatccctgaaatagtcacacgcatgctctcaacataccattagcacctaaactcaaactatgacacacccacaagtctgcatcaccctgcttataacttaaagcttgtgggtttaaactaatttaggagtcagtctggggaccaaagggggaaagtcttataatgaggtggcgatttgcttagggaggggaatgcaatgcatgcgtgacatccagaggctgggaactaatcgtctcataggagaggtttataggacaaggcagtccacaaaatccccctccctctaaatctttgagaatctcttccattctcatacacctggactaagtgtccccaactaaatgtgtatgttaaaaccccacccctcaatgtgatgatattaggaggtggggactttcggag

SEQ ID NO: 475720 - DNA, 618 bp, Homo sapiens
ctgacatgccctggagaacagaacttctggttctgtgttttatcatagtgaaggcagtaactactttcgaggttacagtaagggtgatcggagcctgtaaatccaagggtctggctctagatgatcgcagtggaagcaaacattgggcaacaggggcaggtgggcatgcagagtggcagccaggaggaagttagcatcaagaaaatcagacagctggtgggaacgcaaccaataaccgtgtctcagagacaaaacactgggcaatgggacagggtctggcaggatagatcagtgcctgctgttctaaaagagggtgaaaatactggtcctgttatattgctgcaagaggtgggctcccatggtcttgggcagctctgcacttgtggcttttcaggatactgcctccctcctggctgctttcatgggctggtgttgaatgtctgtgggttttccaggtgcacggtgcaagctgtcaatggatctaccattctggggtctggaggatggctgtcctcttctcacagctccactaggcagtgccccagtagggactccatatgggggctctgaccccacatttcccttcagcactgtcctagcagaggttgtccatgaggg

SEQ ID NO: 475721 - DNA, 700 bp, Homo sapiens
ctggcacagcatcagcgttaggtttggaactgctattggacggaccctcctctacatccttagctcctttgaccatctcagatgacacttcttggccttgcttctgtagttgcgagcaccaagtgtctctgggtccctagcaggttacctggattctgcttgtatacccatgagcagtccccctggttagactttcttagtctaaccctgttgggcagagccttcttacttggagagcttcggcctaatggcgtcatttgcctcatggtcctttgtttcatggcaggtggaaccagcccaagtttgggggcatggaggaaagatgagcggacttccgttcagtccccagcctggattccttgtttaagcataagggctgtcatttttcttgagctagaagcatcagctgacatagattcctcaatttcctttttacacttcaaaaatgattccaaagaagactgcctagaaacaacatcagcactggtgttggttggggggtggattttctccacgcccattctccaggaatggaaaaaggagtagcaacaggtgtcatatattgctataaactgctgttgctgtggttgtttttgttgttgttctatacagttcctaaaatatttgcatttattattttggtgaaaaagaaaagtagtcgacatgaatatagaatggtaagccttcaatgtcatttgcc

SEQ ID NO: 475722 - DNA, 1405 bp, Homo sapiens
aagcttgtgggagttatttgtatcctactgctcaagctggcatgatcattgaattcatagacttatgtcgctgctggtcttagtgcttaatatatacagtgactcattctacttaatggcatcaacaacagatgcagagaaaatgcttcacaagcccaaagattgcaggcctcgctacctttccaaggcaacatcgttcttggagcacctgctgaggtgctctctgctgggggccgtaagtgagcatcgaaaaagctgtaaaaagtatccctgctgctctccagggactcacagcatggacggcacctgcattgagagaagacggcaatggtatcgtgatgccagtggtgaggtgatctatagtggttctgggacagtgtattatggcagaatcaggtcctgggaggatatttggcaacatccctggcctctactcaatggctattgttttcacaacatctacagccaatatgaactgctgctctatggtatgtacaaacgtgtgcactatttaaacactgttgagaaaaaggacctccttggaacaaaggcagatgagtacctttcctgggtggcactggacacaacgatgcttggcctctggtctgtggcccagaggtagacagtaggcagccacatgagctggacatccatccccaaacatgggacatttctttgccattatcaaagaggggaaggccacttggtagactcattttttcatgtgattaaggcctactcactagtacactactaagtcattagggaccaataaaatttgtcatttaaatcagagatgcactcaatgacaacataccaaatgctgaaaatcaaccatcagctacatgttaccttcacaggataaatttctagaataaaagaataaacttgaatttttttaaaaaatgtgatcattatattttctgatggtggagtgtaagtatgatagattgcttctgtgatcatcctagtgtgcatgctagtaatgcaaaatgcttgcctccttcccactggtagggtttgagcatggccagtgtgaggaggtgttaatgtagttctcgtggtgaaggtagttgggtggccctactactgaagttaatgctgccagcattatattttgtgataataaatgcaaatttagacctcaactggttaaaataattttaatacataaaacattaggagattttcactccaagccatatctgtaatacttacatgattttgacaatcaatattcagatattgacaataaatccaagtaacatactttgtccacattattggaatttttatgctgattggatatgatggcagtctctggaccatgtgagtgctgaacactcacaagtttagtgatccagcgatgacactgatacaggtacgtgtccagtttccttctgac

SEQ ID NO: 475723 - DNA, 807 bp, Homo sapiens
tctaagtcaaccgggatcagcttagattgtttgctagtgttatatttaaagctattttattattctaggccatccggctgatggaatggtatcagcttctccttgtacctctcatagaattcggctgtgaatccatctggtcctggaattttttggttgttttccttctaacagtcaggaccctcagatgcaggtctgttggagtttactggaggtccactccagaccctgtttggctgggtgtcagcagcggtggctgcacaacagtggatattggtgaaccacaaatgctgctgcctgatcgttcctctggaagttttgtctcagaggagtacccggccatatctcaagctgtgtgctgggagaaccactactctcctcaaagctgtgacacagggacatttaagtctgcagaagttattgctgtcttttgtttgtctgtgccctgcccccagaggttgagcctacagagtgaccccagtaaaggcccagatctgcaggcctgcctgcatggatgtaaatgggcaccttcctccaggtatctggaatagcaggacctctgccagactgtggctggaaggagtttgggatggttacagatttaattaatttatatttaaaatgattgcttaaagaaatgaagttgttattgccagttatattgttattgttttatgtgtttttagtagtatatttccctcatttccttttttactttcttaaattaaatttaattaattaattaattaattaattattattattattatactttaagttttagggtacatgtgcacaatgtgcagg

SEQ ID NO: 475724 - DNA, 984 bp, Homo sapiens
ccctgacgtgctaattcttgcctgaagcagctgtcctgaagaaacagcagaatgatcttgaaagttagttacggcttcagaaagaagataatgtgttaccctgctggggaaatgccctcttcaatttgttatatgctcagaaccagtgaccaatgtgttgtctccccaaagccaggattcacagggccagaaatcaaaggggaggagacaggtcctcctcactattaccctttggcaaagaaagtttttccagaatgtcagattgaggccactctcagctcccaagaggctacccactgttccccgctacatagctttttccatagacagttcacaagatggcagcttcctaatttaaagacagcaggagagcagaaaacagcaagactcaaaagcaaagatctttacctggatttagcaactgagtctttctgttttgaaaaattcccctgccaagtgaggaaggttattgaataactagaaacgttgcaattcaggaaagatttttgtcgtaattccttccccacaccagtagttaaagagtgtgggtaaatcctacaaaacttattctgctgtcacttatatttgtatgaaataaaatagaattctgcagagctttgcacagtattaagtttagaggaggagaagaggacagagaaaaggaattgggatggtgtacaggataatcacagatcgattgtttaaagaaatattcctatattcttaaaatagccagcaattttcacatataggttaaataataataaattaatataaattcttaattataagttccctggatcattcattgatgtattcattaagcaaactttggatgaacatcctataacatacttttaggttctggttgtacaaatatttgtatcaatatgtcatatttatatttatattaatgtccaggtgaatgaaaatttttattttaaaattatttttaaatgttatctatttatgatgctttaaatc

SEQ ID NO: 475725 - DNA, 965 bp, Homo sapiens
tatacaaaccagcagcatagatgtttcagggggattgacctagggatggggcttcctgagagtcaaactgcagcaattgttatttatcttctggatctagctagccagcagaggcttgctgtggctgctgtgggggatgcaggtgtgattcccaggctaatggagttatgttcccaggaggattatggctgtctctgctgtgtcacacaggtcaccagggaagtgggtaaaagctggcagcaacaggcctcattcagctcctatacagcttgcagcccgaaaggccagtctcactcccagcatgcacccccaacggcaccagcatgggtcatcattcctggtcagctgttggtcatcaagaaaatggtcatttcaaactgttctctggctgctggaaaatcatttaaaaatgactgtccatacctcgtagcaaatgttctggctttccagagataaacatggaagaaatagctgtctattaaaaaatagtagtaacagtctcaattatttaagggtttatttcaacatatttggccttattcttcctcatgctgttcatatattggtcaatagctatattttggtattaggtatgcaaatacatgaaagtttaatgaaataataactagtgccatgaatgaaaaatatttgactttatatttatgattcattacattatttgtaattctctttttcatatttccatgtaacagtgaagaatccttttagcctggctctctcattaggccctggaagaacatataatagtataatttttggaatcactaggtttaaatttagtcaaagaagactcacataaaatggccccacctaaatttttaatatattttgctacttgtcacaggatgctctcagtgcattcacagaagcttaagatttgggtgaggtgatgtattagccccttggggagatattataacagagtagttatgagagaagattgt

SEQ ID NO: 475726 - DNA, 731 bp, Homo sapiens
tccactgacaccttgcactgtgcacctggaaaagccccagacactcaacaccagccatgaaagcagccagccaggagtctgtaccctacaaagccacaggggtggaacttcccaaggccatgggagcccaccttttgcatcagtgtgacctggttgcaaaaggtacttgccttgtctcagatgagactttggacatggacttttcagttaatgctggaatgagtaaggactttgggggactgttggaaggacatgattatgttttgaaatgtgaggaaatgggatgtgaaaagggccagggccagattgatatgacatccacgttcatcttgcctagaataatgaacgtttggtattttctcacccctgcagcttttccagaatcccagtccaagtcttcctttctgacttcccactgtttgctgagattctattttgataaaaagagtaaaaaagtagtacagaacttcaaaaaacactatgactttgagaggtagagccaggacagaaacagaaaggtatgagataacccagaataacacagaactgtagagtcaagaaagcaaaagattaaaaagaacaccaaatacttcccataagtgaaggtagatgcttaaacatggatatgtttactttaagtggatccactggtgtcataacatcagaatatatattaaacattattaaaaagaaataatttccttggcttcttattttctcaagtttcatac

SEQ ID NO: 475727 - DNA, 806 bp, Homo sapiens
atagacagtgccgggagcagggccttgtatgtcgattttcaaccacagtaaaattagacaagtcattcatttctgggtgtcacggaatggagtggccaatggcctgcagagcaacatgcccaagttttattgtgactactgcaatacatacctcacccatgactctcctcctgtgagaaagacacactgcagtggtaggaaacacaaagagaatgtgaaagactactatcagaaatggatgaaagagcaggctcagagcctgattgacaaaacaacggctgcatttcaacaaggaaagatacctcctgctccattctctgctcctcctcctgtaggagcaatgataccacctccccctagtcttccaggtcctcctcaccctggtatgatgccagcaccccatatgaggggtcctgccatgatgccaatgatgggccctcctcctcctgggatgatgccagggggacctgctcctggaatgaggccgcttatgggaggccacaggccaatgatgcctgggtccccagtgataagacctcctgcctgtcccatgatggtgcccactcggcccagaaagacttgaccagacagataaggataaaggagagggctcattatgtcggttttatattacctgttctgcttcaccaggagatcatgctgctgtgatgctgggttttctaaacagcataaggaagtcttgctcccctctcctatcaaagagaatagttttggaggggagaagtgggacaaaaaagatgcagttttcatttgtattgggaaatgtgaaaataaaattgtcaact

SEQ ID NO: 475728 - DNA, 794 bp, Homo sapiens
ccggccatttacacttcttttgtggtggaatgtcattagttaaggtggggcagggcatattcacttcttttgtgattcttcagttacttcaggccatctgggcgtatacgtgcaagtcacaggggacgtgatggcttggcttgggctcagaggcctgacaatggggtttcaccatgttgaggccctcccatggagctggacatctgtgcactgagaagggccctgtgcaggctgcttttgtgggaagcagaatcacagcagggtttggggtatgtgggaatatcctgctgcccactgtgcccacatgcctgtgtcctgacttgatgtacagaactgttaacagaaaggggtcccaatcagaccccaagagagggttcttggacctcacacaagaattagggcctcctatctcatcctgtgacttagaatgccttaacctcctgggaatgcagcccaataggtctcagcctcatttacccagcccctattcaagatggagttgctctggtttaaacgcctctgacaaagccagacgctggactacaaaactgaatgtggcctgtgtcttcagcacagagagcaatgatatcacaaaactgttgccatatgaaaatgaagaggcaatcaaagaatatgcactgaaaaaatatagaaaaataatttatagaaatgtgtcaggcagttaataaaaaggattgttatttttctggattttgttaaaatttgtgaatttatcagtttttttaaaatgcgtaaattgtgaggacctcttttctcattctagttacttttac

SEQ ID NO: 475729 - DNA, 663 bp, Homo sapiens
ttaagatctatatagagcgatgggctgggggcaatgctgacccataaatccatgatactcaatgtgatgtggcctcattcagacctgactggaaggcacctagccttcagcaccaagtggggaatcttctgcagacatggagagtaccatctacctccactagccaatgaatctcaagaacccagacttctgctctggagatgggctgctctgattccataccagctgtgcccatcctatcagggcacaggcactgaaaagcaattggaaatccagccctgcacagggagctgtgccaaagccagcagccttgcgttcacactccccctgcacccattcctgttcttcaccttctcctcctctgtgcctccacaacaggcatggatgggcctttcatcccaagtgccccaggaaagcttggccttgcttttgtacactgctagaattaagaggttgtcgaccagaggaggaaaagaaaaaaaacaaaagggaaataaaggaaatgagtgggcactgccctgaggaggccctagaaccccaaacatcctttgcaacttcaagacacttgcaacaacacgcaccagttttaaactgaaacccaaaatacccctgctactggctgtcagaacctgttttctggatggcttatctgctgagggtagc

SEQ ID NO: 475730 - DNA, 834 bp, Homo sapiens
tgcagtcattctggagaacaatcgatgatgcttgtcaaaatatcctttctcttgggcatggtggcggcagcgacggcagcgggacataggtgctggacgcgggacgcagcggcgcgcgggctttggtcggaccgggggtctcaggcccctcttctgcaggtctgctgcagtttgatggcggtcggctccagagcctatttgcctgggtattaccagcagaggctacagaacagtaaagattcctgcctgctccttcctctggaaggttcttccccaacgggcaccagcctgatgccagctggagttctcctgtatgaggtgtctgtcaaccccttgccgacagtgggaaaaaccgcctactcaagccttagtaatggcggacgcccctgccccccaccaagctcgagtgtcccaggtggacttcagacagctgtgctggcagcatacgaaggaatcccctggtctgtggattgcaaaaaccatgagaaaagcgtagtatctgggctggatagcaccatccctcatggcttcccttggatgggaaagggaggcccccctccaccgctccttgcactccccactccccagctcaaggggaacggccacagccccaagggtccaagattagaatatgactgcggttataggtcaaaagattaaaggtctgtgaatattgttctctttttcacccagagataccaggatagtctctggcactttcgccttggtatccataagtgagacctgtattgtcagtgtttagatttgtcacaatcagaattaacattcgtttagttcagaaaaatatgaaccatccagctgcatctggttaaa

SEQ ID NO: 475731 - DNA, 887 bp, Homo sapiens
gcgcacaggggtcaggcgtatgatggagaaagaaaatgggagtaggatgggcacatctgaggaactggagagcagagaattccgaagattgggccgagcctatgccctggcttttgcagaaagaggagcgttagttgttgaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcagatgactaaaactttttgttagttttaaggtaggttttaatattttgctgcgtgacaaaagacggtttttaaatcaacaatatttttgtgtgaataatgggcactcatcattt

SEQ ID NO: 475732 - DNA, 508 bp, Homo sapiens
agacattctgttgagttactagataagcagagcccagctgagatgcaattctatttcaaccatcaatacgatcatattcaaaaagatgaggaagatgacgaagtttgtgaagagaggacactcaaggacccatccggcccacaaagaaagaggtggcctctgagggcagctgcatctgcccttcttggtgataagtggccatgtctgctcagcccaggttctcttcacccactcagtcctgacttcacccttccgcctccagctctggcgccccctgagccccgctcacccgacgcagggctggctcagggccggctcacagcctcactgcgccccattcccagccccggccccagcccaggactgggcccagccgtgctcagatacaaataccagtcaatggttgaacttaaaagcaatagggttgggaggacctttgcaatattggtcattaaatcataagtaaaattattctggaccataaagtaaaatcttagattaggtcagc

SEQ ID NO: 475733 - DNA, 897 bp, Homo sapiens
caggaaattctgagaatttcaaaagtcgcattaactaagaagtgtctttctttggtttgattttcacacagcagctgagacttatgggccagaagatactggaagatggtgtggccttctcttgcaagaggcatcctgttgggccctcgggagaatctgggctggcctgcgcctccatccttctgcctctcctcaaaacaaatgtggagaaaaggagaatccgaaaaccatgagcagaccaagggagtgatcttgggggctgaagctgttattgagatctctgagtggagtgcctttggatatgctccaccaactgccatggtccctggagaagtcactaaggtacctgggtatggagtggatttaactgagcatcagccaacatggagtaagctcgaattcttctgtgtgtggaccagtgtcccatatgggactagggtgatcgggtcccaacaccaggtcgtgggggtgacaaagtctggcagagtcaaaggaatgaggaaagacagtttgagagagcaagtgggtccaggtggccaaagcgagaatggaggctgtgaaggccccgagctctggaagcccagactatttattggtgatcaaacaaagaaacaggtgatgagaatatttccctccaagtcggagtccctataaccagtactgccaaagcagaattacgtgttaactaaaatttttatccttagtaacctaaaactttagtggaaccctaaaaaggaagaaatcctgaataatagtgggcatttataggtaagaacaattcacaattttagaaacatattttccccatattacaactcttcttaattggaaatgacccagatattaaatgagcattaaaaataactttaagattttaatttatgcaaaaagtttacc

SEQ ID NO: 475734 - DNA, 701 bp, Homo sapiens
aactattagaggagggaggggataagagcaggccggctgccagccctccagactgtccgctatggctccaaggctgttacccaccaccgtcgtgtgatgcactttcagcgacagaagctgatggctgtgactgaatatatccccccgacaccagccgtcaacccaacatgcctgccatctcctcctggccccccacaggaggcatcactggaagccctagaacttacccagagggagcaaggttgccaggagcagtgacggctgatgtacccttggttattgctttccaatttcaggagacgggcctcatcaggcttctctgccgggagagagcagcagttttccaggacaaccgaatgatagctatctgccagagcgtggctctgagcgtagcagacaagcttcttatgcgacaccagctgcggaaacacaagatcctgatgaaggtcttccacaaccaggtcctgaagcccttcctggaggactccaagtaccaaaatctcctgcccctttttgtggggcacaacatgctgctggtcagtgaagagcccaaggtcaaggagatggtaaggatcttaaggactgtgccattcctgctgctgctaggtggctgcatcaatgacgtagatgccatcctcagcaggcagggctttatcaactactccagccttcccagcctgcccctggcatagggggagctt

SEQ ID NO: 475735 - DNA, 626 bp, Homo sapiens
aaccaccataaaaacctcatgccagtctcctttccctgttcttgcaagccattttcagttcagcttgggaagccagccctgcttcccagaaagcctcaggatgggtaggctcctgggaacctggcatagcattgatgatggcagtagtggtggagggacaatttcatgctgtgatgagctgggcaggcctgtgtctaggccttttagttggttcctgcaggtccacaatggtgaaagcatgcaccagctgttgtgggtggagatggggcaattctcaggccccaggcagagtgttcagagccacagtccaggagattccaggagctgtctttggtgtctggagtcatcagtacaagctgtggcgttgtgcctcattgtagcactagtgctggcacagtcatgtgttgtattttggaggtttgttcctgaaagaatggccttcaagacggcttctggggctttcccagaggttcagacacttatgtctgttttcttgtttcaacatgctacaacagtttcttttgtttgccactaaaaatctctgaataaatgaataatggaatctctgctgccaataaatattggatgttttgatgtctatgctattctctgaagttattgcaaat

SEQ ID NO: 475736 - DNA, 598 bp, Homo sapiens
tctcccctcagacatagcttaccccaataagaaggaaccagaaaaacaattctggaaataaaaaaaaatgatagaagatatgagggtagaaatcttcagtgaaatagatggcataaatgaaaaacagtcacaacttcaggaaataaaggacacacttagagaaacgcaaaatgttctggaaagtctcagcaatagaatcgaacaagcagaagaaagaacttcagagctcaaagacaaggtttttgatttaacccaatccaacaaagacaaagaaaaaagaactttaaaaagtgaacaaagccccgcagaagttcgggattatgttaaacaaccaaacctaagaataattggcattcttgaggaagaagagaaatctaaaagcagtagtaagcaccacactgtcactgtgacagacacccttggctgcttacccaacctccttcccatacttccttctgctattagactctcatttcgttcacgcattggtggtcaagggctttaggaaaggggtaaatctttattaagaagctaatttaggtgtagcagtctaaatactattttttttcatgagtttcataattataatttgggttcc

SEQ ID NO: 475737 - DNA, 596 bp, Homo sapiens
cctgcagaagaggaaaactaactgttagaaggaaaactaacaaacagaaagcaaaaacatcaacatcagcaaaaaggacacccatgcaaaaaccccatctgaaggatcacaattcctcgccagcaagggaacaaaactggacggagaatgagtttgacgaattgacagaagtaggcttcagaaggtgggtaataacaaactcctccaagctaaaggagcatgttctaatccaatgcaaggaagctaagaaccttgacaaaaggttacaggaactgctaactagaataaccagtatcaagaaggacataaatgacctgatggagctgaaaaacacagcacgagaacttcatgaagcatacacaagtatcaatagccgaatcaatcaagtggaagaaaggatatcagagattgaagatcaacttaatgaacaaggtaggccaacattcaacttcaggaaatacagagaacaccacaaagatactcctcgagaagagcaaccctaagagatgtgatcatcagattcactaaggttgaaatgaaggaaaaaatgttaagggcagccagagagaaaggtcgggttacccacaaagggaaga

SEQ ID NO: 475738 - DNA, 1779 bp, Homo sapiens
catctgtgagaattttcctactgcaacagctgcaacattcctcttcacatccttatctcttcattcttcccctagaagcatggatgttaaccctcagcccctagtgaccactggatttaatctctatctctatccctcacactgggaggaagtgaggtctgccaggccccaggtgggtccagaagtgtcatccgggagtcagggactagagtacaaaatcttagaagtatacctggtattctattgtattgcagctcagctggcacttaaactacatggtgcagttcttcccactgtttcctctcctttccaaaaaagagaggagtatcaccctatagcccctgccaaccctggccacaaggagaactcccagactaccactgatgttcccttaaggcccaaggagatgtttaccaatgaaagttcagcacctggtacagtacacagctcaataatgaattcttgcctcagtgaatcacaagttcagtttaagacaattatggaaaaggttgagaactacatcaattacacttagtgcacctgtggcattagtacatatgtttattctagaaactattatttcatctagtttccaaacgttcattttggtgaatttcattttcttaaataaacaatatttaatacagctttaatagtatgttgatgacctacacttggttgtatgattataatgacatgtttaactacacatggcatgttcatattttctatttttaaaatagacatcaatcatttaccacagcctcaacgagacattcttaggaacaatgttgtcaaggaaacatactgaaactgttacataaaagaatgtctctgtgaggaaaatctttcaaaatagtatttctattttttcccaaattatgtaaaattataatttacaagcaattcaatttaagtaaataatttataagcagtttatgtaatggtgcagctgtgggaatctgtcagatcttatcacaataaatcttcactgccttagtagttcttcagtgccattacacagattttgttttattttgtccaaactttctattttctttcagcaggaagatagttccaaaatatctagttttctattactggaagcgaacatctcaaattttatctttgaaatttgtctcatttttatatacttgtgaagttttaatttttctaccaacaagatttttttgcgagggagggagctgctgtgcatttctttttctttttactagtgatacaaggctataacatagctaagaaaaaatttaacttagtatttttactatgctccttttaaggtttgcagtgccttgaacaccttagagatatcttctgtttctgttaatggtgatgcatgaagctttcaataggacccttattgtactggcagggccatcttctcattttcagcaaaattgagtgttctctcactttttgtttaaaatcaactttcttggggtataatttacataaataaaaaacatccattttaattaaatagtttcataagttttgacaaatgtacatattaatgtaccacccacccccccattaagaatctccctcctgccagcctccctccctccctctcttcctctctctttctttttctccttccctcactcctttcctcctttcattccttcctccttcccttcctgagaagctcattttcttggactactgtctagtatcttagaccaagtgattatacctatttttcatataaaatgcttgaaggtatttatttaaagtctaggatacctgattgttatg

SEQ ID NO: 475739 - DNA, 1234 bp, Homo sapiens
cacgagctggtgttgagtgtctgcgtcttttccaggcacatagtgcaagatgtcagtggatctaccattctggggtctagaggacagtggccctcttcttacagctccactaggcagtgccccagtggggacttggtgtaggagctccaaccctacatttccccttcacactgccatagtagaggttctccatggacttctgcctggacatccagatctttccatatatcctctgaaatctaggcagaagcttccaagcctcaaactcttgtctcttgtcttctgttcacctgcaggcacaacaccacatggaatctgccaagacttagggcttgcaccaactggaacaagacaaggatgtgtatccactctcaccactcctgttcaaatagcactggaagtgctggccagagcactcaggcaagagaaggaaataaaaggcatccaaacaggaaaagaataagtcaaactacctctcttcataggtgatatgattctatacttatgcctagaaaactctaaagactccataaaaaggatcctggaactgataaatgactttagtttggcaacatcacagatgcatttttgtccaaaggctctcactgacttgaagcaacataaggccagaagttcacgcagcagaatataaacttctgtgagacttaatcataccattcctgtgtatccatatcttagctaagaatcattttaatgattccaaaagaatggttaaaaagtacccatagtggtctttgaacaaaatcttatttcaagatattttacatctcagaagcatagctttctgcctctgaagcccatgtttgaagtctgctagtaattgtacttactctgcagaaaaggaggacaaatggaagatttcagacacaggccgcagatggacatttgaccataagaatcgatccaaataagctctggctgccaaaactactgccattcaaaactgtggggtttgttcagttttaaagagacttcaaaatgagagatgccattagaaaagtgccaccaaaatttaatcaaaaggtttgtttcaaatgtatttattttgtaaggttaagtcttgtgcaattttctttaatttaaatcaattaaatgagttgtacagatactaaccaaataatatagattctcaaaagccaagttactaatttgagttttttcagtcattagtgcaattgagagctttttcaaaaaaaaaaaaaaggggagaaaa

SEQ ID NO: 475740 - DNA, 610 bp, Homo sapiens
tctcctttacatgaaagccagactggtgatgcaattgagtagtcaagccattcagaggtccccaaattgtgggcaacctagggagttggtgcccttcatcccagctgctccagccttggctgaaaggggccaacgtagagctcagggcatggcttcagatggtgcaagacatgagacttggcagcttccatgtggtgttgagactgtaggtgcacagaagtcaaggattgagttttgggagcctccgcctagatttcagaagatgtgtggaaatgcctggatacccaggcagaagtttgctgcaggggcagggctgtcatggagaacctgtgctagggcagtacggaagggaaaagtggggtcagagcccccatgcagagtccctatggggcaccgcctagtggtgctgtgggaaaagggccactgtcctccagagccaagaatggagagagagttttcctttacagactccctgtagaaaaacttcaccagcatgaaaaaaaaaagacacccactgacttacttttcatctggaattaatgtgatcagcaatgtctaaagacggtagataaggcatgttttcatttcaatgaaatgaagattttcaaag

SEQ ID NO: 475741 - DNA, 566 bp, Homo sapiens
tcctatgtggagccgcaggctaaatgccacctgtcatactgcaatgtcagttttactcaaaggcctcaacatagatgccttctccaggaagcctttcctgattgccctcgaatttggtagaatgtgttcagggtggatttcaggggaacaagtctggatgaaaggagttgtcagatgctcaaaaggtcacctgaggagaagaactggagaatgcccatgtcctgtagtagctaaagatatcactggggaccttggtgacaacagttcaagcacagcaatggggctaaagtcaaaagccagtgacatgaagaggccacaacatgagcatttagctaacttggatttgcaattggacctgagactttcagacttactaatatcacattgtgatgcagtagtagcagatgcttcaaatacacctggtgcaatggttcattctgagagggttctgcatgcaaaagatcaactcgttctctaaatagaatctagagatacaaaggaatcagcaatagcctcacgtatttgtacacaatgtagtgtagcttctggtatttttattaccaatc

SEQ ID NO: 475742 - DNA, 521 bp, Homo sapiens
cactcgtttaaattagtatctgttatgctggatactgggaacacacagataattagggcagcatctcaacctgactctctcagaattaaagaaataggagcgatagaattctattacaaaacagtggtggctcaaatcaagacaccagtaggaggggtggagagatgtgactctattggccagacattaagaattgataggatttgctcgttgattggatatagggatgcgagaaaaggagtcaggataatgccatgtttgtttctggctggctcagtgggatggatagtcatagttcatcttggtgggaaaaatgatttcagattcgggcatgaactgagttttagggggatgaagaacccttgtggagatagaaaaagagtggtcacagaggtaggaagagaaatatcattgtacctcgagagagaagatttcgaggaagaaaaacctgctattgagattagattggaagagaagcaagttgataggattgtcagattttgtaagtaaaaaatatagaa

SEQ ID NO: 475743 - DNA, 497 bp, Homo sapiens
caagtttcttaacctctccttgcctcctctgattcctatcatgatgaaaatcattcctaatttccaggattgcagttcatccagcacgctgcttttgagcatcgatgtggctggactacacaagcaggattactctattcttaaagattcccagttgctggttttagaacttaatcccccttccacattagaaatgccctcctttagtgaaattacagtacctgctggtgctgcttgccaaatgaataagcgtgccctggcacctagctctggaaacaaccaagtagaggaatctcttgttagcactgacatctggtggtcactgagaggccagcaccccagcatcttgaacttaaaagtatgcacctgggaaccaggcaccaaccccgacgactccagcagaattgattcctcgtccccctcctctcctggaccacctaccttctccatgcagctggactcagcaagctggagagaaagatcaaggatttagagtc

SEQ ID NO: 475744 - DNA, 690 bp, Homo sapiens
gccagcagttctgtcaccagggccacctaaagaaggaagcaggcatttgcggtgtacgcataccagcaaaaggatggtgcagggaggtcatgggcaagtgcatgcaggcaaagtggcacagggggaggctgcatcgggggcagcacaggtgagctggtgcatgttcatggggcccactctgctggagcactctgccggtcaggtggtccatcagcacaggagctatgatgcaggcccccaaggcaccagaggctgccttgcaagcaggcacatccaggctgggtcccagaagaggccagcagaccaaggggtgctcaggtcaaaatggccccagagaagagaagatcctttaaaggacaatgctaatattatgggaataataggcatcaaaggaagaaataagaagataatcaaatgttatccaattcctttctttattttacctaaaattcagaaaagatctaatgacaatcccctcagcaaacactaaactttcctgcaacaaaccatatacaagttgctcctaccatgtggcttttaagcctcatgcacaccgacttttctagagcattattctcacgtggttgctcctcttatgcctccagtgcaaatgagatggaagttaaataagagctttcttactttattgaattcccattgataaacatctcccttgcaatcgtcttggct

SEQ ID NO: 475745 - DNA, 785 bp, Homo sapiens
tgagataaactgggtacctcagttggaaatgcagaaatcacctgccttctgcattggtctcgctgggagctgcagactcgagctatcagaagtccgcagccctcaggcctggaccagtactgtccctggtgccaaaaaggttggagactgctgctttagatcattgggaatgagtacaatttgcaattgtgacaaattgaaaatacaaatgcagagttcagaaaagaggaaaagctgtaaaggaaaaacagtaaatcttcaaagaagcagtctgcttaaatttttaaaaatgactaaaaaggaaagtgagcaggcttttatcagtgtaccaaggctatattccatggtatgtcataatatttattcttttgcatacaccttcaatttccttgcctcttcttcctttatcgtgctcacctggcaaaacgctagttccagcgacagccaaatctctgctggctctgtgcctgcactcacgcaggggaatatggctgcagactatactttcctggtccattaactctcccatgcatctatttggtatcttcttatttctccttaacctctattacatcttgctgcaccttcactgtcagctgatgaccttgtcactgagaaaatgaaagcaatcagaaaagaactaccattggctttgttataaataaagtttcggtgctgcaaaagaaatagcacttgaatataaaattttctttttaattctcagcaaggcaagttacttctatagaagggtgcgcccttacagatggagcaatggtgagtgcaca

SEQ ID NO: 475746 - DNA, 667 bp, Homo sapiens
catgtacatatacacatgcacgcacatgcatacacgcatctctgccagctaccagcctacaaaacctggtcttcagtgctttcaatcatcctcaccaccaccaccatcactatcacaaccaccactatcatcaccaccaccatcaccattgccagcatcatcaccatcactaccaccactaccaccaccgtcactatcatcaccaccaccatcactatcacaactaccatcacattatcagtatcaccatcaccaccatcaccacaaccaccaccatctccatcactaccaccaccacctccactaccacctcttccaccactaccactactgccaccaccaccatcactatcatcaccaccatcaccacctccaccaccaccatcactaccagcactaaccaccaccatcacctcaccaccaccaccaacaccaccacaacaacaacaactatctgggtatttttattgtccagtggccccagattgggtcactgcttcagtcaaccccactggaaaatatcaagtcttagtgtggagtctgagggttgagagaatccggacatatacttagaaaagcatggacaatagagtttttatctaggctccattatttagaaacttacagaatacctgatccacaagcatggacaatttagtaactgact

SEQ ID NO: 475747 - DNA, 827 bp, Homo sapiens
gttatgcaataggaccttctgcaataatagaaaaatggtgccacactatgggatcccagagggcaaggacagcacttcatgtccttcacatgccccagagtgcctagtaaagtgctggatacatggatatgcacaaggaatagttgttgagttgaatttgtctgaattaaagagaggaatcaaaggcaaccccgctggtggcaaggctgcagaaaaccttgagaaaatgaaaaggagagttggtttggggaagggggagcagaaacaaaggatgaaatacacatttttctacagtggtattgtgagtgatgttcatgtgactgagcgtccagccagagtgggcatcctgctggactacaacaaccagagacttatcttcatcaacgcagagagcgagcagttgctcttcatcatcaggcacaggtttaatgagggtgtccaccctgcctttgccctggagaaacctggaaaatgtactttgcacctggggatagagcccccggattctccgcgggtgaaggggaccaagtgccagcagcatctgccgtcaggttggaagcagctctggaataaaggagaaaaccaccataatggaaagaaccaggttctagatagatggtgtttaaactgtgtttctgagtactggaattccatggaggtgcctgaaggtcaatgtgggatccaacaggaaggccaagtgggcatacattcaaacccctatctcatttcatcacactagctcaatttttatctatattacacattggattccatattataatttatttgataaaacaccttctatggtcaaataatgtttgaaaact

SEQ ID NO: 475748 - DNA, 700 bp, Homo sapiens
caatttcccttctcacaatttaaaaccatcatgcatcaacttcctgcttttattcactggaaaattttaggtccatcttcaagtggttctcgacttggaaatcagagggagagagctcttttgggctcttcatgtagaagctctcatagagtttgtttgctgctaaccacgttttcccagatagtaacaattgaaggcgattcttcctgtctgagccccctcagtcaattgcctggagttcttgacactgaggctcatcagccagggcctgttggaagtaagcagcacagacacagacctgcactcttctatcatctcctctggacccaggctgatagagcaggctccgtccagaacatcactatctcttgcaaggtgatggcagtaggcaaggggtggggggtgggcagtggagagctcagtgaaccacttattggctcttaaaacttctgtttgaagtgatacaaggttcttctgctcagattccattggtcaaacgtgggttagagggaaagggaaggggaggggagaggaggggaggggaagggaagggaagggaagggaagggagaaggaaggaaggagaagggaaggaaagaaggaaagaagggaaggaaggaaggaggaaagaaagaaagaaagagagagagaaagaaagaaagagaagaaaggagggagagagagagagaaagaaggaagga

SEQ ID NO: 475749 - DNA, 630 bp, Homo sapiens
acagtcacctggagacaagttgcagagctaaggaaaatgaggctaagccgtcgggtggttgcccaaattcctacagctgggattcaaccagtttattctcgttgccagatcctggaaatagtggcagctgctaagcttaagtggagtttgaccaaaaagctttatggtagagagagagaagtgggcagagctggagcaacacatggtttagaaagccctggtggtaaatttcctgatgtactggatttcattttgggaattagtgtagtgcaatggaaaaaatgtgaactctggagccagccagactgggttcaaattctggccttaccacttaccagctttatgaccctgagcaagttactctgccactttgcacctcagtttcctcatctgatatatggagatgatgataatggtacctacctcacaaagctattgtggatgaaatcagttaattcatgcagagtacttagaacagtgcctggaacatgcaaacattcaagaagtctcagatgcaacttttgtaccaagacaaagatctaatccataggaacaaataataaagaaaattgaggcaaatgtcagggtggttgtgatggtatttggggggtgggttggccttgactgaag

SEQ ID NO: 475750 - DNA, 471 bp, Homo sapiens
ggaacccattacccccattaggtgttctgcatggaagtaaaaaatggaaaatagctttggggcagctagtatgtccagggcccctgactgggccctagagatgcagcagggagtaggactgcggtcgcctctgccctcatgggacctagagtctgagcttggtgagcatagggcttgcctgctgaacaccaccacagtgatcctcaagcaaaacccacctggattgggaaaacaccaagacacgggcatgaggcaatcctctcatggtggaagccaatggcagtgcctagaagtccatattttgggggaaactgattggcacaagcatcaaccaaccagagtagattcagcattcactctttggttaatgggtggagaggagataggggaagtagttccaaagcataggagaattttactatttaagcagctagtaccattaaccatgcagataaacacaagttgaatgtt

SEQ ID NO: 475751 - DNA, 2409 bp, Homo sapiens
gcggcattcctcaacccacacacaatttagatagttcaatttgactatgatatgtctaggtgcagttttcattgggtccattatccgtgggggttcactgaactatttagatatgaaggtttatagtcttcattatatttgtgaagaatttgcctgtgatattttccagtattttttcttccccagtttttcccttctcttcttatgggattctaattataggtatgtagctcattgtactacaggtcaccgaagttttgtttatttttattttctgtacttttatttggatagctctcattgccccaccttcaagttcactcatcttttcttcagcagggttcaatctgctgttatacccatccagggcatttttcttttcagttattttatctttcagaattacaatgttcatctagctcttttttatagtttgttttattttttcttttgcagagattttccatctgcatactttacattcataatagctgtcttaacttagataactatttttctaatactatttatgaactgacttatgcttccaatcaccaattttagatgttagtgttcccacatattaattttttaaatatacaaatatctacctgcagactctctattctgttctatatgtatctgcctgcttatttttacactagtaccacaataaatttagtagcatgtttatttaatttcttctactgttttctttttacatttctatctgtatatattttataattgagtttgtactgtttatgtaattttttagccttcatttctttacaagaagtcgtatttttaaaaaaattaaattatttacaaacatgacttttagcaactgtataatattccattatatggatgttctatactttagccaattctttattaatgacccatttagtgaatttccaggtgtttttaactattagaagataatgctgctaggaattttcttgaacatacattttttgtttatcttcttaaaatattttaagagcttttaccatatgcattttgattgctttccataaagtctgcttaattttacaattttaccagctattatgagtatagttcaaggatttgagctgagaaattgaattaatttaaaaaaaatttaaacatctattatgtgactacaccagggttcatatgtaaaataaatgtgtgacaaacacagttcttgccattataaggcttttaaggcaataagagggttccagctaagccttttgtgtagatggacagagccttgtgaaaatctccataccaatatctgcattcttaagataacacaaatagaaaacaatgaccaaaacaataaataattttttaaagtttcattgcttctagaaattgtattttttattttacagcacaaaatattcacatgagaatatttttgccttcaaataagcattctatgtcttctgctattactaaatgtagtaatagtgtatttaaaaatccatgagataagttattgtcagtaagacattattagaatatacacattttaatatgcttattaaaatgcatttatatttttatgtttataaatatgtatatttttagaaaatatattcctatattaaaacatatagtacatattatattttattaatttcatctgaaatatttcaatatttaatgaagtaataaataatactgataaaccaatatttgaagttaatattcaagaagaattaaatatgttaataaatgcatattaatctgtacaaacataataaattatcaaatcaaatacatttacttctatcttgactttttaataatatggttatttgaagcattatttaggttgaatattattaaattaggttaagaaaattatattcaataactttttaaaaacaatttctggcaaaataaaatatataaataaaccttcctgttaaagctggttgtttagttatgctatgaattattctagtgagttcaaacagatttttaagtagcacttgagatataatttgcataacatacaattgactcatttgatgtgtgcagcacgttttttagtacattcacagaatagtgcaacccttaccacaattacattattaccagaatctagaatattttcatcaccccttcaccctcatatcctttagcagttactccctatagtctctctacccctcttgctcagccctaggcaacgactaatctactttttgtctctacagatttacctttatggatatttcaaataaattgagtcatataatatgtggtctttttggactggtttctttcacttgcatattttctagattcatctagatacattgacacatgtagcatgtgtcaatacttcatttctttttcttgctgaataatattccattgtaggatatataatcttttatttat

SEQ ID NO: 475752 - DNA, 542 bp, Homo sapiens
agaagaaaacctaagatattaagcagtgaaggttatttgtcagtctgaggctgacatgctgatgttctttctgctgctggcctgataaattcagaacatgggcaaggctgagcccgaggtagaggacagcaatgaccaaaactgtgaggagctgttgatggacaggagggtgaagatatcaagcttcagagctgtcagttccaaggtggaggactggctcaacaggaaggaagttgaaattgacatgaaagtcaccaatgagttacgtgaatggcaggactgcagtaggaggacgctgactcctgctctgaatcccagcaacttccttctcaggactggtcaccgagaagccgagtcaggcttgtttcacaaggcctcaaatggcagaactagaaaggtgcagggtccattggatttcctcaaagatcggagttgccttgggaaagagagcgttctcagtgcaaatgtccacatgtttttgtgcaacctcatgacgactcttgtagaggcattcgagcattaaatgttactgctttcagagc

SEQ ID NO: 475753 - DNA, 899 bp, Homo sapiens
aaccagtgccagcaggggctcctagttcattggtttgctgcagtatgctggaggtccactccagaccctatttgcctggatatcatcagcagaggctgcagaacagcaaagatagatgcctgctccttcctctggaagtttcttcccagaggagcactggcctgatgccagccagagctctcctgtgtgaagttctcaatggtaaggtctccgggtacgcattttccaactctcccctgtttttgggtttgtcgaccagtattattccaggtctggtgatcctcttcaactgccacaaattaatgcagatggtgagccactccctttaccttgggtacctgaccccccctactagtcctccttctgatgatgaggaggaatttgatctctccttgttttctccccaaaaggaggaacctggtgatgatcccctccctctgcctcctatcttggaacctgtatatattaactcttctactaagctgttgccccctctgccagaggaggacgtgtggcattcacctgaatggcttctttcttgttcctctcgtccttttggacttctcccctcttctaagcctactgtttcttttgatgctccgggaccccttctttcagaggtttggaatcctgcttccccccagtccacatcccagtgccctcactctccttctcttcctctgcccctgcacaatggatgtggtctggggtctggaaagctttctctagagtctcggaaagtttatcttaagtgggccctggtacgaggtgtatgtgtaagaatgcttttattatttgaccagactttaatgtcggagaaaacctgagtggggtattaatgggtttgtttgggcattccagcccttgcactcaggcactagtttctccagtactttaac

SEQ ID NO: 475754 - DNA, 1169 bp, Homo sapiens
ctatttgaggtgttctgccaaacgggctctaaaaataattatgatttaaaatgttttttttttccagtgaatatgaacgctttaaaactaagcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggaaaagcttttagttttttgtttcctaacattggggtgtggactattactcacaagctggctttttcagctacaacctgtgagtatagatagtactaattaccatgaagtatgaagggtagtgaagatatatgacaaggaaatgaggcagttggaagcctagacaaaaatgtattcagaaggaaatataacaatgaggtgtaagaagtgac

SEQ ID NO: 475755 - DNA, 1090 bp, Homo sapiens
ggagggccaggtgcactcagtgggtgtgagaagaagtgaagaccaagagagttctctgttgaggaacccagttgccatgttattaggactctcaagcagcctgcagaaacgtccacatggggaggcactgaggcgtcatgccaacaaccagtatcaatgctccagccatgggagtgggcccacgtggaagagcatccaagcctcggtcagacctttgaatgagggtagccaactggaagtggggatggagagcccggggacccctgcactgtgggccgtgcaggcctgggctctcaattcactgctgccggagggcctggacctgtggaaaagcaaagaggaaagcagtggtagtgggcaagcgcaggatctggagctgggcgggcagtgggaagtgtgtgaccgatgccagggctcgtccagtcgagtcctgtccagaccacagtacgaatgggttataattggagtttccatggacacagatgacttgatcacaacctccccgagagagctttccagtgtcggccccgatatcaggcaagaaacaagtgcccaccctaaatcaaagcgtctagcagctttgctggacttgatgaaggacaccgttgtccaggctcccacaatcaaagtcaatttactagtcaactatctgagaagtggacaagcagtctaccagatggcaggtggccacattgcgttttctggggccatgaaactgcctgaattgtctgaaggttgtttggaacctttccccacctaattccagaaattgttcctctcagcttcagcatgtggctgaactgggcctatcagacactgtctcctggccttggaatgtagaatgcagttttcctcagagctgttccccaagttcctagtggggcttcaagacatggtgataggtgtcctcaggccagcaacagccctcgtgctcttggctcccctgacgctgcatcctggaatcctttcctgttcccaggctcttcactgtcttcatggcactgtgttccaagggtttatttcagttgtctgaaacaggatggccactgattcatactgaactttctgttttactctagtgtggaatggt

SEQ ID NO: 475756 - DNA, 1135 bp, Homo sapiens
tattttgtagccgtgtgaccttgggttggcagagtacaaaggaacagtcctttctttctggagttctgagcactgtgtgctcctacatatgggaggaacagtggccttttcccatgggaagagacctggtgctagctagcaagtctgttgggttggtggggcccctcacaccctccatccctggccctttcagcggccacctggtcactggcagagacaaagaggagcaccacacaaaagatgtgcccacagttgccatggtggtttccaagccctccccctaccctccactcattcctcctaatcgccctgtgtttcgggcactgcggctgaggcttctacggaccagccatgggaaaaggctactctgcaacttctttagacgacacagtgggaataagagccacctcacaggaacagaaggaatgagggaggtgggctggcctgatcaggaacggagccagcagaagcagacattggaacctgggctccacttcatgggaagaacagaccttactaaggctggcctccatggagatcctgtccccatgctaggcacaaattgcatcagttgatgcttttcatggctttgctggggatgggagggaatatttcagtctggaatttgaagtctttgcacctccacatagaattcaggaatgcaaacatagtgggggtgagccatctgggacctggggaggaggcagcttccctggggatgggagcagcaggcagattgaaggagtctgggctcctgacactgtgtgcaatagccatggcgccagcctgcactgatggtgcccaagttgtggtgcaagagagaaatagacgtctctcttatttaggctactactattttggatctctattcatagcagccacatctagatcatcaattataattcttaatttgaaagttgaatgtatgcatttggagaataaggaacgtgcctaaacaaaccaccttctggttttggcaacccaaaacatgtttgaatttggaggcattccttagtgagtaggaagaatggaaggctttccaaagcccttccagtgtgcaatgagttttaactgacgccctgtaaagcccccctgggtgttcctcagatctctctcctcctctctgtgttggaat

SEQ ID NO: 475757 - DNA, 1402 bp, Homo sapiens
gctcacgctgggagctgtagaccggagctgttcctattcggccatcttggctcctcctggggccttgatcttaaggaggaggtggatgagcacccctgcgctatgggatggccatggctagtgagtggtcagagctgcccatgagtgaggagaggagggcatctcaaagggcaggacagggatagcccagggacatacagggcccaggacagatgagcttatcccaatcagacgccacttgcacccagtactgcccccagccggccctttcccagcttgctcaccttctcagaggctccagcctgatcaatcaccgctggccccaccatgactctggcacattttgcatctttatgtcagaccgtctgtatctacacctacaagactgtcatgattttcttatggatcatggactgctggaatgaagtcagtgcaggaaagaagcttgttcgatcgacagctggtagacatgaagcgtctcagaatgaggaacgcatcacaggctgtccctgtgtttctgtagaaactttacctacaaaaggaaaaatagagcacaaagccctggacagaactctctgtgggactctgcccatgtttctgagatatcgcctcaattgtcctggctgggctgtcgggtctgcccgttttacagatgggcaaactggagtgggaagtatccgggtggcttcctcaggcctgcagctggtggagcagctactgaaacaatcagaatatcctgttctttgctggattattcagcttggctttcaaactagccccgggtttagggttaattctctcaccttctctggctttgaagacccagacatggtgtgctgagaaatccaacaactcaatagttttccttctgcctttaactcagccatataaatgagataaagtgtgcaaaactcttactgtgtgcacagtaagtgggagccagcagtggaatacatgctacataaggcgccactttatttagctgtattttgtcagtccaagtgaagattttaattgcagaatagtgtcttgctagcaaaaatgaacctgcttagagtcaagtttttaaaattcaagtgaataaatgaaaaattgtaagaaagattgttaaagaagcattcattttaagaacatctcagatatgaaaaacttagaacttagatgtcagaatttcagtagcgatgaatcccatggcaaagcttccatctcatctgtactaattggttcataaattggacacgtgggcttccttttgtgtgtcttcaggaagttgaggcctgaggaactctgaagccaggagcttcctcagcccctctgctgctggatggaggtgctgccagtcaggggcccatcttcaggacactggcacagggacctcctcaggccgggccccttgtacagc

SEQ ID NO: 475758 - DNA, 707 bp, Homo sapiens
gcggggaagaatactgggaccgttatgtccaatccctggatgcgcaccccacatatctgcacatggctacatgtacatggctcttccgcaggcaaagcctcgctctgggtcattgagaaacccaaccatgaccccaggcgagggctgccgctcccctgtgtgttggtgtgtcagtacctggaagataaagtatataaggccatgtgtaagggctgtatctgcccatgggcaggcacttggctggacaagtacctctgtctgcagaaggtggagacagctgctgtactgggccagggaatcaaatatttgccgacagccaatttccatgtcagggagaacctgagtgttcttgacaacttcagcagccacagccacaacgagctgctggcctcctgcgggaagaagttctgcagccgagggagccggtgcgtgctcagcaggaagacaggggagcccgaatgccagtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggagcctgacggatggaaggcaggccagccctgaggtgagtgccttggggtgagcacgtcaccttcaccagaaccatggctccaggggggagtagaac

SEQ ID NO: 475759 - DNA, 497 bp, Homo sapiens
agcgagggctctgaggattgccagcacgctgacattgggatgacaggcacacttataccagatcttcagagggaaggcattcagaacagatggagagaaggcacagatgctgaactgaagggggagaccccccatgaccaccaaggacacttgaatttgaaaggaatgatgcttaaagaactggcagaagccaagaagttctttgaaactaatctgaacacagatgcaacatgccagaatttctgggacacaactaaggcagtattaagaaagaaatttataccactaactacccacaacaaaaagttagaaagaattcaaattgacaacataacatcacaagtaaaacaatgcgagaagcaagagcaaactaactccaaacctagcagaaggcaagaaataacaaaaatcaaagctaagctgaaggagattgaggtaaggaaaacatttaaaagatcagcaaatctaggagttgtttttttgaaaaaaatttagta

SEQ ID NO: 475760 - DNA, 1060 bp, Homo sapiens
attgtgagcagcctgagagaggcagggccttgccctgttcactttgtactcctgtcatgtggcaaagggtctatttattactcagagggaattcaataaatgatgtggtgagaaacttgctcaagaagtgggtaaacactttgatggcagaggccatgtcccgtttccttccactcacaaccaaggaaggtcacagaaaggtcccacttaaattactagttgagtccgctatattttgtatgaaatacatacataaaaagtatgaaaacagcctcttcttttgcataacctttgagaatttccccgatcaaatcctgcagctggacaacagtgatgccagtgcttgtgtctgtgaggccctgctcactcgcatcccttcagggcttcacagcatttcaaaggaaaggcattggataaaggagaaagcagcagaagtggaaaggacacagatttcaaacattctgtttcacattggctacagagttttgtttgtgcggggaaaggggtgagtctatgcataccaggtaccacccacctgtgtgctccagaaggcccgtgatatcctgcccagttgctgaaatctataaaatgtcaggccaggtagcagcagggtgaaaggctggaagcagccagcaaaggaaaggaaaaatgttacagaaaattataggttgtaaattccacccagtgcatttagctccatccttgctgagggtcagaggaatggaatctcaccagtcatatttcatgaggtctttcagcaagttcctgtactgtgtagagatctgaagggcaaaaattcaaaaagtcagcagggcacaaatggaccagagagggatgggcctgaagggttaaccatttgccctggttttaagaaacagatgtcctagcagaagggtctggggacctcccaacaccatgaatgagttgcgccaacactagagagtgtgacaatttcagttcaagcttggatgtttagaacattggagtttttgctttcccagatgggaatccttaaatgttgcaatttcttctttaaggcaaattagaggaatcgagctcc

SEQ ID NO: 475761 - DNA, 507 bp, Homo sapiens
tggtttatatctgtaatgcttaaggatgatttctgacaccagcgtctgcacacacagtcacccctcccaatatgtccacgaggctgtgtggacaccgaacacatccctgcacagaatcttcctttgaggaccaaaccattgcctgtgctgttcttgaagccagatccacccttagattctgcagcttcataggcctttcaggcttcagccagcacaagttgggtttctacaactcagaattgggactgatggtttgtactattactatccgcatcctttttcagacagtcagccacttcacattataccaagatagattaggcagggaactgagagatccagaaaacatctgctacacaaaatcaaaattaatggtaaacagaatgcagttcttgatagctgaagttcacccagatgcagagaactataaaggggctattggaggcagctgccaattagggaccgattccacgggttttcagaaagtgaggctctagtttcacactc

SEQ ID NO: 475762 - DNA, 668 bp, Homo sapiens
gtaaacagaatttcaataggtggtgaagtaactgccagccaaaatgttcaccgggaatgggcctgtgtcacaatctgtgaggggaaaagacggatcaggatgctccaaagctgttgcctatggcagtgagcagggatggactgccaggtccctcaagcacccacttctttctgaattggatgtctgttctggaccagccctaagccagttcatgctggatgctggcctccaaggagctccggtgtctttaactcaccagcctagatcaggatgcagtcatttgtcatttcttcaacagactcatcaaaatgaaaccaggaggcttttggctgcatctcacactgctcggagcctccctgccggctgcgctgggatggatggacccaggaaccagcagaggcccggatgtgggtgtgggggagtcacaggcagagaagaaggcaacctgtgtggatacagacaagaggttgataacacgacacagtcttatttcctggaagaatcaaaaccagcagagtttcctgagactctaaataagtgaaaaacctttttcaggaaccagatattaaaatgtttctgcatttcttcccagtagtagtacttcacacaaatactcattgacttaagatttttaaagtacttagaaagcgttaataagatttgattta

SEQ ID NO: 475763 - DNA, 1708 bp, Homo sapiens
aggactgcagaggcaacaggaatgtgtatggtcatcaaggtggctgtggtccgaggacacatgcccaccatcctggcagcagggtggcaggtgtatgtgctgagactggcctgcactcaggctgttctctgcactggccacctcaggcccctcgccctccccatcttcagttgttcagatcccaccattcttcaacattcagccaggatgacccctcctccccaaacccccactgattctgtggctcctcctccagtactgtggctcctcccctggttctgggctcctcccccggttctgtggctcctcctctggttctgtggctcctcctctggttctgtggctcccctcccgggttctgtggcccctgctccggttctgtggccccctcatcaggttctgtggcccctcgtccagttctgtggctcctcctctggttctgtgactcctcctctggttctgtggctcctcctctcgttctgtggctcctcccctggttctgtggctcctccttcggttcagtgtctcttcatccggttctgtgactcctcctctggttctgtggctcctcctccagttctgtggctcctcctctggttctgtgactcctcctctggttctgtggctcctcctcttgttctgtggctcctcctccagttctgtggctcctcctccagttctgtggctcctccttcagttcagtggctcttcatccggttctgtgtctcctcctctggttctgtggctcctcctccagttctgtgcctcctcctctggttctgtggctcctcccctggttctgtggctcctcctctggttctgtggctcctcccctggttctgtggctcctcctctggttctgtggctcctcccctggttctgtggctcctccttcggttcagtggctctttgtccggttctgtgtctcctcctccggttctgtggctcctcctccagttctgtgactcctcctctggttctgtggctcctcctccagttctgtggctcctcttctggttctgtggctcctcctctggttctgtgactcctcctctggttctgtggctcctcctctcgttctgtggctcctcccctggttctgtggctcctccttcggttcagtggctcttcgtccggttctgtggcccctcctctggttctgtggcccctcctctggttctgtggcccctcctccggttctgtggcccctcctctggttctgtgtctcctcctccagttctgtggcccctcctccggttctgtggctcctcatgaccttgctgttatcacagctctacagctggctcccaccatggtttagagaaaggcctcagctccacgaggcaaacaggcaagagcttttttttgtttttttcctctccctgaaaatcccataatttggggtcacttttggctctaaggatgatgttatcttcagccacataagacattcctgcttcctctttgccttccactatgattatccagtgtctgcagatcccagtggtcaaggcttaggagtagttttgcagtatatatatggatgtatttgtggcattttgcagatttctttctcaagaaggccaagaaccgtgttgatcacgtggttccaggaccttccagggcaggatacagcttcccaactcagtaatccctttccaactgaaaacttagaatgccacagcattcacagatttccacttagaga

SEQ ID NO: 475764 - DNA, 1086 bp, Homo sapiens
cctccttcaggaacgtgagacaggcaggcgccgaggacccctgactcagactctgttaatgcaaacatgttctctgagtctccaggtcccagacgccagggaaagtgtggagacacagggggacggcggcaggactgccgcatgtagctatccccaggacacgacctaagctgactcccctgctagggccctctgcccagcctgttctctgagatttgccccaaggctatggcgtgggggttgtttgctgccaggagaaaggcactgatgcccagcagctcatacagaccctgcgaggagaagacaagtgatggcaggaattgcagggagagaggtgactgtgatttcatcccagttggaaaagacaatgcagatgtccttagccagtggcaaggtgtcagtggtaccttgttgacattgccgccttgtgggcatgaggaggtctccatccccttcccaagcatgcagttcctctgcctccatcaaacctggagcacacacaaaccgtgcacagcgaagtgcttagcagagaaacaagcaatcacctttggaaaatctttgtgtgctattttggaagacttgaatgaattcctggagagggtcccccatgcagaaagattgacaagcgagctgatttatctcctcgttatacttcagttctttttggagtacgggtgcttgcctccaggttgaactcctcattctcaaatcctgtgtagacttttagcctggtagctctggcttgaatagccagctttagaatcagttggtaaaataaaggttgactttgctgctgctaaagttgaagaaagcagatgggcctgtgagcacatggagggcatctcaagggcccaggagctggcagcctttgggccctgggacctttaccttcagaggttaattgtgcagagaccagcaagagtccaggaccctgtgatggttcagccattctgagactgaggactggaaaatcggagtgtttattgcctccattttttatatcagcaaaactttaattacagctctcactaaacctactaccttctgccagcatttacaaggcaataaatttccccttctctcctt

SEQ ID NO: 475765 - DNA, 495 bp, Homo sapiens
ggggcaagcaagggtgaaacaaaatggcgaagattcgtcaaagatgttcagctgcacaaggatatgattggattcgtgaccgcaagttggcttgggacaacagatttccagggagttggaacgcgaagctgttccaagcacagttggcaaacatttttccaagaaataaaaacaccttaaaatgcaaaggatcaaattccgaccctttagttctctgtgaagttaggcaagcaaagccaccacggatggagcaattagagactaacagaacaggaaataatcaaagactcaatggtatattaagatccacaggaaagatgcaggtcacaagctctgacagatctgtagtgaaactggaccactcctcacctttgacccttccccactccatctgccactccccacaccctggatctttaaggaaccttccagtcctaaaagctagtgcattgtagataatgagggtagtctttcaaattatgtaagagggatgaa

SEQ ID NO: 475766 - DNA, 933 bp, Homo sapiens
aggccagaggccaacagtggcgcgtctggagtttgttccttctgatgttcgaatgtgttcggagtttcttccttctggtgggttcgtggtctcgctggctcgggagtgaagctgcagaccttcgcggtgagtgttacagctcttaaggcggcgcgtctggagttgttcgttcctcccggctcgtggtctcgctggcttcaggagtgaagctgcagaccttcgcggccccaccagacccaggagcccagctggcttcacccagtggatcccacacaggggctgcaggtggagctgcctgccagtcccacgccatgcgctcgcactcctcagcccttgggcggtcgatgggactgggagccctggagcagtgggccgcgctccttgagaggctcgggctgcatgggagcccatggaggcgggggaaggctcaggcatggcgggctgcagtcccgaggcctgccctgcgggaaggcagctaaggcccggcgagaaatcgactgggggacccagtacaccctccgcagccgctggcctgggtgctaagtccttcattgcccggggccggcagggccggcccgctgctccgagtgtggggcccgccaagcccacgcccacccggaactccagctggcccgcaagcaccccacgcagccccggttcccgctcgcgcctttccctccacacctccctgcaagctgagggagccggctctggccttggccagcccagaaaggggctcccacagtgcagcggtgggctgaagggctcctcaagtgccgccaaagtgggagcccaggcagaggaggtgccaagagtgagtgagggctgagaattaacatacactaaccaagttcacaagaaactaatatataaaccaaaatatcaacttattctatttctaggggtatgattgaaaccaactttgcaaagatt

SEQ ID NO: 475767 - DNA, 579 bp, Homo sapiens
ataaaaacaaccaagtcctgttatgttcaacaacatgaatggaactagagggtcttacctcgatgttgattcctggcaaatgatcagtgtgtttgttgctgaaggccgtggtggctttggcaattttttaccatcagacagtgaagttgctgcaccactgacaattccttttacaagaggttgccctccaaatatgtctagttataaagagaagattttggggccagttcttgtgggtctggagacagaaacattggataaagtcatcaagatcataaataacaacccatatggaaatgcaaccgacatcctcaccaccaatagagctacaacttggaaacattcccactcgtgtggtggaagtcagagaagtttgtggacaaactttcagaagattcttaaagccattcaccatctcttcagtggagatagtaaacaatgatcagcactgcattttatttaaagattgtccctctaatctttcacaatgctccatttctgactcagtaatgaaagatcaggggtggaaaattgggtagaagatttagcatatgacaaaataaactgattgattttcaa

SEQ ID NO: 475768 - DNA, 1387 bp, Homo sapiens
ctgccatcacctctctgcctctgcccagtttagtagcaaagcaggcttctctgcattgagtgagtctgaatgggacattagagggaggcagtgcaagctggagacagggcaccagcctggccaggactgaaacccagaccctttgctggcgggggtcactatgagcagggcctttccctctgggcatctccggagcagtggggctatgaataacctctgcgctgacccatgtccttgcctctctccatagactcgcctgcaggctggcgttggctacggaaacaccctcagctgcatccgcgtggtgtacaggagggagagtgatcccccttggccacagcctgacttctttccagcccaagatcactgcccctcccggcgcatgcatggcatgtgtgggttccaggccaggacacaacccacaggaaacaaagcggcctgcagaagccgggctgtcctcggagcaagaatgcctgcccctgagtggttccccaccccctacctcctgtcgcatcagcaccctcttcccctctcttcatggacacatgggcagatgtgtccggtggtgtaccccgtcagcctgcaggctctgcgacggcagcccggggtcctcacgcctcttccttctggttttcactgcagatgttcggcttcttcaagggcatgtccttccccctcgccagcattgccgtctacaactccgtggtgtttggggtcttcagtaacacgcagcggttcctcagccagcaccgctgcggggagccagaggccagtcctccccgcacgctgtcagacctgctcctggccagcatggtggccggcgtggtctctgtcgggctgggagggcccgtggacctcatcaagatccggttgcagatgcagacacaaccgtttcgggacggtaagaggccaggggagcggaggctggtgtctgggacttgtggccctttcctggtttgtgggatctgggacatggttgttaaaatccttttattgagcaaggcatctaccttgtcacctagtagtccgtaattacaggcatacctcggagacatgggtttggttccagaccactgcaataatgcaaatatcacaataaaagtcacatgaactttttggtttcccagtgcatttaaagttatgtttagactatactgtagtctaagtgtgcaatggcattatgttttaaataagtatatataccttaattaaaaaatactttagtactaaaaattattgacaattatctgagtattcagcgagtcgtaatctttctgccagaggagggtcttgcctcgatgttgatggctgctgactgatcagggttgttgttgctgaaggttgggtgggctgtggcaatttcttaaaataagacaacaatgaagtt

SEQ ID NO: 475769 - DNA, 733 bp, Homo sapiens
aaactggaatacacaggctggctccttcttctcatctagcccttgcaaacgaatattactaatgatgactgagcctcgtcatgaccagttcacagaactactacagtgagggcatttatcgaatgtcaccatcttctgttacctcatttgctccaaatcttcagccctaccatgatgaccctgtggagtctgtgaacacgattaaggcctgttggagcttctttcagtctctagacccatggagcagagttcattttaataagcagagaagttatatgctgaagatgagccctgaaggaggaaagggagtgaccctcacagataactgtggaaagagcattccaggtagtgggagcagtgagtatgaaggccccaagggtggattgggcctggaaggagatctggaattcactgtggacatgtatgaggtgactattaaaatcaacgaggagtccagtagacagctggatataaacatctgcagttcaagtgaacttgagtcatcatcttcttgctggtggaggatctcgtcttgatgttgacggccgctgactgatcagggtagtagttgttgaagattggggtgtctgtggtaatttcttaaaataagacaacagtgaagtttgcacacggattgactcttcctttcacaagagatttctctgtagcatttaatgttgtttggtagcattttacccacattagaacttctttcaaaattggaataaatact

SEQ ID NO: 475770 - DNA, 594 bp, Homo sapiens
ctcccggagctaggaaagagcagccttttctccggatttcccatccgcgctgagaacaaatgacatgctgatgtgttcaatcagtgtcatacgtggtagctttgagagtaagtgccagaatgtgtcagggaagctatgggatggtggaaggagttggggctgccgctgcctttctcctgatgaacaccaatggcggggccttctgcacccttgggctcagagcaggaagagaagcgtgtcttctgtgtctcccccttcctcaagccccacacacactcagggggcacttggtacagtccctgttcttcggagcacccaccccaaacctcccctgaaatcaaagatggctgcccgactaaggaggtgttttcagttattcagaacacctaacctcactgagaccagcagggttaaacaacctgattctatgtcagaacacccttctcagttattcagaacacctaacctcattggatcagcagggttaaacaaactgatactatgtcagaaaatctaattgagtcattgtttggcttaagtcatttctcatccatttatccactagacctcccacaatgaacactctagttctac

SEQ ID NO: 475771 - DNA, 1456 bp, Homo sapiens
ctcaggactcagttgcaggccatgaggagggggtcccgtgcagccagggggccccccgggaaagcacccgagttttgcatggcacagccctgtgttcctggttataggggcaggttccctggcacacagtgtgggagggcttcctcccaaatatctttagacacaggaagtggcatctctgtcctgggctccatgcctctggggaccctgtgctttggggtaacttccttgaaattttctaagccccttggatgcctgggaccagctggagccatcattgacagcgaggcagggtgccccaaacctagaccaggactcatatgggccctggctatactcgcccttgggcttctactgagtgtgaaggcccaagtgccagtcaatcctgttcattcatgttctgattatggggcaccagagggtggtggaggtggtggccggagtcctttatcctgtgtgcttcctgctgctgcagccagataggatgtcaaagagcaaagaccctagaaacaaatgcattcatcatttttgtcccatcacacagatgttaacttgcatttggattcaaattgacattttaggaaataactagattcacagtctgtggaaattgccatcataactctttaccatatagaaacaacatcaaatggaggaagaggaataaatttttttttcctgaaactctaacaaattcacattttagtctagagtttaaattatttcattcatgagggagcttctctctaacttctgttctttccaggctctgtcacaatcccatgctacttagtagacacaactcgagtaaggcaattagctcctttgatttaaaactggcaagaaacattttcctatttcattttctgcacttggataaatgtccagttcccaatccatcatcaccaacaacttaagattccaccatttagttcccgcttcaaggagactgtcctgaaccatgaaagcaaagctgccatgactcacacttcacataaaacatgtctggatgtttgggaaaacagccaaaagcacttaatataaccttacgataggagatataaggtagttgggaatacaataggaggattcgttttaagctttgaaatactttttatctgataatcttttaagtcttttttggattaaaaagcaatgcacattgacagctgacaggaaaagaatttcaatatctaagtgttcacatatgtgaaaaaaattgaatgtggactgaaagcacgcatttgaaataaatcatggctaatggacaaaagaggatcttttgcctggtaattattttccctagattaataagggaacaatttaatctgggtggttgtagtaaaagatttaaaagctaactacttattgttgtcagcctgtggttttgaaaatcagaaaagaacttgaaaaatggtttcctagaatctctaaggaataggggagagggggaagg

SEQ ID NO: 475772 - DNA, 669 bp, Homo sapiens
acagaagctagctggcctagagggatgtggggggatattctgagtctatttaaatccctaaatctgaaccttgtgaggatggctggagacacaccccatcttaattcaagagcctcaggcaggaaaccagtggatgatgaaaaatgcatgtatttggcagaagatgaaatggagaaagcactctcctcttcctgctcaaagggaactctaactagctgccttccgaagctgttgatgtatggtgtcctggattttgaaagcttccatttcaggaccaggcagagcagctgggcttttaaatgggagacttatgtgatctccccagagtccaggggtgggaagctggaggacaggggccattttccgagaaagcagaagggaccacttctgcccccaatcccgaggtccagctctcttgttccttccacattcaactgtaattgagcatgctgtcttcagagggccagggctccagctcagagaggcacagccattctgggttctgctttttaagggagcttatttggatttcttgcccagaccaaagacccctgaaaagggtacctggtgaccttgtgggggagggatcctggcacctgactcctggagggggggccaatgaagagacagtgaataaatggacaaattagagatgatttaccaaatggc

SEQ ID NO: 475773 - DNA, 620 bp, Homo sapiens
gcacactgctcaaagttgctcattccctccaagtcatgttctcatgaggtgtgtctgcccctggagccagcacaaagcaccagagctccacctgcatcagctgccaaatgtcaatgagggcaccgaggagaaagatggtccaggtggaccacctcctccacacctatccctttcaccaacaaatcattccccacctccaaactcaattgcaactccttctgaagctttttctggattttccaacctcaggaaccactcccttgttcagatcattcagcactttcggtcaattccaaactgtctcacaaaggagcttgcagtattttacccagtttgtggagttccatttgaggattgctgggggttgtggaccatccagagatctttccatggtaaagatcaagcatcgtgggttgccatgatctattgtcaggtggcagctgaggtcattgatttgtaatttttctttttttctaatatagtgttttagtgatataaatagcattaaatttatttagcagcatctcacaaattataacacattatgttttcatttaattcatttcaaatactttctaatttctcttttggtctttgcctaattcatgtgttatttagaa

SEQ ID NO: 475774 - DNA, 1534 bp, Homo sapiens
agaaaaccagaaaggcgcattaagcatgaatgctaaacagctatttctcatcagctttaaattaaaagcatgttctgggcagtccttggccttcgacagcctgcgttcatatcaagttctggtttacaagcagctgctgtgtgattctgggtataacagttatcttaatcttcctgcagacttctatagccccagactaggaaaaacagaagatcctgactttgagtctcctaaagaggctgaacagctgcagaagctctccatcaaagagttgggctttgaaacaaccgatgaatgtatgaggagccattttgagcaatggggaacgctcacggactgtgcggtagtgagggatccaaacaccaagcactccaggggctttgggtttgacacatatgccactgcggaagaggagtggatgcagccatgcatgcaaggcacacaagaaataccatcctgtgggaatggctacaactttgaagtaagaaaagccctgtcaaagcaagagatggctagtgctttatccagccaaagaggtcaaagtggatctggaaactttggtggtggtcgtggaggtggttttggcaggaatgacaactttggtcatggagggaacttcagtggtcatggtggctttggtggcagccctggtggtggtggatatggtggcagtggggatggctataatggatatggtaatgatgcaagcaattttggaggtggtggaagctacaatgattttggcaattacaacaatcagtcttcaaattttggacgcataaagagaggaaactttggaggaagaaggtctggcccctgtggtggtagatgccaatactttgccaaagtacaaaaccaaggtggctatgccagttccagtagcagcagtagctatggcagtgtccgaggattttcattactgccaggaaacagcttagcaggagaggagagtcagagaagtgacaggaaagctacaggttacaacagatttgtgaactcagccaagcacagtggtggcagggcctagctgctacaaataagacatgctttagacaaatactcatatgtatgggcaaaaaactcaagaattgtatttgtgactaattggataaccagtgattttagtttctgttctgtggaaagtataaagcattccaacaaagggttttaatgtagttttttttgtttttgcacccatgctattgattgctaaatgtaatagtctgacatgatgctgaataaatgtgtcttttaaaaaaatgttctgtgtaaagttagtctactctgaagccaccttggtaaacttccccaacagtgtgaagttagattccttcagggtgatgacagattctatttggaatttatttacaatcttctgggtagaaaagccattgtcttcagaaaccttggtgtagttgacctgatggttactgttgtgacctgaagtttgccattaagagggaaatcatgaattatttgttataaagatgattgttagcacatcctatggaatacatctaaattgattaatggt

SEQ ID NO: 475775 - DNA, 510 bp, Homo sapiens
aaaggacacatccgaattctctgatgtatggggcctgacgtcacacacccgcatccacattttccttccatggtgccgcatccttcatccattttgaacttattccagaaccaagctctgctcttctctgctcctttgcctctgcctatcttttcttcattaccaccacttaggatttcttcttctagcatatctgattttcccttcaccgctctggttggcacctccccgtgcaagtccccttattggcagacttgcagggaggtgtggagggagaggcgtgagagggaactggggctgcgcatggcacttgagggccagttggagttccgggtgggtgtgggcttggtgggccccacactcggagcagccggcgggccctaccagccccgggcaatgaggggcttagcacccgggccagcggctgcagagggtgtactgggtcccacagcagtgccagcccaccagcactgccctcgatttctcactgggccttagctgccttcccat

SEQ ID NO: 475776 - DNA, 554 bp, Homo sapiens
tccctgacttacctgaaaaagaattcaggaggaaacttttgacatgcttttagaaattttagatgctctggaaagtctcagcaatagaattgaacaagtagaagaaagaaattcagagctcgaggacaaggtctttgaattaacccaattcaacaaagacaaagaaaaaagaataagaaaatataaacaaagcctccaagaagtcttggattatgttaaacgaccaaacctaagaataactggtattcctgaggaagaagagaattctaaaagcttggaaaacatatttgggggaataattgaggaaaacttccacagccttgctagagacctaaacatccaaatacaagaagaacaaataacacccgggaaattcattgcaaaaagatctttgcctgggcatgttgtttgcaggctatccaaagttaagacaaaggaaagaattttaagacctgtgaggcaaaaacaccaggtaacctataaaggaaaatctatcagattaacagcagatttctcagcagaaactctagaagctagaagggattgatgcccta

SEQ ID NO: 475777 - DNA, 912 bp, Homo sapiens
ttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcagcgggcttgtaatgggttaagtgataacagatgtctggaaatataggggcaaatccaggaaataagaaagcctgtggcttttgcagactgtgaaaataaatgaacagtttctttaaaaagcaaaagaattcat

SEQ ID NO: 475778 - DNA, 597 bp, Homo sapiens
gagttaatgggtgcagcacaccaagatggcacatgtatacataggtattaaggacaacagactgggaattatcaagataaaaatgacatacccagaaaatactgaattctccagtcctcaaaaatctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgagtcctgttggctgcatggattcaatatccacgcctgaacttatcattgtggctaggagagcagataacattgattatccaggtcatatgcccatggctagagcaaaagcagggaagatgagatactaaattttaaaaaatttaaagtttgtatttaatgtgattgctttctgtcctccaaatcttccaaaatatagctggaagaccaaatctagtataggcggggaggttacctaagcattttgctgaggcttgtgaaaaccagctatggttagtctaactacaaatgcatt

SEQ ID NO: 475779 - DNA, 515 bp, Homo sapiens
ggagtagtaaatggatttagcatgctgaactcttggacactgaactgtaacaagaaaattgaacatattttgttttgtgcatataaaagaagtactattgaagatgagcattcatttatttacttaacaaatatgtataaaagaatggagattatttctggtatgttcaccatttttgccctcggcaccttgcacagaatagatgttcaaaaatacaaccaaccaatcaaccaaacaaacaaagatgaacaagagcagtttggattctttgccaatagagtgataagaacaggaaaatgtgactggattaacactggcaaaatcaacaatgaaaatccggtggagtcactaccatctgatgctggttcagacatggaaccaaacaccagggcgtttgggtctttacttagaggatgagcaaagcttttgttttcatcacctttttggtcttaatatcacagtgtcatatatttctgtatatttttgcagaaatctttgaaaatgtttttccttga

SEQ ID NO: 475780 - DNA, 890 bp, Homo sapiens
gtgttggtgtcatttgctgagcgtagaaacttgacagtcatatctctggaccctgcaactctggccccagctggtgtcatgacatgcaaccctctaggtcgacattggagcatattaacgtggagatgcaaaggctgttgtgccccaagacaggatgtagtctggtgggagttgtgctctcaaaatggtgctatgatgcagctgcttgggtctcagagtgtgtgtgacatccagtatgaactacttgtctggaaaaatattatcatatggactccagatgtcatttggatggaaaatgaggttggcagcagaggaaactgtgtgcgcaacaatgtggtgacaatgtggcacacatgtgggagtgcagaaggtccaacagaggctcggggaccagagccctgccatgaggaagctttgtctcaggctaatgaggtgggattttattttgaaggattggtgatgtcaaaaagaagagtcggttgtacagaacctaggagcttggagaaggtatcgtgtagggaaagtgcttgaacctagagggagagggtttgtggtgaaagtatcatgagtttcacataaagaactctgaggagggggtgtaaatagctgtaattctaactgccaaaagcaaagaaactccaaagagtctggatggtggagctggagttggctgttctcttttgatgagggacactgtcagacactaaacgctgaaagagaaacttttgttcccttcccctcacctccagtttacctctctgcattccattggcagaaattaacagtaagctgattaaaaaagatgtctacaaaatacagttcacagaattctagagcaagcaactctatgaaatgtttagacgagcagactcagagctaaaatctgatgg

SEQ ID NO: 475781 - DNA, 577 bp, Homo sapiens
tttcatcttctgccatgattgtgaggcctcaccagccacctgaagctctggagttccgggtgggcgtgggcttggcgggccccgcactcggagcagccggccagccctgctggccccaggcaatgggggacttagcacccgggccagtggctgcggagggtgtactgagtccccccagcagtgcccgcccaccggcgctgtgctcgattcctcgccgggccttagctgccttcctgcggggcagggctcgggacctgcagcctgccatgcctgagcctcccacccactccatgggctcctgtgtggcgcgagcctctccgacgagcaccaccccctactccacggcgcccagtcccatcgaccacccaagggctgaggaatgcgagtgcacggcgcaggactggcaggcagctccacctgcagcccaggtgcgggatccacttggtgaagccagctgggctcctgagtctggtggggacgtggagagtctttatgtctagctcagggattgtaaatacaccaatcagcaccctgtgtttagctcaaggtttgtgagtgcaccaatggacactctgta

SEQ ID NO: 475782 - DNA, 733 bp, Homo sapiens
tgctgtgcatggatgtgcttccacctgaactttaggccatgtgtttcaatccctgtacctgaacaatggaacaacttcagcccagaaatgaacaccacttccattttagtaggacctcttgtttccaatctggaaataacccatatctcaaacctcacctgtgtaaaatttagcaatactatagacaaaacaaactcccaaggcatcaggcctgttggaactgccatcaacaaaccaagtgtgatgagggtgaggaacaggaaagaaggaaatatgggaaaatggagtgaatgtcaggtggatcaaagagatacagtcatgggggccaggtgtggtatcaggaataatgtgggaggccagactgaagtctgggccaggaacaatgataattgtgggagacccaacgaagaccttgtggcagtacagcccaggtaagttgctgagactgatgggtgtcagggtcagtccaagtgaaagtgaagagaggctgggatgaaggtgtaaaggaatagtaaagaaagcgtctttgagatccagaacagaataatggcttgtggagggaggaattgaggataggagagtatatgggtttggcaccacagagtggataggcaagacaattttgttgataaggtgcagatcctgaactaacctgtaggacttgtccagtttttggacaggtaaaatgggggaattgtaaggagagtttataggctttagaagcccatgctgt

SEQ ID NO: 475783 - DNA, 859 bp, Homo sapiens
gcaccgtggcatcatcagctgcttggctccccgcttatgcactgtgtatgtctctccctttcacatggctggggaggcctcacaatcatggtggaaggcaagaaggagcaagtcacatcttatgcagacatcagcaggcaaaaaaagagcttgtgcaaggaaagtcccattttaaaaccatcagatcttgggagactcattcagtattataagaacagtgcaggaaagacccacccccattattcaatcacctccaacggagttcctcccaagacatgtgggaattgtggaagttacaattcaagaagaactgtgggatacatagaaaactggaaaatcttcgtagcaaatggtgaagtcttagcacaacttgcctctatccaagattttactagtatctccatatattttactggtacctccaaacattttactggtaccttcaaagattttacaggcactaaaaaccatctattaatacttgaatcttatctataatctatacctctgaaaacattgtttaaatattattaaataaagtgttataatgtaaactgttctactttattagaggattttaaaatttaaatttcttttctgttacttttattgctctatgaagaaaattcattaaagctctttatccttttatgaagtcttctgccatttcctacaactcttttaacatagtactttctggtgcttctcaaattactttctgatgtattcaagttatttattattttattttggtttttatttattttgtaaagcacgtatttgatgattaattcttatatgtctgtttatttataaatattttacatggcttctcatttctgacttttaaattaataaa

SEQ ID NO: 475784 - DNA, 3256 bp, Homo sapiens
gtgttggcttcagactttcggcattatgtctgcactgaataaaagcaagcagctccagctgttccagacaactcactcttgggccactagtgccgggaagtcccctagctgctcttacattgcatacctgtgtctgagtattcctttcatccagcagaagagcagaagaatggcagaatggtgtggcagagagaaggaatgtctgaacattgagaggaatttggctggggacagtcagagtgaaaatcagctgctggatggccacattccaggacaagagctccagatacagaaagctgttgcactggccctttgcccttgtgaaaaggtagagggtccactgagctgtctaacacttaagccatctgtggatggcaaggctaaaagaacacactgtaacacacgtccacttgcactttgggagtctcagacacccactctggacgccactgtgtggccagagcccaggggcacttgccccagctcctgcacctgcccatccgtggactccccatcccataaggcatttgagcatgcctagcggctgaaaaagatgaactgcaccctgtcacatgtcctgcgagtggggccagggaactctcacacttcaataatacttgaaatgcatttacaaagtaagacaatttatatgtgtattaatatctgcataataaagatctcaaaattaacagatttatacctttgataggtaaataatagtaagattttgaataaatatagcactaagcagtggagcagtgtttcaaagccttgtgctgcaatatttgatgtgattttgaaccccagttctacttagcataattaataagctttttataaaggaatgttctcattaaaggtatatatcaatgttttaaaataagcacatataatgctatcttttgagtttagctttttaatgtcatgttccaagtgtttttaggaactgcttttgtgcccatgctacatgctaatgatttacctggagatgtcctttaagcaagacaatggtgaatactccttagtgattacttgttatcttcaaggctctttgaagttaggctttctctatattataaacctctgctcatctatgagaacgctatgagccttgtaattctttatctgctctttgacatgacctaattgtctgccttcctatcgtctcttgctaagctacggatagaaactcttttaactcttgctctgagtgtgtttttttgttgttgtttctcctggtgcccatgacctgtacatggatctaatatgaatcagtgatctcatctaaagaggctttggaaatctggttctttactatgacatacctaatttcccaagatttgaagtccccaagatgcataacagatcccagtaaactcaagcattatcagtcactgttattagcaaagcagttgtggaccacaaatcattttatattttaggcatatggtagttattaaaaaattgaaagcaatgaaagtgatagaatgattaaatacatactttagattataaaagaacagaatttccagcatgactatttgaagacttcaaactagatgtttcaaaaaaaaatcatggtattttcaattttcgtatgtgcttttgtgtagagttgtattccaataataatggaaactgtgacttggtaaatatgtaaatcagttcttgctaagtattggcagtagtttttagctaactttctttgctgtgaacttgctgatcttgctgattatatgtggtgcttatctgttcagagaaggtagatataaaatgttgagaacagaaagcattttcaggatggtttttactttacataacagggaatctaggcatgtgtcttagatacagggtcacaatgcatcttacttttcccttgctaatacaattgagagagagctaaaagcctttaatggcctttagaagagcagagatgcttcattaatgcagcattgaaggtaaaaagtttaaggatacacagtttttgaactgtcatagccaaatacttttctttgttcatcagaaaagcagatgcaagttgccaagttgacatcagggaaaggtgtttctctggggatgccatgatttcatatctcctggcttacatattaagagatagaaatgttttctttttgaaatgtctttgtggtttaaactcaagtgacatcgactgcaaatagcctgaggcaaagttagctttgattgttcctttgctttgaatgatctagtcactttagaaaagataaatcatatcaaggggaaaatgcttagaaatgaaatatggaaggaaaagtattttaaacaacacagatttgtttgctgaaataatgattaacctatcaaatttcctgaaacaaagatttaattttgacttctaaattttatattatatttaaacacattatttctagtattatattattattgttaactctaacattgcagaatataaactcatttccttttgtctcttcatttctgaaggatcgtgcggctgcacacgctttgggtccatgcatttctctaatcgagctgtaacacttgctgctgcggtccatggctccattccttgaagcccacgagaccaggaacccttggattgagaaaaaaccttcaattgggaggatacttcttatctcatttctaggggcccatccgggatttctccacagcactcaagctgagctttcactctctgtccaccactgctgtttgccactgccgcagacacgcgctgacttccatcccttcggatccggcagggtgtcctctgtgctcctgatccagtgaggtgcccattgctgctcccgatccgactaaaggcttgccattgttcctgcatggctaagtgcccaggttcgttctaatcgagctgaacactagtcactgggttccacggttctcttccatgacccacggcttctaatagagctaacagagctgtaacactcaccgcatggcccaagattccattcctttgaatccgtgaggccaggaaccccaggtcagctaccaccaggctagccaccatcttggaaacagcttgcggccattttggaagcgtcccattaccgtcttggtagctctgggagcaaggacccccagtaacatgaggactcacacagactagtaaggcaactttccataaggaatgacattgcatttttctgaataatgtggactggcagatgttgtgtgtaagtgtttgctgaatcatctgattgaggcatttcttcttaatcataggtgaggggag

SEQ ID NO: 475785 - DNA, 1058 bp, Homo sapiens
tttcagaaacaaaatccaggtacctaagagcacggtgagtatgaggaagcagatggtattaaagtttatgagctatcagaggataaatggggcaaggagcactgtcccaaagaggccgtttattaaggtgagggaagatacagatttgtctgaaattattcatcctcatggcccaagtgagagtacatggagaacttttgtccagcgtggagcagatgggcgaggtggcctagggagcggcccgcatccgtggggagacgctgggcctcaacggctttggttgcacggggcaggcattgcagttcgagccaaagcctttggattcagcgtcatattttatgacccctacttgcaggatgtggtcgagcggtccctgggcgtgcagagggtctacaccctgcaggatttgctgtatcagagcgactgcgtccccttgcactgcaatgtcaacgaacataacaaccacctcatcaatgactttaccataaagcagatgaggcagggagcattccttgtgaacgcagcccgtggtggcctggtggacgagaaagccttagcacaagccctcaaggagggcacgatacgaggggcagccctcgacatgcatgagtcggagcccttcagctttgctcagggtccgttgaaaaatgccccgaatctcatctgcactcctcacactgcctggtacagcgagcaggcgtcactggagatgagggaggcagctgccacagagatccgccgagccatcacaggttgcatcccagaaagcttaagaaattgtgtgaacaaggaattctttgtcacatcagcgccttggtcagtaatagaccagcaagcaattcatcctgagctcaatggtgccacatacagatatccgccaggcgtcgtgggtgtggctccaggaggactttctgccgccatggaagggatcatccctggaggcatcccagtgactcacaacctcccgacagtggcacatccttcccaagcgccctctcccaaccagcccacaaaacacgtggacaatcgagagcaccccaacgagcaatagcagagaa

SEQ ID NO: 475786 - DNA, 749 bp, Homo sapiens
agacttatcacatagaataatcataagcattcaataagaaaatgtataagcgccatgaccctcagcattatgggccacctggagtgggctcgtggatgtcagacagccacaggcatctactgggatctgctctttgtccaggctggaggagaagatcctgcaggtgtgagtatagcagaggcattccccctttcctgggaaggtggaggaggtccctctataggtcctgggcattcctactgggagctccaaggctgtaaaagaattcttaattccaatggaggcatagacaaagagactaagggactcctaaagaagcctcttctgtttgaggaaaaaaacccagtggccaccagaacctgggagggaatggacccttgtgagaagagagctgcacttggtacaatctgtgttcatggggctttctgtgtgagggtgccctccattcactgtggcacggagctgctggaggtcacagctgagagctgtgttacaactgggtttcagaattggaggaggcagttaagaactgctagaacaactggaaagggagggaagacatttcagaaaggacggaaccacagaagggggagcactaaaatcattgtaaactctacccaagttattggcggccctctgaactcacatgaatgggtgagactccaaggtttccagcaaaaagcaacaggaaaagtctggaagaactgagcagtttcagctgtgactcattgcaggggagacagtttgga

SEQ ID NO: 475787 - DNA, 686 bp, Homo sapiens
gcgggctccccttgcgtgacttggtgatatttgagaaaggcatgcatattgcctttctgtgcttttgtttcctcagcttctgacttagtctgttcaggccacgtcccctgcaaactagagtgtgacctttcaaaggccgagtgagagccagaggccatgaatcatgatcactggctgtgcgggggacctccagggtcctggtttcatgggcacatggcatggccctatgagctcaccttcagagggaaagatgtttacttatttaacaaaggaaaggttctctggaccatccgtcttgtccacatgacatcagcatctttctgtcagtgctggggaggagaaattgtgttacaacaattacagagttgcgtcagtgcctgttgggtaacaggcagggtagctcaggactccttgaccccgcagcctttgggagtgtgggttctgtggagagccttcagtcaatctcagaggactgttctacccatgtggtgggccctgctgttagcagtggctgttgctcagagaggggatgcccactcttctccatggaagccttgttggtgattgtacaggaaaactgtggctcaggaatgtgggtccatttgtggtaggcttgcctactctggttacctcttaccgtggggaaaatgtcacttccaaaattgcaaatttcaaaggagaattat

SEQ ID NO: 475788 - DNA, 1009 bp, Homo sapiens
gattcttcagttacttcaggccatctggatgtatacctacgccaaagatttagtgtgacggcagcccgtgatggaagaagtagaaggcagaggcaactactacagtgggaggagcgtggcctttgggtccaggagagctgatggtgtaagttccagtccaggtctggagacctacagcctcaagagccaggaagagccagtgtttcatttggagccccacggcaggaaaataatgatgccccagctcaaggcagcaggtgggcagcagcaggtggacggcggcaggctcagggaagacatcaccccatccttaggggtaaatagcttcatccagtccaggactgcaatggaggagagcacaattctcatgcctattactgaggtgctttccacagttctgtctgtggagtccttactctattccaaagcaggcactccaatctctggcccaagattaaaatgcctgcatgaccatggtgctaggtctccaaagaatggctgatttcttatttagtgattttccccatccccctcaagttggaacactttgaattattgccacacagacgccaacatttcaggggtaagattgtgtgattaaaatgaaattaacagtgtcaacagtgatgcacaatggaaggattactagcattttctggttcaagattgtattttgctttactgcaggattcaaattaactcataaatattggatggtgtataacaaatatcccttttaaataaaaaaaaacagggattcttcattagtgccaaacaaatgagatttatgtaagtgcttgggaacatctaacattgaagctttattcagtgctgtgactaactcacagtagatcatcagcatagctgtgaggctgcttcctgagctctcagtctttctaaaataattcagatggaatcttagcagaacactaagctggggtatgaaaaggataggtggacaaaagtctatttgcacaagatggtgaggatccatgggaaagtattcatt

SEQ ID NO: 475789 - DNA, 546 bp, Homo sapiens
agtgtgttagtgagagcactgctttttctgtatcccatgggttttggtaaagtttcgttggagattgggactcccagtaggctgattttcagattccagtggtggcagtggtgggctaagcatcactgtccttggaccccagggtggcatacgctggcactggtgttagcaggtccaggcagactgattcttgggtctccatgtggcttacttcctggtagtggcagtggtggactgggtgggtgggcagataggtccctgggctgccagaatgacttgggctacagcagtggcagtggcaggatgaccctctgggtcctgagtagtgtgtgctggtgttggccgtggctgcaaagggctgggcagaccagtccccagtactccaggtggcatgtgcaggtgacagctgtggttgtagtggcagagggagcagaccccacctcaagcccccaggaaagagtgttcaggtaccaatggtggtggactgggctggacaaccctctggctcctgtactgtgtgctctgccatggggtgggggataaagt

SEQ ID NO: 475790 - DNA, 620 bp, Homo sapiens
aatatgaagaactgaattgaaagaggatttactatgggaattgattatgaagttgaggccacagcctgccatctgcaagctgcagaaccaggaaaacagggatgtctgaagttggatgctatttctacaacagagacacagttttctagagaccagaccaggaggaaaccaggtccagtgagaggaagggagaagaatgtttcaagtactgaaaaaggaagaggaggaggaaaaggaggagaagaagggaagaaggaagaggagaaggacaaagagccaaggacatgtgtaaacgccctcaggttttgggcttatgaaactggatggatggggatcctaatccctgagacagaggacattggaaagggactaaatccatattttggagaggatgagatcaagatgcttatgggaaggacctggttccaaagaaagattgatgggagaaagacaaggacaatctatagtccatgtgaagtccctgagaaaaactaagtgggcatgagaaaaggagaaaaggagaaaaaatgaggacaggtgtaaataggtctgtagatttagcatttggaaatggagggcatttcccacatgatgacttcacttttctctgagtcacaagt

SEQ ID NO: 475791 - DNA, 636 bp, Homo sapiens
cagcaattgagaaactgcttgtcaaccatctgaaactggtgatcagcagcttaccaataagatctcaggagttgggcaaatgggcccaagcatgcgcattaagaggcaaaatggtggaaaatgctgcttgaacccaactgcttatctttgttatattaaggcaaataagggaagggtgttgtttctggacttggactcagagaagaacaacaggagaagacccgaaggctgtagatgtgggtccaagtggcccagttcaatcgaccgagcacctgccctgcttgctgtagatgcaggaggacagctacatatccttgccctcttgaactcaggcggtggtatgtcacttgctcgggccaatgaaatgtggggcagaagctctaaaagtcagttcctgctttgtgatactcagttttcccagagtgcagacagtgtgggcagcactgcaacttctcatggtggacatatcattttatgctcttagacaaatcaaattacgtagagccaagatcattttcatgagaatactgtctgattggatttgggtagcaagaacagagcatggaaacataatttaggagagacaagatttttctgttcactagaattgttggaaattgagaagatgggtttgca

SEQ ID NO: 475792 - DNA, 842 bp, Homo sapiens
cctgaaaaccatgaatggcttgggaccattgaacataagaactggcactatcccagggacaggtgatcaaggcagaagacctctggtttatgattagtggcaagactggtatcattagtgacactagaatatatgacacagggaccacatttcctgagcaaaacagtacctcatatggcctgatgaaggctttgagtgcatatggcagagatggaaaatggagatgtgaaaatgaggtcacatccaagtggtcaagcccctcttctgcagctctgctggagtttgctggaggtccactccagaccctgtttgtctgggtatcaccagtggaggctgcagaacagcaaagattgctgcctgctccttcctctgcaagcttcatcccagaggggcacccactagatgccagccggaccactcctgaggcagtaagtcccttagcagagctcgagcactgtgctgggagatctgctgctctcttcagagctgtcaggcagaaacgtttaagtccgctgaagctgcacccacagctgcccctttccccagatgctctatcccagggagacgggagttttatctataagcccctgactggcactgctgcctttctttcagagatgccttgcccagacaggaggaatctagagaggcagtctggctacagcggatgagttgttggggtgactttgtctgtttttagtgggttattttatatcacagaagtacagttgtaaaataaaaaacagcatgctgcagtaacagattgattgtggtaaaggaaggattgaaatgagtcaaatagaattccagtgtttctttaatgggaattggatgatactgtc

SEQ ID NO: 475793 - DNA, 815 bp, Homo sapiens
gaggcgaggatttcgccatatgcctctggtggcactgggccgtctgggctatggtttaagatcatttggcaacgttcattcctacaatcagagaacagcttctggtgctgcagataggggacatcagagaggcaacttgactttggaggaagaggcagagaggcaacttggcttcaggggagagaaacctacccttcccacaagaatttgggacccaccaagtgtggatacccaaaaaggctatcacactggcttgtttcccttgctggcgggaggtagccacccccctcgccgaggcaaaggggccactgagctgatagcacactgctgtccatggttggttgagctaagagaacactgtaacatgccctctggagccttggggtcacaggcacccctacctggacactgccacggggcctgcacagagtttgtttctgctggcaccaaagtggccagcaggttcctgcagtcactcacttgcatgttccctcctgcgaggggctgagcatgattggctgaatattacagctctttccttgtcattagtataaactggattcattctttttaacggttacagagcatttcattgtatgagaaaacctaaatatattgatctcatttcagtcaatcaatacttaggcagtttccagtcttttgtgattgcaaacatgctgcaatggaagttgttgcagagatatttttgtgcacatatgccagtctacctgtaagatattccacttgaagtggaatggctgcgtcatatggtttgcatattttggactttgatagatgctaccaagttgtcttcc

SEQ ID NO: 475794 - DNA, 476 bp, Homo sapiens
atacgttgaggggcagtcaacgaatgtcaaatctgattgtgatttggctaaattggatccaagactgttatgagccttttagcactgtgtgtggaatttctgcaggtttaaatctttcagaactattcaatcacatcacattcagcattctaggacaaaagcagcaaaatgatcaagcaagtatacctcagaattcgtgctatctttacaatctgccaaaatctttaagcaacactagcaaacatgtgaactcttcaataacccttgcatttcagagtggattaattgatgctgatgtcttggaaaagcaggcactgaaaaactgtgctcaagcaatagaggaacatggaaccatgaataggggcagtaagcccaaggtcttaaaaatgatctccagggaaacctcaggaaatctgaatcatcaacttccactagtccatacggaagagactgagacacagaaaaagtaaatgaat

SEQ ID NO: 475795 - DNA, 623 bp, Homo sapiens
tgcagataggctgcaaaattatacgtttctctctaagtttgcatggcctggtttattattttatttgaaggagtggagtggatggagggtagagaggttgcttatagtcagatcccgagttcggccagatatctactcgaaagccactcagattgtaaatatctgagtggaatgactggatcatatgggagtttcaaaaggagagggagtgtgcgaataggtgtgggtcacagacatgaagtactttacaaggagggaggcagaaagcactttgacacagaagaaggcaatgtgaccactgacgcaagaggccacatggctggctttgaagttggaaaaaggggccatgaaccaaggtgtgcaagaaatacaggtgtaaaaggtagagatgtcaaggagatagattctcctatagggttccagagggagtacagccttgctgatagtttaatttttccccagacttctgtgctccagaactggtataatataaatgaagaaatcctcatcgttctccaaaagaatgtgaaatttggggactacaatgtgcttatgaaaaagtcataagactaggtgaccagatgtcctaaatgcaggcaacctacaaaatgggagaaaatttc

SEQ ID NO: 475796 - DNA, 838 bp, Homo sapiens
actggtttacattcccaccaacgggatggggcatcctgagagccaaactgccattattgttatttctgttctggatttagccactcagcggagctactgggctccaggccggtactggggaatatctgcaaagagtcctgtgatgttatccgtcttcaggtctttcagccatggatacaagcacctgctctggtggagtagtggcatagaagccaatgaaaggggagagtttcaggaagactcagcagtattaaagacagagaggttaagaggcctagcagagcaagccctgaaatgtaaagtagattgcgccagtgtcagtgcttttctatgggaactgagcagggcaaaggtgaggaaagctgctggcatgctttgggctatttgcaatcactcccataattatcaagtgttttttgatcagaaataaaaaggatacattttaaactgcgataagaatttgtgaatctgcctagataaatagtagtgacaaatgattctttcatttctataattagcatactgcttggaagagagttcttaatgtatctcagtaatgctgctttttatttgtaacatcaatattttataagagaatgtcctgttttagttattgtggtccagttccttaattcccacttcattttacagattgagaaagaaagaatcagaaagtttaactcacctatgaagttatgcatagaatgcaagaaatttgagctattaaattctttatctatgaatattaggtgcttcctccctctggttgctgcttgctttgcttaaaagaaaagctaaatttgctaaggtattctgaacttatctgctatggacagag

SEQ ID NO: 475797 - DNA, 705 bp, Homo sapiens
ttattcccaagagactatggaactaaacatactcttaccatatggtccagcatcatgctccttggtaacttatgtctacacaaaaacctgcacaggaatatttatagcagctttattcataattaccaaaacttggaagcaactaagacgtccttcagttgcggttacatggatgccaagtgggtccaaggcatctcatgtctcagaagcaacagaaaattcctagaacatgaggcaagaggcttgaagcgtggactgaagtatggtgctgttggggtgaagcttctcctttctcccggggctgtgacccgttgtgcagatacttttgctgctgctgttgatgacatgaatctgggcctaagtcgagccccagccaacccctttgacccctcggtgccctggactgcctggaggctactcatgtgctggacaaacaggccaattgctggagcatgcagcttgctgtgcttggcacagctgctgctggatcgcaattaaacaggtatctatggcttgcaataacatttctagtttcagcgtcatacatttatctcaaacaagttggacagaattgaacacgacaccctccagaaacagtgtgagatgattcaaattggtttacataatgacaaagtcagggatatcaaaagtggatttaaaaggtttgaataaaattactttataagatgtaaagaaaaaagcaag

SEQ ID NO: 475798 - DNA, 494 bp, Homo sapiens
cgttccactacactgaagcctgggcaacagagtcttggcatggtcctcttagcgtcttcgtggacacgtagaaagagggatagatcaccggacactgactctgctgttgcctcattcttggacttcccagtttccagaattggactaagcagcattttgcagcgcattccttcaaagattgaagtttgtgtggagagtcactcattaaataaggagtccaaggctgctgaactccttgggaggatgagcgaggttcacttgctgacctttgccagacagggagattgtcttgagatcaaaaatgtgcagatgcatcttgggcagaatcaagttggctgtccctctaaaatccctcaggatccctcactctttggaaggctttcctgggagcaaaaaggtttgggccagacccctattaacttcattaggggcagcaccaggtgcaagaggctgaagaagagagttggacccagcgagtaagacatagagtttat

SEQ ID NO: 475799 - DNA, 1671 bp, Homo sapiens
agaagatccaacagccagactggtttgcaccgacggttcccaaatgcatggactggcactctgggctgttacacccgccacagctgctcggagaacttgtctccttgcttcgggggaggccaaggaaactcttgcacaaatgtacaatactgtttggaatatggaagacctggatttagaatatgccaagacagatataaattgtggcacagacttgatgttttatatagaaatggacccaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtgctgtgggaagtgggccaattcaaggcaccttccaggcctccaa

SEQ ID NO: 475800 - DNA, 1165 bp, Homo sapiens
accacgggcccctcggcgttcgcggagtcgggggcggggttggcggggggtggggttggcgcgggcggggggggcggggaagcgcagggtacctggcagaagaaatgtttaagcagcaaaccattcaagaggtgacttgggtgctgttaaaagcattcagttttaaaagggaaacacatcataaaagttcagaaattttgcaacctgatgtgatagaaaggaaaaacccattttcagaggagacattcaagctggctgcagaaatttgcataagtaacaaggcactaaatgttaatcaccaagataatggggaaaatgtctctagggcttgccagagaccttttccacagctgctccaaccgtggctaaatggggccaaggtacagcttgggctgtggcttcagagggtgcaagccctaagccatggcaacttccacatggttgggcctgtgggtgcagagaagtcaagaattgaggtttggaaacctctgcccggatttcagaggatgtatggaaaggcctggatgtcaaggcagaagtttgctgcaggggcagtacagaagggaaatgtggggttggagtcctcacacagagttcctactggggcaccacctagtggagctgtgagaagagggccactgtcctccagaccccagaatggtagatccaccgacagcttgcaccgtgcacctggaaaagccacagacactgaatgccagcccatgaaatcagccgagagtgagactgtaccctgcaaagccacaagggtggagctacccaagaccatgggagcccacctcttatatcggcatgacctgtatgtgagacacggagtcaaaggagatcattttggagctttaagatttgactgccctggtggatttcagacttgcgtggggcctttagctcctttgctttgaccaatttctcccatttggtatgggtgtatttatccaatgcctgtacttccattgtaatctaggaagtaactaacttacttttgattttacaggcttataggcagaagggactggccttctttcaggtgagtctttggactgtggacttttgagttaatactgaaatgaattgagactttgggggactgttgggaaggcactgttggttttgaaatgtgaggacataagatttgggaagggccagg

SEQ ID NO: 475801 - DNA, 644 bp, Homo sapiens
gttacaggcatgagccaccacacctgctctgcatttttattttttaaagcgggagaaggacagtccctattattttccagtataatttactgcaagagtcagcaaactttttctgtaaagaaccagatagtaaatattttaggctttgtgggtcatacagtttttattgcaattactcagttctgccatggtagcagaaaagcagccacagacaacttcaaaagtcatttaaaggacaggtgggaaatattaacatatcattttaatgggacccaatatggattggcgaatggaggtggtgatggtggtggaaatgatggtgtgtgcaaacactcccggacagacagttgtaacagcaccctgataatttgtgccagtgctcaaggcttgggtgtggaatataaccaaccatgggctaaatttcctattagttgaatctctaagaaatataatttattagcttgctcttcatcatgtttacgctccttgtcacttttcaaacacaagctcattttcagataagcatagtagaatgtttcagaattgcatctttagttcaactaacacattccttatggatctaaaagagttgcttttgttggagaaaggtctatgatccattttaagttaattttttatatggt

SEQ ID NO: 475802 - DNA, 944 bp, Homo sapiens
ctaaaactaagtgcccgacatgctcaggttatagccagtggaaggaaagaaaacagctgcgcaggctgctattactaaattcatatgaactatggtccaaaaatgcacttcaagtcttgcagggtttggaacactgatggacatccttgcacagttgcgagtgccaagagcatttctaaagggtctgctaccacatatcattaaagaagctcctgggaagagggtaggcactacaaggtctagacctcaggtgtcagatttcacatctgcgaaactgagtgatggagatgaagaacttgttgagaactggagtaaaggtgactcttgctttgctttagcaaagagactggcagcattttgtctctgccctagagatctgtggagctttgaacttgagagagataatttcgggtatctggcggaaggaatttctaagcagcaaggcattcaagagaaagcacagcataaaagcttggaaaatttgcagcctgatgatctgatacaaaagaaaaacccatcttctggggagaaatctttctgactccatactttaagcccaaatggttgctggacctagagaagctttggtggataacatccttagccataataaaagcttatggctttggttcttttccatgtactgttaaaacttcctggcacagttctactttcatataacatagctaaggatgaatgcccttggcttttgaggctgagtaatgctttcacaggttgaacatttcttactaaaaatgctagggacaagaagtgtttcaaatttcatattttcttagatttttgaatatttgcattgagcatccataatgtgagaatccgaaatccaaaatgctccagtgagcatttcctttgagcatcattccagaactcaaaaagttccaaattttagagcatttcagatttcagattttcatattaggagc

SEQ ID NO: 475803 - DNA, 888 bp, Homo sapiens
atcactgatgggcatttggggtaatggcagtaggatccatgctcatttgcccatgccagcagcagtgtgagcatggtggggtgcatgcttttcagctgggatggggtgctggtgagtgtgtggatgctggtctccatccagtcattctcagctgcagtagttttggtgcaaagatggggttgcggaggggtggaggggtaaggccattgaaatttgtgtgtgcattcacactggcggccctcttggcacaggaatggggtgcctgcctgcatgggtctggctgcctccatgagcacattcatgccagtggcaatgatggcacagggccgctggcctttacatgtgcatttgtgctggcaacaatggctatggcagggtggaagaatggggctgttggcctctgggcttgcactgacattggcaatggttatgcagaagggaggttggaggggtcagtgggttactcatgccagcagcagtgacacagtagagtcacatgtgcagtgactctcatgccagcagggtaggagaggtaaggtttatccaagcacatgtgcacagaaagccagattcaggcagtctcagtcatttcttaatgtatgagaaataactgttaaaaaaaacctggtgtcatagcactggggagaacacttttaccttcaagttttgatgaaaggataactcagaattttttaaaaaactgttgagaatgcatgtattattctattttaatgctgctgttaaagacatacctgagactggaaagaaaaagagatttaattggacttacagttccacatggctggggaggactcagaatcatagcaggaggtgaaaagcaattcttacttggcagcagcaagagaaaaatgaggaagatgcaaaagc

SEQ ID NO: 475804 - DNA, 2430 bp, Homo sapiens
cagccacctcttacatcagcgtgacctggataaacatgggaagcatggctgcccttttctcactcaatatggttctgggcccccagctttgttctctggcccctggaggctgtgctggaaggggtgaggtgtttccagatcctggccagagcactctgatgactgatgctggtgaaagtgctttgttagatcggcagcaatgggatctatgctcattcacatgtgctagcagcagcagcaaggtggcagggtgcttgcacattgactgggtgcagggtacccataggagtggggctgcagtgttcctgcatgcactcatgctggcagcagaggtggggcagagtgttactgggactttcacagatccagtaacatggccactagaaattttagtttatgtcttgatcctgatcaaatgcctggctcttccatccatacccttaagtttatccagtgtcaatttgatagggacagaaggaagccaagtgcctaggtaggtaggggcagattcaatttctttaatagacataaagctctacacattttctatttattcttgaatcagaattggtaagcttgggcttttatagaattttttacttctatcaaaattttcaaatgtttttacataaagctgccatagaaattattcatatttgtagtattggtatagaagtaaactttttttatttctgatgtttgcaatttataattttcatttttaaattttgatattgatttatcaaatttattagtgtgttaatgaactagtgtttggcttcattgatatttctatattctatacttgttttctaattcatctatttctatcatatttcttttaattctatgtgagtttaatttgtcacgttatcttctagccccttgaaatgaatgcttaaagacatgatattcagtctttcttttataaaatatacaggcaaggtatatattaagtatatatatatatatttgtccctaagtcatgtcttacttaattcttacaagtttttatgtgccacaattttatttccattccatttaaaataatttctaatttccactgtgatatcattaaaaaaacatgggttatttagatgtgttttcttttaaagttagaattttttgattgattttttcacttcataccactgaggctagagaaaatgctctttatgattcaatcatttgaaatgtattaaggtcttctctatttttcaatatgtggtcgatgtctatgattatcatttgtaattttaaaagcagggataatgtgcagtcattgagtgcagaagtctatatatgcctattatgtaaagtttgtaaaataagttttcaatcttctgtatccttagttcccctatattctcaccagtaactaaaaggtatgttaaatattttcatattattattgatttatttatttcttatacacattttatcaactttgtaatttatacactttaaagctaaattttgatacttagatacctttaggattgttatatcttcctgcagaatccatgctttatttcataaagaaatgccctttttatgtcttgttatgcgtatgatttaaaatctttgttgttagaagtaaattagttttcctgatgatttcatatatttctcaatctttttactttcaactgttctgtctctatatctgtaatttttaaatagttgttaatgatgctatttttattgttttaaaccagaatctgatagtttttttctaaacaggagaatatgctcaatatctatttcatgtgtttagtgatgaatttcagtttatatctacaattctataattcctttgtttttatagttcttctccttatttgacttcatttgcttacatcaatataattttattgttatattttgttctatttatctgatagcagtgtattccttaatattccttggcatattagagtctaatttaaaccatgcaatattagaatttggatattataatgctatgaccacacttattccctttttatattttgagctattgttgtcatatgttctaattcctcatatattttaaacctcagcatttcattaatttattattttaaacagacaacattcattttttgaggttttttttttttttctgcaatactggatcaatgtcagagataatgttccgtctgtgtaaagacctccttttagaaagaggtctttctattgatagtaaattttgataattccatattaatgattatttatttttgatattctgaagatttaatgtaatagttttttatactttcattatatctgagttttatttatcttttgataaacatatatgttatttataacatatgtctttgagaaagaatatttaagagtcaatttgtttttaaagagagtcattagtgaaatgttaaactgaagaacaagccttaataggtt

SEQ ID NO: 475805 - DNA, 1064 bp, Homo sapiens
cttacacttggcttgcattctctcttacctgggtgccttgttggaagtgtcttttgtcttccaccatgattgtgaggcctcccagccatgtggaacttttgaaggatacaacccctattttgctgaatgaatttgggtctccaagcatggagaggactgaggctttaagtgacaatttgtgcagcatgagctgtgagtggatttgctgtgaaagagagagaagattaagacaagcctttgccttccaaagcaaaatgtttagagaaggaactaagacttatgccgaggaaatagggggcagagaatcccagagaggtgcagggcaggagggtcagtgtctagccttcaccctcaaatcaaagcctgttgtctttgtaaaagggctcctgttcagtgatactaagccagcttccttccctggactggtggagcctccggtaaatgcaggtttaaacaggctggtgaaatctgtaagcacctacactgcggtgggaaaggcttggttcttatgcaggaagtgtcacttctcagaccacagtgcttttgattcctgtggttctgcattcatcaggagcagccagtactttaattcccccaaagctaaaactgactgtgtctctcccatctgcaccagcaattactctggccttgcttttatggtgctggggatggcaggatttcttcctgaaatatcgctcaccatccccaggcccatcaaattgcaggcggccatatttagaagggattcggagtgggaacaaggggtgtgcgtgagtgtggaagccaatattcccctgtctaatttatattttacatttctgtaaaatcatgcttagagtattttggtaatctctgcagagattaagtataatgctgtacatttaattgatataagtggtttcaattctccttaatatgacaaatctccagtgtgaaatattctttgttaatgatcaacataaaatagagttcatttttaatgtgagcacaagatttgaattaatttgtagctaaagcagggttattaaattttgtgtgcattctgtgcacaggcacacgttcgg

SEQ ID NO: 475806 - DNA, 498 bp, Homo sapiens
agttcagctgccatagagagcatctatgccttgcacactgttaccaacatggcagcaggggtggctgtaccctggacagaagtgccattactgccccagtccctccacattgcctatgcttcaggcctcagtttggtggcaccccgtgggcaccaatcatcagacactgatgccacagccaccaaaagtgagtccacaagccagacccagtgccaggaaggatcccctcagccacagcttccccagtaggagaaaaagagattggaaggtccttagcatccatcaccccctaagaccccaacagccctcagtgccactgtggaaatccacatccctagcttctgaggatccctacaatctttgtcaacatcaatctcagctgtcaaagctgcacagagactacacagatgcaccctcagtggtgccagggctgctgcatcatacctatcaaataccctcatattcccctgtaaacaatggtctttccacatgaaaact

SEQ ID NO: 475807 - DNA, 883 bp, Homo sapiens
acttctgcagacttaaacatccctgtctagcagctcttaagagagcagcagttctcctagcatggcatttgagctctgagaatgaacagactgcctcctcaagtgggtccctgactcgcgtgtagcctaactaggagacatctcccagtaggggcctacagacacctcatataggcgtctctgggacaaaaggtccagagaaaggatcaggcagcaatatttgctgttctgcagcctctgctggtcatcaacatcaaagaccaaaggtagataaaaccacaaatatggggagaaaccagaggagaaaagctgaaaattctaaaaataagagtgcctcttctcctccaaaggatcacagctcctcaacagcaatggaacaaagctggatggagaatgacatcaaagagttgacagaagtaggcttcagaaggtcagtaataacaaacttctccaagctaaaggaggatgttcaaacccattgcaaagaagctaagcaccttgaaaaaagattagacaaatggctaactagtataaacagtgtagaaaagaccttaaatgacgtgatggagctgaaaatcatggcacgagaacttcacgacacatgcacaagcttcaatagccaatgtgatcaagtggaagaaaggatatcagtgattgaagatcaaattaatgaaataaagcgagaagataagtttagagaaaaaagagtaaaaacaaatgaacaaagcctccaagaaatatggggctatgtgaaaagaccaaatctacgtctgattggtgtacctgaaagtgacagggagaatggaaccaagttggaaaacactctgcaggatattatccaggagaacttccccaatctagcaaggtaggccaacattcaaat

SEQ ID NO: 475808 - DNA, 723 bp, Homo sapiens
ggtcttctaagtagcgggtgttttcccttgacacttacgctaccgctagaccatggtccacctggcaacggttgtcttcccagacgctggcatcaccgctagaccaaggagccctctgtactctccccgctttcctatggacgtggcttcctgtgagccaaactgcagtgattgttgtcttttttctgggtctagccacccagtgagtctacctggctctgggctggtactgggggttgtctgcacagagtcctgtgaagtgaaccatctatcggtcgttcagctgtggatacagagcctttctggtggagatgacaggagggtgaaatggactctggaagtggaggaaagccggcagtcacaggcctcacctggctcccacggaaaccaaaaagccggtctcactctcattgtgcccccactaacagccctgagtttgtttccagatggctattacacccttgcctctgccaagccgatccctagaaaccaggttcatcaagaacagagacctattgaacaagattctaaaatcaccaataatgatcaaagagtggaatcaacctgaggccctcattagatgaccaatcttgaaccttccagtcagcagaactgtgagttaaattaacctactttctttataaattactcagtcttaggtattcctttatagcaacacaaaacagttgaaggcactgctcatggactaataagaaactactc

SEQ ID NO: 475809 - DNA, 716 bp, Homo sapiens
cggcgtttattattcagggattttatttgtcatcactcttcagctgctactgctgtgtttgctcacaagagccgatggcgttacaaggggcttcccccttcactcagtactcatccttgctcctgctgccctgtgaagaggtgcctacctccatgactatatccaaaaatatggaagcgtctttggaactgggtaacaggcaaaggttggaagagtttagagggctcagaagagacaggaagatgtgggaaagtttggaatttcctagagacttgttgaatggttttgaccaaaatgctgatagtgatatggaccatgaagtgcaggatgaggtggtctcagatggagatgagaaacttgttgggaactggaaaaaaggtgacttttgttatgctttagcaaagagactgactgaccgtcccatagaaaacaactgtaaactctggaaaaaatacaaagatcaactacatgaaggcactggagatgaaacgaagacagattttggagggaagttagcatatgagcaaagctaatgatacactttttgggggaacctccatacttagagattcttgaacactttatcatcagtaagtcacccacaacaattcttcatctggtttaatggctacaaaatacattaattgtgataattattccaaggtgtattttcaaaatacaattaataaggattttatgttgtattaaataaatct

SEQ ID NO: 475810 - DNA, 711 bp, Homo sapiens
gacgactgtcatcaaggtctgttaccatccgaggaatgctgggacagcctgtaaccagtaaggaaatgcagcagtccctgcaacaccccaattctaggagtccaaaactgagcggtcagtggagactagtgcaagatcttagactcatcaatgaggcagtaattcctctatatctagttgtacccaacccctataccctgctctctcaaataccagaggaagcagaatggttcactgttctgggcctcaaggatgccttcttctatattcccctgcactctgactcccagtttctctttgcctttgaggatcccacagaccacatgtcccaacttacatggatggtcttgccccaagggtttagggatagccgtcatctgtttggtcaggcactggcccaagatctaggccacttctcaagtccaggtactctggtccttcagtatgtggatgatttacttttggctaccagtttggaagcctcatgccagcaggctactctggatctcttgaactttatagctaatcaagagtacaaggtgtctaagttgaaggcccagctttgcctacagcaggtcaaatatctaggcctaatcttagccagagggaccagggccctcagcaaggaatgaatacagcctatcctggcttatcctcaccctaagacattaaaacagttgcgggcattccttggaatcactggcttttgcc

SEQ ID NO: 475811 - DNA, 572 bp, Homo sapiens
aaaatccttcattcctgaacgccaccatcgctgtgagccctgtactatcagccatggtcaactccgtcgtcttttttgaaatcaccagggatggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaaatggttcccagtttttcatctgcgctgccaagactgagtggttggatggcaagcatgtggcgtttggcaaggtgaaagaacgtgtgaatattgtggaagccacggagcactttgggtacaggaatagcaagaccagcaagaagatcaccattgctgactgtggacaattctaatgagtttgacttgtgttttatttt

SEQ ID NO: 475812 - DNA, 2624 bp, Homo sapiens
aagcaaaagctccagatggctgagctaagacacggcgtattcggtaactcacgcatgatgagtcccacagctggctcttcgtgcgggctggcacgcctattatcgctgctcagaaatgaagaccataccgttagagatggttcctttgatcatttctccaaagcaatctcgttgtcagtggacagcttcccagaagacagtgtgaaagcacagcacaaaagacattcatttcggctttactatgaacagacttcaaaaagccttgctaagaaatatttccaactcggctggcagctaaacagcactggccacgagataagcaatatcgaaacaattgcagctcatctgctgccggacgctgactacatccatttctgcctcacctttccccacttgaagtgtgtgccttcagtctctgctggaggctacacttcccagcccgcaggatggccagtctgcaggtcgtaaacccctataagaaataaaactctcatttccaatttatagatctggactccctgtgtgactgccctgtagcttatttaggcatggtatgcactgagatgtggtcagagtttggggccactgggtttcctgcaagctctgctcctgtgcacacgtggactcccaattgttacagtgtgactgtgggttactgctcaggtctggcacacagcactagtttctccgggtgtgtgtctaggagtagagtcactacgcatagaatataggcatgttcaagtttggtaagtcattccagaccttttccaagggattccactgatgtacgcccttccacacagcggatgagagctggtgttcctgcataccctcactaatgcttggatttaagatgggccaatttggtggaggtgaagtgcaatgtcaccatggtctccatctgccctgccccagtgccactgaggtgaagcatatgattatgggctattcatcttccctcctctgctaagtgacggctcaaggctcacacttgtttttttctattgggctgtttgccgttttattataatttgtagttctttatatcttctctgcatacattctttattagttttatgtaatacaaacatatctctttcagtttttgtcttttttccaccctttgttgtgttttttgatcaagatacataattaaattgattacttaagttaaaattaaactcttaaattttaatgtggtctaatttatcaagtgttttctttaatatttgtacatccttgtcttgtataatgaatgtctgtgttctaaatttgtaaagatattttcttacataaacttctaaacattttatgaatttgtcttttatagtcatttattctatctgaaattgatttttaagactggtgtaatatagaaattcacgttcattcttttccatttggataagcagcaacattaattttttaaagttttttgaattgataatacattcacacgcagcaaagtatcaaagcaatgtcaaatggcttacagtgaaaagtcttacttcccctccctcacaacccagttctccacctgtgcacctacagacaacgacttttagtcattattttataaatttccttggcatctctgtgtaagtgcaagaaaacatgaaattatatttccattttccttctttgctagactcctaagaaacttgttttttcacaattcgcagtagaccttggcaattgttcaaagtccctaccaagaccttccttgttctttttgagggatggcacagtattccattgtacagtaaagccatatctagagattttcttttcactcatgatgtaacagactggatctgcctccctccccaccttaagcaattggaatttctgaagctaaactctagaacgcaggaagctgtggagacagaagtgataacaaactccagagatgtgtggagcattctccttgagtctctgagttggtcgtgatctgcactggagtaatgtggaatgaatgaagatatgtctcttcaagccttttgcccatttttaattgggtgtttgtgttttgttattgagtcatagagttatttgtatggcctggctagcagacccttatcaaatatatgatttgcaaaatagttctcccattctataggttgtcttttcactttatttataatgtattttaaagcacaaagcttttggttttgatggagcccaatttttctatttttttcttttgctacttgtgcttttggcttcctgtgtaaaaaccccttgcaaaatccaagatcatgaagatttacttctgtgttttcttctaagagttttatagttttagctctcacatttaggttgttggttcattatgagttaattattgtaaatgatgtgatgtaagcatccagcttcattcttttgcatattggtagccagctgttccagcatcatttgttgaagaaactgtgtttcccatttgaattttattggtgtccttgttgaaaatcaattggccttagatgtatgggtttatttttgggctcttagttctattccatgggtctatatatttatcctcataccaatactatgctatttcaatcactgtagatttgtagtaagtttagaattaggaagtgtatgtcttctctttcagaatt

SEQ ID NO: 475813 - DNA, 913 bp, Homo sapiens
ctgccctgagctgctcctcggtgcctatggggtagccctgccctgcaggagcagtcacagagcatgacgcacactgctgcctcaataaagctcttttcttctgcctctggcttgccctcgaattccttcctggacaaggccaagaaccctcgcaggctgagcccactgtggggctcacctgctctgcatcagtacaaccagaaaattgccatcggagttttcctaaaagcagataagatattggatttaagaaaccagaacaagatgctaaagacatttttgcagaatcaaagcatgatcttgatgaataaaaacaagggacagggcttcctaagagccagactgcagcaactgttattgtcctctggatctagccatctagtgggggctactgggctccaggctggtgctggggaaggtctgcaaagagggaactcacagtttttcgactgtctcacagtgtttgcaatggcaagccacttttttcaaaggctctttgaattcttttggttttcctggtatgttcctgtggtggttcttggagcaaaagttcacaatccagttcccttctatgtgcaaaatcccatatcaccctttggatcctgcataagtcaccagaatggctttgtaagaggcactgaaattctgggctactgtaggaacccaggtggcactaatagacttaaagcattttgcattctatatttagggtactgttccttacagagatgcaatcttaagctcagattgggtgcagctcttcttctaccgggatgtgaagtacagcaattcagtgcttcaaatatattgcggcagtaacgtttctgagcattttgagtaattattatttcacggctgtcatttcagtgtttcttggggttttaattgttttacttttggggtgttgaataaa

SEQ ID NO: 475814 - DNA, 1307 bp, Homo sapiens
ctctcccctttgctctggcagattcctgcagggctttggcagtggactgacagacaccaggtgacctgcctctccaggaggatggagcagaagccctgccagtgtcccctgaagggcagggctggggaccgcatgaggacaaggctggagagtatccagagccttggctttgatgacaagtcacacaggtgttctgtgtttaccagcatcccccaaaccttgcactaccaatcccccaatgcagaagcacaggagacagagttgagcctctatttcctacactttgcctgtgcgacagccttacaagttgtggagaacattgcacatgctgaacctttaaccaaagcccccagcacacagacggggctgcagcaacgtccattgaatagctcagacatccacttgtctgcaggaggctctgctcccccatccttcccccaggcctgcctggtcccttgggctggcacttatgcgtcccacagcatttggttcttgatcttttccttggtgaaaccttccttgcaactcctgtacaaagctctttgggatcggacccatatgccatgcccatgatggctgccaactgtgggtcccctttctatcctgttcaggcgtcaaggacaggggcaatggcgtcttcattttgtgagtccaatgcccagtgcactgtttagactgcggagaaatgggtcttcagtgattaaataagagtccctaagattttgcttctgagaatctttcacatctttaattaataacaataataatacttagttactgcgttacatattttccttatcttgaattgagaaacatttcaaacatacagaaaagcagagtaatacaataacaactaccaccttctactgaggccagacaaaagctaatatttactacgttgatgcaggctttttttttttttttttttttttttcaaaataaagcaccatgaatacaggtaactacagataaacctctctgtctccatttcctgtccccctgacacaacttctccactcaagttggtgtggcttcatccatgtatatttttggcttttactacatatgtatgtgttcaaaaactatgaactcttctgtgtatttaaatattacatatatcggattacatggcatgaaacattttataacttgcttttaaaaatttaacacttgaaatttttccaggtagatacatgtagatccagttcattcattttatttcaaaactgtattatttcaaaactagagtttatcaattccatgaaaacctcatcattatgcacattcttgtactaatctcctggttc

SEQ ID NO: 475815 - DNA, 3338 bp, Homo sapiens
cagaagttatccttgcaaaagtgaagaaaggtgagccgcacgatcctgtctgtggcgcattggaggaagcctgattgactgtctttataggagcacacgggggcctcacaggagctgagggacagcatgggatgtgaggggctctgagtgagaagaccgttgatcacatgatgtcaggggctctgagggagaaggggcccatgagatgatgtgaggggctctgagctgagaagaccgttgatgacatgatgtcaggggctctgagggagaaggggcccatgagatgatgtgaggggctcagagctgagaagaccgttgatgagatgatgtcaggggctctgagggagaaggggcccatgagatgatgtgaggggctctgagctgagaagaccgttgatgacatgatgtcaggggctctgagggagaaggggcccatgagatgatgtgaggggctctgagctgagaagaccgttgatgacatgatgtcaggggctctgagggagaaggggcccatgagatgatgtgaggggctctgagctgagaagaccgttgatgacatgatgtcaggggctctgagggagaaggggcccatgagatgatgtgaggggctctgagctgagaagaccgttgatgacatgatgtcaggggctctgagggagaaggggcccatgagatgatgtgaggggctctgagctgagaagaccgttgatgacatgatgtcaggggctctgagggagaaggggcccatgagatgatgtgaggggctctgagctgagaagaccgttgatgacatgatgtcaggggctctgagggagaaggggcccatgagatgatgtgaggggctcagagctgagaagaccgttgatgacatgatgtcaggggctctgagggagaaggggcccatgagatgatgtgaggggctcagagctgagaagaccgtcgatgacatgatgtcaggggctctgagggagaaggggcccatgagatgatgtgaggggctctgagctgagaagaccgttgatgacatgatgtcaggggctctgagggagaaggggcccatgagatgatgtgaggggctctgagctgagaagaccgttgatgacatgatgtcaggggctctgagggagaaggggcccatgagatgatgtgaggggctctgagctgagaagaccgttgatgacatgatgtcaggggctctgagggagaaggggcccatgagatgatgtgaggggctcagagctgagaagaccgttgatgagatgatgtcaggggctctgagggagaaggggcccatgagatgatgtgaggggctctgagctgagaagaccgttgatgacatgatgtcaggggctctgagggagaaggggcccatgagatgatgtgaggggctctgagctgagaagaccgttgatgacatgatgtcaggggctctgagggagaaggggcccatgagatgatgtgaggggctcagagctgagaagaccgttgatgacatgatgtcaggggctctgagggagaaggggcccatgagatgatgtgaggggctcagagctgagaagaccgttgatgagatgatgtaaggggctctgagctgagaaaggcgcccatgagatgatgtgaggggctctgaggtgagaagaccatcgatgacatgatgtgaggggctcagagctgagaagggtgcccgtgagatgatgtgaggggctctgaggtgagaagaccatcgatgacatgatgtgaggggctcagagctgagaagggtgcccgtgagatgatgtgaggggctctgaggtgagaagaccatcgatgacatgatgtgaggggctcagagctgagaagggtgcccgtgagatgatgtgaggggctctgagctgagaagaccatcaatgagatgatgtgaggggctcagagctgagaagggtgcccgtgagatgatttgtcaccgtggacgcgggctgcagggaggcccggacgcccatcccaggtttcggcctcaccctcaggctgatgcagcgtgcccagcggggagcagcaggacgggatctccttgctggcgtgcctgcatccagctgtttactgcacgttaatcctgaatctggggggccatctgtttgaaagatgctattccaaggtggcccccttgtgtggcggcccagggatggtgactcaaggctttggttcgggcagatctgaaggacctatcggttattttgtctacacagaaggaagctaaaccaatgaggacaggcatctcatctgtttttctccagaaaagcacctgggaaagtacctggtgcataacagtggtgcagtcattagcaacccccaagccatcgggcttcctgcactgacgctcagtcgctgtcactgcttgagaccagttccccatttccgtagctgcagtttcataacttcagtgtgaataacaccatcctttcagggtccctggaaaagaaggacggctaatgtaggtgaagtccttgaactggaaggcacaaatgctgaacaagttcactaactacctgcactgccacctgccctgctctgaacagcagcctgtggcccaggcctttgcgcccttgtctatctcaggcatggaaagagaatgtagagaatgtgaagccctcacccttacaaaattcaaaaacatggccttccggaaatatttgctgctagacaaatgtaaaagccctaaagtgcctataccaaggggaaatgagaacagtcaacatcctcatgtccctccagaaagtgtcatcagcttcaggcccacgggcacccagctacctgcaagccaccttcgcaccaagctgcgggctctgaaatgcactcagcggaagatgaccctgagtcctgatggcacaggtaccagcaggcttcaacagctccatggtgctgggcagatgcgctgggacacagagatgtgctccagggccgcgtgcagggagcagcagatggctttagacagctgccccaggcccgttggtctctacgaaaatatctcaggactttcatagcttgtttttttcctatgaaatttctttcttctcatttctgttaactttgctagttaaactgtcaggccaattttgaaagggaataaaatctttgtccctcctcccatcctgaagccaaaatctattttggttcatataaaaatgatcaaattacaccttttggcatgttccttaactaggaaaaaataacttggattaactagtgccaataaactaagtattttcaattaaattctaacattagtaaaaatatcagtcataccactctaaatcctaaccaactttaaaacagtatgtgtaaccctcaaagcagctgtctgc

SEQ ID NO: 475816 - DNA, 1316 bp, Homo sapiens
ctatgatcaggcatgatgacatgcagccccttttagagcgcgtttgcgcacagccatcccgcgctgggtgctggtggcaggtcccagcaccaggacctagccaagggcagccttggtgcgtggcggaggaaaaccatctgtcctgccctgtgcatggcgctgcctacagtgacaaggactctgctgcgaacgggcgggccctccacgctcaggcctggctctcagggcagcctcctgagaaacggactccgcagccgcagcctttgagacctttactagccacacaccagtttgctgtgtatgaaatccgtacaaagcagaagacagcaaaagcatcaggctcccagtttccctcaaccagcaggcatcatgcttcagtgggacgtgtgagggaccgttcagtcacccaagttgctcccttcagcaccactcccaaagccctggcagtggtggccagctgtgttcgagagcttttctgccaggttgccagaccagtcatcatggcccccctaatgtgccagtgcggccacccaaaccatgcccctcctcgagggccgagtcccagctctgcagggccccctcctatgagctcggtggtactgatcatcaccccagtgtcttttctctgtgtccacagcccagggtagtagtttctccttgcagttatgacatctgggttaccaagggcttccatgttggcctcttaagctccaacacctacataacaaagtgtctgtattaaattccctctgtcgaatggacttgtgtgacttcagtgttcctgactggaccgtgactaatacagtcatttgacaactgaaagtaaatgttgaatcttgcattttattagtttttttcaggagtattcaagtatcgtatcatccagcttgctaaccaccctgcaaaatgctggtcagttttgaaaactgtttctaagcaaaaatattttattttcattttaacatatgaaattgattcattagaataaaaaattccacaattgtcaaagaagaattagttgaaaactgtttctaagcaaaaatattttattttcattttaacatatgaaatcgattcattagaataaaaaattccacaactgtcaaagaagaattagttgaactgtttacactcataaaatgaaggttaattgtttgttgaagtgaatatattctgcacagtttagaaaagttgaatataaatttgcctattccccatccttttggtttgaaaactgaaatcagttttaatgcaagcaatcttaaattaatagcctttacaaactaatgtgatcttaatgtaagcacataatcttt

SEQ ID NO: 475817 - DNA, 736 bp, Homo sapiens
ggggacagaagccagggcagaaataaactgctcagcataaaatgggaaagagggcctgggagaaagacagctcctgcagccaccatgatgccactatgcagaatccccgaggttctgtggcttctgtaggctcagagccctggacaccagtgccagggtcatcgaaggaaggaggaacagagtgcgtcactgaagccaaaagtggaactggccctccctggcttgcccgggctgagactcctgacttcagcactgaatttggcggccacagaacgggccgggaccggctgcagggtttcagttcgagtttgctgcgtgccccacaggggaagtctctagagccaggcccacccggggacagcagagcagagccctccctctacctccaggacctaaattctgcagtagggccatctgccctgacaccttccaaaagggtcatggtagaagatatgaagcagaagtctgcgaggatttcatcttccaactttgaggaccaggtatctgcccacccactcccatttcgccttgtctttggtggaagctgggctgcatctggagctggtgggtctgtggccgaagatctgccttgtacagcagcaacaggctcccctcctctcctcttgcttgcctgatgtggttgcactcaacatgcttcttaacttttgtaaaattctacagtggaatcttcaggacaaggccactgagtggtctcctgggtatttcctgttacttc

SEQ ID NO: 475818 - DNA, 589 bp, Homo sapiens
aaggttgataaatccacgaagatgggaagaaaccagtgcaaaacggctgaaaattccaaaaagcagaatgcctcttctcctccaaaggatcacaactccctgcctggaagggaacaaaactggatggagaatgagtttgacaaattgacagaagtaggctttagaaggtggataataacaaactcctccgagctaaaggagcatgctctaacccaatgcaaggaagctaagaaccttgaaagaaggttagatgaattgctaactagaataaccagtttagagaagaacataaatgacctaatggagctgaaaagcacagcacgagaactttatgaagcatacacaagtatcaaaagccaaattgatcaagcagaagaaaggatatcagagattcaatatcaactcaatgaacaagacgggccaacattcaaactcaggaaatacagagaacgccacgaagattctcctccagaacagcaaccccaagacacataatcatcagattcaccaaggttgaaatgaagggaaaaatgttaactacagccagagagaaacgtctggttacccacaaagggaagcccatcagact

SEQ ID NO: 475819 - DNA, 803 bp, Homo sapiens
gttccaagtgtggccttcagcccatgccaaacttagatcaactgcaggcttggagctttctgaggcgagaatggaaccttcttctagaagcctgtgctcagcacaggggccaagccctgcggctcaggcaggcccacgtgactcttgaactgcagactcaagtcccaaggtgggaaaccgtttgtcaacggcccccagatttacaaccacgaggccaggctggtcttggggtgcaaagccattgttcaaaccatcagtcatgcaaggagttcctaggattttttattttcccctccaaaaagctctcttcagctttgaagaaatgctgtttcctcctctggttacttctgcctgatgagaatgctgatctggggatccaagtaaagggtggaccacagagcaccttgtctctgtgtaaaaggacacccctgttactcagcgtgcctgaaagtgcctgagtgtttcccagtcctcatcagtgtaatcttaagctagaagttccccttgggcaatgcatcaggtcttccactttttttccaatagacaccatgggccatacttcctaaaatacatgtttctaaatcttctactttttttgaaaaacaattttgaatcattaaagaaatttttgaaaatagctttctataacccacaacacctctttgtgaaccccatgattttcatttgttgaaattttccgattctgaccatgggaatgtgtgtcttaccaaatttcaaccagacatccagtgtttccacctaacatgccatttaaagccacttccatattcaattcagtctgc

SEQ ID NO: 475820 - DNA, 1674 bp, Homo sapiens
gccgtgtaacgggagtggttaggagcacctggcctgaagtgtcttcttgaatcttctctggtctgttttgtccccatggtatgaccagcccgattctgatgtgtggagtccgatggagttgggttggggtttcagctgtcccagttaccagggcacagtaaggaacagggctttccctatagcctggaggggcctgtctgtgggcttcactgatctggcggccagtgcccactgtgaagacctgaagctggagcagcctccttacttggcactgctgctcagttgctccttggcagagattcacatccgggccgtggcttccctgtgcttggcctggagccccgggcgtccttggctttgtcctctcccggtcctgcgggcggccccggcgtggcccttactgctggactactgtatcttagagcacagggctgtgaacagcctttgccatcatgccaaggagcatattgacagctgcccttggaagaggccctgggcagcagcatggcctgagcattagaagaaccaggggagcttttttctttttaatttttaattgacaaataattttgtgtatttatcagcctctggtaaccacttttctactcagtttctatgagatcgactcttggattctccatataagtcagatcatgtggtagttgtctttctgtggctggcttatttcacttagccttaagttctctggttccatccatgtggtctcaaatgacagaattttcttcttttttaaggctatgccgtattccaggggtccctgactcctctgccccgtctgtggaaaaattatctttcatgaacccggcccctggtgccaaaataattgggaaccactgtcatattccattgtatgtacagggaattctaaaaatctgttcatcagttgatgggcacataggttgattgcatttcttggctgttgtgaacaccgctgcagtgaacctggaagagcagacatctcttccgcatactgatttcagctcctatggagcgtcctccagaaggggggctgctggagcctctggcagttccatttttagtctacagagaagctgccatactgttttccaaaatggcggtgctaatttacattcccgccaaccgtgcgcaagggttccttttcccccacatcctcgctaatacttatttactttttgtctttttgataaaagccattcagatgtgtgtgaggtggtatctcactgtgttttcatttgcatttcctgatgaatagagagggatcactattgctatcctctgagatcacagccccccttctttgccttttctctgttctaccctcaaaaggttttataaccaataatggagtttcttttcctgtctgctcccattactgcctccttctgtttgtagaattctgactggctgctgtgtgcaagtacctagacttattgttccactgaggcaggtagacttcaatgattccatctgactcctctctgcaatgtttactacaataaaacaagaggcctcattgctttgaataaaaatggggagatcctactttctggcctagggttcaaaattaagccttgcattttcctaggggcccataatcaatcacagaggcatttagatggacaaactatttgaaaaacctttccagatctttgcttaaccaattaataggct

SEQ ID NO: 475821 - DNA, 1515 bp, Homo sapiens
tgctgtcctggggtgacagagctggaaggatattggtctgtagttttctttttttttgttatgtcatttcatagttttggtattagggataccagcttcatagaaggacttagacccaagaatggtagatccaccaacagcttgcaccatgcaccaggaaaagccacagacactcaacgccagcccatgaaagcagctggagggaggctgtaccctgcaaagccacaggggcagagctgcccaagatcatgggaacccacctcttacatcagtgtgacctggatcatttcaaatgtgtcattccattaccttatggcctccattatttttgatgagaaatcagctgttaatgttatttatgagttcatgtatatgatgagttgcttctttcttgctgtttttaagatgctgtcttggtctttgtcttttgacagtttgtttgcaatgtatcttggtctcagtttctttgtgttgatcctccttggagttcgctgagttttcttggatgtgtagattaatgttttgcatcaaatttttagctatttggtcattatttcatcaaatatgctttttatatttttctctactctacattttggactcccattatgcatgtagtttatatgcctcattatgtcctagaagtttctgagaatctgttcatttttttgtcattctttttcttttctgttcctcatactggatcacctctattaatgtatattttagaatcttgatttttaatttggcctgctcaaatctgctgttgagttcctccagtgaatcttcatttcagtttttataatttttgtattctagaactgctatttgctgtttttttaaaaaaaatttctatctttttattgatattctgtatttggtaagaaatcattttcagactttactttttaagatatggttgcctttagttttctggagatatttaaaattgctgatttaagtgtttctctggtaaatataaagtctaggcttcctcaagtatagtttcttttgattgcttttttccttgtgtttaggccataacttattgtttctttacatgtattatagttttttcttaagaactggacattttaaattatgtaatgtggcagctctataaatcaacttttctctccctcttcacccagggtttgttgttgtttgtttgtttgtttagtggcttttcagaattaattgtgtcaagtccagattctttgtcatgtgtggctgctgaaatctctgctcagttagtttggagatcagctaatgattggaacactaggtaggtgtgctgtgttatttacaagctaggggtggggggggcactggttgcagcctttatattgaagagaggtttccactttggaccctcctgtgggtcaagggaagaaggcagtgataagtgtgtccttccacttacattacttttgtcaaacatgctaagttgacagcatttgctaaaatacttagctactcccttaaggggcatcttggcttcatgtgatgattggc

SEQ ID NO: 475822 - DNA, 660 bp, Homo sapiens
tcctctgggaagggctcgggttggccgtgttcgattcagctggatccaacatgtggacggtatgtgtagccttcttgaggccagctgtgctgctcatgtcgtggagcactgaagtggacagtccagggaatacacccaacaaaggctggtctaagccatggccagcagcggctttcacagacacttctggtgctgagctgcgagccttaactgtgtcctgctcagtggctgaagatacacacatccgccctgcagagcccctgccatcaattcgctgcgaaactcagcttctttctaagaatgccagctccatgagaattaggaatgaaataagcaattgcgaaagacactttatatgccaccccccaggcaagccaaacactcagaagcaactgtacaaggttgtcctctttgatcaaacacaaaacattacaaaagctgatgaaactggtaacagaattgaaagttatcttgacttgtgagaagtcacattcattttttttttgattgctgacctcaacaccagagatatgaagaatactttaaacaagacccttctgggtgaaggaagagatgcatatccagccatatacatttccattctttccctgataacctggcatcctcctggtcctgagtgttctataaaagccacctttc

SEQ ID NO: 475823 - DNA, 1430 bp, Homo sapiens
tgactcagagattttgagcttgtgttttttccactggaaacatgaagttccagaaaaagaaagtccctctaataacaaaagcttcccggagcctcacccactccctacagtccagtgtgatttgggccttctgggctcatggacaattgctccagagtataggaactggtctgcaagagataagaaataccaggagagccaggcttctggccggggcgtcatgctggtctggggtttggagatgctcaggtggaaacttacagaggcagagaggaggacgtggaggccataacatgggggcacaggcactggccctctgcctggtccatggctgtctctgctttccctggagagccaggcttctggccaggcatcatgctggtctagggtttggagatgctcaggtggaaacttacagaggcagagaggacgtgcaggctatggcatgggggcacaggcactggccctctgcctggtccctggctgtctttgctttccccgctccccttcgttacctggtagcacgggcttgaggaggggctggctggagcggtggggggtctgctgtgctctgggtgccgctcctcccctcagtggcaccattttggcctctcatggtcattctggccaacaccaggcagcacagcacagcagttctgcacattggcacctaccatatctgggcctgcccttctcctctgccacccactatctggttcactcccctgctctgcagtcgggtgaggcccagcatccgtcttcagaggctttgttggcatcagccatatctgggctcgcacccctcccctgccgcttgctaactgctcctgggagagccctggacttttgtgcacattgggtcacaccccgtggtcatctgaaggcgagttctgacgcttactggccaagttgtgctccctggctgggctgggggcccttgacccaggacacagcctcctgggtggtccttgcaagttcttccccctccgtggggctctgcagatgatacgctccaagtccttactccccatggaacataagccactgtcttcttctccagtcttgtctcttctccccaagtacttgcccctctacccttcctttaagggagggtcccactcatctcccttccctgggtctctctccactggagggtagggggacaaagaccagccagacatccatcactggttttctcatccactcattcacctgcctatctttgcgctcacacctggggaacagagcagaagacaggcccttttagtggagaaaaatatgtctctgccctctggtctttccctcctcccctcttccatctcttctcatgagatcctattgccctgatgggacagccgccatgaccctggctttaaggaggaaaataaaaaataataaagccaaggctctcttacaatgccacttcacaa

SEQ ID NO: 475824 - DNA, 597 bp, Homo sapiens
gagacagttgctgatggggtgtgtagctcaccccaacctgtctgtacccagcaggcttcagcccctggcctgggaggggcctggggggagatggctgactatgggtgggctacaggaagaacaacaccttgggtctggcagtggcagtggcacagagagctgccattcgcctctgaggaccatggaggccagaaaaatagctgtggggcctatgaaaaaagccaccagggtggcagcgggaacagcaaatgcagactggctggatggggccagagagaggagccccgcacgagcctggaggcccccaagctctgacagtccctgcggctccaggaagccgctgactctacgaagaatggaagacggccttgagtgctttccaggtactggcacattgccaaggcctctcacgtcccccttcctgcctgaaaatccactgttcatgtgctacttctgccggaggtttagataagaggagggagtacacagttttctgaaggtatataatttttaagccattttgattatgagagtacaggaaaaacataaactatactctggaaatgtatatgtgtatattccatacatacaccccat

SEQ ID NO: 475825 - DNA, 964 bp, Homo sapiens
gtttgatgaaataggagtttttacatcttggtgggagataggccgtccttgccccccacccacacccttacgtttaatttttaagcccaagtgatgaacttctaattgtagaagcaggtgtacatttagggttgagtgacgagttgtcaggtttttctctgtttaagtggctacagctgaatagctcaggccaaacttaaagctcacacttgagacttgacgtgctcagctcctgctaaagaggctccagggcagcgcctgcctttccgggaagctcccctgagggtcaccgaggctgcagagaacacccggtgatgactgcatggatctccttcatctgctgggattcaagctgtgttgctgtattctgctctgctggcactcccccagccccatccccaaaccacacacacacacacacacacgcacatgcgtgcgcacacacatgcgcacacacatgcacatgcacgcacacacgcacacacacacacttcattggttcttcctgcagtggacaactgttaggttttgtcattactgctgctgatggctgtgaggacccagatttggtgagaatgatggttctttgtgtttttaaatcagcaacttctctgggcctttcccccttatacacaggctgtgaggacccagatttggtgagaatgatggttctttgtgtttttaaatcagcaacttctctgggcctttcccccttatacacaggctgtgaggacccagatttggtgagaatgatggttctttgtgtttttaaatcagaaagaatcaacagataattggcattttactctattgctaacttcccggccagcagccagaccagagtgtcctgtggtcactgaagtcaccacctgctcacccgccattgtggcatatccctggattctttggagaggtccccctcacctcctgacttcccatccctacccctcgtccggccaattcc

SEQ ID NO: 475826 - DNA, 1084 bp, Homo sapiens
tataaagccatcactatagagttctgtaccaaacacaggtgccttgtaaacgtggaatcatgcaatatttgtccttttgtgactggcttatttcactgagcatagcgtcctccaggatcatccacgttgcagcaatggacagaatgtccttcctttttaagatggaatcatattccattgcatctgtataccccattttgtttatccagttatctgtggatggacacctgggttgcttccaccttttggctattgtgagtaatgctgctgtgaacccggggtgcacgtgtcttctttgtaaattcccttgccattgggcagacaatgagccatctcactacatgatgcctgcagctcctgccagggcccttggagtcaaggttaggcttgcattgttattcccttttaccatgactctcatccctgtggtgtgtaatcctcagtaaatatggctttgattatttctcccaccttttcagaagttaggatgggagctttcttaagagctgcaacttctgatcctgtcactcttttaagagttgcatcaaagttccaggaattcatccgtctcttctaggttttctagtttatgtgtgtgaaggcattcttggtagccttgaatgatcttttgtatttcagtggcgtcagttgtaatatctcctgttgcatttcttagtgaggttatttggattttctgtcttcttggttcatcttgctaatggtctatcagtttcatttatctttctgaagagccagctttttgtttcatttatcttttttgttgtttttttttttgtttgtttgtttatttcaatttcatgtagttctgctctgatcttggttatttcctttcttctgctgggtttggtttgttcttgtttctctagttccttgaggtgtgaccttagattgtccatttgtgctcttccagactttttgatgtaggcatttaaggctatgaactttcctccaagcaccacctttgctgaatcccagaggttttgataggtttatgactcataacagggatgaaaatcttcactgaaaattagtgaaagtggagtgtaaaatgaaaaaaaaatat

SEQ ID NO: 475827 - DNA, 593 bp, Homo sapiens
ctgtactagtttacattcccatcagcagtgtagaagtcttccctgttcaccacatctatgctgacatctattattttttgatttttcaattatggccattcttgcaggaggacagggcttcctaagagccagactgcagcaactgttattgtcctctggatctagccatctagtgggggctactgggctccaggctggtgctggggaaggtctgcaaagagggaactcacagtttttcgactgtctcacagtgtttgcaatggcaagccacttttttcaaaggctctttgaattcttttggttttcctggtatgttcctgtggtggttcttggagcaaaagttcacaatggtactgttccttacagagatgcaatcttaagctcagattgggtgcagctcttcttctaccgggatgtgaagtacagcaattcagtgcttcaaatatattgcggcagtaacgtttctgagcattttgagtaattattatttcacggctgtcatttcagtgtttcttggggttttaattgttttacttttggggtgttgaataaactcaagccatgctcattgctgtccaaagttaatcactgcc

SEQ ID NO: 475828 - DNA, 1989 bp, Homo sapiens
agagattttgaagtgatttttttttccccagcagaagttaaatgccctccttcaaagcaggtggttctggctggatgatcagaagtgcggctgatcaggcccctgtcgaatggccagagagaagccatctgggatcccttcagtgcccctgtgtgtgggcttggctggcctcatgaaccacacagggatttttaatcaccaatccagtccagtgaatggctcctgttatttgttgcatgagaagaggaagaagaagaagaaggagaagaagaagagaaagagaaagaaagaaagaaagaagatagaagaaggggaagggaaagggggagaaggtgacaccgggcttgaaactttcacctgcccacctggccacacagaccacgcacctgttgtgcaagagcccaagaggaaaacgccctggagcctcacagcaatatgtgaaaggagcagaatatattctgcagaatatattccaggagcagaagaaaacagcaagctaggaaaagcaagaggcagcgctggggactcacctgcccatatggtgattcctatctcttccccagacctaagaagataatcatgtacagttgcacagttcttacactgaacaaagacagcaggctgaaatccattctacactgtactctgtgtgccctggcaaagggatgcttttctaaatctggacagacaggactcattttcctaatttgcacacagctaccttgtagggtagtaaaccagctctccccacctcacaacttctctcttgtgttactgctgcatgcagggctttgatgacaagtcacacaggtgttctgtgtttaccagcatcccccaaaccttgcactaccaatcccccaatgcagaagcacaggagacagagttgagcctctatttcctacactttgcctgtgcgacagccttacaagttgtggagaacattgcacatgctgaacctttaacgtggacgatgaatcctgtgaagttagggaccccagctgttctgttccccaccttcctagcaaagcccccagcacacagacggggctgcagcaacgtccattgaatagctcagacatccacttgtctgcaggaggctctgctcccccatccttcccccaggcctgcctggtcccttgggctggcacttatgcgtcccacagcatttggttcttgatcttttccttggtgaaaccttccttgcaactcctgtacaaagctctttgggatcggacccatatgccatgcccatgatggctgccaactgtgggtcccctttctatcctgttcaggcgtcaaggacaggggcaatggcgtcttcattttgtgagtccaatgcccagtgcactgtttagactgcggagaaatgggtcttcagtgattaaataagagtccctaagattttgcttctgagaatctttcacatctttaattaataacaataataatacttagttactgcgttacatattttccttatcttgaattgagaaacatttcaaacatacagaaaagcagagtaatacaataacaactaccaccttctactgaggccagacaaaagctaatatttactacgttgatgcaggcttttttttttttttttttttttttttcaaaataaagcaccatgaatacaggtaactacagataaacctctctgtctccatttcctgtccccctgacacaacttctccactcaagttggtgtggcttcatccatgtatatttttggcttttactacatatgtatgtgttcaaaaactatgaactcttctgtgtatttaaatattacatatatcggattacatggcatgaaacattttataacttgcttttaaaaatttaacacttgaaatttttccaggtagatacatgtagatccagttcattcattttatttcaaaactgtattatttcaaaactagagtttatcaattccatgaaaacctcatcattatgcacattcttgtactaatctcctggttc

SEQ ID NO: 475829 - DNA, 520 bp, Homo sapiens
cttcagttgctgataacgtgtcagtattcattcctgaattgtaccaaatgaacgctataactgtgcaggagaaacaggctgtgctgaaggagctgctggacaagaagcagtcagaggatggagccatcctggggcctggggaaacaataaaactgaacaaaatctatgcgcccctggacagcaggcagtgcaggaccatggccctgaagagcagggaaaatgagttaagccacactttcaccctggccatctccctggaggtactttctgggtcgctcagggagatgagcacaaacacagctcagcgctcctgctgcactgaagaggtgacgggagcactgctcaacgcctgggacaccggggcaggcaccggagatgaggaacgggagggccccggggacacagggcacccgctggctggagagactgcagggaggatgtgggacattcagatgaggtcccaggaacaaggactacacccctgagaatggtccacaggcctgaataagcacaaaactcc

SEQ ID NO: 475830 - DNA, 533 bp, Homo sapiens
tggacctaaacaaatgaacaggagtctgacttgggatgagtgggcaatgccaaggcctgtacgagttttcctgtggctcttttccaactctcagctacaggaaccacacattatacaagttaataataatcacatccttgaattccctgctcccgtccacaccataaatgccctggtggcaaccgcctcctgcaagctcttcgggatcacagacagctcacagtgcagctcctaccttctgcttcggaagcaaagtttaccttctttgaatagtttggtgagcccagaggaaacactggatctccatggaaaaatcacccccataaagggaagcagaccccgacctgggccgcaatcttcacccagccctccatcttctaaaaataacagcgccaggccactcttccttccagctgcaggctcaggacagggactttctaaaaaaaaagaaaaagaaaaagcacttcttcctgtttcactagtactagacacagatggccaaggactccccacacagatgccctaaatttcac

SEQ ID NO: 475831 - DNA, 748 bp, Homo sapiens
tagcaactccttcacaaattcataccttttctgagaggaaaatggtgacagggctgcgtggacccattttatcagctcctccaaaagtggaactggccctccctggcttgcccgggctgagactcctgacttcagcactgaatttggcggccacagaacgggccgggaccggctgcagggtttcagttcgagtttgctggtacctggctggctacttcctgaaaatactatgttccccacccccaaaatcatctcgtgccccacaggggaagtctctagagccaggcccacccggggacagcagagcagagccctccctctacctccaggacctaaattctgcagtagggccatctgccctgacaccttccaaaagggtcatggtagaagatatgaagcagaagtctgcgaggatttcatcttccaactttgaggaccagagtgcccagcgtggagcagggacagaggagaggtctgcgggtgtgtctggaggaccaggttgggagccttgcggaggtttctgtcctggagccatcaaacgtttcctggacacccaagggctgcatggttgtggcaggggagaggtggagactgttgatgaggagcactcaggacgtcagcttttcttgtctgaattggccaatgaaagtaaggcctagcaaactctgaaaacctttggagggaaataaacgcatggaagttcatcagctctggactgccaaatgcttccctggcagagctggagaaa

SEQ ID NO: 475832 - DNA, 690 bp, Homo sapiens
cctgagctggtgatgaaagctggatcattgagtaccatctgctctggaatggctgcagtgcaagcggatgtttgccctagactgggggtacctgctgtgcttgggactcacttcttgaacagaggcaaccaaagggtgttatctctctggttcctaaggttggttccaggccagcaaacaacagggggtgccccaaaaggtgcccccagaaacctaggctcccctatcagggtgcatcgtgtgggcagccccctcttgtgcacacttctctcgaatgttcagagaaagggcgttcgtgctgagaatttggctacatttcatcccagcttcccagggactgtgatgcttggcgtgtgcctggaccagggtaggcactcattttcctacctgatgtgtgggaattctggggttgaattgcttctctttgtttgcgttatcatagacacctgccaacatgtgtgtgtgttggagggtgggctatgacaacaatgggattttcctattttaagggactgatctgtgtaaaccaagaagtgtctttcttcaaatatgaagcctgattatctcaaagtaattgcttgtgaggattactttaactcttcacactgctatagagctttataattcacaaaccagtgtcatatacagtgtagcatttcacgtgactgaccgtaattccttctttgtgac

SEQ ID NO: 475833 - DNA, 670 bp, Homo sapiens
acaggaaaatcaagaactgtgaactgccgtagcatctgctctcactcccagggagggcagctctgggaggaatggcccacggagcatgcgcagctgtggccttccagcctgcccctctggccctcaggtgccgcggtctgcttctcttcttgtcttctgtcttttcaccaccataccggcagctcttggcgtttgttagcaccttccatccatccaagtggcttccagagaattatctaatgaattcataccagtccacagctaaggtgcatgtaataggaatgagagccacctgtgtttcagaaagcgtctgggattttagagctgcttgtaactgcagcctaacacagcctcagccgactgatacatccagtgtcgtcaaaacagagcaggtattgttccattctgtacagtttaaccttaatcgggaccctcatgtgcactgggatcctgatttgggttcatggacggaagacgcccatgtactgtgtgctccagtgctccaggttgtggcacatggccatcttcaatatagcagtccactctgaatttaaatttgtcaccattttccttagagggaatgagaaggaaaatgaatttaatttagtataaaaaataaacatttctgggcactggaaatgtctgtggtgttttaagagctgttatcatt

SEQ ID NO: 475834 - DNA, 863 bp, Homo sapiens
caagagttgttttttagggaccactttgctgcatagccagggtaaatgcccactgccctcatgcccatgaatcacgagtccctggaagctgtgggagagaagtcatgtggaaatgagaccccagtcgagtggtataactgtgggagtgacgaccgtctccggtcctgtccttcatcccaagatgagcagactccattgatgtgcatttcatatttcctgcatgtctcggtgcagaccagcccccctcaaattttcaatggtcacatgtggccagtggctatggtgttcaactgtgaagatgaggacatacctctggtcaggaagcacagcctgggctccgatgctggtgctgctcctgcttacggatgtgactttagacatcgtcctatcctgctggaacccaggcttcctcaagtcaaaaatgaggattttcatcggggtaattcaggaccacattctggtagagatcatcagttgtgagtaacacaatttgatgtttgaaaaaacatgtattgaaaacctcctgggtagcagacattgggcttggatatgggagcttgatgtttaaaaagacatggttcctggtggtgagggagacagcatttgggaactccctgtactttctgcataatttttctgtgcgcctaaaactattctgaaaaatagagcctatatatattttgaaaagatgtggtccatcattagcctgactgtacctttgtacaaattagacagaggcacctctttctgaaaccaattttattgccaacaatcagaaagttgtgctaataaatgtatatgtattacatatatgtatatatttataaatacacatacagcgaccacaatgtgaatgatgcttc

SEQ ID NO: 475835 - DNA, 2006 bp, Homo sapiens
ggttcggaaacacagacagggcctggaaccatgcttgtgttaacacccttggctctgctgatcgtccctcaaaatatttcagcacatggtgacctgagccaagctacaactgcagcaaacccagacctgactcacctgtggatcagggcaatggacctgcccttctgcagcctggcagaatccatctcaccactctctgcagcaaacccagatcctattcacctgcaaatcagggcgatggacctgcccttctgcagcctggcagaatccagctcacccctctctgcagcaaacccagatcctattcacctgcaaatcagggcaatggacctgcctttctgcagcctggcagaatccagctcacccctctctgcagcaaacccagaccccattcacctgcaaattagggcgatggacctgcccttctgcagcctggcagaatccagctcactcctctttgcaggaaagtatcatctacttcactcttaactattcctttctacaagaatacccaacaaaaatcaaatgtgataaaacatgaaaaagcaaggcaatgtgacccatgtaaaataggaaacaggcagccaataaataataccataccaaagaggtatgagtaaaaagtacatgtaacagataaaaaattacgtactagaaagtatttgacttgttcaattgtttaaaaaagacagaaaaggaaagaaactgggagaaagaacaagagggataaataaaattatatcccagcacagaagacataaaatgtgccatgtcaataacaacctgaattataaatggactagacactccaggtaaatgacagtgattctcaggcaggtaaagtagcaagactcaacttcaaactctataaaaaatgtattttaattattaagacactggttgaaagtaaaaggtcttaaaaaaagatatatcatgcaaattatgcataagaaagttgtgtggttattttactatcagaaaaaaagtaaacttcaggacaaggaatactactagagattcagcaacacagtttataatgttaaaaggatcgatgtatcaaaaagacaaaaatatgcaaagtacatatacacctaaaaacagagcttcaaaagtcataggacaaaatataaacagaactaaaaggagaaataaacaaattaattattacagttataaattttaatgcttcttttcctgtaattaatgtaacaaatatacataaaatcagtattgctttggaagatttcaacactatggaccaacttgaagtaattggcacatatagagccctcctcccaatagctgtagaagacaagtccttttcaagtgtacataaaactttcatgaagatcaatcatatgatgggtcataaaaagtctcagtaagtatcaaatatttgaaataattctgagcatattctctgtttttgtatgtgtgccgtaaggaaggggtccagcaccataattttgcatgtggatactgagcaccatttgttgaaaaaatgatttttctcccatgatatgctttggcaccattttcatacatcaattggccacaaaagtatgtgtttcacttctggactttcaattgtgttccacagatctatagttatatccttacttcaataagatactgtcttgattattgtagctttgttctaagttttggaatcaggaagtgtgagtccttcaactttgtactttttcaagaatactttggttattctggtttccttgcatattcatatgaattttacaatcagcttatgcattttttgaaagaacccgctgggatttttacgggaattgaattgatctttagatcaccttaggaagtactgccatcttaacaatattgtcttctaatccatgaacattaaatgtctttccatttatttaggtcttttttaatttccttcaaggatgttttatagcctcagaggacaagttttacacttgtttttaaaactgtatttccttgatgtttattgtttttaaggctatgta

SEQ ID NO: 475836 - DNA, 2566 bp, Homo sapiens
agtctgcctggagagtggggagccaccatgggagtccgagaccacggacaggacaacagaaactcactgctggggctcattccctttgggcagccccaggcagttacaaccaggatgactgcgacgctgtggaaggagcttgcagccagtggcccttctgcgtgggcctctgtgcggagcatgggcagaaagaaaggaaccaacgtactcagcaaacagtgctcggtgtatctgctgccaggcccagtgctgaaccctccagggcctcaccgagggtccatgcagatcttagctattcacaccggatgctcctggagccaggatgcggtccttcagaccttggccatggtcctgcttgcagggtcctcaccaaagcacagggctgcccctctggagggaaaaagcctcaggtggtgctgctcctgccttcctgtgaagtctttccagtctccccacaagcatgggttgagcacctactgtctcccttcacaaggctaagagctggggatacagcagagactagacaaagtgacagtcaccttttctgatgtggtttgcccaagcagtgtctgaattaaatctcgccagttgaagcctgccagggtgctgctggtccagagagctcactggggctgggcaggaaacattgtggcttttgcaccctggctaattccattgcgcagctttcaatgccactctatttaaatccctgtcagaaagcccttaaggacagccagttttatttactgtcaatgtaaccactcctttggttgatactggcctaaacacctccaggaaagaaagcccgggctcatcaactggacctccatcctgccgaaggaacaaaggaggcttcctcctctccttggcatatgtgcatattaaaaaatttattgaacctattttaatatccttcgactaatgggagagttttaagacctttctaagtatagtagtagtaaatcctgctgcgtatttcacccaaagatccaaaataaaaatacctttgattgagagaggcgagtcgcccactggggcccataccttcagtttcagtagctcagttcaacatcaacaacaacaacaacaacaaaaaccacattgtagcaatcagccctctaataagcctctaactcggtttctaccttatcccaaaggtataggaaatagcactgctttttttaaaatatcaagaaaacatcatttgctctaaaatgtccctaaaagcaggtctaaattgccaataaaggctaggtaattgtatcagcatggatcagaaagcatttctcaggcccgatgaaagagtttgcagggctgaaggactccaaagctgctgcccaatcccccccacgcttagtcaacagcccgcaccagcagttcgaagggagattttcagcacaatgcaatttcccttttaaagccaaacgcctctctactccccccattctcattttgttctaatttgttaaacttaatttcttctgaggagttgtctggaagctcaggtcaaatcagagaaactttctggctgtttgtttttgaaaagcagaacgttctccttcctaagcctctgggtctgaattacttaattattctctccttttcctcctcgtccaggtgaatgatatatgcactgaaaaagcaaactgcatgggtggcttgtcttcttaaccacatcaccagcctcgctctccaccttagagcactataatcacttgactagcaaacacatatacagtataaatatttaagaaaaagtaaattctattaagccactgtgtgatagatgcagtggtaggtacttatctttgaaatattaaactctagacatttatatccatacaaaaaagagtttcctgccatttgatgagaattatgtgcctggcactaataaaatattaaactccaatttaaaagataagtatcttatccacttttttcataataaaacattttacagtgctcaagaaagccaatatgcatcagaatttccatacaatactgtatttacaaactttcataaaagttttgtgtctgcatttatcagtggctggtttcacactagcatcctgatcattctccctaatgatacggtgcatttcaataatgcatgatggaaggtgtacaaacagcgctttgtttttgtgtatggtaattccatatttttggttagtggttctccctggcaattaattaaatggaggtggtcactaagattgcattatcccttttggtccccattatataaattaatgtcaaactgatgcaatgtttcatgtttaaaataacagatacaagtgttaaaaattatagcctgcagttttcctatttgacaatgcattattttcagctgcaaatgtcagtttctaacccctgccaagaatattgtggcgaggcaatgagtaataagtgttagttatcaaatttagtgtcttttgaaatttgcccgtgttgccagggtgggggtggggaagcagtcgatgcacttgtgtaaatttatggaagctccacttccagagccctgtgggaaaggaaaaggattctagcaggcagctagactttccac

SEQ ID NO: 475837 - DNA, 1396 bp, Homo sapiens
cacgagtggaatggcatggattggaatggaatggaatggaatcaacccgagtacaggggaatggaatggaatggaatgcaatggaatggaatcatccgtaatggaatggaaaggaatggaatggaatggaatggaatggaatgcaatggaatcaactcgattgcaatccaatggaatggaatggaattaacccgaatacaatggaatggaatggaatggaatggaacggaacggaatggaatggattggaatggaatggaatggaatggaatggaaaggaaaggaatggaatggaatggaatggaatggaatggaatggaatggaatggaatgcaatggaatggaatcatccgtaatggaatggaaaggaatggaatggaatggaatggaatggaatggaatggaatggaatggaatcaactcgattgcaatcgaatggaatggaatggaattaacccgaatagaatggaatgcaatggaatggaacggaatggaatggaatggaatggaatggaatggaatggaacggaatggaacggaatggaatggaatggaatggaatggaatcaacgcgagtgcaggggaatggaatggaatggaatgcaatggaatggaatcatccggaatggaatggaatggaatggaatgcaaagcaatggaatcaactcgattgcaatggaatggaatggaatggaaaggaatacattggaatcaaacagagtggaatggaatggaaaggactggaatggagtggaatggaatggaatggaatggaatggaatcaactcgattggaatggaatggaatggaatggaatggaatggaattaacccgaatagaatggagtggaatggaatggaacggaacggaatggaatggaaaggaatggaatggaatggaatggaatgtaatggaatggaatcaacccgactgcaggggaatggaatggaatggaatgcaatggaatggattcaacttgaatggaatggtaagaatggaatcaacacgagtggaatggcatggattggaatggaatggaatggaatcaacccgagtacagcggaatggaatggaatggaatgcaatggaatggaatcatccgtaatggaatggaaaggaatggaatggaatggaatggaatggaatggaatggaatggaatggaatcaactcgattgcaatcgaatggaatggaatggaattaacccgaatagaatggaatggaatggaatggaatggaacggaacggaatggaatggattggaatggaatggaatggaatggaatggaacggaaaggaatggaatagaatggaatggaatggaatggaatggaatggaatcaacgcgagtgcaggggaatggaatggaatggaatgcaatggaatggaatcttcc

SEQ ID NO: 475838 - DNA, 699 bp, Homo sapiens
agggtttttgtggtgagatgaaatggctacattaattggtcagacaagactgcaaatagtaaaactgtgtgaaagtaacacagataaaatcattgttcctttaaataaggaacagttctacaataagcctgtcagaaatgcaaataaagatgcctccacaaagacaaaaaacctgaatcaagcatcatcgactcaccaggtctgctggagtttgctgggggtccactccagaccctgtttttctgggtatcaccagcagaggctgcagaacagcaaagattgctgcctgctccttcctctggaagctttttcccagaggagcccctaccagctgccggctggaactctcctgtgtgaggtgtccgtcgacccctgctgggaggtgtctccctgtcaggaagcatggggattaaatgaaatggttaaggatctggaagaggtgaatacagttgaagaatagttatcttgggatgggaagaaagagacacagagagagagaagagaagagagaaggagggagggagggagagattgagagctagtgtaagcatgacggagtgcacaagctgagagcaagggcaggaggttcacagagaaaatgattggtgttaggaatttcaaaggtggaatattcctgttgatgacttcttaaacatgtgacactggcaaaagggtcgctgatatggaaggatggatttc

SEQ ID NO: 475839 - DNA, 764 bp, Homo sapiens
agatataattaggagattatcacatcaacctaatttatgccaggctataaatgactgacactcctaaagaactaacagcagctgagcagctgagcagtgcccccttctcacagggattcagagcaagccctcggcatcttagaagacgagttgcagcggccgcagctgcccgtctggaagaagtgaagcccgtggtggaagttcaccatcagagtgagcaagaaacttcagtgaggaaacgaagaatcaagaagagcagccgagtccagccagaattttatcactctgttcaaggtgcttcaatcaggaggcctgtgtggcctttatattgttataaggcagcaccattgtctttttctaacctggtgccctgttggccacaatgccacctttcttcagaaactcagggctcaactaggagctggtcttcatccccttctcacatcctgagcacgttgttctgtgtgctctgatttttctttccttggttctggctcatgggctttttaccaaggctggggcttagaaaatgccattttaaaacttgtaaagtaattttatgactgcaataattttatttgctttggcattagaaaaaagtgtctgtatggctcatctctatgctgtggggagcctgttgttgtttcttgtgccaacataggggagccatcaagatttggcttgaaaatgtctttgtaaattattgaaacagaactgcccttctgtgggggtaactgtgtggcaggcacatgtggagactgtgc

SEQ ID NO: 475840 - DNA, 1085 bp, Homo sapiens
gcagcatttgcaaaaatcccaggcatgtgaggggggcatctggaggaggcaacaatagaagcaaagttgtgaggatacatgaggagaatttctggtggtcctattgagctggaatttaggaagatgatgagaaatagagatggagaagaatctaataaacagaggtggataatagactgtgaatacctgagcttcagaagaactgagcggggtgagggaggagggatagatggaaatggaaatggaaatggcaatgaggagcagaggccactaaggtgcaaggctgagaggtcctgccatgagcacacagctccatgggacccccttcagtcctaccttctggagactgtggaaggtgatgccaatgacagcatgtggaatctcttacaaagttggtgttcttgcagacagccaagaatgataaacaaaaacacaaaaatgatgaaacacaaaaatgataagtcacaacttttacatatattctatccttctaccaggaggactacacctttttaatcacttggaaagccatactcaaatttagaattctcagactcctgagagggaaagagggcttgggactcacttttcagaactgtgttttcagaattgtgtctttacactcaagcatgcatggatttataactctttttagcatttcttgtaggacttgtctggtagtgacaattctctcagcatttgtttgtctgaaaaagactttatttccccttgatttatgaaacttagttttgtaaaataattcttagccaacagttgttctgtttaaggaggttgaaaatacgacctcaatcccttttggcatgtaaagtttctgctgagaagtctgctgttaatcttatgggatattactttaatgtttatagttctttgtaacctaatttggcctttggtgctttcagaggtgaagaatttgtatgagttccttggttttttgtatgaatctttgtattatggctttgtcagatgttgattttagtagcaacgtgcttggtgttttttgtcatgaaatctattttatctgacagtacaagtgagtctctgaccatgctgggctgcctggaatt

SEQ ID NO: 475841 - DNA, 912 bp, Homo sapiens
ttcagagtcaaaatataattaattgttgtggttcaggttcagaagaaccctatggagcccatcctgtgccgtcccctcctctcagacagcggctgcggtgagaagcagggctgggtcccttttggaccttaccaggtacattgcggctttcttgaattcagcccccaaaggcttatcagacatgagcttttagaagcattgagggtgaagccacatctttcagatacacaggttccagaagatgactctgccacagcagagggactgctctgttttaataacttggcatccttaataatattccattgtagcgatataacacttttcttatccattcatccgctgatagacatttgggttgttactgcctttggctttatgagtaacattcctatgaatattcatatagaagtgttgatgtggatatatgtttttgattttcttggctatctactgaagaatgaatttgtcaggttataagttaactctacattgaacattttagagaatggcaaactgttttccaaagtggcttaatcatttttacaagcccactaggaatatatgagtgttccaatttctccatatcctccctaacacttattgtttttcttattttagccatcctagtggtataaagtgtatctgcttgtggttttaattttcatttccccaatggctaattatgtttagcattcattcatgttctcattggccattagtagatcttctttggagaaacgtctaaatactttgtgcattttaaaactgtctttttactcttgagttgtaagatttttgtatatctggacacaagaatctaattgtatagatggtatgcaaatattttcttagtatgtgggctgtttactttctagatagtgtgatttgaagcacaacattttaaatttt

SEQ ID NO: 475842 - DNA, 643 bp, Homo sapiens
agcaggcatttcaacctcgtcacgaccttccgtagcctctctaatgacttctctgctagcatcacagacatatcacaaactttgccccacctctaacactggagattacaattcaacatgtgattggggcgagtacgcagaggcaaaccctatcagtcaggtagctcctttgttggctgcctttggaggtgagaagtgctatggtagcaaagggcagaaagaaaaagaaaaacaaatattaccaccagatcccctgaatgcccatggtcactttagcaccacccaacatgaggaaaagtatgacgcagaaaaggtccttgtggaaagaaacaggagtttcacctggttccagttaaatgagcaaaaacatatcaccatttggtgtccaaaaaataacaaaaggaaaagtgtcaaaagatctagtgagcaacttgttcatgtttcttcctgggataaatctgaggccagctttgcaacagaatcttccgggaattaggagggagtcattaatccttcaaactaggatgtcagaatgttcagaaaacacctcacatgcataagacctttctaaactttccagattataaagggctttcagagacttttgttcaatacgtgatgcaatagaaacttagtcgtaatg

SEQ ID NO: 475843 - DNA, 625 bp, Homo sapiens
gtggaaactggatgtttgactatgggtcaagtcaccatgccacctgaattgcctatcatgaactgggtgctttcagaaccatctagccatgaagtgggttgtgcacagcagcattccatcatcgaatggaagtggtgtataagtgaccggactcgagaaggtcctgaaggcaaaagtaagttacatgaggaagtggctcaaatgcccatggtctccacttttgccaccctgccttctctaccccagcctgcaccaatggcctcatggggagttccttatgatcagttgacagaggaagagaagactagagcctggttcacagatggttctgcacaatattcaggcaccacccgaaaatggacagctgcagcactacagcccctttctaggacatccctgaaggacagcaatgaagggaaatcttcccagtgggccgaactttgagcagtgaacctgattgtgcaatgtgcatggaaggagaaatagtcagatttgcaattatatactgattcatgggctgtaagccaatggtttggctggatggtttgggacttggaagaaccatgattggaaaattggtgacaaagaaatttggggaagagggtacatgtgcacattgtgcagg

SEQ ID NO: 475844 - DNA, 886 bp, Homo sapiens
ttcaaagggatgtggtcctgtttggaagtggcagaggcatgtgtaggggatgtggtctgtaatgcacagttggcctcttaccttaaagcttgctcagcaaatggaaatccgtgtgatctgaaacagtgccaagcagccatacggttcttctatcaaaatataccttttaacattgcccagatgttggctttttgtgactgtgctcaatctgatataccttgtcagcagtccaaagaagctcttcacagcaagacatgtgcagtgaacatggttccaccccctacttgcctcagtgtaattcgcagctgccaaaatgatgaattatgcaggaggcactatagaacatttcagtcaaaatgctggcagcgtgtgactagaaagtgccatgaagatgagaattgcattagcaccttaagcaaacaggacctcacttgttcaggaagtgatgactgcaaagctgcttacatagatatccttgggacggtccttcaagtgcaatgtacctgtaggaccattacacaaaggttagaccatgcaaccttcgacgtccccaaacttccccaggcccctacccctagatccctagctgtaactaccatatctgcaggtactgtttctagaaggaagtaatggatatttactgtttcatagcaaaccaaatctttatatttattgaaaatgtttgacagacatagatctatatctacatctatatctatatctatatctgtatctatatctatatacagatgcatatttacacatttatatttctatttttctttacagatacttaggagatgcacattagccaatgtgctaaaaattgtgatttgttgtatattatgtaataggcatacagctcagagtttatggttttgatttc

SEQ ID NO: 475845 - DNA, 511 bp, Homo sapiens
cacaacaggccccggtgtgtgatgttcgccttccttctcagtaacgttagtccatctgaactccgcagaacaaacctcagagtcttggctccttgtggtttctcagcttctcccagttttggcggccttgtccctccatgcctggccacatctcatcaggttgtgaagagaaggatgtttgccaagggcttcacagccatcttcccaccagaaggaaatagcctttctgggaatagaactggtagagaagaatgcagagagcaatgcttacgtgatgcaaatggatgtaaacatgcttggagagtaatggaagatgcctgcaatgattcagggattaaaaataaggctgctataaatattcacatacaagattcagacaaacataagctttacttcacttatgaaattgtggggtcacatggcatacaaaaaccttgcactcgatgagagtttcatatggacaagacctaaaggagaaagcctaaatattcccgatggacttcgtaaagga

SEQ ID NO: 475846 - DNA, 657 bp, Homo sapiens
tccttgcgggggattgtgcatgtctctgccccagcctctccctggggaccctctccaccaacagcaatggagcgaaaagcccgatgtctgggggactccagcagagcccctcgtgactcttccccctgcttcacggtgatgcctgcaccagcccacagtggaagagagaagctccttgtcaacttctgtgtggcacaccgttccaagggatgtcgggggccagactcccccaggaacaagaaaggcaggtgcagcgccactaatacggcttttaaaagtctcacaaaaccaacaaagcccacacggagacctcctactgggaataccacatctccaggggccacgcctccagcttccacgcctccagtggccatcactgcctgctgccttgtcccagaaaccatggcaagagtgcccaggcttgagcccacacgggtgtcagtggggtgggtgacacacatctcttcaaaaagcagcatccttgttccctgcatgcttgctgagcttgacataagtggagtcccccaaacccagaactcaggtcccccaccagaccttagtttggaatgactgaactactgatcagtaggatactccagccccagaagaattaggaagggctgaggggcctggggagtggtagctccttcctaagaa

SEQ ID NO: 475847 - DNA, 721 bp, Homo sapiens
ctgcaaccagggggtcctcaggatcctcctggaatctcttcctcagcatctggctcatgataaggtttcaggattaactcctcctgcaaaagatgaggaatgcaccatttggcaagttgggcatcactggatcataactttagcttctttccagaccttactagaagtaatcctatcatccctgctggcaatggtccacagactcctgttgggaacttttgtgggggttccccaggcagaaggctcacagcatttgtgcagcataaatctactgcagcagtaccagctgtggcaggggacaaacattgtaaatcccatgaagtatatggggtcccatggttcagcagagcattttccattgctggggcccttagggatctccaggatttatcccagagtgcccataatggacagtacaaaagtgggaagagtttccaagaaagcaaataccccatcatccaccacaaaacacactctcagcttattcatcaatgtggcactggggtccttaatgtgtggcaggcagagacagagtcttgcttcttcgccgaaactggagtgcattgatctgtattttgcaaatattttcttcaatatgtggcttgtctttttgttctcttaacaaggtctcttccagagtataaactttaaatattaagaaatccacattgtcatttcttctgtgtatatcaaccttttgtgtcatttgttaaaattcatt

SEQ ID NO: 475848 - DNA, 967 bp, Homo sapiens
tctctctctctctctctctctctctctctctctgtcacacacacacacacacacgtgcggagcaggacaggttgaaaataggaatgacatgaacccgcgcggaacagctgccggcgcggtgtccagggcggcaccccgcccggtcccggcccctccagccctgggcccgacccctactacgcctctgcctcgacgcgaacgcggagcccgagcgcgcgtcacgccgtgtggggccgaagaggctgctacccagaggcggagtgcgggctcgcgagggtccccaccccactctcgctcccgccagcacctacggactcgcgtccccgccgcgcgccgactcgggagcagcaccgcccccggcacaggagcctcacgcgcctcttacctaacaggaagttgggtggaagcagcgcggacccacggcacaccgaacgcactccaacagaacccgacgcagacacgcgctttcaaccggcggagacactggcaggagcctgctctgtcacttctcccaagatgatttatgacctgttcagaaagcgcaaagtcatctcctttggaggctgcatcgctcaaatcttcttcatccacgtcattggtggtgtggagatggtgctgctcatagccatggcctttgacagttatgtctactctagaccctgtttgcctgggtatcaccagcagaggctggagaacagccaagattgctgcctgtttcttcctctggaagttttgtcccagaggggcacccaccagatgccagccagagctctcctgtatgaggtgcctgttggcacctactgggaggtgtctcccagtcaggatacacgggggtcagggacccacttgaggaggcagtctgacccttatcagagctcgaatactgtgctgggagatctgctgctctcttcagagccatcaggcttttcaaagatgctttaagtctgctgaagctgtgcccacagcc

SEQ ID NO: 475849 - DNA, 842 bp, Homo sapiens
gggacgttctcagtggcagacgccatggcgaggagcggccaccagcttttgccgggggcttcaaaagcccacgtctgcatcccggctgcgtccccgcaagaactgcgtgctgcaggcaccatctgcgccgagctgggactgagccggcctggctcccctccctttcagcagggcagccccacaaaggagagggcctgccagccccaggtgcaggtgtggaccagcttggtggctgcaggaccttgggtgcaggcgtggatcagcttggcggctgcaggacctcgggtgcaggcgtggaccagcttggcggctgcaggacctcgggtgcaggcgtggactagcttggtggctgcagggctgcaggactgcaggacctcgggtgcaagtgtggaccagcttggcggctgcaggacctcagcctcctgctgcaaggacacagaggcccaggacctcctcccagcacctgagcaccaccctgcttttgcccatggacacggaagtctccagctcccaggccccctttgacatcgtcaggctgctcccctcaccaactcccctacaccatggcttctccctgtctctgactcaacagggactgagtgcagcaagggccctgggggaggtctgggctttctactgccttctggttacagcttctcctcccccgtatctgtccttcctcctggcctaataagtccacattttatttatgtgtgagtacatgtgacaaccaataactaatgtcccaattgaaaaggaaatataacacaaacttaccttagtttgtataatatcaactttctgtctcaatccaggtcttgtccaaaaagtattgattgagg

SEQ ID NO: 475850 - DNA, 552 bp, Homo sapiens
ccggcctggcagccactcctgttccagtgcagcactccaccatgcagaggggtcggagaagcagttgtaggtcacagcaaggagtgggccgtggggatcatggccaggtcgtgaaatccaagtggcacccgccatggcaccagccagaacaggtcccctcctttccaaagggcagagctggggctggccctggagatgctggggtcagcaagggctggggctgcgctccctcctgggtctgtgtcaaaagcagccggcaccgaagcctgtccacatcggccaggccctgtgcaagccgcacttcccagcagacggcacggaattgctgggttcttcctcccacttgccgattaaagacgtcagcatttccccacctgacctcagggcacctcagcaaggagcccgcactggcggctccatctgaacgatgtcctggcttcctgcaaaagtcttcatgtgaacgcggcacgtttcccaaagggagcgtggtggatccctcgttctgctcagagctccctgccagagtgtccccaggttgagtgtttgggaaac

SEQ ID NO: 475851 - DNA, 1318 bp, Homo sapiens
gtaaagagcacctgtgcacgtgatgtttttctgcaagaggcaccgccgctcactgcgcgctcatgggcactgccacttctcacctctaaagggcactgccgttctccgagtgctcaagggcactgccgttctccacgtgctcacgggcaccaccgttctccatgtactaaagggcaccgccgttctccacgtgctcaagggcaccgccattctccaggtgctcacgggcactgccgttctccatgtgctcaagggcaccgtgctcacgggcactgctgttctccatgtactaaagggcaccgccgttctccacgtactaaagggcactgccgttctccaggtgctcacgggcactgccgttctccatgtactaaagggcactgcagttcgctgcatgctcaagggcaccgccgttctccatatactaaagggcaccgccgttctccacgtactaaagggcactgccgttctccacgtgctcaagggcaccgccgttctccacgtgctcacgggcactgctgttctccatgtactaaagggcaccgccgttctccatgtgctaaagggcactgccattctccatgtactaaagggcactgccgttctccatgtactaaagggcactgcagttcgctgcatgctcaagggcaccgccgttctccatatactaaagggcaccgctgttctccaggtgctcacgggcactgctgttctccatgtactaaagggcactgccgttctccacgtgctcaagggcaccgctgttctccaggtgctcacgggcactgccgttctccaggtgctcaagggcaccgccgttctccatgtactaaagggcactgcagttctccacgtgctcaagggcaccgccgttctccaggtgctcacaggcactgccgttctccatgtactaaagggcaccgccgttctccatgtactaaagggcactgcagttcgctgcatgctcaagggcactgctgctctccactcgttcaaggtcaccgcagctctccacggcttaacggcaccaccggtctccacgtgcagccagggcaccaccactctccacccgctcaagtgaatggatttcctaggtcataagatctcccttaagtcccaaccctggcagggaactgagggccagggccgggccgggcgaggcctggtaagacggcgccgggcagctcttaaggctcacaagttctctttcctcatcctacacgtttcttcacgccccgccttttctgagttagtttgaatttcaaaacaaaataaaactaataaaaacaaaaacaccaccccctcaacccgacccccc

SEQ ID NO: 475852 - DNA, 2385 bp, Homo sapiens
acctctcagcagcgaggagacagtgtgatgcagacacagatgcagacacggatacagatacagatgcggatacacagatgcagatgcagatccagattcagaggtagatgcagatacagatgcagatgcagatacagatacagatgcagatgcagatacagatgcagatggagatgcagatacagacacagatacagatatagatacacagatacagatgcagatgcagatacagatgtagatacagatacagatacaaacgcagatgcagatgcagatacagatacagatgcaggtacgggtgcagatacagatgcagataaagagacagatgcagatgaacagactctgtcttatatctgtatgtgtatcttccttgaacagactctgtcttgcatctgcatctgtatctggctctgcatctacatctgtatctgtgtctgtatctgcatctgtatctgtgtctgtatctgcatctgtatctatgcctgtatctgcacctgcatctgtatctgtatctgtatctgtgtctgtgtctgcatctacatctgtatctgcctctgcatctacatctgtatctgtgtctgtatctgcttctgtatctgtgtctgtatctgcatctgtatctgcatctgtatctatgcctgtatctgcacctgcatctgtatctgtatctgtgtctatgtctgcatctacatctgtatctgtgtctgtatctgcatctgtatctgtgtctgtatctgcatctgtatctgcatctgtatctatgcctgtatctgcacctgcatctgtatctgtatctgtgtctgtgtctgcatctgcatcttatctgtgtctgtatctgcatctgcatctgtatctgtatctatttctgtatctgcacctgcatctgtttctgcatctgtatctgtgtctgcacctgcatctgcatctgtatctgtatctccatctgcatctgtgtctgtgtctgcatatgtatctgtatctatgtctgtatctgcacctgcatctgtatctgcatctgcatccgtatctgcatctgtatctgcatctgtatctccatctgtttctgcacctgtatctgtatctgcatctgtatctgtatctatttctgtatctgcacctgcatctgtatctacatctgtatgtgtctgcatctgcatctgtgtctgtgtctgcaactgtatctgtatctccatctgtatctgtatctgtgtctgtgtctgtatctgcatctgtatctgcatctgtatctgtatctgtatctgtatctgtgcctgtgtctgtgtctatgtctgtacctgcatctgtatctgtatctgcatctgcatctgaatctatatctgcatctacatctgtaactgtatctgcatctgtatccatatcttcacctgtacctgcatctgtacctatctgtatctgtatcttcatctgtacctgtatctgtatctgcatttgtatctgtacctgcatctgtacctacatctgtctctgcatctgcatttgcatgttcctttgcatctgcctctgtatctgtatctgcacctttacataattttgtttcaccatgtgattgacatgtttccagcagacccaagacacaggtttcagtagtgctactgatgctgatttgcaggaggtgtgcttagggcctaatgtggatgcccctgtggtcactctggactgtctttctctgccgtctccctcatcagtggtattgttgttgcccggtggtggagcttctcaggaccttatacctttggatctgttctgtgttgccaagatgttcatctgctgccctgtcatccaccagtgccaacttaaaaaactcagatgggctgatagtgcagaagctggccctcatcagcatcttgaggggagaggttcctgtgggaggccctggtttgcaaaggcgtatttaacagtatgtaatattttgtgtttggaaaaacaaaaatacagttttttctgatgcaactacaacaacaaagtcctacaaaacctttctggtcattttgagatttccagaaaatagtaatttcctagggaaaggtgcccaggactttcctggaggctcatgtgagaatatcaaggaggggcagggcgggggccttttttctgtccgcatcacagggctgtgtttaaggatgttgagaagctgtgtggtgggaggagagcagacccttgggtttgatgccgtaatttctcctaaacaggcagtcactgtgcagagaaggtgggatgggagtgggggagccaaactaagtacggcttcacttgagatgaaaaaatcattccaacattatatttcctgcaatgaaatcatcatttaaaagatggccttggctagcaatcattccacagaccattgggcacctgtggtgt

SEQ ID NO: 475853 - DNA, 1175 bp, Homo sapiens
acagctgtaaaccagagaccacgatgcaccctgtggccgccattcaaattaaaggctcagagagcagaacgaacatgcaaggttgcaaagctccatccataaataaggccacagagtgtggccttcaactcccctgttgcctcaggctctggcagcagaagaagctgatggaaacgcccacagcctcttcaggacgggtctgcagccctggtccccgcggcacacagggacagagtgccagggtggtcccgggagcgcccgtccacaccggcttgcagccggagacacccggcccttccagtcagtgtccgcctgcctggggaacacctgctcagggctcccaagtgctcgctggcatcagcagcctggacgcagcctgcacatctcagccccatgctcagtccgacagtccccaccaggtgtgtggccaaatcgcccagcaagtgaacgcacggatgaaggagcgtgcggccgctcagccacggccctccaaggtctcatcttccacaaggcctctctcagagccgaggtctcatctgcaaaagggaagcgactctgccttttccctcacattgacggcgcgttcctgcctggcctcagtccagaggacgctcagctccttcaccacgtggatggagctggaaaaggccctggacccggcgctggaaggagagcaccgatcccagccttgtcgggcggccacgcgcttttgcagggtgtgtgttcgttctcacctgcagaaggaggcggggactgcacggacgctcatgtccctcccagagctggagcttatgggagcctccagcaggattcaggccacagccacacctgcaagtgtgtggtgcttggacccaccctgctgcccggtacaggggaacttcaagtgggtctttatggctctgaaacatgctccttctgcgcggcaatgttgggattaatgtggcattgaccacagaggcaggccgccttttgctttcctctgggaaaaataaaatttaagatcattttcattctatgggttgaacttgacccctgattaccgcgggccaagcttgagtgctgtgaccagtcatcacactcaacatttctaggccatttcgactttttccaaacatgctagaaacagggcctgatttcatttgcacaaatccactcattgtactgattaggaagcc

SEQ ID NO: 475854 - DNA, 696 bp, Homo sapiens
tggctgcggggctctggtggagatgagagaagacacgctccagatctcacctcagccagagatctcggtgtttgggtttggaaagcgggtaatgaaggacatggtgatgaaggacacggtgatgaaggacatggtgatgaaggacatggtgatgaaggacctcggtgatgaaggacatggtgatgaaggacatggtgatgaaggacatggtgatgaaggacctcggaccttggtgatgaaggacatggtgatgaaggacacggtgatgaaggacacggtgatgaaggacacggtgatgaaggacacggtgatgaaggaccttggtgatgaaggacatggtgatgaaggaccttggaccttggtgatgaaggacatggtgatgaaggacatggtgatgaaggaccttggtgatgaaggacatggtgatgaaggacctcgatgatgaaggacacggtgatgaaggacctcggtgatgaaggacacggtgatgaaggacctcggtgatgaaggacctcggtgatgaaggacatggtgatgaaggacatggtgatgaaggaccttggtgatgaaggacatggtgatgaaggaccttcattgaacattgttaatgaaggattattgataatgaagaaccattggtgatgaaggaccattgtacgtttcaaacttctttgcattggtagtttttaaaatatg

SEQ ID NO: 475855 - DNA, 2189 bp, Homo sapiens
gtgtgtgcagctatggaagtgccagaaggccgcaggctcgggacgcttctgggaggacggtcaggggccctggcctggagctggaagagggtgcaggacacacacagggtgcagccagggcaccgccgctcactgcgcgctcacgggcactgccacttctcacctctaaagggcactgccgttctccgagtgctcaagggcactgccgttctccacgtgctcacgggcaccaccgttctccatgtactaaagggcaccgccgttctccacgtgctcaagggcaccgccattctccaggtgctcacgggcactgctgttctccatgtactaaagggcaccgccgttctccacgtactaaagggcactgccgttctccaggtgcttacgggcactgccgtcctccacgtactaaagggcactgccgttctccacgtgctcacgggcaccaccgttctccatgtactaaagggcaccgccgttctccacgtgctcaagggcaccgccattctccaggtgctcacgggcaccgccgttctccacgtactaaagggcaccgccgttctccacgtgctcaagggcactgccgttctccaggtgctcacgggcactgctgttctccatgtactaaagggcaccgccgttctccacgtactaaagggcactgccgttctccaggtgctcacgggcactgccgttctccatgtactaaagggcactgcagttcgctgcatgctcaagggcaccgccgttctccatatactaaagggcaccgccgttctccacgtactaaagggcactgccgttctccacgtgctcaagggcaccgccgttctccacgtgctcacgggcactgctgttctccatgtactaaagggcaccgccgttctccaggtgctcacgggcactgccattctccatgtactaaagggcactgccgttctccatgtactaaagggcactgcagttcgctgcatgctcaagggcaccgccgttctccatatactaaagggcaccgctgttctccaggtgctcacgggcactgctgttctccatgtactaaagggcactgccgttctccacgtgctcaagggcaccgctgttctccaggtgctcacgggcactgccgttctccaggtgctcaagggcaccgccgttctccatgtactaaagggcactgcagttctccacgtgctcaagggcaccgccgttctccaggtccttcgggcctcggcgcgcggaggtcgggggacgtggctggagccccgacgcctggaccacgggaaggacttgcgctttctcagcgtcctgagccaccggaatcccggcctcggcaagggctgtgatctctccggctccgcgtccctgtgcgcaatggcccgggctggcgacccggtgctgctggcacggaggcccccggggtctcgtggcgtccgtttctgaccccagcaggatgtgagtggttctgggagggtgacttttctgtgcattttactgtgttttgctgcccccgcccccaaatgtgaagcgactcccaggggggaaaagctgtcctaaatactgcatttctttccagattttcaacacacatgtaaaatacaagctaaatatttactataaatgacaaactacgtatttactgcaagttacatcatttatacattttactctataatatttttgtttttgtgtttttcctgactgtggaagtaataaatgcttactgtaaaatatttaagctactctaaaataaagaaaattaaacaaaaataccatagtcacatcccccaaaacaattcttatacgtggtttggtgtgcagccttgcagacttttcctatgcataacaacacacattatttattttacagaaatggtttagagtaaacattttattataaaatctgcttttctcataacttgtcatgtccagctttggatactgtaacacacaggtttgcctggttctttcttaagggtgcgtgtactgcatttcttagtgcacgtggttgcctaggttttctgtattttcacaattatgattaatattgcataatattattctcatgcatctatgctcaagttatgcatatccttccacagcaaaaatttctggaagtggacctgctaggtcaagagcaatgagcactgaataccttgatggttattgttaaaggttcttcacatcggacg

SEQ ID NO: 475856 - DNA, 962 bp, Homo sapiens
aaaacatgtgctaacaaagaatggatcagaaaaatggaagttctttcactggatttatcctactgggtttctctgacaggcctcagctggagctagtcctctttgtggttcttttgatcttctatatcttcactttgctggggaacaaaaccatcattgtattatctcacttggacccacatcttcacactcctatgtattttttcttctccaacctaagctttttggatctgtgttacacaaccggcattgttccacagctcctggttaatctcaggggagcagacaaatcaatctcctatggtggttgtgtagttcagctgtacatctctctaggcttgggatctacagaatgcgttctcttaggagtgatggtatttgaccgctatgcagctgtttgcaggcccctccactacacagtagtcatgcacccttgtctgtatgtgctgatggcttctacttcatgggtcattggttttgccaactccctattgcagacggtgctcatcttgcttttaacactttgtggaagaaataaattagaacactttctttgtgaggttcctccattgctcaagcttgcctgtgttgacactactatgaatgaatctgaactcttctttgtcagtgtcattattcttcttgtacctgttgcattaatcatattctcctatagtcagattgtcagggcagtcatgaggataaagttagcaacagggcagagaaaagtgtttgggacatgtggctcccacctcacagtggtttccctgttctacggcacagctatctatgcttacctccagcccggcaacaactactctcaggatcagggcaagttcatctctctcttctacaccatcattacacccatgatcaaccccctcatatatacactgaggaacaaggatgtgaaaggagcacttaagaaggtgctctggaagaactacgactccagatgactt

SEQ ID NO: 475857 - DNA, 919 bp, Homo sapiens
tgcactcaaacggaatataatggaacaaaatggaatcgaacggattgcaatcaaatggaacgagatggaatggaatggtctcaaacggaatggagtcgaatggaatagaataacatggaatgggattgaacggaataaaaagaatagaatggaatggattgtaatggaaacatatcgaatggaatggcatggcatggaatggaatggaatggactggaatggaatggattcgaatggaatggactggagtggaatggagtcgaatggaatggactggattagaatggactcaaatggaatggacaagaatggaatggagtggaatggaatggactcagatggaatggactcgaatggaatagaatcgaatggaagggcatcgaatggaatggaatggaaaggaatggaatggtatggacccaaattgaatgaaatcaaatgcaatggacacaaacagaatggaatcgaaaggaatggtctcgaatggaatttattcgaatagaatggaatcgaaaggaatgcaatagtatggaatggaatcgaatataatggaatcgaatggaatggaccggaatggaatggacttgtattcaccggactcgaatgtaatggattgaaatgtaattgtttcgaatggaatggaatcaaataagatgtaaccaaatagaatggaatggaatgcaatgtaatggaatagaatggaatgcaatggaatggaacagaatggaattgagtggaatagagtccagtggaatggaatgaaatgcaaaggaatcgaatagaatggaatcgaatggatttgactggaatgaaatggactcgaatggaatagactggaacaaaatggaatcgaatggattggaattgaacggaatggaatggaatgaattggaatggactccaatggaatggattcgaa

SEQ ID NO: 475858 - DNA, 491 bp, Homo sapiens
acaccttccctgctgtagccagttctactacactcactctccagtgtccgcatgcttaattcttcctggttggggagcctacctttcctggcagcaggccctcagtgcaactgccataccccttctgaaagcccaacccctggaggcctgcattctgccctggggcagatcacctcttctcttacaggagaaagatgcaagcaggtcacacactccatagatctgactgacaggggcctatcttccctggtgacaggtcagaagcacggctgctttgccccacttgatgattgcagctccagcctgtactctcctaaaagcccactagtacctaaaccatggggacttgaggacaagtccattggtccagtccaggtccgattcctccatgactcgtgtatgctgtccaggggaccatatagggacctgagcatcaggggattgccagtccaccactgctggcacctattcacttttcctagggtctgagg

SEQ ID NO: 475859 - DNA, 856 bp, Homo sapiens
gtgaggagttaagagctgcaggctgataagactacttcatctcgctcccttaaagagctatttacccacaatgatggctccttctcttactctaagtatctcatctaagggagacgtgcagaaaagagctgatcccccgtacatgaggcaattaaataatttaacaaagcagaacacaggaccctcagctgcaggtctgttggagtttgctggaggtccactccagacgctgtttgccttggtatcaccagcagaggctgcagaacagcaaatattgcagaatggcaaatgttgctgcctaatcgttcctctggacccacttgaggatgcagtctgtccgttctcagatctcaacttccatgctggaagaaccactactcttttcaaaactgtcagacagggacctttaagtctgcagaagtttccgctgccattttttcagatatgccctgcccccagaggtggagtctacagaggcaggcaggcctctttgagctgcagtgggctccacccagttcgagcttccagaccactttgtttacctactcaagcctcagcaatggggggcgcccttcccccagccttgctgctgccttccagttcaatatcagactgctgtgctagcaatgagcaaggctccgtgggcatgggaccctccaagccaggcatgggatataatctcctggtgtgctgtttgctaagactgttggaaaagtgtagttttagggtgggagtgtcctgattttccaggtaccgtctgtcatagcttcccttggataggaaagggaatttcccgaccccttgagcttctcgagtgaggtgatgccttgccctgctttggttcatggaccgtggg

SEQ ID NO: 475860 - DNA, 1580 bp, Homo sapiens
tatcagtttgacaagcaaaatataataccattttttggaagccacaatatgacaatccaacttgatgttcaaatgaaattccctgggaaattccacagagctcagcaaggtaacctgaaattccaactaccctatgagagtttttataaagaaaacctgtgttcaacagtggagcacattattcaggaacttaaagacagattttcagaacagcacctcaaagctcttaagtgcttatctctggtaccctcagtcataggtcagctcaaattttacacattagaggaacactatactggcatgtatagaagtgacttaccccatcccagtgtgctctcagccaaactgcattgttggggaatcaaatggaaagacagagggaagagtgtagagcttccatccaccatttatgaaactctccacttgactaaatcaagttttttactaatgtgtatgcattgctgaaggtcctgtgtatccttcctgtgataaaagttgagaatttttatcaacataaaatgaaaatggacaaaagcatctcaaaacatacttgaggaaccctttgacagaccaaagattgagtaacttggctttgcttaacataaattttgatctaaagcatgatctggatttaatggtggacacatatatcaaacattatccaattaagtcagaattccccacagataattcagaaatcattacaaatactgaaaagcttctctaaacgggctttatcttacatttgatatttggaagaaaagctatctatgtgtaatgattactgtcttgtagtttcctgatgttcaatccgatttgtttgtccctttcaaattatatttatcaatcaccctgcatatgcaaggatctatataggacaccagagggataataaactgtactgaagactgtatatatatatacaaacttactcagaaaaaagccatcagttgacaagatgcatgtaatctagagtctgttcacaaaggagaaagatgttaatcaaaatcttaaaacattaaaacataaatagaatttaggaatgtgaaatactatggagggaaattcagttacgctttggtcctaaatttcaggttttctggtgcataaacaaaaagtggggagtgtgatccttaaaggtgtgtctaggaatcttcttaagtcataggaatgtttgactatattggaaaatgacattacagtcagtttatttgagtatgtccactctggatcctgtaggacaattagctgcttgatcattctgtggctactcagatatagtcattggaggtaaaaatgttttaacatgactcgataattacattatataaatttattaaaaaacacatagaagtcaccaagacttatgctttaattttatcctttaaagtgacccagagaggtaaacttgctcaaagttctatgtttagtagcagaatcagaactaaaaatttgcagatgtttttgacttccagattgaggaggaggaagaaacaaagcactattttttagacatgctgaatttgataagcttgtgagatttcctagatgatgtctaagaaatactttgttaattatgt

SEQ ID NO: 475861 - DNA, 518 bp, Homo sapiens
ctttctggcacagctgttctcgcccctgcactctgaagaagagtagatacctagatacatgggatcagagcagtctctttgggtagaactaattttgtcttcctaccaagtggatcctgccagatgccctgtattaagatatcttcacactctggctggtgattatatgatctatttccagccctgtgagtcccaggaattgtttggcctgcctgtggaagcatgtcattgcgatgttcatccctctagctgtcctcccacttcccatggtgatgatgggactaagcgttggcataaaggggccgaagagttgcagcagcttagaaggcagagccagcacacagaggagagacggcctggatggccgctcagacctgtagcagaatgtgctcaagcaagaaatcaactcctactatgttgggccattgagacttggagttgcgacaaaagccatgctctggttgaagattgagcagaatacctttttaaggtgctacagaagtgaggactccaaagac

SEQ ID NO: 475862 - DNA, 689 bp, Homo sapiens
gttgtcaagcaagtgacgtcagttgcctcccaccaggagcagcagtcccgggatgtcaacccactgcatggtttctccaggtcctcctctaaaaacccactgtctgagcaggcaccctctggccactcaaggttccaccaggggactggcagggcaaggagaactggagtttgtgttacttgctgtgtcatggcttatcaagtcctttgcccctgacccaggagactgtctcatgtcccctgccagtatccatggaacagtaacagacgtttgctttaccggctacgaaccaggcactgatttgcctttccacatacaaatctcatttcctgcttatactatgggatgtgggaatcgtcagaaggttggagactttccttccagtgaagaaacacttggtaatgtaaagatatttgaattgtcaggaaccaagagtcctaactctgatgccaatacctgtcacttgaacgagtcatatcttacggaggcatggatttctgttattccatgtattacaattatttacacacataatttttagatcctcatttgtcccaaatttggctattgggaatctctcttatgtaaattggttgattattgtggtctcatgtaattttgtatcctttatctgtgctttctttgtgtttttttcatgctatggcagtcttcataatgaccctacacat

SEQ ID NO: 475863 - DNA, 557 bp, Homo sapiens
gtcatcccttcctgcacctgcttccacgggcccttggcggtagcctgggaacagctggtcaggacctgaggtcttcttccactgtcctcactgggaacgtgaatgccgctgcttcccagatccctgccttcagttcaggtctccctgttgaactcaggtctcatctgtgcaacttcctgctgcacagcttcctgtgaccatctctcaggcgtctcctactcaacaggttccatcatccctacctgtcttgctcacgcaggcatccatgctagcgttcaccccataaatacttctcagacacccattacctgctatcatccttcaaagcttggttcagctgcaagcttcccagtatggctgtgcaaggggcattgcaaagaggtggagggtgccctgtgcacatctgaggtcactgtagattatgacaattttctggtacatagtgataaaatgaatggtgccactgagcaatgtctgagaagatcaaagtctgaggagacagatgtgactcctggagaggcatccaatgggtagttctccacttctgccttgcaacc

SEQ ID NO: 475864 - DNA, 1229 bp, Homo sapiens
agccaagcctgaagctaccagaagccggagaaaaggcctgggacagaatgtccctcaggaggagacaactctgccaacacctggatttcggacttctggccttagaaccaggagacgatacatccctgttgcttgagccctgcaggctgtggtgttttcttaccgcagccctagaaggcggctccagagccccagcttccatatctggggaacgaggtccacttcaagcttcaggtgttccaccagacttgaggcctgtcctcctctggcaaaggatggtctttcagttgccagaactgcgtcatccttccagccggatgatgaccaggaagaacagatgggatgcttatacctgctctgctatccaggaaattatatctttattttttcctctcaattcagagcgagacacctttaaacctgaatgtaacctgatcaaaggtgtcaaagcagaaaggacggttggccagcatggaggcgtggaaacggaacatgagccaagtgcgtgaacattccatgtccttgttaccattttggtggggtgtagatacggagattcaaggagttttctgtagacttcaagttattctttttcttttagagacagccatagaaagccagccagcttcccccatgaatatgaatgagaagcagtagcccaaatgattatcagcagccaattgctatcaagttaaaaagaaagaacttgattacatcattaagctgccgaatcagcaacccaattcattcccttattgtttagactggttcgctgtggtttttctgttatgtgtatctgaaaacatctttagtgctctcttcataaagtgtctgagtcttatgaaaatccgtgtgaagagggtttctttatcctgatgtggaaacggattgtccagtgaaatgcaattaactcaccacaaggcccggcagttagcaaggagtggaactggggctagaaccaggatttcagatccctggcctattgttttaccaccttccctctcctgacaggcagtacaactgtcacctctcattttgtgaaaatcgccaagagtcctttgatcacatagctgcagctcttcactgatgccaaattatgtagcaaatatgcaaacagccatgctgctgaacagaggggccaatcatgttttgtaaacggagctttagcagctgtgttctttgcttcgccctgttatgagaaaactgccaaccacgtgaggtgagtcccc

SEQ ID NO: 475865 - DNA, 785 bp, Homo sapiens
ccagttaacacgtcttctacggaatggcttctccaaagccgatgttcttcgagggctgcgctctggttctggtcgtcttcaaggattggagaagtggctgggacttggtagtggctactgtggaacaggaggaaggagagcgaggggtccagggcagctccctgtcatctggaacagctgcgcacccttccgcaggggccccagaacaccacacactgggtggagaggatgagttggtctgggagacagggactcagcagtcttggagatcatcttcgggaacctggacaaagtctggacaaaatgaacccatcttcggagtatcatctccctcatgggaaggtgactgcaaaggagaaaggaagttaaaagcaaaggtcggggcaggcgcagccgcgcagcctcacccgggctcgtctgtgactcatttccctggaggggaggcttctatctgagagatggagacattcctctcctctgggggcagggagggcacctgtggaacaagggtcttgggcctgctgcaggggccaggggatgtggggaaggggacctacagtgacactcggtgactatgcacggggtcagccaggtgaggaggccaagttcccgctgagaacgtgcagatgcgctccccagagaggtcgtgtgatctcttggtgtaggatctaactgggcagggttatccaattcaataacaaggacttaaatctcattctataaagcggatgagctcacctgatgaggggcaggggtggcccatctgtatgtaatacttgttttca

SEQ ID NO: 475866 - DNA, 779 bp, Homo sapiens
cagggagtaggtacaaagatcacatgcttcaaagggtaaaaagcgtaactactaataagggtctaataaagatcacatgcttctcagggaacacgacaaagggcaaaagcagaactactgataagggtccaacaaagatcacaaggcaaagggcaaaagcagaactactggagtgggaatgctatttgcagggtattcacgtcttcagtaatactagtaataccaaactattttccagagtggttgcattcttacaacttgtaatgaatatgtttctgttaaaattgtcccctggcactcacccttctacttactgtttctatgaatcctactgctatctactcttggtcccttatatcactggagtcataagtgttgatttgacaatattcttatcattccttggaaacttaatcagtttagttaccattctcgttttctcatctttatgagaaaaggtagaaagaaaggaagtgaaatgcccaacaccactcatttttgttaatggtattgataaaattggcaccagcctttcaggaattcggatgctttgattgttcttttttgttgttagatttttgtatccattatgcattttgaatcataataaagtggaattaaaaaaaactgccatatttgtctagcatatatggcgttttatgattttaaagatatttttaaagtttggttaaaaaccttaacagtatatgtgaaatggaacactgtgcttttactgtggaaatttatcctatataccttaataaaatagttatttaaga

SEQ ID NO: 475867 - DNA, 942 bp, Homo sapiens
aatattgagaagcagagaggagttaaagcagaaaccaggcatggtgtctgcattagtgaccatgtgtagccatgaagaagatttaatagtaccactgatgtcttcacacaagctatctggtgaacagctatggaaacaaaatccaaaagatattcataccctggcacagtttatttctgcttactcacttgcagatccagagaaaggcacagctcttagtaaacatttgccatcatcagatagtatgtctctaaaagtagatgttgaggctcttgaaaattctcctggtgctacatacatttggaagggtggaaaagttactagagatagtcaaccaaaggaacaaggaaagggagatttgaaaaagaaaaagaagggaaaattgcctaagaattatgacccaaaacttaccccagatccagaaagatggctgccaatgcaagaatgttctttctaccagggaagaaagaagggtaaaaagaaggatcagatgggaaaagggacccagggagcaactgcaggagcttcatctgaactggatgccagaaaaactgtgagtagcccacccacctccccaagacctggcagtgcagcgacactatctgcctctacaagtaacatcatacccccaagacaccagagacctgcaggggctccagcaacaaaaaagaaacagcaacagaaaaagaagaaaggtggaaaaggtggctggtgatgagaatattcttgttgaaggctgtttttaaactagtctcggtaacattaggaatataataaaggtaatacagcaagaagcacagaactgctccctcttcatctccatattttcataaataattccttgtgtttcaaatggaaaacatcttcctcaaagtctgcctagtgagatatggcctactggttgcctcatagctttgtacagattatgaggactgaaaatat

SEQ ID NO: 475868 - DNA, 547 bp, Homo sapiens
atctccttaaaactgctttgccttccttctttggtattgatatggggaggcagcacaacagcatatctctctctgatgtgtctgcaacagtgatggctgttggctacctcagtagtgaaagctgcccaccttatgccagacagacaactggggaccatgatggcacccactatgcagctgataacaatagcccctaccctctttggttcacagcagtctccagattactgagcttgccagctttggagagtccaaaagttccctgtgaggaagggtctccccagtgcaacacagcctctttgccagatcgtggccagactgcttctttaagcaggactctaatccattcctcctcattgggctgtacatcccagtcaggacttctgccactccagccagttttctacagaaatatctctaatttccctctgggacagagtccccgtggagtggggcaggctgccatgttagctgttctggcttctttgtcagtccagcctctggagcctggagaacccataccaagaagggactgaagggatcctca

SEQ ID NO: 475869 - DNA, 1455 bp, Homo sapiens
gcctgtcttttggatataagccattttaactgggggggcatcccatacctagtaatgctgtggttcttgcagacttgtagaagtaccaccttgatgatcttggacaaggtctgggggaaattctctcgattaccaggtcattgggtgctcctctggctcaggaaaggtccagaaatgccactgaagagtcaagtcctggaatcagggaccccaagagcctgctcagtgctctaccaccctgcggcgatgctggtacctaagggccttgatgtatacctggatattgctgctggttattcagggcccaagggcttttcagttagcagttcagccctagaactcgcctatgagagttgcagtccttatggtctagactgtcatttaagtttacttagagatggagagtactttggctttcagtggtgtggtttgtgggcactcaagttcagaccactggaattggcaattcccctctgattaggactggtttaaatgttccctctgtgggcaggcatcagctgagtttggtatggttttcctttctgctctaacaggacagcactgccagggatagagtaggggtggtgtcagtgattcagggttgtcttttctatctcatcagtgcctctttcagtgatatgaaattaaaaccaggtgaaataaattataatagagtgatgatgttgtcttaagacaacacatatcagttcatcagtatctgttccacatattagcatagtatctgcaataaacttataactaaaccttaaaatcttaaatgttaaagtttagatagattcagaatatacagggctttgcctccattttataaataagaacaaatgacatttaagtaaactatactaatgaaagtatatatctcacaatatggattgtaggctaatttataccttattgtatatagccatatatatatatttaaagttcatgtttggtcataatgatgaccctgaaagaaaaggagaacttgactgatgtctcagttttaaacaaggttaaaattatgtcagtttatatcactttaagtgtttttttaaattttattctagttatttcaaaagagtaattattaacttatatatgatttatctcagttggcaaataaatttaactgaattctaattttcaaccatttgttttagttttttcttttttaataggctactttttcaggtttcatgattggtatatataataattaacctggttaacttttaacttattcttggattaaatgtaatgtgattcttcctggaattttatagaaactggctgatatggtttgcatatgtgtctcctccaaatatcctgttgaaatttcatcccaaatattggaggtgggcctagtgggtggtgtctaggtgatgggggtggattcctcatgaatgccttggtgttgtcttcacagttatgagttctctctccattagttca

SEQ ID NO: 475870 - DNA, 584 bp, Homo sapiens
ggtcctgctctggagatttctaaagccagcaagtatacagaaatatcccatatgatttagggcgtaaatggatcaaagttcagtgacctactacatagaaggctttgaggagagtttcaacgtttggatcctctccacaaaagaattcacatttgctttgattctgtgtttcatatataattttccaaatgctatttgcatattgacacattcaaagttgaaaactcttaattggattattttaaggaggccccttgcctataaaaacaatttatatcaccacaaattagtatgtgcaatacttggaaagaagtaccacattgaaaaacaggagcagtttgccgctaagctacacttctggaaccagcctgactacaatgtttcaggaaaaaccaatttctggatcccagaacttccagggacatctagtcacctccacaagcagacagagtctggtggaagattgaagatgaactatggcttctaagtagcaacagggcaactttaagattttcaagttaaatatgcctgtgtcattttctaccattagtcattcttgaactattaatttaaataatacttga

SEQ ID NO: 475871 - DNA, 5345 bp, Homo sapiens
catctgatagtaacaattctaaaatattttggtttgtgctttcaacatttaatgaatcaagtctaataatgatattcagaaaattatttggggggcaaatttcaagagacttggaatgcccaaaagacaggaagatgtggaaacatttagaacttcctagagacccgtttaatggcgtcaaccaaaatgctgatagtgatatggacaatgaagtccaggttgaggtggtttcagatagagatgaggaacttcttgggaacaagaaggccttcagggaagcccctcccatcacaggcccagaggccaaatggaaaaaaaacggttttatgatcttggcccagggctctcccgctctatgcagcttcctgactcctgatatattgccctgtgtcccagctgcttcagctccagccgtggatataaggggccagctcaggtcatggcttcagagggcgcaagccccaagccatggcagcttctatgtggtattgagcctgctggaggagaacaaatcctttagacaaatgtcaaaacaggacaaaagggcagtaagggagcccccgcccagtgaggaaggatgggtcacggtcaggcctgaagatgtgctcgggccacagtctgccatacccggtgtgttgggctgtgtaggacaactattggaaccacgttgtccaatctccctggctccagcaggggagcagggtgcggcctggagctatagagatggatgccgcccttccccagcccaggcagttatgagtcccagtgttggctgctgccccttcccacaaggaaggaactcaaacagcttagagagcaggcagcgcagctgcggccctggtcgccctccctccccggagcttgacaggcttaagcagattctagctaagaggctgttgaaaatctgcatggctccagggttgagaccctaggccctggtggcgtgggttgaacagggcagcgatcatcagggcccgcactgtaggtatgtcagagaaactttgcagggcggggacctgaataaatatttattaaatttgagcgactagtatagaacttggcatacagtagttattcaataaatggttgtactttttgaccatttgtatctcttcttggaaaaatgcctatttaaatgttttgtccatttttaagttgggttatatgtcttttttattgctaagttttaaagtttctttatatattcaggatcttggatattattatttttataccttgtgaatattttctttcattctgtatatagacttttcattttctcagcagtgtcccttaaaacacagaagcttcatatttgatcaagtccaatttatttatttattttttagttaacttaatcttttggtatgatagctaagaaactattgcctaatctgaattcacaatattttcacctatgtttttgttaagaattttatagttttaacatttacatttatgtcattttaagttaacttatgtatatgatgtgaagtaggaggctcaatttcattcttttgcatgttaatatttagctgtctaattactatttgttgaaaaaactatcatgtctttgaattgttttctcacacttgtgtaaaatccattgaccataaatatataggtttatttgtggattcttaattctgtccctctgatcgtgatccgaatgaagattccaagttccttataaagtagaacagaaattgaaaatccagcccatttctttgtattcatgtttatttgaccttcttagactagacatctaaatgttggattgtcctgttaggtactgtgtttttttttccctccttttatattcatactcaatgtttaagtgaaatcttaaaaaaaaagtttaaagttaaaggtacttttaaaattcatttgttttaagtaaaccaatatacatttttggaatacagcatgtccctttgttatatttagcaagatggattccttgctgtgataagtggagcaattgttaatttcagctcaaaatggattctaacaaagcagtaggtcctgttttcagttaagctgttgaaaagttatttagtgctataaatagtctaaaatattatgctaaatattatctttttataaaaagttactgaaataattgaaatgacatttattgtttgctactatagttggtatgttgctgatttaatcttcacagtaacatagcaatgcagggattacaagccccatgctactgaaacaaaaactgagtaccacagagatcatgacactcctggcatgatgggtactatgtggcaagctaaaatttgacctgagttctgtgttattctaaagtccatgctctttttataatatcatgtgcctcttatttaacattttaatatatttatgttcaatttcagcctaaaagcatacctgaatatataagtattagcataaattcaatattatgatattaactaggacaatcatataatttattgtccaaatatggtaattttgaaagttaaagtggtgctattaattgtgcaatggcaatatgtgtaaacaaggactactcaaatcacatgggacatgtgtttaccctaaaattagaagaactctaatgtaatgcatcacaatataaattagagagaatatggtatagtagaatagtcactatattaagttattcctgttggttctggctttaatagtttttggtggtatgaatttaagcaagtcatatactctccataaaatcagagaaccagattatttctaagactgcaattttgtgtatacagatattatttatattcagtaaaacaaccttttattgattattcgttatgaggaagaaacaatgacaagtgccatgacatattaaaatactttagatgttgaataatgctggaaacgtcttacttagcagacctaaaccaatgatcaaagtattggtagcaattacagttttacatcagtgatgactactttgagtaaattgggctggagataattttttgacaaaacaataaagcaaaatgttgcatgacttagtggttataaaacatcaatttatattaagttggcttcaaactggaagaatattccttcaaagttcctatactgcatggttcacaaattctaacagttttattgcaaaacaccttaagtctaagttaaatgttcgaaatatatgatgttccaaatacaaagaaatcacctttaaaatgtttattttattaaatcttcttactatacacattccatttaataataaataggaagactttatttctcagtcttagtaaaacgtgatttgattttatcatgccaactataaaagtaattttcctaagagtcagatgtttctgatagttaccctttatcattcaacatcatgttgaaataagcaatttttaaaaagaaaaaataggcaatactataagcacgaagaagaacttgtgaatttttttgagaatgcaaaatatgtcatttaaataggctttataattgccttatagctaataaattgtttttttaaattctacctaaattacatttgtaatcaaacatttagaaagtaccacacatatggtttaaatatcacatatacagcctcttgaaatttgttttcagtatattgtaatttgaaaactcagagatcatcttttaaaaatgtctactcttctaatcacaaagatctatctacactctacctgtatcacacagttatcagatgttgctgttcttttttatccataagtagagtccacttactttacagttaatgtacaacttttctttttctatagtctttaaggtacaatttcacagatgacaaaaaaaatttccaataattatgaaatataccctgccaagattacagtatcttcagtatcttagaaaacaaaatagatttcctaagtgaaatgttcatgaaaagttttctaatagcagtctttgttaatatatgattggatttcatatcatcaggtagtagagaaaattttctctaaatacaatggatttattcaagaataaaaataaggattctaatccagaatgtatagaatggcaggccaccagcccatttggtctgggaagtgtaaggggaacttttattagccaaaagagatttacataagcagctcagaaacagagttcattagttccggaggttcagagtctgagttgtcagttagttggtggagatgccattactaagcaagtgttcttttgagaacatcttatctgaattactccagttttaaagaatgtctagtgataaactttataaaagcagagatgtgcgaagggcaggaacgagtttcctgtggtgttttttgaaagtccttgaaaacagttcttatctcagacatgtaaacatgtctcagacatgtaagccctattttgtctgggcctgacaaaagtgacatcatcctgtaatttgcaaactcagagatcatctttcacaatataaaattaagaaatagaaaccctagcaatggtgcaactgtcctgttagatgatgcaaaaccttttttgcatctccaagttctcactttaataacattattattatttgcttcatcaagatataaaaataactaatttcaatagagcacttgtcaattatggttctatattggcttagtatacatatctgtagaagtatattgatactttacttcagtcatctacagttatgttttagttcacaacagaccataaatacagtggtggtcccataagattaaaatggagctgaaaaattcctattgtctagagagtatagcactggtggttagtactgttattaggacctcacttatagcttagggcacttaagtaaatggtcagaacaacagtcacctttttcttttctggaaggtaattattagcacaacctctgtgatcaacatattggagcatatggtggctggagggcttcatcctagttaggctctgttgataaatagcctagggaattcacagtgtccatgcacagaagaaaccatcttcacttgtctaggaccaggttctgatgctcatagcattatcttatggctgactgatcactttttttttaatattaaaatatactttcagataccccatcaaaatttgtaaatcattggagtttctaaatgaaagtatttaaaattatatatattttgctttacttgaccaatactacttcctcattcaccctttggaaaatgtatttctaaagcacataaaattgagaaatatattaacattgttagaaaaatactattgtgaaaaaattaggtgtttccaggactatagaagtaatcattactcccttctgggaataaaaaactaattttacattgctaagtcagaaattctta

SEQ ID NO: 475872 - DNA, 1040 bp, Homo sapiens
gtgatgcccttgatatccatccaagttgtgttagctctctctctctttgcctaccgccatccatgtaagacgtgacttgcttctccttgccttccaccatgattgtacggcctttccggccatgtggaacttattgcaagtactggcctacttgtagatatggggatgagtgtacttaccatcatcttgtttcaccttggaaagccttccctaattgtacatttcctgaaaaatgtttgtttgttcaccaaaattgtaaatacattgcaaactgtactaaaccagattgtccctttactcacatggggagaattacagtactgcctccaaacccagtagctataatgccagcaccaccttctagtagtcagctgtatcactacttcctggcttctaaggaaactgaatgtcacttgtatcatccaaaacactgtcgatttaacattcagtgtacaaagccaggctgtgcattctatcaccccattgttactgtactgccactacataccttggaatgaattctacctcaaaccagcaaatgacatccaaagcaaaaagcggctgcgatggtgtctggggtttgcaggactggttctgacatctcataggaagccatggggacagaaatatttattgaattctaagcagaaatcacttgctttggggaaaattattgcaagacagacaaaatatctcctcttaagttctcagtcagtgaaggagggagatggcattttgggagaggagtcatcccataggagaaattaatcttcaacatcaaagacagaaatctgaaaaaaattacattaagcaaaaatgttgcatattgaataattttcagagagttggccttaagaatgtggcctagtgttttgccaagaatatagaaatatcgacctgattacttgtttaaactaattatagttgtgtttatgtgagtgatttgtgtttttgctgattggcttctttttatgaagcatggagatattaattcatttatttaataaacatttactgattgcatcaagcacattttttct

SEQ ID NO: 475873 - DNA, 790 bp, Homo sapiens
aaggtgccaccagccacaggattggtccctggttccttatttagttcatctggtgacataatgttttcttggatggtgttaatgctagtagatgttctttggtgtttggacattgaagagtcaggccctcagtgtagtacatgggtatctctgctggtattcaggaaccaagggctcttcagtgagcagatgaatgctgccagcactgggtcctttccttcaaagtaccaggttcccttctggcccagggtgtggatagaaatattatcttggagccagggcctgaaatgggggtcccactactctgaccaggtgctctgtcctctgtggctgagctggtatccaagatgcaagacaaagtcttcacattcttccctgtcctctcctcaagtgaaaggatatcttttagatcctggaggtgtacagcttggagttaggggaggggtgatgccagcactccctggtctcctccagctgttgtttcagtatgtcacatgtcccgccatgtatccactgtctctgagtctagtttagaactaggactcacctaaaatttgcagtacctgtggcttagattgtcttttaagttacttggagacacagagtgctttagccctctctggcaaggttttcaggcactcaagttcaaaccactgggataggcaatccccttttggataggcctggtttaatgctccttccataggcaggcatcagctgagattttcctttctgctctaacagggtagcactgagttcaatgccttacaattgctgtgttctgcttccc

SEQ ID NO: 475874 - DNA, 3180 bp, Homo sapiens
gcgcctcgtagctgctgctgggggttggcgggcaggggtgatatcggcagttaaatactgctttcctatggtcttcagtgacactttcattaatatgatggcagtgcaaaagggaaatttggggttggagaccccaaacagagtccccactggggcactgcctagtggagctatgagaagagggccactgtcctccagaccccagaatggtaaatctaccgacagcttgcattgtgcacctggaaaagccacagacactccatgccagctcatgaaatcaggcagaagtggggctgaaccctgcaaagccacaggggcagagctacccaaggccatgcgagccaacctcttgcatcagcatgacctggatgtgggtcatggagtcaaaggagatcactttggaactttaaggtttaatgatggcactattggattttggacttgcatgggagcatctgtgactaccattgcagaagggattcagccagaggagcaggatgtcagcagtggaacacacatcttcaagagcaaaggatgtagcttcaaagcaccatttggaagcagagagcagtcctttcccgacaaccaaacctgctaacactttcatctttgacttatttgcctctaaaactatgagaaaataaatttctcttctttacaaattacccaggctttggtgttttgttatagcagaacaaatggactaagacaaaacctaatccccaatatgatgacattagtatctcacctaggatattatcttaccatacaatctacaatttcactccttggtatttaccaaaatgtatcgaaaacatacgttcacacaaaagcctgtataccaatgtttaaagcagctttacgcatacttgccaaaacttgaaagcaaccaaaatatctttcagtaggtgaatgaataaataagctgtgctacatctggaaaatggaatattatttagtgttaaaaataaatatgctatcaagctgtaaaaagatatggaggaaacttaaatgcatgttactaagtgaaagaagccaatctgaaaaagctacatacagtatgattctaactatatcacattctggaaaaggcaaaactatgaagatatttaaaagatcagttattgcctggggatagaggtgggagataaataggtagaaaacaggatttttaagatgttactctttggagatttagaaaaatatatattgaggacagatgacatttgtcactgtagcaactgtgaccatttagatggtataaaggcattttttaaataacttgtcagtgctaaattaagattttagaaaataacagggctggatagattcaatgtggggtgggggtggggtattaatgtaattgaaaagctctgggaaagagggaagagtttgagaatagggattggcttccagaaaatttattgatgcagctttctaaaaccttacagatttgtatgttcctgtttgtacacactgaagaccagcagatgctactttcatgaaattatgttggggatagtgtgaagagacaacataacacattttgtgagataaaaaatgttctactggagatattgtgaagggcaaatagtatatcctctgtgctattggctaatattttaatggatttttatgtattcaattttttcattaaattgtgatttccctgaatacaagagtctgcatcttcttcactgccatttcttaatttcgtagaacatcttaatttcattagcacatctagcagagcttcgaaacctagttaaagttaagtttactaggttaaatcagtaattagaaaattaaagttattcatttatactttagtttttatatgtctttattccacaatatataattattgttgttttgcagtgtaactttcgtatttatcaacagtttttcctttggacccttataattatctgcatgtccatgcttatatttggagtagttttctcagctaccataaatgattattttttgattccatgaataatttggaagtatactaatacattttcaaatatttgagaattttccagagctcttattttcattggattctaatttaatttcatttttaatatattgaagcttgctttattgcaaataattttatttattttggtacatgtgttatgtacacttgaaatgaatatgcattctgatgtttttgtttggagtgttcaataaagtcagtcctttttaatcacgtgaaaggattgtctggttccatatacattttaaaatattttttctagttctgtgaagaatgccattggtagtttgataggaatagcattaaatgtgtaaattgctttgggcagtatggccagtttaaagatattgattcttccttcctcatgagcatggaatgttttcccatttgtttatgtcatctctggtttctttgagcagtgtttttaaattctcattgtaaagatctttcacctccctggttagctgtattcctgggtcttttattctttttgtggtgactgtgaatgggattgcattccttatttggctctcagcctggctgttattaatgtataggaacgctaatgattttgtacattgattttgtacattgattttgtatcctgaaactttgctgaagttgtttatcaggtgaaggagctttgcggtccagactacggaggttttcagacatagaatcatgtctgcagggatactttgacttcctctcttcctattgcaatgcccttcgtttctttctcttgcctgattgctctggccaagactttcaatactatgttgaataggagttgtgagagagggcatccttgtcttgtgccagtttttcaaggaaaatgtttccagcttttatccatttagtaaaatgttggctgttggtttgtcatagatggctcttattattttgaggtatgctatttcaatacctagtttattgagagtttttaacatgaagggatgttgaattttatcaaaagccttttctgtatatactgagataatcatctgggttttgtctttagtcctatttatgtgatgaatcacatatatttatttatgtatgttgaaccaaccttgtatcccagggttaaagcctactcgatcatcgtggatttcctttttgatgtgctgctgaatttggtttgcaggtattttgttaaggatttttagatcaac

SEQ ID NO: 475875 - DNA, 5693 bp, Homo sapiens
cgcctttcagaataatagtacttacccattgccagtatcccaattgtatattggaaaaaaccacagtgatggctcgggaacaccaacatgccaatagccaagttcagttggtctggaagttcttccaatgtcagtggagaggaagatgtgaagggatttctctccagcagagctgacaaattccagagaatatctccaagagacaagagccttgaagatgaggagcttagtgaccagccatgggaagttgacaacgaccaattgagagcaatcatcaaagctgatccccttacaactacacgagaagttgctgaagaacttaacatcaaccattctaaggtcgttcagcatttgaagcaaaatggaaaggtgaaaaagctcttgaccagcattggtcaatgggaagggcccagttcttcttcaagacaaggccctactgcacctcgcacaaccaatgcttcaaaagttgaacaaattgggctacgaagttttgtctcgcctgctatattctcgccaactgactactacttcttcaagcatcttaaagactttttgcagggaaaacacttcctcaatcagcagaatgcagaaactaaggcagaaaaggctttccaagagttcatcaaatccatttcagttcacaagctagagacccagaacggccattgtaagttccagctcaagtctgagtttgaagtgctcatttggaaaagtctagctaaactaccaggttctcatggatggtttctgtgaacacattatttagaagtaatcatattctcctctgatgatatatgtccaaaccaattattaacaaactttaattaaaacttttataatttgtacatcacatgcaattgtaacaaataatacagagagtttatacaaggaactgacattgatacaatccactgattttatcaagtttctgtttgacttgtgcttgtgtgtgtatgtatgtgtatgccacgaatttaattttagcctttcttgcctctcatgattttaccacttaaatgtcatgtttatctctcatgtacattacggaatctgggaccaagagttacattgtccattttcttttctttatgcttaaccaattctccattcaagcacattacttataaataagatgcatgcaataaataatattaattgattgataaggtaatgggctgattatttcccttcatggctctatgtgcttaagcatttaaaaatagaaatgactaatacttttttcccaatagtgatcttcagtcaggctgatcataaatatcaccaagaatactttcagaacaacaaatgcccatctccaaatggaagttcctgatttaataggtgtggggtggttgtgggcaattttggtttcctaggtgtgtctgatcagagtctggctttggcagtaaagcttttagccatctggttttataccaaacccctccttagagatacagaaaactggaaggcaagcccaatacactcatttctagggtgtagtgtaagacaggaaggtggcaaaagaactcagtgacacatgatgttattagagtaatatggatattttctcaatagtcttttgcttctccatagtataaccactaatcctaagaagagcactccatatcacctttcaaaagcttgcatattaatttatgcttgccttttaattttctgatttactctattcccctctattgcacaggtgcagagaatattatctttctacaatcaaggattctaaaatccaacttaaaaattacaaagtacaatttatgtaaatgaactccccaaatctcaagtctaaactctgtattgacagtaaagaataaagtactgaaaaaaattaatgggctgtttacaggaataaaaataaaaatatcatcaacatataaaatttgagggcttttttgtcctacagtagctttaatatccatgacattttatactttacaaacattgaattattttgacattataaaaagcaacttatgctgttaagtaaaaatgtaaaacaaaacaaatattaagaatttgaaatatattttatatatcattagtagacatagtatataactaaatatacagttatataaaactacatattatatatataactatttagattattataattgagaaatatacacaaaatctgtatttgagaaaataattatccttatatataataaatgactttgtaggttgaaaatattcaaaatcctaggcaaagacattcctagataaaagttggtaaatcagctttagaagatgacagacttaagacatattcaattattagctgatgttacctaaatcaagtttgacacataattatatatatttacattattcttgcaatgctagagtaaatagctgtagaatataaatacaagagtcatctatttaagttatattttgttattctatttaatttaaaaatttaaaatcttttttcagtgttaattagtctctgggttggtataaaagaaaaacatgttctggagagaaaaagggatacttaattttaacagcttaggaagagtaaaatcaaaatcagatgttcagttcaatgaaataatactcttgtgaatatgtaatatgatgttatctgcctaaaaacagttaaaatacattcataattattaatatagaatcaaaatgaattaataaaatccacatagcaatatccaaaaaaatctagtctaaggaaaatatagtatttactatttcataagaaataacatttgaaactttacagagattgaaaaatatcagagaaaagcactgacatgattatatttcagatgtgtatatgaaagataatttattaaacagaaaattaatagtatgggaatatattttcataattagtaggaatgattattttaatacatataaaatatttatctcattatgtaaatgagcaaaaacatacacaatagagatagaattgtaaatggtaactaacagctaccaataagattactattgacagtaattaaggatataaatattaaacagttttgagatacaatcttaaaactactaaattaccaaaacaactaacaaaatattaaaagccagcaaactacccaatttgagaaaatagattatttattgcttgaattgatataccgaaaaccttttcaatgatcatattcattaactaagcaggcaaaagatacttgcatgaatttacttcatcgatataatggaatgatgaaaacactgatgttataactaaataaatgtagacaacctagctatccaaaaacaaatggaaaactagattataatgctttaatcttgtgaaatagttggcaactattaaaattaaaataacatcaatcataaaacataaaaatatatatgaaataataaaaaggcagaagacaaaattggacagtatgattataaaaatctgtctcatttaactacctgtatatgtacaaaataccttttatgttgatgggcttaaattcttacctatttttcaaaatgttcttattattattacatttttataatcaaaggggaaaattgctaatttcaaaaaacaagcaaacaaaaaacccttctcaataaaatagttatataacctagttaaatttgcgtaccataaataaaaagcatacattctaatacaatttaaagggaaagataaccaatgttaactttatttcttgtccgcatgactttataggtaatttctttatacaataaattaatgtcataaaagactgactatttattgttgattaaatacaataaatgtcaacaaaagggcaatagttagcaaaagaaattattatacatacaaaaattatgcatgtataatttatacgcactcacttaaatagaaaataaatcactgaagaccaaactttaatgttcagcatttgctttgcagtggaaaaagattcagaaaatatctattatgaaagaaactcctttttaacaaatgtagttctaggtattagactttgaaaggataggagaatgctttttaatgaatgtgaagtaatatttcaagggaaaactgttctctaatagagagttactattcatagaaactaattataaaagaggatttcactaattttaaaggtgtctgaccaaggtgaaaaattaacaatgaatcatattgccattggccgatcacctgatggtgtatgagtactttatcatgtgtacctcaggtacagtgcccatggagttcatcgacccaccaaccacagaactgttcagcacaggactcctagatgtgtgcctgaacaatgtgaaatgattaaaagatgtatttttaaatcctaaatttcaaagaatgtcctttcactaagatattcataattcagcatagtgacaagtaattactctaagtgattaattgacagatagaccttaattaggtaatgctgattttgtaatttcataatttaaaggaaatataaaagactgagtaattaatattttattagatttatttccttgagcttaaaaatataatgtgttctttgcaaatattttcttcatctgtataaaatacaaaggtctttacccacattaagttttccagcatttatccaaatacttcatgcaaaaattgaattttcctcctatcttcacagtttggatgaagttttcatgcatttgcttggtaatgctttgacaaaatgtattagtgacttaaattgtgggttgaaaaaatcaagaaacgtatttcaaaaacattatccttcaacttttgaagtaaggaaatctcatcttccatattaatatttcaacttgttcaatcaaagcattgcatgttttcaaaaggactaaaaaaatctaaaggttttgtatataaaaacagaaaaaacctaaaatggtatgtttcagtaatgcacaataagttagtgtatcataaatgggatttcttcagggaacattcaacagatatcacaagacaataatagtgttttctcctttgaaattgaaagttgataagccttctcacatgatgtttgataaatgatatatatgctttaatattattttttaggccactgtattttttccttaaatgtacttcctgtacggccaaaatttttgagaaaaaaaaagattcgtcttctttgaaggaagaatgatatctaaaatctctgatatttgcatgagaagactgatggatttttatttgccagagatttccccgtgtgtgtattcatgcgcatgtgtatattttctaacaaagaagaaaaaaatttcaattacaatacttggaagcatctgtgatttttagcatgtatataggtatgcatttcattttctgctgaaagaaaatagtagactaggatagccaaaagaagattcatttatagggtctaccaaggctacttgctacagcagtttactaccacaggttgattaacttgttgtgcatgtattatacttatttaatttacatttaacagtgctttccaaatcagctctcaagatagaagcttcttttactgatgtctttcttcacagctctttgcaatctctaaaactcattctgtcttcttacattctgttggaaagattatttccaatatacctcctgggaaatactctctttgaaactagcaacacttaatgaaaaacatatacatattcattaaaaggaagatactgaaaaaatatggctagtttataatcactctgat

SEQ ID NO: 475876 - DNA, 3369 bp, Homo sapiens
cctgaaaagacaagagaaaggcctctcatgccatggaatggctgtgggcacaaggtcctcagagttgtatctactccgcttatgcatgctagagcactgtattataagaatggtaaagaaacttcaagcaacctgaagatatttcagattggcatccacagagtctgctcaagggctggtaggagcagcaataaaaactcattaatgatggagtcccagtccagagcacgacaagacctgggctgcatgttgtacagtgccaatatttgcatctatgggacttccaaaatggggggagatgtaatgaagctatgggctcaagattcaaagaaagagatgtgtattccaaacatgtcagaaagtgatgaccatctggacagttgtcctgccacaaactcattgattcataagccaagtagttttactaattgagggctctaaccagagctttcatttttatattaaatggaaatttatttatcattattttctatttttctgtactgccatatttgagtcataaaatatgcttattcctcttttccttagtagaatggatttattcatttatttgaagaaataaatcataataaagcatggttttctgagactaagtaaacataaaggaaatatacctggacttgatttgcataatgttaggggacaaaactgtaagaatgatatttaaaaattaatcatacttaaacctgaatattagcctgatcaaaataagacactgttcagaaattgtcagaatttttttaaccaaatggaataatgacaataatctcaaaaataactctgaaatcaaataattatgcatcttgttctaaatatattacatatattaatccatttaatcttcataaaataccctgtgagttaggtattattattatctccttttttctacaaatgaggaaaatgaggcccagaacagttaaaaagcttgcccaaggtgcaaagtagagaattgagatttattaaattatttaaagttaaaattgtattttaaaatacaacaaacagcctaaatatgaaaggtcaatgacagtaacagttattctttcatacttttttttgttatttatttacagatactaccatgtatagcaggcataagttaaataaaaagccattatggtgaaaaaggaaagtatattttcatcaaagaaaaaggttgaaaagagaataaagaatttaagtaaaatgttttgtgtagttttagaaaatgcttctattaattgctatccagaaggcatctattaagattgtataaaagtaaagatgcaacaaacaatttgggtgtctaattctgattagactaatgttcaggtttaagcatggttgatttttaaatatcattcttacctatacagtttgggcccctaattataacactcaagcaaatgataaatccatgtacacttccttcatgtttgcctatcctcataaacatttgaatagatagtaaaagcaaaaggctaaaaaggctttctaacctaaatatattaatctttcatatacttctgagaacaataaagcaggatttaaaaaagatgtattgtgtataaggttgaatttttgaattattctttgaaaatatttataatcaatgtattaatataagcatgctattttctacttatgagattattttagaaattgacaatttttaacttaccatcaataagtattgacttttcacatagtgaagataagttgctctaatttattcctaatcttctctagtattggcaataatgaagaataaacatgccagtgcaggataacagccagaataaatgggtgaaaataaacctagaaaaattaatgtgttggccttggcttcagcatcgtcacactttgatttgttaaactatggttgtaaaatataaatagtttatatgaatatatcacataaattcactgttcacacttttatttctttattatttcaaagaatagttactgaggcttaccacatgcatagcaggtatcatttactgatagtacaaaaaattttgcacatgatgctgctttctgggttgtcagcattaactggaacctggcctttgcccttaggaagattacaattaactagaaaataaaatcatataaaaatatatgcagaaaatcatagtatatggacaagaggctagactatagtataggcagaatgctataattctgtgatagtagagaaacacttcaccaaggaaataccttttgaattgatcttaaaaaaataaatgaatatattgagtggagaagttagaaaatgactttttattgagtggaggtatcctgtgcatggaaagacaaaagggcatgagaagtgcctggaaagaataaaacaaacttaaatatataaattattattaaaaatttcacaggaattcatagtaatttttatttttaaatttcacacaccatatgctaattttatattgagagccgtgtgtctggctaagaatcaaggtgattctgcttaataaaattttgccaactaaactactaaattacccaactttgggccttgttaaattcaacaacatttgttataattaacccatgtaattagtatatttatgaaaaagttacattaaaggactgggaattaaaaacagtaaaattaaatataaaacagcaaaaaatcataaatatttaatttttgacaataaattcgcaaatatctgactaaaccatattccaggtacaatttctaacagctttgtaaaagctaaagggaggtcgcaaattgagaaggataattgagttcaaaaaaagcaaaatcaggctataacaacaggcgtcattttcagtaaagtatattcctgaatttgagtcatttgaattacacaagaatatatttctataaattcagttagaaaatctgaagtaattgaaaactgttagctttcattctttaataactatttcaagctaagaaatgtctgctatggatgaaatatagcaattagccaaagattttataaataaacaaaaaaccaacagaagtatactatttttaaaggcaaagtggcaaatgtataaattatttcttttattagaaaaattacatatgcacagctttggaataataaatatttcattaaaagtattatgtaaaattttcaaatggtttcttgctttttcccttcccttcttttccttgctaatcaattcattctaaaagtcattatgcaggattgtgcaaagtaaggctcagcacaggaaatgttcaactactgtggtggccaagtgcaaggtattcaacacaagcaagcatgttgaccaaggtatctgccaagaagggtgatctggctcagagtattagaacccaagtggtataaggaaggtttgtcc

SEQ ID NO: 475877 - DNA, 2521 bp, Homo sapiens
ttcagtctgaatccaaacacctgaaaagcaggggagctgatgcgtcttctgatgcctaatttacatctggttgctaagaaagccttctgtgtgtgtgtgtatgcgcgcgtgcgtgcacttgcgcacatgcatataaaattgcaaagaccttgtgaagctgctgtcatctccagtatgagaagtcagcagcaggcactgccagagcaatcgggaaacaaaacttttactttcctacctgatgcatccccttcaatcaaatctatcccaggaggaggaaagacgttgtttgtcaagccaaacagcagaaagcagtcttctgcatgtcatcacatgagggagaaaggaagcaagatctctggggactcttataaggacactaatcccattcatgggaacttcatcctcatgacctcatctaattctagttgccacaggaagaccccagctcctaatatcatcacgttagagagtggagtttcaactatgcactttggggaaacacaaatattcaatcatgcatttttttattaaatatctgaattcagctattcagctgctgtttctcttggtggcattccaacagacagaaaagataacatagggattaaaaatgccacaacaagccacacgagaacagtaaatgcttcatttcaattttagctccttttttccttttattactacaaaatttggacaaaaaaggtgacaccttccagaaaggaagtttcttacatcagtgcctattttaaaagaacacatgtcctggaaactaaattaagcaccatttaccaattaattcttactgagttcattgtgagctctattactctcttatttagatcctgattttcttatgtgaacacagaaacatacaaatgaaaaatgttcacgtatgtgtaaactgagttcccgctctcctttttttccacattgctaagattttgcttagccctcaggcaaatttctgctttttatatgacccaatttaatttctttagaattcatggcctacctgacctattacaaacagaccttgaattttatgaggcgaagtgaataattaagagctcagctgctttcaataaattaggatcaaattgaatttttataatctgctattattttatattagttttattttaataatcatggcatctgtataatgactctagcacttgttatacattttatgctattttataactatcacacaatattaaaatattataactaaaatatatttaaatataaattcaaacatttaaaacattaataattatactgcgggaaataaacatagaaatgtttctgtataactttaaaatataaagttagcaattaacaagtgatgccctaaaatctacaaacccccaaataaagtatattttagtgttaaatttatttattcagttaataaattttgtaccaaccttttaaacaatcaactgtattattcattgaagcaatattgagagcaacatttttggagtaaatatttttttctttttagaacttacagtaaaatctgaagaaattcaggctatcaacttaataactttaaaaaaatacatgcaatgtttttgcacagttatttgaagctttggggtaaaggtgctataattattgcttatcattcaatacaattacttctttaatgttaagagaatcacaaaatttggggatggttaaaaataaaggatccaagacacatttttaaatttataataaattcataattgtacatatatacggggtatttgactacaatgtgcatcaaagataactttttgggttgaatctatttgggaatttttgagcttcgtgcatctgaatttcaatatctctccccagacatggagagtttttagttattattttattaaacaggttttctatgttttttcccatcctttctcctttggtattcccacaatgtgaatatttgtttgcttaatcattttccacatgtcaataggctttttgctattcttctgtgctcattatttttgtctgactgtattactgaaagacttgtcttcaagctcagaaattatttcttcttcatgatctggtatactgttgaagctcccagttgtattttttttttttattccagtctttgaattcttcaggtccaagatttctgtttgattcttttttatatctgtttctttgttacgtttctcattcagatcatgaattgttttctttattttgaattgtctgtttgtgttctgttacatcttggttagttttcttaagatcattattttgaattccttttcaggcatttcacatattcccttctgtttggagacctacgattgaaatattttgtgctcctttagaagtgtcatgttctttgcttttgcatgtttcttctatccccctgcattcatatctgcacatcttgtggaactgtttttctttcaattttatgaagtagctttcaaactgaagaaagtttacagaactttcttctgtagatttgtcctatactgtaatttgggtatggtgcttc

SEQ ID NO: 475878 - DNA, 955 bp, Homo sapiens
cttagcgtctttgctcctttgttagtccaggggccatctgcaagctgggaaacaagagaggacagtaatggctcagttcaagtccaaaagccttaaaactaagaaagctaacagtgcagccttcaggctgtggccgaaggctcaaaagccctggggaagccacaggtgcaagtcctggagccagcagaacacaatgttgcaggaagaggaagcaaacattttgctagcagatcaacgtggagtaatggagactagttatctgcagaagatggtagagccttactacaaaattctagaggccgcttctgtgattcacctatgggggcctgtcaaaggctcccaacagcattgttatctgtcactgacacctcaaaccctattggatctgctgggtcatatggctcaagtggcagagcagcttgcacagcagcctggacctgttgctgagccttctcctattttaggccccactcaaaactatcagccttctcaaaaaatgggccagagtaacacacctaaatgaagaatgtggtgcctccaaaatacaaataggcccactaggcattgtgttttatcatgattttaggaggggccaaatccaacaacttattttttgccatagaaggaatatctcaacaggccccacaccattgaacccttagaagttttactgagcttgaagtcccctaaattttagccaaatttgttttccatcccttgacatggaaatttcacaccaataagttcagagtggtttctgcttctcactcaatgggtccattgggtccatgatgtcatcaatgtaacggactagtgtaatatcttgtagaagggaaaagcaatcaagatctcagtgaacaaacttatgacatatgggtggagagttgatatacccctgagggaggactgtgaaggtatattgccggccttgtcaactaaaggcaaattgcttctt

SEQ ID NO: 475879 - DNA, 634 bp, Homo sapiens
gagaaaagggttgatgagtggaccgtcctggttcttactcaatcagtcgatatacaaggtggccatggtggtttgtaatattgagagactttgtaatgagaccctaaagagccagaatctatttaaaatactgacagtgaatcccataacagtttttagaccaaagaatgaaggagggggttggttgataaactactcaaaaatagaaactgagttaaaggtgatgttttggctgttaggctttcttcaggccataatatataaaagtaatatttttaaatttcttcttctgcccaaggaaaacctcaaagatagaatgttatgtttaaccttattgtacattccacagagtattttaagaactagaaaaggattgctggggcaaaaaatgattgtagtattgaaagatcagaaaaactctgtcataattttaaaaaataagcaaacactgagaacttcatccgcaatgttattctgaattcagtattctatcgggggacttttgagggatacatattattaacatgacctatcactgttaattttaacactaattcgttggctagggtagtatttgtcaggtttcttcactgtaaagttaagcttttcttcacctttctgtattgtactattt

SEQ ID NO: 475880 - DNA, 651 bp, Homo sapiens
tattatgcccaatttacagatgaggaaatggaaagttatgtagctttccagagaagtcaatggacttttttgaaagacaatcttaaaaaggaagttgaatactcagtgattgactgtgcagatgaaatagagaaaaagcaatctttaagtatacagtcctttggcattaagcacatgcaagttgttattgcaacaatcaccatcatctacctccagaactttttcatcttctccaacagaagaaactctatactcattaaacgttacctccccattctttcctttcctgtaacccttggcaactaccattctattttctgtcgctgtgaatttggctatccagatacaccaccaattgtcacgctgttttccatagtggctacaccatttaatattcccactagcaatgtacaagaattccagtttctacatatccttgccaatacttgattattgatgttgctgtaagaaccatatgaaatataaatatgtgtaatataaatgatgattatgtttttcatatggcttattctgcaaagacatacataaagatttttattggctcttgtgcatgtagtttgccttttgtattgatcttacttcttaatttaattttcatattatttaaaatatcaatggtatgtaagtaca

SEQ ID NO: 475881 - DNA, 605 bp, Homo sapiens
cccatctgaaggttaccaacatcaaagacctaaggtagataaatccatgaagatgaggacaaaccagtgcaaaaaggctgaaaattccaaaaaccagaatgcctcttctcttcgaaaggatcacagctcctcaccagcaagggaacaaaactggatggagaatgaatttgacaaattgatggaagtagacttcagaagctgggtaataacaaactcctctgagctaaaggagcatgttctaacccaatgcaaggaagctaagaaccttgaaaaaaagttacaggaattgctaactagaataagcacatacacaagtatcaatagccgaattgatcaagaagaagaaaggatatcagagattgaagatcgacttaatgaaataaagtgtgaagacaaaattaaagaagaaagaatgaaaatgaatgaacaaagcctccaggaaatatgggattctgtgaaaagaccaaacctacatttgattagtgtacctgaaagtgatggggagaatataatcaaattggaaaacactcttcaggatattatccaggagaacttccccgatctagcaagataggccaacattcaaattcagaaagtacagaaaa

SEQ ID NO: 475882 - DNA, 775 bp, Homo sapiens
acccccatcacatgcgctgcgagggagataagggaacttcaagggaacttttcctgttccactatctccactctttttttttgagacggagtcttgctctttttacctctggggacagagacacttccaagtcttggtgtctcctccccttctgtccatctaatgacaagctgaggaatccaggagagtctgacctagggacagcagcaattctggaattccaacctgaaagtgacaagaatgacagcacaaccacagcaattaccaatttagaggagaagccaaacaagagtacagaagattcaagtctgccatctcatgctaaacctggagcatatcctttgaatggaatggagaacagaggcactggcatcccagtggccattcattccaacaaaaaatatttaattgaatatcacgcaggagaagtagataaatttagaaaaatgcaagtagtttggcctgatgctgggtctaactgttggcattacagtcttacaagctatgctgagaagtaacgctaagatgatgttctagatcaggtgggggaaagtagctctgctaccttcaactgctaataaatttagcttcatttatctttgtctgaatccttatttaataccatggactcagacttcctacactacgttctataatagggagcatataacaatcaaaattacaaatgcctatacaaaatctttacaattgaatataaagaaagtctacagaaacattactagattcatgaaagtgaataaatctgtgtatattt

SEQ ID NO: 475883 - DNA, 720 bp, Homo sapiens
gagcccacaggtatggctaatctgctgctcccttttggcagaaggctcctctttcacctccatcacaaacacacatggtattttttgctgcatggagcccaggcacttcttggtgagcccaacaagcaggaaagaaagaaagaaagaaagaaagaaagaaagaaagaaagaaagaaagaaagaaagaaagaaagaaagaaagaaaggaaggaaggaaggaaggaaggaaggaaggaaggaaggaaggaaggaaggaagaaagaaagaaaagcaaagaaaacaaagaaaaagaaaagaaagaaggaaaaagaaggaaagaaggaaagaaaaggaggaggagggaggaaggaagggaaacccttgtacactgttggtggatatttaaactggtatggccattatagaaaacagtgcagaagttcctcaaaaaaattaaaaatagtactaccgtgtgatccagcaattcgtcttccaagtgtacccgaaggaaacaaaattagtaccttaaggagattaatctctgtgtccctgtgtcttcagagagaagggcattcctttactccaggtatagagcaggcacgtctggagcgagagtcataggccctactttacaggacccagaactgctgaggtttacgacctacttcaggggagaagaggtgaggggaaggacggaggcactcatttccccagctgaaggagggaggtgttgattgacga

SEQ ID NO: 475884 - DNA, 613 bp, Homo sapiens
tgatttcagctgagtgactgtctggatctgggggtatggtgacacaagcagccctgcaaccaccaccactgggactgcactgggtcagacctaaagctagcacagaaatgggtcttgcccaaggcacgctgcaaccactgcctggctactggctatgttcactcaagactctagggatctacaatcagcagatagcaaagccagccaggcttgtgtttttcccttcagggtgcctcaccccatggccaccaccaccacaggcctgtggggagtactactgccgatgtttacttaaggcccaagggctcttcagtcagcttgtggtgaatgctgccaggactggtatccatcattcagggcagtgggctcccctctggcccagggcagatccagaaataccatccaagagccaaaacctggaactggggaccccaagagctcgcttgccacttctgctggtatctcagtgggttgcattccccttaagtccactggatctgggcccagcgcaacactaggacttgcctaggagtggcagtcctcatggcctagactgcccctcaagtttatttagggccccagagcactttactccgtgacggtgacacttgct

SEQ ID NO: 475885 - DNA, 863 bp, Homo sapiens
ctatacttattacttgctattttggttacaggagaggccgtaaatgtccaggtgtccagttgtgacttcccattcagtagaacacttgctgtgtctcgtggtgggactgcttttctcttggcgggtaatacctctgtccatcagactccaaagacatggggaagtttccaaagttctaacttctcacctgctggcagtaagagggcagcaaatcacatcctgtatcctgactgttctctgcaggtgtgagtggggaattggtgtggcagggggaagttttgatggtaaaacgagcaaagctttatcccttgcccatcgatgccctggaatgcagaggctgacctgtgtagactatattaactatatcaagaacacccttgcccttggacttctggttgggttaagccaatgggggcatctgcaggagactggcagaaggacagagtgcaagtcccaggtgtgactcttggctcccttccagctaggtcacctcagcctggctgtgcctcttcagtgctatgaggcattccaaatgaatgaatatttcccagtaaacaaatgcgggaaacaccgttcttttaaaactccaaacaagtaaatttgtaatgctgaaatttagtgagattgatacattgttatttaccattctgctcccataaatttcagatataaagcaatgcctgagcatggactgtataaattatttttggaacactagaagaggcactagtcataaaaaaatttaacatacaatttttaaataatacattgttcagacttagtttgttctctctgtaattctatttggtagcagaaaccttattcttagttttctacttcacagaattatagcaaatgccaac

SEQ ID NO: 475886 - DNA, 1375 bp, Homo sapiens
gccggctgtatcataccagtgccaaacggccacctgtcggcctgggccagcaccatgactgacaatgagctgtctgccttggtagtggataatgggtcagggatgtgcaaggcaggctttggtggtgacgatgccccccgggctgtgttcccctccatgatagggcgtcctcgacaccagggcgttatggtaggcatgggccagaaggactgctacgtgggagatgaggctcagagcaagagaggcgtcctgaccctgaagtatcctatcgagcatggagtggtcaccaactgggacgatatggaaaagatctggtaccacacattctacaatgagctccgtgtggcaccagatgagcatcccatcctcctcaccgaggcacccctgaaccccaagatcaaccgggaaaagatgactcagatcatgttcgaggctttcaacacaccagccatgtatgtcgccatccaggctgtgctgtccctctatgcctcaggacggaccacaggcatcgtgatggattctggggatggggtcactcacatcgtgcccatctatgaaggttatgccctgcctcatgccattctacgcctggatctggcagggagagacctgactgattacctcatgaagatcctgacagagcgaggctataacttcaccaccactgctgagcgggagattgtgcgagatgtcaaagagaagctgtgctacgtagccctggactttgagcaggagatggtcagggcagccgcatcctcctcaccggaacggagctatgaacttcctgatgggcaggtgatcaccattgggaatgaacgcttccgatgccctgaagccattttccagccttcctttctgggcattgagtccagtgggatccatgagacaaccttcaactctatcatgaagtgcgatgtggatattcgcaaggatctctatgccaacaccgtgttatctggagggagcaccatgtacccaggcattgctgacaggatgcagaaagaaatcataaccctggcacccagcaccatgaaaatcaagatcatagctcccccagagcggaagtattctgtttggattgggggctccatccttgccagcctgtccacattccagcagatgtggatcagtaagcaggaatatgatgaggctggtcctcctatctaagaattttttgtttaaggtaatacttttcaaataatttgattattccttattggctttatctgacaacataatctttaaaatgcatgtaaccaaaattaatctccaaaaacactttattttatataacttgctttcagtacattaaaattgcttcatacttgtatacttagatttcctgttatttctcctcaaccattcccttagaatt

SEQ ID NO: 475887 - DNA, 636 bp, Homo sapiens
agatcagcaggtaggtactgggactggatggatcctaaaataactctaagaattaagattctcatggccctgctgggcaaaaccagaaaattaccaaaaatatatggggaagtcctgtgtatccttcacccagtttcctctaatggtaacattttgcgtgactatagaacattatcaaaacccagacattggcattggtacaattggcagagtttatttagctttcaagggtcagtctcttccctcatttgcccccgtcaggaggatcttactctcccagacttgttctcagcctttctggggacaaatgaaggaagcaactggggagaagaaactaaccagaggtttggagatgtttctcaggttattttgagaacagccgatccggtagggacacaagtcctggtttacaatgcagatggttttgagcatactatgaaaatgccaagccagaagtcatttaagagtcattaattcctgcagactcctgctcatgacagccatctcctgatctaacctgctatagttatgggtcgaggtgcgacaagcatttgttaatcatgtctgcatgcaggacaatgaagcagatgacaatcagtgctttgattctttctgagggaaaaggacactacaagg

SEQ ID NO: 475888 - DNA, 1229 bp, Homo sapiens
ggagaaagtcctacaacactgtcaccagctcatctgtatctccaaaaatgcaaggcgtagtgcgagttgcaaaggatgtacgtatgagtataatatggtccctgccctcagaagccttctgcctgaaacaatatccaagaaatccagagtgcattcagctagattacgtctggaaagttaatatggcagaactctggagccttcagcttacagccaagtggaagcaatcttgttcctcctatgtaatagacaactttcttgtttctgccttccctgaactctcaagaggctgcaagttgggagtgaaagagcaatactggtcctccacaataataaggaaagaacagcaaatgaaacagcaaacagctagagttgttccagttccctgcaaagctagccaggggccccagcaaagtgagcttcagccattctctagtccaaggctcttagaagatgccactgtgtggcacagaggaaacaatgcagaaaggaaacaactacatgatatattacttacagagacttcaagcaaaatcagtgggtcaagagaaggttagaactcttaaaaatttatcttgattggctttaggatgccaccctagacatagaagttacaaaaagaaacataccttttagagtctgccaaagggatcagctgaggagaaattaccaaactagaatagtaatcaactattctaaaatactctttctgaccagggtatgggaaagggggagaaggggaggtagaggtaagtctgataatgtggcctgcatataaagtgtttttccttagtctgaggtaggatcaattgtgaggtttattttctcttatattactcttctcattttcttgacctactattcttgctccataatcttctaacataaagcctatctgcctaaatatataattttcaaactaaatagaaaatgtgacagaaaatcttttgaaaattctcttaagtttacatctctaaattaatcctcaaaagaattaaatattcaaatcttactcatttctgaaggtatacggcttttctctgctttaatcaggtaatgtaccatttataaattaatgattcattaattgcttattgaattaatggatttgaaatatgatttataatttattagaaattgaaaataatattgaaatgtggaaatcatcatctctgctagtactcttaaaatatacccatagtaactgcactgccaaggcatataaaaaa

SEQ ID NO: 475889 - DNA, 671 bp, Homo sapiens
cagcactctatgtctagctcaaggtttataaatgcaccaatcagcactctgtatctagcttatctgctcagggattgtaaacacaccaatcagcaccctgtcaaaacggaccaatcagctctctgtaaaacagaccaatcaccctctgtaaaatggaccaatcagcaggatgtggctgtaacactcaccactaaggtctgcagcttcactcctgaggccggtgagaccatgaacctacccgggggaatgaacaactccagatgcgctaccttaagaattgtaacactcacagtgaaggtctgcagcttcactcctgaagccagcgagaccaggaacccaccagaaggaagaaactccaaacaagtccaaacattagaaggaacaaactccggacatatcacctttaagaactgtaacactcactgcgaggcaattctgaggggccatatggaaaacaggttgcaagccagatttggccctcaggctgtcaatttaaacattttctggttcacaattggttgagtttgtctaaagacctgggatcacagaaaggaaatgttcaggttaagatcaaagattgtggagaccaaggttcttctgaagtcttatagtggctccccttagagacaataaatgacaaatgtttcctattcagatctttgaaaggtact

SEQ ID NO: 475890 - DNA, 563 bp, Homo sapiens
gcaacattttgtttcctgtctccatgatctcatactctgctgaccttagaggtcttagttccaaagggagaaatgtttccaccaggagacaaaacaatgattctactgaactggatgttaagatagccactggccactttgggttcctcatgcttctgactcaacgggcaaaaaatatacctgtttgtatactgactgatgtgattgatcctgattaccaagggaaaattggcctgctactacataatggagagaaggaagagcctcactttgttgtccaggctggaatgcagtggcatgatcacaacacactacagcctcagtcccctgggttcaagcaatcctcccaccttggcctcctgagtagctggggctacaggagcacaaaggaaaggccatgcgaggacacagggagaagacaggcccctaccagtcaggaagggagccctcaccagaaactgagctggccagcacaatggtcttggacttgtagctccagaactgtgaggaaataaatttctgttgttgaagccacccagtctgtgattttttttatggcagta

SEQ ID NO: 475891 - DNA, 669 bp, Homo sapiens
tgcctagtgttgcttcctgctgtgacaggacagcactgtttcaatgcaaagtcccacaatcattgctttccttaccccaaggccatggattctctgtgccatgtggccactgctggaggatcatgtaggagtgatactggcaatacatgtctgtcattttaccctcttcagtgcctcttccaatgatatgaaattaaaaccaagttctgtaatcacttacctgattttgggttcttatgaaggtgcttttttttgtgtaaaaatgggagtgaccacagggacttgggtttatagcctaaaagtggtgtcaaggtttcagaaagttgaagaagaaataaagaagcacggaagtaataacatgggattatcagaaaacctgactgattgtgctgctgctggcaatggtgatgatggactaattccacaaagagcagaaaacctgaaaatcagcaatttcctaggacggagaatgaagagtatcatagatcttacctgtgagtagacaaggttttgccagtgttgtgcagcaggataatttccacccggaaacctcaccaggctggcctgaaggagggctgagctcctcgttaaagactttacgtcaagctgcaggaatttgtcaggatggttgttatttggcaaaacagagagatccatgtctcccttcac

SEQ ID NO: 475892 - DNA, 1527 bp, Homo sapiens
tcctgaaaataaagaaagtccctgactggggctgctgccttttgttcagagatgccctgcccacaggggtggaatctagagaggcagttggccttgctgagctgcggtgggctccacccagtttgaagtttctggtggctttgtttacattgtgagcataaaactgcctactcaagcctcagcaatggtggacacccccccgccaagctccagcatcccaggtcaatctcagactgctgcactagcagcaagattttcaagccagtggatcttagcttgctgggctctgtgggcatgggacccgctgagccaggcactggaggaaatctcttggtctgccggttgtgaaggccatggggaaagtgcagtatccgggcaggagtgtactgttcctcccagtacagtctctcatagctttccttggctaggagagggaaatcccctgaccccttgtgctttccagtcaggtccctctgctgcaggtctgctggagtttgctggaggtccattcccgaccctgtttgcctgggtatcaccagcggaggctgcagaacaacaaagattgctgcctgttctttcctctggaagctttgttccagaggggcacctgctagatgccagccagggctctcctgtatgaggtgtctacctataattaaaatcaagaaccagtaggcctcagagggtgaaacataaagtatggcctgtgatgagatctgatatacataaaaaaagactttattcagaaaactgggaaatatgtgtaggaatggattttaagagcgcaggatcaaaatggaaggaatataaagttggatcgtgatgatttcattgacagagctcattaatcagagattctgaattcaaaactgaaggactggaaatgactctaacagttttcttggttagttttccaaaatgtggagcaaaaggtagcctccactaccagatctttggtagattataaagtaagtgccagatctttgctcgtacaatatagagtacgttatccaaaggtttagggagactgaactattttaagtgaatgtagtgactgtttagtgtttgcattttctttttaaaattttttatcttaatttttgtaggtacatagtaggtgtattgcatgaattctctgcttgttgtatgaaacgttttatttattgctatttgtttgaacttattaattatgttattcaactttgatatctgtaataatttttgtcttcacctgtttttgagaagcatttgctaaaacactctgacatcaatggttgattagtctgtttcttctcctaattctgttagtttgcttttttatgaatgtgattctgtaatgataacaaaagaatgtatatttctttcttttaacttagtctttcctttggactttttccaaacaagtgtctattcacaaaatagcattaataaatttaatggtgattttattaaagcttacataggacatatggaaaagggttatattttacagtgtgtagcattcattttaaaaattttcattatagt

SEQ ID NO: 475893 - DNA, 1250 bp, Homo sapiens
ggaggcttctgctttcctcttatcagggccatgattcagtccttttaaaatgtggaaaaagtctacggccataccaccatgaacgcgcccaatctcgtctgatcctggaagctaagcagggtcgggcctgactagcagcggaggggagcccacagtggcccaccatccctggagtctgactgagctcacgtcgacctccttctacgatggctcaaagactcctctccttgtcttcagtgacatgcctgctccctcttcactttccgcaagcactggatactgttgtccagtctaatatgaagcatcagcccttcatagtggtgaataagcacaacgtccaagtagaatacaagggagagacaaaaagcttctatccagaggaagtgttttttatggttctgataaagatgaaggaaattgcagaaacctaccttggaaagactgttaccaatgctgtggtcacagtgccagcttactttaatgactctcagcatcaggctaccaaagatgctggaacaattgttagtctcaatgtacttagaattatcagtaagccaactgctgctgctactgcttatagacaaaaagtaaaggagaacaaagttattatcactaatgacaagggccatttgagcaaggaagacattgaatgtatggtccaggaagctgagaaatacagagctgaagatgagaagcagaaggacaagatgtcatccaagaattcagttgaaagctatgcattcgatatgaaagcagctgttgaagatgagaaacttcaaggcaagattaacgttgaggacaaacagaagattcttgataagggtattaaaattatcaactggctggataagaatcagattcagaagaaggaagaatttcaacatcaaaatctggagaaagtctgcaaccacataattaccaacctgtaccagagtacaggaggcacaccagaaggaatgcctgggggattccctgatggtggagctccctctgctggagcttccccagggcccccattgaagaggctgactaagtcagctcaagtatagatgtagcattgttccacaaagttaaaacattgaaggactcaaatttgtagcaaattctgtggccatcttaaagttgagctgcagtagttaactactggccaatctcaatactcgaatatggaacatgtgcacaggggaggtacataactttgcactttataagtactgtattataagtggaaaaggtaatgtcttaaacaa

SEQ ID NO: 475894 - DNA, 462 bp, Homo sapiens
aatatacagacgtgtatggacagcactgagttcaatgtaaagcctcacaaatgctgtgctctccctgtcccaagcacagagaatctccactggcattgcctctgccaggagatgggggttgggtggcagctgtgctttaagactgtctttcctgccctctccaatgactctttcaatgacatgaagttaaaaccagaaataaaatctacagatacacccccacacacgcgtatttcaaacactggctgttcccttaaacacttctgcatggctggctccttcttcttggggatgaactcctctgaacacaacctggtggggggagtaggaagtgcgcttcagacacaagtgcaggagctggacaccgagcattgtgggcagatgggtcatgcttgaaagctgtgattgctatctctgcagggaagcttatggcctggggaaggtttgagttctgtgcacaga

SEQ ID NO: 475895 - DNA, 684 bp, Homo sapiens
aaaacttctgaacaaatgggttaacttttcgactttagcctattttggtagagggattagtagtgatatggggcctcagtgggccagttctcgggcccccagggagacttgtgagtgctggcaatggcatgtggagcaggccaatcctcaggctgctagatggtgcatatgggtgctggcagttgctgggaaggctggctactctccaggctcctggagaggatttatgaatgccagtgcaggaggctccaaggctctgaggagtgcatgctttagggccctttgctttgtggccactctgcctggtttgctggacccctgttccctggggtataggacactgagtggtctagagtactggggatccagccacacagctgcatccagctggcatcacaacactgaagccctccaggtgaatgtaggggaatgtcagcagggatccaggaccaagaaaaatggcacacaaatatctctaagccggcacaactttcgctcatttatcccctttcaacaagctaagtggtaaatgagaaataaaagaggatagaagaggctgaggctttgtgcaaggtctttatttgtggctgaatttttgtacctggtttcacaggagggtatattagcaaagtaatttttggtgttgaagtttgggctgtgatccagttgatgtcacttaagcat

SEQ ID NO: 475896 - DNA, 717 bp, Homo sapiens
ttacaattcgacatgagatttgggtggggacacaaatccaaaccatatgaactgggcagttcctctaggaagcttcccatgctagaggaatcctgggatgaagatttctctttcccaaactgttcccatgaagacactttcagcagccgtggctttatgcttgctgaagaaagtggtctagctgcaattaaatatgagggcttcaaattagaatgggattcagtcgaggggatccagaaagcaatcatggaccttgtagatgagtttaaagatgaatttcccaccatcctaagattatcacagtctaatcaggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaacgagcaaatctgaatacaggtatcactgaacagaacttaagagttatctatttaatggcacatttcatctgacaaaactcagagtctagtttacatattctgaattgctctgctttcttaaaaaaaa

SEQ ID NO: 475897 - DNA, 599 bp, Homo sapiens
tcctttctcacttccatgtttctcccacagcatacctggtagcaggccctcttcctgccacaaagattggtacgatgtgaaagcatgctatgttcagtagaagaaatactggaaagacactggtcaccaggacccagggaaccaaaattgcacctggtagtctgaagggtcgtgtgtttgaaatcaacccaaagttgactgagctaagtgaaaaacaggaattttcatattggtatgcaggggtatatcagatacataaacttgctggcagccttagtattcacagccttgcagactcaccacttcagacttttaatctggttcccttttcaggatttgtccatgaccttgaggaagtcaatttcctctttctggaccttatgtggattccaaactttgaggtggctgcaaaacagttacatgatatgtgggtcccaatgcaaaacgaaaatgtgagaccctcttctccaaaaattattaagaattgcaaaatggcaataccagagcattaaatcaagtgtgaggctctcctgagaatgatgccctgtgcaactgcctgggttgtacttctgggaagccagccctgggtgcctgagctg

SEQ ID NO: 475898 - DNA, 642 bp, Homo sapiens
tttccctgattggtccccgtctaccagaatgctaggaaagattggaaagaaaccagaggaaggaggcattatgctcatcaggtcattagggctccaccttcatgaatggattgatgctgacataaaagccctgggcatatcctcatggccctatataccaggccagtacccacaaactgagcctctagacctgtcccagtgccagacagtgccacacagctcctctagacatcagccttgcatggcaaacccaatctctagcctgtaccacgtccaggccatcatcaacagcccacagcttcaggcagcccccacagtaggcaggcctcactggcccctggcttcatttgtgtcccagtctaatgctggctgcatcttccttgggcttctggtccaacccagtgctgtgccttccacagggtaccccaagtttctggcagtgccatgttggttgcagctgccccaggcttctgatgcacctaagtgacatatttgcaactgggctttctcaggcaaagccagtctgtgaagactggaataagtaccttcttcttccaatgcacagacatcaatgcacaaccacaaggagcaaggaaacatgacatcacaatgggatcaaataaggtgctagtgactgactct

SEQ ID NO: 475899 - DNA, 1317 bp, Homo sapiens
tgtgggtgggcttcattgaatcaactgaagtcctacatggaacatatctcggcccctgcggagcgcgacccaccccccagaagcggttccactgcccacttccggtcctgtcacagactcagcgactgccagcgaccgctgaccgccccgctatggcaagtgcgccaaaactaccaccccgactgcgacgccgccgtcaacagccacgtcaacctggagctccacgcctcctgtgtgtacctgtccatggccttctacttagaccgggacgacgtgaccctggagcgtttcagccgctgcttcctgagccaaacctgcgcggtggccgcatctgccttcctgacatctggaaaccagagcgtgaatactggggagagtgggctccaggccatggagtgtgccttccacctggaggagagtgtcaactacagcctcctggagctgcactacctggccatggagaagggtgacccccagctgtgcgacttcctggagagccacttcctgaaccagcaggtcaaggccatcaaagagctgagtggctacctgagcaacctgcgcaagatgtgggccacgggaaaccggcctggcagagtacctgtgtgacaagctcaccctgggccgcagtggggaggagccctgagcccagatgggccccacagccacggggtgccttcaccgggttgggccgccagacagggtgggcatgttgcccttccagaacgttctcttcagttttttcctttcagttttaccattgttggcaatacagttatctggttttcaaagcaataaaggtgtccagttgatgcgtgcctgcaaaactctcactatttaggaataaaggcacatcctcacacaagtttaaagttgatatccagcagtctctccacccagccctgccccatctgcatgcagctcaggatctccaaggttggaggaggaaggtattccatggggccctggaaagcacattagtcttccctttataaactacgtggatatatggagtgggatggggtgggatgggcagtcttgggccctggtgtctgggggtgcttgggcatcgtaaagtgtgaaacacggtccggaattcatccccacctctggggaagaagtgaggggaatgagattgggcagggattaaaatacacaaagaggtcttcatcttgacatgaaaacttttgtttcttaaatatgaaaatgttaacatttgttgattctaggtagcaagctggggatcctggaagatggcatgacagagtactctctgacaaactcacgctgagtgacagtgacttaatgggaatgggctgg

SEQ ID NO: 475900 - DNA, 670 bp, Homo sapiens
ccagccagtggtctgttcactacccgatccccgtagtaagccgtgggtaattggtaatccacctatgaagtcaaacggggaaactggtgagcgacaccacaaagagttcaagttcaacttatcccagattcctgagggtgaggtggtgacggctgcagaattccgcatctacaaggactgtgttatggggagttttaaaaaccaaacttttcttatcagcatttatcaagtcttacaggagcatcagcacaggaaagggtcgaagcctgtccaccaggagctcaggcacctcctgcccttgtccgagggcaaaggagagaaaggcctgctgtattttggcaatggtgctctctgtcagcccagtggtgtatcactgattgttctcattgtacgattacaaaagtgtgccacagaacaacgcaaattcatggggccccagagtgactcggtagcagagtcgggatggaaactgggctctccacatccacgaatctgcactgaccccgctgccattttctttatcacagaccctgatctttaaaaataaaagctcattctgccagctgtgctaccctcacgctttgaactgtatttctctgtatccttattataagtctttaaaatgtaggtgcctaatctagtcatcagaggtaactcggcatgtgctcac

SEQ ID NO: 475901 - DNA, 934 bp, Homo sapiens
gaggagcagtgatggattgctgggggctgcctcacctcatggcaggcaaatggaagaaagctgttctcgccttaggaaagaaagatttaactaatgtacccaccttcttacaatcgtctctggatgctgtagcaaagccagcaagtgactcactgtctgtcctcaaactctttgcagcccccattactgaagagccccacagacaacttagaaaacacagtgatgggaaagtgacagtgtttgcagagttgctggttgccaggggtctacatgcaaggccaattgatgatgaggaacttctcctggaggagcagatgttggttcagttgctcctgagtgaagcccaatcctcaggttccatcgctattcacagggtgacagctatcgcttgtatggagataccaaagctgcatgggagacatcaaggaccaggggtcacagttctctccttgacctcatatggaaggacaattgagtgctctctgcaagagcttccaagtccccagatgcaggcactgggccctctgcgagtgtctcgaaatggaaactctgcagatggggtctttgctgccaaagctaacatcctaaaggctcgtggccccaaacagctgagcggggtcacctctttttccagcaagcgcttaaaaaggctccatatcagtgctccccagacaccacactgaagctttgcaggacaactctctgttctcaccatctgtttctctggggtccccttagccaagaaagagtctgtacagttggttgggagtggggtggggataagattttacttttagttctcacaccttattcactacctgtgtggttatgctcagaaataaaaataaaataagtttagtaagatttctttgctattatagccatcagacaccatataatacggagaataataatttgttcagtttatgaaatg

SEQ ID NO: 475902 - DNA, 900 bp, Homo sapiens
ggtgggaacagctggagaggatccgtctctccctgagagctccggagaccctctgctctggttgcaaatgccagagcagcggtataggtggcatgtggactctccagaagaaatagcacatagatctcagttcatccccagtctttgctgggtatctggagagagtggagctgggtggggacaagatgcagagcacacgactggggccccaaagacaaatttgcttactgtggtccaggacaagtctagcactgaaggagatgcagctgcttctgcaaaggctgccgttactgcagataaaggctcgttattcactgtgacacacctacatgtaccacctccatccatatttgctccagtgggtcaaggcattaccagtggaggatctgtgtcgaaacacatgctgaaccagcgtgtgcaatggggaggactctccaagagtcttctggatcatattaccttagagggccactatcaacacgttattgccaataacacaataattatgtaagattgagttgccatttcctagaaaagaagagagccccaagggaatggagcccagatgaggcaaattattgaaaatggggaataagtgaagaaagctatctatttccttgaatatttctcccttcacttcttgtattattctttggatttccttgcattgggcttcacttttctctggtccctccctgtttggcttaataactaacctccttaattctttttcagctgattgagttcagccctatgctataaatagcccttgtaattaatggctatctgtttgaaaatcagttatcaggaccacagtttaggagcctttacctctgaaattcatagagcctattttatgtctcagtgataagggaatgataatgtgagttcaaagctaaa

SEQ ID NO: 475903 - DNA, 1091 bp, Homo sapiens
gtccctgaaggacagtggtgaaggaaaaatcttcccagtgggcagaacttctagcaatgcacctggttgtgcactttgcatggaaggaaaaatggccagatgtaggattatatactgattcatgggctgtagccaaccgtttggctggatggtcagggacttggaagaagcatgattggaaaattggtgacaaagaaatttggggaagaagtatgtggagggacttctctgaatggtcaaaaactgtgaagatatttgtatcctatgtgagttctcaccaacaggtgacctcagtggaggaggaatttaataatcaagtggataggatgacccgttctgtggacaccactcagcctctttccccagcctcccctgtcatcatgaacaaagtggccacggtgacagggatggaggctaagaagggacttacagtgttggctggggtgattgacccggactatcaagatgaaatcagtctattactccataagagaggtaaggaagagtatgcatggaatacaggagatcggtgcctcttagtattaccatcccctgtgattaaagtcaatgggaaactacaacagcccaagccaggcaggactacaaatggtccagacccctcgggaatgaagatttgggtgacttcaccaggagaaaagccacaatctgctgaggtgcttgctgaaggcaaaaggaatacagaatgggtagtagaaggtagtcaccaataccagctacgaccacatgaccagctacagaaacgaggactagaaggagaaaagcgtgatctcaaggagccaaaagaaggagaaacaggtcaaaagggaggaagttgtcagtgccgtttttgagatacatgaaaaaatttttaaacatgatcagcataaagatggatttataacaattagatttctttactgaccctagattctttataatgcaaacaaatatttaccatattctaattttttctttaattacaaaatagaatttttgaaaaagataaaaatgtattttatactaatcatatgtgaattcaagatatttaaaaagaatatagactttctgtacaaacagccctaatttgaatt

SEQ ID NO: 475904 - DNA, 834 bp, Homo sapiens
tgaattatcacaggagtccaaatgtccctggggagtggggctgtaaagtctacactttcattctcttctctgacccatggacattttgcacagggcagtgtaacaagtcactcgcctcacagagccctctgggaaaatcccgcagaaattcggaagtcatctcttcctacttgcagtggataccagactctttctcaaaaagctgagcccattcatgtaatagaattgcccttgaagaaataccggaagttattgggaaagaatttttatttttgtcgtgtggaaataaatgaagaaaaatcaaatgagaataagcaaaggctgtttacttactcagaacgtgctatgagcaagtcagctgccatcacttgtcttttggcagaaactcagaggcaggcagaggagtggggaagcttcatagtgggggaaagggaaggctcggagagtgtgctgattggaggctgctggtgcgggaagctggagggggctcactggaagtgaggtgtcccatgggatttggtagagtgcaacttggctttctctgcttggtcctcagaaatagggacagaaattagaaaaactgtcagtttttaattaagtcctggcccttttggagcaaatgttacaacggtttttgttttgcttcctggatggttactagagatagcgtctgacttcctaaaagtctgtgtcatagacatcaggctggcttcctgggctggctcctgcagatgatgggttggtttcctgggctggttgcatagattgtgggtcactttttaaaaaatgtattaatgaggttttactggtggcccgccttcatctataactgcc

SEQ ID NO: 475905 - DNA, 888 bp, Homo sapiens
ttttgcttcatcttgggtaacatgaaggattttcatctcctcctcatgggccagccagtggtctgttcactacccgatccccgtagtaagccgtgggtaattggtaatccacctatgaagtcaaacggggaaactgtggagtacgacaaggagttctcccctcgtcagcgacaccacaaagagttcaagttcaacttatcccagattcctgagggtgaggtggtgacggctgcagaattccgcatctacaaggactgtgttatggggagttttaaaaaccaaacttttcttatcagcatttatcaagtcttacaggagcatcagcacagagactctgacctgtttttgttggacacccgtgtagtatgggcctcagaagaaggctggctggaatttgacatcacggccactagcaatctgtgggttgtgactccacagcataacatggggcttcagctgagcgtggtgacaagggatggcctggtgggcagagacggcccttacgacaagcagcccttcatggtggctttcttcaaagtgagtgaggtgcacgtgcgcaccaccaggtcagcctccagccggcgccgacaacagagtcgtaatcgctctacccagtcccaggacgtggcgcgggtctccagtgcttcagaacaggactctcagatgtgaaagctcagttgtgtctcaaggacaagaagactccatcactgtgtcctccctcccatccgctggactccagaaaaatgcacctccatatggctcctttcaagttagcccccaacccctcccaggtgtactggcccccagagagacagaatcaataggatatatggagatatatatatatataggaggagatttattatgggaattgactcaggcaattac

SEQ ID NO: 475906 - DNA, 2262 bp, Homo sapiens
gagctgcggcttcctgcctccccaggcggcttcggttccaagggtgcctggctgcctagcgtcccgcagtgtccagggctttcagacctcacctaagcaaatgaaacctgcccgtgggatgccctttggcttttatttcacgagtgatcagaagctggctaccgccctggtggcaagtgtgagcttactgtcacttactgtctgggcagcagtttatgacatctgtgcatatgcagtggaaactttattcattggactgattgacatgggatcacatgtggaacaaggagagaacaggacccaagagggacacgaacaagagacgggcaaaagaagaggagccaaggtggacaaaaattggcaagagaatctgaaaagacaagccacaggtgatcaaagtaattgcaactgcaatatgcgaagacttttgacaaatcaacactgcctcttggaacccaacagccatgatgtgaaaagcccaactcacatgcaagaccacattggcttccaattggtcatggtgggagtatttacactttggagatcagcaaacattacaaatcagatcttgttctatgggttgttcattgtccggaccagaggtctgcaaaagttgtctgtaaaaggccagatagtatatattttaggctttgtgggccacacggtctctgttgcaacactcaaccctgttgttgtagtgcaaaggcagtcgtggataagtcatgaacgtggctatgttccaggctttattggcaaagccagatagcaggctagattcggctcaagggccatggtttgctgactcttggtctagacttaagaaagtgatggagaaaataataagaagaagaattaacatgagtgttatgtctgagtctgttacattgtgatgagcacaaaaacttcaggaaatattcttccagtattcaaaaactatcatctaattcagcaaagaagttgctcatgtcattgatagacaagtgaagttccaacatacatatttgttgtctcatttccattttaattatgaataaaaatgaaatatcaaccaacattcatgtttgaaccacacacatttgtcaatgatatgagcaacttctctgctgatcaaattataattaagcttattcagagtattattttgggacacaatcatggatgataaaattattaacgacattggaatttttaagaaatagcaagtcacattgacattatagaatggaatttacaataaagacttgtatattttatttgcaaattatgtactatacatcctttttattagtaaactttgtaattatctcatgtacatatctgtgtacttatagtgtttttatgttgttaagcatttaccagtatagcattgtacataactgttcagaacttggcttttgttcacttcatatattttgaagaatcttttgtacatatatacctgcctcattcttttcagcaactctatatttttaaacaacttctagtattttagagtccctgtttgtttaaatactctcttagtgatagatatctaggctgtgtgtcaacctttctccattggaagcaatggaaagtttttaattattagccagttgggtttaatttagattgtgcagtctggctccagccagtggagacaggacacagtaacagggacaaactgcgtaagggataaaaattgcttccctcctttgttcaggtgtgctcttgccattgttccatctgcaaggagcaccctttctgcagaaagtaaaattgccttgctgagaaaactttttgtctaaatgctgatttttccttgtggtaccaaggaacaagcattctgtttctaaataaacattttacttataacagaggcctaaggtagaaggattgctgggagttcaaggctttgccacccagtccactgtgctaccttccaaacatttgttgtctctgtcacccccactcattggatggcatcctttggtctaggctccatcacctcatgcttggtgctgaaatgatctcactgtcttcagcaaagaccccttctaattctacattatttttatatcagatggtaatacgttacgtttcctttctttggaaattaaaaggtgagcagtccccaaagaaatgtgtaagaaaaaagggtgttagtttcctctcaattcccctccaattccacttccttgaaggtaatcattgttaacaatttgatgtgtacttttccgtattctcctccatgcttgtgtatagtttttaaaaaatgggtcctat

SEQ ID NO: 475907 - DNA, 770 bp, Homo sapiens
ttccgtttctgtcctatcagaatgcccttgtttcaatcttccctgcaattgtctacttttaggatcctgctgataggtgcgattctggcttggaaggagcaggatggagaagtaaacaccgagctccaggggatattttttaattccgggcttcagcatcatccatccccaagagccccagattttatacattctctcacatccaaggttgtagaacacctgacagtatggtcttcactgagacaagaacaagctaatggtggtatcctgggtgacgttgcagggggttccaggcattgtacaatcagggacgcattccttcctaatcagattcagcaacctgttcagatgagtctgctcttaccacaacaaaaccctcttaagtggcagcccatgacacaaacctcacatcttttacataagaagcctccaactctctgcccagctgtcttcatagaagcagatggtgtacaggctgaaagctgccccagccactggggaccaggaaactgcggacttgctttcctgactcctgaagtgaccaaaatggagaataagccaaaaatatcttggcaaagttaacaagggaacgtcataagttgagcttagagaacactcagaaattgcaccatgcactccagcttgagcaacagagcgagacctgtctcaaaaaataataataataatcatttaatctaatgtaaaaacttttttaaaaaaatggagggatttacttcgggctgattaacttagggatgaagacaattgtc

SEQ ID NO: 475908 - DNA, 656 bp, Homo sapiens
atgcccaggaatggccaaggacagcttgcagatcagaagcaagatggagtcaactatgtcagatatctcttactgtcataattttgcaaaggtggtttcaattgtggtctccagaggtcatctagcccaacctcatcgtcttatcaaagaggatgtggcagcccagagaagtgatgcgacttgcccatggccacacagtctgtcgggaagagaaccagggcagagcctgggccacagccaatactgtgtccacaagaccacagaatatatgccagaaaaagcaggtgctcaaatccctgaaatcacaacggacatgtggccccctaagaaggaagtgctctggattgagttcaccctctccctgcacggttgcaagggtagggcctgccccactgcacaagccctgggtgctgggcctgacagatgctctaatggcctcatgagccaccacaccctaggagcatcacgagggtcggtggagcccagggtgaggtacactggggacctgcaagaaactgggaactgcatggatttgggaggactcattggggcacaataggagggtctcttctgtaaggtctttcaaatcccaccaaaatactggatgcctaagacttggaacgtcagagccttaccttagggcaacagcctcttgc

SEQ ID NO: 475909 - DNA, 984 bp, Homo sapiens
ctctgtgtgcagtgatggagagtggtagcttgaaatcagccatggtggcggtatttgcaccatgggagttaacaaacaccacaaatcagagctttttttctcctggagatctggttgttaaacacctaccagcacacaactgtttctggagcatagtaggattagaccatttcttgagacccactttgctctatgtcacattgttcagagaggagaagttagggaagaggagggaaaatcaggagaaatgtggaatgaaattgcaaacagattatttcaagagcagacattcggcagggttggggagtgggtgtgtctcagacgccctgttcttagggaggacgcagctgagctggcagcagcagcatatgaaaatcccaaacctggcattccacatcacctggaggaagctggctgggcaagagtgtctctctaatgcagggaattgaagacttccccactcatcccaaaggtggtttgtgggatcatttcttagtagtgtacaagggagccaccaccaccatgctaaactccaccatttctgctgtcctggtgaattacttctggtctcctcatcctgctagtaaggtgaacacagtctctcctcatttttccagcccccaacaattgctagggtcacagaacaggcaccttcacatccttcccataagcctaagaaagtggggtccctgacttggcattgcactttgaaaatgtcacccgtaacgcaagagggaagctgtggaaagtattgaatacaatctttagaaagcaaagcctttttagtgaggaatgcacatttatttgacagtgttcagtgttcagtgcccactgcaaggcattttgctaactgtcatattctatgaagagtggtgaaagcaaccccctaaagaagtctaactgggatgggtcccggcatagaagacaataaagctctgggccctggagaaggtgtagaatatattagctgtccattaggtttgt

SEQ ID NO: 475910 - DNA, 1144 bp, Homo sapiens
atctgatttttttacatccacacagctcaggcagcagccctgagggttctggagcacaacttgaagaccacaggggagagggggtgatggggacatttagtgcagtctggttaccacttcaaggcaagcagaaagtcggcacggctgggcttagactgggttttgggaagagagagacagtgtcatgggctaagatttggaaactaaaagagggagtaaggaggaagaaccaactccgaggcaaaggccctgcctgccatggtgcccaggtggttctgagcaagcaggctcaggatggggttctgggtgaagccataggggccaagcaccagggagcaggacgtttctacaagatgcccccagacacagccatggcagtggacagagtttttttgcaactgttggttctgaaagtctgtgtgtggccactacgccctgtgcacggccatcatgcacaattgggcaggttgtgcactgcacaatatctcccaggcaagggatttggataacttagaacaagttgcttccctttcatttctggtgagtgcatttggtgagttttatgtttactgtatcaaactgacaaagaagtgtgtacaagctgacctcaaacaacagagatgactgttttggcacctggtttttagcacagttgcatgtagagccgtctgataaatgatagaaaaatttagtagatttggggagtttggttttgatgttgattgaggactgagtaaagattcaatgcctgacaacgtgtggcttgtagattaatagctctgattgttgcatgtatcagataaaatgatcaggaaatctgagcatctcttctggtggttaagagcctgagctccgcactttgtagttacctgatctttttaagcttctgttttatcacttgtgaaatgggaacagcaatagcatctacctaatagagatagggtgagaattaaataagacaatgaatttagagcattgagcattgtgcatggcacgtattgaaaactgtttatagatgtttatttgaaaaaaaattcaaaggctttcactctcattttgttctctacagggtgttattttacttgttgcaatgcatctccatacatctctcttaaaatactattttttttttaaactctaagtt

SEQ ID NO: 475911 - DNA, 656 bp, Homo sapiens
tgcagcagcatccatccactgctcatacacggaagagacctgaggatgatcccaggcatgaaatgttgagagggggtaaggtgatactggaaattgcccatcagatttggcaatgtgaaggtctttatgacttgatgagactaatgttagcctggttgactgagctagtgtatgtggaggggtggggacgagggaagatgtgcaaatgtttggcacttcctagagacttgttgaatggttttgaccaaaatgctgatagtgatatggacaatgaagtccaggctgaggtggtctcatatagagatgaggaacttattgggaaatggagtaaaggtcactcatactatgctttagcaaagagactggtggcattttgctcctgccctagagatctgtggaactttgaacttgagagagatgatgtagggtatctggcagaaaaaatttctaagcagcaaagcattcgagaggtgacctggtttttcctgaaaatgtagttatatgcattcacaaagagatgatttgaaattgaaacctttgtttaaaagggaagcagagcataaacgtttggagaatttgcagcttgaccatgaagtaggaaaaaaaaatattttctgggggagaaattccagctggctgcagaaattttcataagt

SEQ ID NO: 475912 - DNA, 785 bp, Homo sapiens
aaattgagttcccaggtaatcaactctcacagctccctccaaagtttgttttaaatccttaagtctaatcataatgcttaaaaaaacagcacttcatattgacgataatgtagttcttcagaacgttgacccaaaccgtggtcactttgccattagtcacgtcagctttggtcaatcccaacccacatgtttccaaaacactgtggaggtgctctggcaagacagatccaaggccatcaataggccaatgaacccaagcggcctcaggtcttgggcgtctctgaatggaacacctgcagggaaatgcaagcatgagagcaagtccacagagcccaggctagtgggtgctcaggacgaaggcattcaggtgcttcgttttgtcttgtgtgaaacagccttcagatgttctaaagtgagacagtcggctcgctatggcagacctctaagttccaccctttccaagcggacttcctcaggaacctccacaatcaacctgtgcaggtcccagcatccagattattatcaacacctgggaagtgtttgctttgagtgcctttctctctcttccttgcccaactcctaccagctaaagcctccaagacacgcccataagatgtcctgccattgagaaaaaaaataataataaaaactgtgagtagagttcttacaaggaaaaagtgctttttaagatttttaaaaatattttaagaatgagaagggggccagttgtgcgtggttgctcgtgcctacaattccagcactttggaacgctgggataggaggat

SEQ ID NO: 475913 - DNA, 816 bp, Homo sapiens
ggaacggggaagaaataaagtcctgtgaggacatttggtaatgtccagagatatagttggttgttataactgggtagagtggagtgtgctacggcgttgcagctctaacccgcaatgtgactgtgtttggagacaggccctttgtggagaagaggaagagacaccagggctctctctatctccacacaacaaagagaaaaggccaaatgaggacacagtgagaaggcagtcatctgcaggacaggaggagatatctcaccagaaaccaactcagctgaagccaaatgagggggagagaagaagcagcaccagccggtgttattttaaagctgccaatgaggaccccactgtaggtagcagcaggaggagcacagatcgtcccgggtccaagatagccactaagtcagtgaagctttcaccagaggcgcacgtggtggcataccagtgaaggccagtgcaggtatagaatcgtatcatcaatgaggagagatagcttgacttctcctcttcctatttggatgcttttatttctttctcttgcctgattgctctaagacttcaagtactatgttgaatagtactggtgagagtggtcatccttgtcttgttccagtcctcaaggggaattcttccagcttttgcctgtgggttgctgctttgaaaaacagtttggcagttctttaaaatgctaaacatagagctatcatatgatccaacaattccacttcttggtatatgcccaagagaaatgaaaaatgtatgtctacacaaaaacttgtacatgaatgtttgtggcagtgtcattcactaatagcc

SEQ ID NO: 475914 - DNA, 546 bp, Homo sapiens
gaaaaggaagcccacggaaggatagctgtctacgcctgtccctttgtcaagccagaagcgaggcgagaatccgagtatccagagtgagcatttggcgtcaaccagctctccatggcctcatccaaaaaacacagctgcataaggatgatgtttattcacacaaatagcacaggaggacaccagccccatgcagacagcagcccgggggtcacaccagtccttctgtcctcacattggcagatgaagctctctactccagagccttcatgggggcctgggcacctttggaagcctgagcaggagctagaactgaagctggagctgcagctgaagccgaggcctgggccttgccaagatgaacatttaaatcagcagacttcaggtaaaggagatctccttcctggatgtgagtgggccacatccaatcagtggaagacctggacagaacaaaaagactcgtgtctcctgagcaagagggaattctgccagaaaacggtctttggacttcacctgtaacatcaactcttccctgggtctccagcctgc

SEQ ID NO: 475915 - DNA, 839 bp, Homo sapiens
tggatggatggctttgggtggatagccgggtgctgtgagtacattcattcactattcattcagcagatatttttattgactgcctactctgtacaaattagtgtggatgaaactatgccctgcccacaggaacatgtccagctggggagcaagatggaacatgcatgcaaagccctcgctcgctctcggggcctcggccttggcgcccattctggccgtgcttgaggagcccttcggcccaccgctgcactgtgggagcccctttctgggctggccaaggccagagccagctccctcaacttgcggggaagtgtggagggagaggcgcgggcgggaaccggggctgcgcggcgcttgcgggccagcgcgagttctgggtgggcgtgagctcggcgggcccctcactcagagcggccggctggccccgccggcccggggcagtgaggggcttagcacctgggccagcagctgcttgcccagtcccattgaccgcccaaaggctgagaagtgcgggcacacggcgcgggactggcaggcaactccccctgcggcccgggtgcgggatgcgccaggctacgacatggatgaaccttgaggaaattatgcttagtgaaaaaggccagacacaaaaggacaaatattgtcattccacttagatcaggtccttacagtagtcaaactcatagagacagaaagtagaatgatggttgccaggggactggggaggagagaaaggggagttagtgtttaatggggacagtttccgcttgtgaagaagaaaaaattcgggagatgggtggtagtgttggttgcacaaaattgtgaatgtacataatgcc

SEQ ID NO: 475916 - DNA, 1216 bp, Homo sapiens
cttggggaaatgggacactgcagagaaaagataacttccagaaccccctcgaaggcagaagcatgtaagcccactcggccaccccaggactcagaaccgctcccaagcaaagccgcagctccgggctttccacactgcaccaagctgagcaactagatgctccatgaggctgccacgaaccgaaaacaaacgaacaaaacaaacataagcacccaaaacaacaacctggctctcctccagaatccaaatgaccacttggcttacatgccagaggaaatctggggtctcaagtggcgcagggtcgggagctcggctggtgccacagcccccgccctgctgtcccgccctatgggactcaggctgcccgtccccgccagattcagaagcccagctagcttcacccagtggatcccgcactggggccgcaagtggagctgcctgtcagtcccgcgccgtgcgcccgcgctcctcagcccttggatggttgatgggactgggcgctgtggagcagggggcggtgctaagcccctcactgcccggggccggcggggccagctggctgctccgagtgcggggcccgcggagcccacacccacgcggaactcgcgctggcccgcaagcgccgcgcccagccccagttcccgtccgtgcttctctttccacacctcccggcaagctgagggagccggcttcggccttggccagctcaggaaggggctcccacagtgcagcggcgggctgaagggctgctcaagtgccgccaaagtgggagcccatggaaaagaagtgcccagagcgagtgaaggctgccagcacgctgtcacctctcactagcactttaggaggctgagacgggcggatcacctgagatttggttgtgtcctcataggatcatttatcctgttcctgcgtcctgtgtttcctgtaaactgctagttacatctagtggccacatagttcaggttcaatgtttttaggggcaggtgaggtattttacagatggttctgtgtacttccttttacatcacaacaggagcacctatggggctggctgctccgctttcaatgacaaagcaatgggttcgggtactatcagcctgatccaaccattgcaaactttcccaccagctcttctcagcatccttcacaataatctatgagggaggtgctactattacttccacaatggttacagcatttgccttcttaatggtgt

SEQ ID NO: 475917 - DNA, 669 bp, Homo sapiens
tttctgctcctgtgtgtctgtctacacccagagctatcctgtctgaaggcgcatctgccaagggatgccctgccaaagcctctcagtgccccctgcacgtacctttgaggcctcgcatgctttggtctcttcccatccagcctccctggctgtgggcactccagccttgctgcctgctctcccctgccctggcatctctagtgcctatcctggactgcccttccttaccccttttttaccatattgcctgcacttccttgagagttcaactcagtgcttgcttcctgaagaaagatcacataatatatatttcgcaagatattttaggctaaatggacaaaatatagaggatgaggacagccccacaaacttgtctttctggctgggccactggacctctgcatttggcaggcagggcaaagtaaggtgggcctgctctctggtagacctcttcgagttccactcaacgttagcttccatcctgcaaacttataagctgttcttgactctgtctcattcctcacatcctcagtgtggcgtgtggaaagaagaggaaccagaaaagaatgtttgtgaagttctggcttgaatctcgtgccgggaggtgagtctgcacacagcccccgatccttctaaatgcacgaggatgacgacttctattttcccagg

SEQ ID NO: 475918 - DNA, 570 bp, Homo sapiens
tgcttttctgtctttaccccatctggccaagactaactagagaatgtcaccaaactatgccaattggaccagctgcaaatttaggctaagccttaccacatgtgactgttcagacctagatctggctcatttgatgcagttgtgctgccagtgtaaactacacatcagatttcacataaaaaacaatgtcaagtgtcagggcagcaggcctggccatggctggattcatccatttccaaagaagaaagcagacaccactgtaggtatttcaaagcggaagagatttcatataggaaatctggttaccaaattcttattaaaactggaaaaacaaggaaaatgtggtgtttccagaaatcctgaactgcagaaagctgctacctcttttacaggatccagtgctcagtgtgtcattttagtatgtgctatttatggaaatccctttactaattcaccatcataaacccatcgccaagcatatgtaggccatgattctaataagagcaatgggttttgctgagttctacccactctgttaccctgggctgttaagaacatttactttaaggc

SEQ ID NO: 475919 - DNA, 688 bp, Homo sapiens
caacccatatttaaacaggattaaccctgcattgcctgaggaaatggtaatggccccctctgaaacagtggccaaccatgacactgctgattctcccaaagacccacctccaccacccttctttgcttctagacctataactagactcaagtcccagcaggcctctaaaggcaaagtacaaagtgtgacccatgagtacactaccctccaaaagaactacttgcattttctaatttatatcagcagaaatccagggaatatgcatgggaatggagagtggtttgtgagaggagtcccagcatccctgaagagctccatgattattcttctcaataggtcagatcttctagtgggaaccacagatattcaactggaaaacttaaatccagtgggtataataggattctgggatggcaggagccaagatgcagctgtcatcccagaatcctgccaaaggcaaggtgggcatagttaccataaaaaacagcagagacaaagcaaaaatcagaatagtctgacctatgtaaatctacgacatttgcaaattaatcatggtgttcctagaagtgaaacagtcaggaagcctatctaaatttttgcttgatctgtataagtagaaaacttgcaggtcaagtgaacaaaagtttaactcaaataataaaaactgagactcaaatcatggcccctc

SEQ ID NO: 475920 - DNA, 721 bp, Homo sapiens
gcacacatctgtgtgagcgactgagtgtgtctgagtatctgtgtgtatgggtatttctgagcatgtatgcctctgtgtgtatgcattgtctacgacgcgagtgtgccacctggcaagtggatcctctggccccagtcaaggagctgcagctgatggtgcatggagcagagagaaactgccctgctgagccctgccaaaatcataaaattacttacggtcagcccctaagcttctcggtgaagggaagagcaacattgaacatccgtcttggacaccttgccccttggttcttctatctcacgagtgcctcgcagtggctctgcctgtggacccttactcatgttctctggaccagggttgttaaccatagcagatcgtctctggatgctgtagcaaagccagcaagtgactcactgtctgtcctcaaactctttgcagcccccattactgaagagccccacagacaacttagaaaacacagtgatgggaaagtgacagtgtttgcagagttgctggttgccaggggtctacatgcaaggccagaattcctggtgggctttgctgtcatttcttcataacgcctactggggacactattgctttctcccttagtatctttcttgtgacaaccgcatgcctggagaaaccagcaaactccatgatggctatttatctataatttatttttaagaacattctgccaatgacatctcaagcaaga

SEQ ID NO: 475921 - DNA, 575 bp, Homo sapiens
ttaagtctgcatgtatgcagaatgcaagagtgaagaaggcttggtggcttccacccagatttcagaggatgcatgggaaagcctgggtttccaggcagcagacggctgcaggggtggagccccacagacagcctctctacttggacagtgccgatggggaattgtagggctggagccccaacacagagtttccaccagggcactgcctagtggagctgtgggaatggggtcactgtgcttcagacaccagagtggtgtaggcactggcagcttgcactttgagactggaaaagccaaagacattggactccaaccttttagcaaccctcatgaaaccattcccatcagagaaggacccagtatggtgaaaaaggaaacaaaatgcctgaagaaaaagggctttggcattttgggagcataaaaaaattattgaatgggggtaaccaataacaggaagagcctgaactatggagtaccagggagagtaacagtttttccctactccattagatgaccattaggataattcattcattcaatacatgcttattctgtaccaggtagcaatgtataca

SEQ ID NO: 475922 - DNA, 1898 bp, Homo sapiens
gctgccctgggaagatagatgagcccacttggcctctggccagcacatgccccacagaggtgatgagatgatgagcccaaagacacagcgcggtgcgtgccacggaggaagtggtgttcgctcgatagtcctgaatcctcctgcttaccaacgagctcccggttcccacccatgccagagagggagaacggatgacttgggagaaacgtctccacagctcctccttggctctgggcacagcctttctcttgagtggactcacacagccctcatgaggccaccaaaaagacaggacacctcccaagccacagctgcagccctgagagggaaacgtacaagctccccacctggaggcagcctcttcctgagtgagcggcggggtgctccgccatcaacttgtcagtcattcatccggggaaggatggaggaagccgctgttgaccgcttcgcccacaccccagggtggctctgaggcgctcctgtggcctgggacagaatgtttctgtgaacagcagcccatggccaggcaaacacagaacatctcccctggaagacccgcattcaaagggccaccagattaaactcccacttcacactgagggggagctgataagcaataagtgaaggtgctcatagcagtcatcaatgtgcttacagagcatttagctcaaagttgcataatctttaaccttccccaggccccagcctgtcggtctccacaccagccactgtgaggacaggatgaattcatttgcagaagacaagcacaaaacctccgatagaaaataaatgcaatgtaccatagtaaatgggagcagcttaaaaaaaaaaaagcacaaaatccattggggaccctgttgccataggaactggcattacagcttgcttccgataattaatggagggttttgctattacagtattcttgaaacttcggtttcccctgtgctgcactgcagaatgcagcatcctctccccattcataaatatttcatgactaccggctgctgtgtttcatcaccgtggatagcactcggcctaatccaccccttgccaaattcatgttgtcctgtcagagagcaacttccatttcttcctctttcttctgcagtcttcatttatctggtttgaagttctttaccttcccaaccccagaatggtggctttcattgtggctttgtcttcagacgctggacatctctttcctgtgcctgtcttattttcctaacggtcccgtgggcctcccccaggggcattggttgtgctccggccgtactgccttctgcacatctgctttaatggagtcctgggaggatactgggcttttgaattctggtgtctcaacatgctggctgagcctctgttccctcatggttaagtagagatgccacctgccctgcagggttggagagagagagccagaaaagatacaacacgtgtaaagtaccagtccccccacgggtgggctcaaatggtcacagtggctgctggtgttggtttgttctcttatatctcttgtttttgtctagataaaatccgtaactttttttaattgacaaaattgtatgcatttgtgtgtacagcaagttttgatattttgacatgtagaatggctgatccaagctaattaaccgtgcattacctcacatacattttttgtgatgagaatacttaaaatctactcttagcaattttctagtatacaatatattaattgtagtcaccatgttgtacaatagatgtcttgaaattcttcctcctgtctaaatgacaattttaatcttttcatcaacatctccccaagccccccaacccccaacccctggtaaccaccatcctattctttgtttctatgagtttgactttttttagattccccgtgtaaccgggatcatgcc

SEQ ID NO: 475923 - DNA, 1984 bp, Homo sapiens
agctgggactacagagccatgctggggtgcagcgtgtggactccatgccctgatttactttcggtgtggttgggtgggtgacaaacgggattgtttcaatcctttagccactttcccttgatttctcacaagccccaaatatgggtggtgccgatccagagacacctccagccttctcagacttggggctgggctgtcccatgctggctctgattggcagcataggccatttaccggccaaaggcccctttgaaggaaacagtacagtgagcgccctcggcctgctacacacagaggctctggaggagagagggaggaagtccttaagccagggtctttgctcccaggttctggggttcctgatctgccagaaggagaaaaggcagaggaaacacacccacagagccctggaactcagcgccactccttggttcccagctctgacaggtccccagcagcacaaagctgcccagggcacagctggaaagccagccaggctgggtgctccccaaggccctctcagctctcaccttcaggggtcttgtgccatggagttttcaggaggggccctggagacaacaggaccggtggcaccgcagcctttccctttcagggtgcttaagtgccccgggctggtggagggctgggcacaggagagaggcaagtggcaacagcagtgtgccaacagcttagatatagagtgtgagagagaagagtggaggctggttctcaggctccagaagcataagcctgcatggagcatagcgtcactgagcaagacaggtgtggaggatgagaagcgggccacaggatgggaagggaatctgtgtggaggcggtgccctaaacatgctgccttgaggagggacctctacatggggtggccgggcacagccaggctacccatggggacctcaacagctttgccattgcacactatctttgcagacaagatcttaatcacatccaactttctgcagttgcacagggtacctcagacccacatcccagatgacattcctcagaagctcgcagctggagatgacatcaccttagacaacatcaccctagcccaagacatcgctattagagatacatcacctggacactaaagcctccaacccagtgacactctcaaggtgctgacaaaatggacatggacatttgttgcttttcttcttttgaattaggaactctattgtgtttcctgaatttactgtctgcttggcccatgatcctggtatgttccttgctctctgccaaaacatgcaccgtcccctccacacctaaaggaaaacctggtagaagctactactctcaatgccattctaaaattgacgaagagtattattttccccaagaggcagctgctgcaggccagtgaatcctctggaccctggggagagggtcatacactccctagtgacttctactgtatgctccagctttccaccaggacctcctgccctgtccccaactgtaacgaccacaaccaccccatccccttggttacacacaaatatcaccagtctttacatgtactttactgacttctcagataataccctccaacaagataactgcaggacttgccaccatgacctgagaaatacaccaagatattattgtccaatttttttgagatatatatatatttctcatacttttaacatactctgcaatccaccaagatattggtagagaccctggaaatttcaaatctatttcgtctgctaatgccatgtgaatgggaaacttagatacaggctggcctacaaggactccttatacttcaatttttgttcctcctttcaactctcataaaaaatattttctgtactatttagggcaaatgatggccttctttctaagtctcatccatcattgctgcaaaggtgccttagtttgatgttaaagtgtcacagggccaatgtattgaccatgtttctggcgtctataaagtcgatgttttaatatctgtccta

SEQ ID NO: 475924 - DNA, 535 bp, Homo sapiens
aaaggaggcgccaggacgaccttctcccttgctgcttcccagaatggctgctttcagtgaacttttagctgacaaaagtcaagatgcccctcccgtaaagatggaagtaaatccagaatttgaagagggacacaagagaaatggagatggaaaatcccatctgaccaaaattaatttggacaaatccagccccaccactacagaccctcctgcccccaagatttatccgtttgaattaatgagcaaacccttccaaacaggaccatctctgggaatgttaactcattgtaacccttctagtccctcataccttagtgtgacattgttgaatgcaggtaacaagaacaccctgactgaggtgattctgatgagtgacgctggctcagagccgctcttttacgtggctctaatactcaagtcattgaatgccactgaacaaccattatccaaggcttccttggttcaagatttcatagttgcgtaatttttatgttttatccaagttgttggctgaaaataataatagctaataatt

SEQ ID NO: 475925 - DNA, 2717 bp, Homo sapiens
tgagacaattgtttatagtaaatctccttctctctctctctctctctttctctctttattctcccttccttcccctccccttttgttccctcctctccccttctccttcgctcccccctctctccctcattctctctctctccctctcttttgaatgctgagagttcccagtgcgagtgatgcacattgctggtgctacaggtgccagtagaaggatctccagggcagtagaatcccatggcaacacggcagataaaaatgactcagccctctgctgccaaaggtctttgccagtgtgtgaagagcaaggatctcagttcttagctcctctagaccaggggtccccaacctccaggctgcagactggtagcaatctgtggcctgttaggtactgggttgcacagcaggagacaggaagaagaagaagaggaagaggaagaggaagaagaagaagaagaagaagaagaagaagagaaggagaagaagaagaagaagaagaagaagaagaagaagaagaagaagaagaagaagaagaagaggaggaggaggaggaggaggaagaagaagaaatgaatcaacagggaaatattatagctacatttgagccttttccttttaaatttgggatacaccatgaggggcccatccctggccttgttccaaactggggcattttcggctcaggccattccctcacccctgtacaaggtttgtccccgaccacagccagtagtgccacagtagatttatgctgcacaaaagctgaggatcctgaggaccccctgattgcagccatgtcgagactgatgctgaggaggaccccaactgtcatgagcaacaccagtcaaacacagccacccatgtgcggacagatcaagaagctgtcacagatggtggaagaaaacctgaggaaagcaggacaaccagtcacagcttctgaatgggagacattcctctccatatacccgtaaaaatcttttatgcattcacttagaactctgcattaatctttgctaggatcggttttcttaagtgacactaaactactgggctttcatcttgtgctgctctttgcatcttaacttttcctggaagtctacccaagaaagcccctttagatggtatgaccacaaggtctgtaatcgtcgatgcctcctctctttcccaacttgctgaaatctactgcaatgaccatttgctctacctacctgtggggaccctttgatggtcacaacgttctggtcagttaggacagctggaacccaatagttctcaccatttctttttggtgtcagccaaaaaggattaaaggaaaggactttaattttctcttcctaattttggacatgaataacttctaggtagtgggtggctatgaaaacagtatctctgggaatgatgcttcttttccttgttcttgtaaaacatacctattctttcacaacattggcacagggacaaaatacctaagtttagcatatgcaattttgtaattcatattttacctggtgccagacaaacaggaaaatacttagaaccactttaaaattttccctacaaatataaaaggtttattgatccttgatgtataaaatatagactattagaaaagtgcaaatgaaaggtctggaaatctggagaagctgttgtctgagaagtcagaagtctcacccaggtagctgtgatgtaggcagctcacttgtgctctctgaggatctgttgcctttttccataaattaaagaggttgaattagatcattgtgaggacgttttctaactgggtatgccaaatttaattagatatcaattagcacaaggattggctaactaaggcctgcaagtaaaatctaaataaagttttattggaacacagtaacgctcattagtttacatattggttgtggctgcttttgctacaatagcagtattgagtagctgtgactgtaactgcatctcccacaaagcctaaaatattcactatttgatcacttagagaaaaagtttgttgactaatggtcaacagttttgaaatcggcaggtattccattgattgaacaatgccatatttttattgaagtataatatatatacataagagtgcacatatcataaacaaaatgattgaattttacatacctgtttaactagatccccaggttacaataaaaaccaggtcactgccaacgctctagaagactttttgtgctaccttccagttactactctccccaaggatacccactgtcctgatttctaacattgatttctatcaatactttataattctattttgaatttcatagtatgtgctttgttggtgaatagactctttaactctcattatgcttgtgaaatgcaccagtggtatgctggtaaaccagctctttgggggaagaaaacgcctactttgtagcatttgctggtttctgtggcacaaatacacccaccatggctgatttcaagatgccaacttgacatcattgaacgcagattaggaagagatgctaacagttcttgctagtggggaaagccagtctttaaactctgagattttctccttaacttggtctagtctgctattaatacttgtgattgcattatgaaattcttgtagagtgtttttcacctctatcaagttgattatattcttttctatactggctattttgtctgtcacctcctgtatcaatttattttgattcttaccttccttgaat

SEQ ID NO: 475926 - DNA, 1400 bp, Homo sapiens
ctctggacacatctgaacatctgaaggagtaaatcccagacacaccatctttaagagctgtaacactctcccacgatggcactcctcacatcccagacgatgggcggccgggcagaggcgctcctcacctcccagatggggtggccgggcagaggcactcctcacttcccagatggggcaaccgggcagaggagctccccacttcccagacgggatggccgggcagaggtgctccccacttcccagatggggcggctgggcagagatgctcgtcacttcccagatggggcagctgccaggcagaggcacttctcacttctcagatggggcagccgggcagaggcgctcctcagttcccagacggggtggctgggcagaggtgctcctcacatcccagatggggcagcttggcagaggcgctccccacttcccagatggggtggcggccgggcagaggcactcctcacttcccagatgggacggccaggtagaggcactcctcacttcccagacagggcagccgggcagaggcactcctcacttcccagacgatgggcggccgggcagaggcgctcctcacttcccagatgatgggcggccgggcagaggcgctcctcatctcccagacggggtggcagccgggcagaggcactcctcacttcttcccagacggggtggccaggcataggcgctcctcacatcccagacgatgagtggccaggcagagacactcctcacttcctggacgaggcctccacagaagcagacgcctgtacagcctgcagaactgtgagctgattaaacctcttttctttatcaattacccagtttcaggtatgtctttatagcagtgtgaaaatggactactacaagaaactggtaccagaaaagtgggacattcctatgaagatacctgaaaatgtggaagcagctttaaaattgggtaaggagcagaggctggaacagtttggagggctcagaagaaggcaggaaaatgaggatacatctgaggccactggtccagaaggtgcaagctgtaagaagccttggcagcttccatgtgtgttaaccctgcatgtgcacagagagcaggagttgaggcttgggagcctttgcctagatttcataagatttaatgaaacacctggatggccaggcagatgcctgctgcaggagtggagccctcatgtagaacttctactagggcagtggggaagggaaaagttggagcccccacacagagtctccactggggcactgcctagtggagctatgagaagagggccattgtaccccagacccccgaatgatacatccaccaacagctcgcaaaatgcatctggaaaagctgcaggtgctcaacaccagccagtcaaagcagcctaaggaatgtactgtct

SEQ ID NO: 475927 - DNA, 664 bp, Homo sapiens
gttagactgacacagtaggattcacatgtatgtagaaggcttgaaggacctgagtgacatgattatgttccagccactctctctgcctgaagagaagatgaatcttgcatacatccttgaaagagccactacaagattattccctgtctgtgagaaggcactgagagaccacagacaagattttcttgtgggcaatcggctgagctgggctgatacacagcaacctgaagtcatcttaatgactgaagagtgcaaacccagtgtcctcttgggctttcctctgctacagaaattcaaggccagaatcagccacatccccacaattaataaatttctccaacctggaagccaaaggaagcctccactggatgaagaatccattgagactgtgaagaatatatttaaatttgaacatggcctgtttcttaaaaacatgagcactacagtagctgagtattaacaaatgaaacaaagtctaagaaacgtagtaaatatttcactatgcattggtagcagacccataaaaatatcataaagccacattaatgtaataaagtaataagacatgaggaaataaactgcctaatacctgtaagttacagagcctcttctacttttcataaaacaagaaaacaccaattaatcagagccatccaaatatgaa

SEQ ID NO: 475928 - DNA, 653 bp, Homo sapiens
aggaaaaccagagacctttgttcacttgtttatctgctgaccttccctccactatagtcctatgaccctgccaaatccccctctctaagctgctctgacccccgactgcaacagaacttagctgatgagtccaaaacatgaaattgactccagctcatcttttccattcttgaatttggctttgacaagaaccacagaagtcaatgggacctctgttggagattacaaaatcagtctccccttcccatggacccacagcaccaacccaggacaggcaggcaacaccaagggattgcaaacttcctgcttgcacacacttagctcctgggttggaaatggcaagagactctgcagaattgtctaccaaattgctgtggcaccagcagcctggggccaaaaggccactgacaggcatggaaggagacagacagcaggactcaaggagaggaaggccaagcagaccatgcatggcggcaagatggcagccccagtaccagccaacatgtctccatggttcaaatgtggatttgagggcaaactcagaagcccaaacagaccctccaaaatgagactgagttatgttcttatccctgaaccaatcactgaccacaggagaaactgacactctggatcatatgccagtcctgggtcgg

SEQ ID NO: 475929 - DNA, 797 bp, Homo sapiens
gtcaccaccagcacgtgcaccatgtcctcccgctgctgcgtgctcctctgccagtggcaatggaagaagagatccccgcgctcttcattgacaatggctccggcatgtgaaaagcagctttgctgggacaatgccctccgagccatattcccctccatcatcgggcacccccggcaccagggcgtgatggtgggcatgggccagaaggactcctacgtgggcgaccaggcccagagcaagtgcggcatcctgaccctgaagtaccccatcaagcatggcatcgtcacaaactgggacgacatggagaagatctggcaccatgttttctacaacgagctgtgcgtggccctggaggagcaggtggtgctgctgaccgaggccccgctaaaccccagggccaatagggagaagatgactcagatcatgtttaagaccttcaacacccaggccatgtacgtggccattcaggccgtgctgaccctccacagctctggttgcaccactggcattgtcatggactctggagatggggagatggccactgctgcatcctcctcctccctggagaagagctacgagctgcctgacagccaggccatcattattagcaatgagcgagtgcaagtactttgtgtggatcggtggctccatcctggcctcactgtccaccttccagcagatgtggattagcaagcaggagtacaacgagtcgggcccctccatcatccaccgcaaatggactgcgagcagatgcatagcatttgctgcatgggttaattcagaagtataaatttgcc

SEQ ID NO: 475930 - DNA, 757 bp, Homo sapiens
aggtaagctgtgtattccatcaaaggtctgtgtgtgcaggattgcatttccaagagaaggcattcctggatcatgatcattttgtctgagctgcatgtggccaaaagagaccacatagtgagtaaagcgtggaacagcaaggattccaaccctgtagcgcagctttatgtctggaggaagcaagtcttagactgggactgtcaggccaggaagaaaactcagagcatggacaaaaggttcagagggagtgaggaccgatttatatgtgttgagggcctgagccaggggaaggcattggccctgagctttgcctgtgtttccagatggaggccattgaactttcagtggatccaaagtctaacaaaagacaatgtcttgttttcgtcaccccccaaagaagaggaacctgtgagaaatattctggagaaatttaacaccatcagtggaagcaagaggtcagataatgagaatggttataataccaatgcaaccatgaccccatcactgaagaagaaggctaaacgactatgtaattttgatgatggatggaaggacacatactactgaactaggaaggtcttgtaatctttaatatgttaataaagaagcacatctattatgtgacagatttaaatgtttaagaatttgatttcaatgaaattgcatttcaataaaattggcttcctttgcaatcctgtgtattttattttgtgcatttctccagactgccaaagaggttggtgacacattgaaagtt

SEQ ID NO: 475931 - DNA, 1035 bp, Homo sapiens
ggagtgcatgcgggccgctgccatgacgaccgccatcttggagcgcctgagcaccctgtcggtcagcgggcagcagctgcgccgcctgcccaagatcctggaggatgggcttcccaagatgccttgcactgtcccagaaacggatgtgccccagctcttccgggagccttacatccgcaccggctaccgccccacggggcacgagtggcgctactacttcttcagcctctttcagaaacacaacgaggtggtcaacgtctggacccatttactggcagccctggccgtcctcttgcgattctgggcctttgccgaggctgaggccttgccatgggcgtctacccactccctgcctctgctcctcttcatcctgtcgtcaatcacttacctcacctgcagccttctggcccacctgctgcagtccaagtcagagctctcccactacaccttctactttgtggactatgttggcgtgagcgtttaccaatatggcagtgctttggctcatttcttctacagctctgaccaggcctggtatgaccggttctggcttttcttcttgccagcagctgccttctgtggctggttatcttgtgctggctgttgctatgccaaatatcgttaccggaggccttatccagtcatgaggaagatctgtcaagtggtgccagcaggtctggcttttatcctagacatcagccctgtggcacaccgtgtggcgctctgtcacctggctggctgccaggagcaagcagcctggtaccacaccctccagatcctcttcttcctggataactgtctacacctggcagttttctctgacgtgctgttcactcacatccctaccttgcatgaggttggaaacatcttcccctgtagcaaggcagtcaccttaaagctgcctctacttcccgttactcctgctacttctccgacccttctcactaccctctagttgttttaactcagtcatggggatccttgacacatccagacagagagagagagaaggcctaaatttccacaagcagtagc

SEQ ID NO: 475932 - DNA, 584 bp, Homo sapiens
gaatccaatcaacacgtatcagacctagttccctttcagattgcccttgaaagccacagacacaggcagtatgcaaaatgatgaaaaaatagataagattaaagagttatttttatcccctgccaaatggccaactgggaaaagtaaccatgatactaatttcacatacaggatgctaaagaactgtgcctgggatcctccagccctgaggacatccaggaagaaccctggaagctactctgagtgtgaaagccaggtttatcgggtctttctccctaaacgttccagggcctgtttgaaaaactccaaactggatgaactcaggaagtttaatcgatccttcccagagacattgagaattaagccatggacccagttctggcccatgcgacataaagagaatctgctggtcatggctctggaaaaacatctgttagtaaaggagacagtctatggtcccttctgttttatcctccctcctgaattgaatgcaaatgttaaggttggatttgaagcagttatcttgagaccatgagggaaagaccaagagaatcacagaatcacagagatgtcagtcctgatat

SEQ ID NO: 475933 - DNA, 1425 bp, Homo sapiens
tctcccagaggactgctcactccctttgtccctgcagccttcaaatgcataatgcttgtttgtatccgcatggctgtgctcctgagggccgtcctgaacagtgagctgatggatgagaacactttggggccagtgaaagcagcaaggagggaagctgtaccctgcaaagccacaggggtggagctgcccaagactatgggaacccaccttttgcatcagtgtgacttggatgtgagacctggagtcaaaggagatcattttggagctttaaaatttgactgcagcactggattttggacttgcatgggccctgttggtgcaaaagtaattgtaactgcaacaatgcaattacttttgcaccaacctaatacctgggtgtggtccggtgagtcaagctgtggaatgtcaggaaatttggctggtgaccaagagtcgtcatgtttgaccggtgtgacatcatgggctgccacttactggcacaggactgatgatgatacaggaacacacataaagggacacagcagcaatcacaaaaccacacaccccactgggtggcctaacctagatttctgccctgaagaggggctgtggcaggatgagcaaccgcaacccgtgggcagcagtccccattctctgattcctcttgatttcttacggaaatggagagtttgggcttgtgggacctttgaacatggatatcaaggtcattcaaacttaccagaaaacatgttttcttaaaggttctgtctttttatagtgtgaacatgtttttattgaacaccaacttaatttcaggaacatttcaggtacattgtcagaaataaagactcttaagaatgtattattatgtacccaatactggtttcaggcctttacatgtattctcatgaaactctatgaagtagatattattatcaatattcctactttacagatgaggaaacccaggcctggagaggtcaagcaacttgctcaagtggcacagctggagagtggggagctgggacttgagcccaggtagtgtgtccccagcaccttcaactaaactccattctgtgctgccctttggaacacccactcaatggccttcacactccatgtcctacttgggaggacatgtgatctcaacagcactcacaaatgaaggctttccagacaggatattgaagatgggaggtgtgagctgtgggagagagctgactaagaagaagaaactccccagaaaggtggcctgccagtcttcacgatgtatgggagcaggtgggaaaagagctgcaagtgtttgcacttcatcattgaaattgttgaaactgctgatcaggaaacacagaatgagtttaaccagcgatgccaacttctgcaagatggactccagcttgggagctctgtatggaataaataagatatcccagacatcaaagcact

SEQ ID NO: 475934 - DNA, 3137 bp, Homo sapiens
agatcagtatacacacggatgtggactcctcactacgtattgtttgaatgactgcttcttgcactaatagaactgaaggacttatttggtgtccatagctgtgtcttgcatacaaaggccacatgaacaagatcctgaagatgattgtgtccttcacaatcggctttcaaaacatggtaaagaataccacctgtgactggagtctcacgaggaccagccccgagaggttgggaacaagggctctaaccggagaggactgcaagtgctccctgagagcccagttctgctccatgctgtttttcagctggcagttcgattgcactgacctctgggagacttgtgtgcgttgcttcggggatctccagccccctccggcaaactccccagtgctggttcatcagatcaaccttctccctctggcccaggagacgggcctgttctatgtggatgaaattattattgcagacacaaacctctttctggaaggctgcagcctaagcaagacaggacatccttcagacaaggtcctcctaggtgcacaccccaacccagacgttaatactttgtttctgacgtgccacagctctgtgcccactgaaggaacagaagagggatctggactggtcctggtgacgacacagagacgacagcggacaagtccacctctaggaggacactttcgcatccagcttcctaatacagtgatttctgatgtccctgtacaaatttctgctcatcaccttcaccagctcttacagaataatgccgatgacttcacatccaggtacctcaatgccagtgacttcactgtgaaggaggatctatacacttgctacgaacacgtgtggaccttgtcctggtccactcagattggggatttgcccaattttatcagggtctctgatgaaaaccttactggagtgaatcctgctgcagccacgcgtgtggtatatgatggtggagtttttcttggacccatatttggagacatgttggctactgccaaccagcatactcagttatttcctaaacatctgcctatcttctgtagggttgatctccacatccagtacctcacagaagttttcagcatcgagccttgctgtgggtccctgctgggagggaccatcctcagcatctcaggaataggcttcagcagggacccagctttggtttgggtacttgtgggcaatcggtcctgtgacattgtgaacttaacggaggcgagcatctggtgtgaaaccctgccagccccccagatacccgatgcgggcgctcccactgttccagctgccgtggaggtctgggctggcaacaggttcttcgcccgtggtccttcaccaagcttggtggggaaaggcttcaccttcatgtatgaagcggcagcaacaccagtagtcactgccatgcaaggagaaatcacaaatagcagcctgagcctgcatgtgggaggaagtaacctctccaactcagtcatccttctggggaacctgaactgtgatgttgagacacagtccttccagggcaacgtgagcctgtctggatgctccatccctcttcacagtctggaggctggcatctatcctctccaagtacgtcagaagcagatgggatttgctaatatgtctgtggtgctccagcaatttgcagtgatgcctcggataatggccatcttcccatcgcagggttcggcatgtggtgggaccatacttactgtgagggggttgcttcttaactctagaaggaggtcagttcgggttgacctctcgggtccttttacttgtgtgattttgagtttgggagaccacaccattctctgccaggttagcctggagggtgaccccttgcctggagcttccttctccctgaacgtcacagtcctggtcaatgggctaaccagcgagtgtcaggggaattgcactcttttcataagggaagaggcaagtcctgtcatggatgccttgtccacaaacaccagtgggtctctgaccactgtgctgattaggggtcagaggttagccaccacagctgatgagccgatggtatttgtggatgatcaacttccttgcaatgtaactttttttaatgcaagccacgttgtgtgccagacaagagacttggccccaggaccccactacctgtcagttttttatacaagaaatgggtatgcttgttctggtaatgtttccagacacttctacattatgccccaagtgtttcattattttcctaagaatttcagcttacatggtggaagcctcttgaccatagagggcacaggcctgagaggacagaacaccacgtcagtctatattgaccagcagacctgcctgacggtgaacatcggtgctgagctcatccggtgcattgttcccacagggaatggctctgttgccctggaaatagaggtagatggactttggtatcacataggagtcattggttataacaaggcctttaccccagaattgatctctatttctcagagcgatgacatcttaacctttgcagtggcccagatctcaggagctgcaaacattgacatttttataggaatgtcaccctgtgtgggtgtctctggtaaccacaccgttcttcagtgcgtggtcccttcccttccggccggggagtaccacgtcagaggctatgactgcatcagagggtgggcctcatctgccctggtgttcacctcaagagttattattacagcagtgacggagaacttcgggaatgtctcagctgctgtgtgtggtgctccctgccgagtcctggctaatgctacagtgtctgccttcagctgcttggttctgcccctggatggtaactttaccttctccctccctgaacttccccacaaatgcttggccaatggaccgatggagccatcagagagtgtaggctgggtggatgtggcctggcagccgtgattcacaagtatgaaaaaaagccatagagaaatccagcagattgtacaatgtttattcaaaagaaggagggattttaagaaagtagatagaaatgtgtaatatttataacaatcatgttctttgaagtttcaggtatcaaaaaaaatttgcaatgaaacaagttttagtaataaagaatgtatccaaatgatatgatactaagtcaccttt

SEQ ID NO: 475935 - DNA, 672 bp, Homo sapiens
gggctctgtaccgcagtgcctttgaagaatttgagcttggatgcataaacagacatgctgtctgttctcatggagcctacagtcaagaagatcctggtgataatagaagccacaggaggtgacaggatccaggaagaatgtgcagatgaggaagaagaggacgtatgcctgggacttacagtgtttgttctcttgcagctccactcatctggcttaggtagtggagctggcttagagagtggaaatagaaaatactacaatatactaaacttcgtaaggcagtgtggggtaaggactacagcagtatgtgcaaagcctggtggaagcagtaagaaggatgagaagcttaaagacttgagagaggctgagtataagaagggagtaagaagattgccctttctgaaatctctggatctatttcctcttttgcctggactgctgttactggtagttggtgtgttattcaattatctctacgttttaaccttggtgtttacctctaatgttgctcaagtcagtaaatgattcattgcatttggaaccaataaacagggtttggcagaaaagggacaatgtgtggcggatgtgtttgggctaaagggaacaatgcatttgaaactgggctctaagagcttagaaattcaattatgccttcatgcagacaaggctagg

SEQ ID NO: 475936 - DNA, 1049 bp, Homo sapiens
taaaggaaaaaggggggttgttctctggcgggcaggagtggggggtcacagcggggcaagctgattttcatggccccaggacccatcgagctcagggcacacgccatccttgtttctgatggtggagagctccggattggatccgaagacaagcccttccaaggcagagctcagatcacactctacgggagttcctactcaactcccttctttccctatggagtcaagttcctggctgtgaggaatggaactctttctctgcacgaacctgaacgaagacgacatggggcagtgctgcagctgacctactgctctcatctggcttcattttcagtcaaactctgccctcatggaggcagaaatggcagtcctgtgactccagatgaaagggaatgcctctttcccaatggctgtttaacttctgagcaaatttcaacatttccccatcaccgtttgacattgctccttcggttttcttctccttagctttcaacattatttaatgtattatgtaaggtttacttttcacatttttttgtatttattttattacctctcccagaagaatatatacatcatgagggcaagcactttactttttttttttttttaatctgcattgcctagaacagtgcctggactcataatatgctttaaaaaatatttgcttgaataagtgaatgaaaaacttgagcaaaagcctcaggattaactttcgccccatttgagtcataagccatttgagagagagagagagataaaaagagagagagagataaaaagagagagaggaagggagagagaaggagggagagaaaaagagaagcagatagagagtccaagtccaaaggcgtaagaaccaggaagaccaatggtaaaaagttaccaggcccttattttaatcagtctagaattgattctgatatagtttgtcagttatctattttttttcaaatgaatagccaattttcacagcactatttattcaaccataggctaaaaaatgacacccatgtatgtccatgtcctaatccttggaacccatgaac

SEQ ID NO: 475937 - DNA, 1126 bp, Homo sapiens
cctgtgagtcatttttggatgggtcctgctcacctcttcagaatgaagggacagatgtatttatggaacacttacatgctagacactgtgaaaggcattgatattgtgacggtgaatgaacatagagcaactgcccatgccctagacacagtgctggctttagaagatgctgtggactggaaccctggggatgaagttgtcatcatcagtggaacaggtgttaaaggtgccaaaccgatggaagagattgtcactgtggaaactgtgcaggatacagacctctatcttaagtcacctttgagatattctcacaactttacagagaattgggtggctggagagcaccatattttaaaggccactgtggctctgctcagcaggagtattaccatacaaggaaatctcactaatgagagggagaagctgcttgtttcatgccaggaggccaatgctccagaagaagagcccagccaggtccagttgaagggagtgcagtttcaagtcttggggcaagccttccataagcatctgagctcactcactctggtgggagctatgagaggtgctttttctggaaatgaggagcagttacatgtgcagatcttggccagacatgaagatataagaagggagcaggaaacatcaaattcagagtctttcatacagggctgcacagtgaggaactccttcagtagaggcctcagcatgtgcgggaccttgggcctgaaggtggacagtaatgtattctacaatattttaggtcatgcgctgctagttgggtctttgcacaagctctctggctctgttcatgccacttactcttctcttgcaacattctctctcccagacaagtccttctgtttaagctctttaagcgccaatcagtacttcttgatttaaaattatataccacatttctggtcatctgattaatgtctttataccaccggatttcttgaggacattgtctcctgaacacttagcatattaactagtgcattgtagatctattagttgaaagaaatgaatgaattaagaaacaaagggtctccagttttatcagaataaaaaagcaaatcagaggttttcactgaaagtgagaatataactgtatttgttaaatacc

SEQ ID NO: 475938 - DNA, 786 bp, Homo sapiens
tcactcaggttaaggagtggttcaaaatgccttgtttattgagtgccttttatgcaaggtgtgggggataccatgatgagcaagatggaatgaactttgactttatggggtcttatgatctcttggggatgtcagtcaaactactaacttctacctctgcccctgaatcagctttaaaatggtccctccctgaaacatggcaaggtgttgaagaaggctggggaggatacaacaataccattccaggccctggggatgacgttctcattttacccagtcttctggggattgcaaggtctaggttttttgtttgtttgattgttgttgttgttgtttttgccttgagccatctgagcaaggtgacaactatagaccttggtttaaatggcaatgccatgtcgtccactctgatttctttgaagtctgatgaagagaacagtagcatagcaccgtctctagatttaaaacaataataataaagcctgggatgagagaaggcacagattcttttctatttttatgaaaacagcagcaccttctggtattctcctttcagaatttgggatgcagaggactgatctgatacagttggtaattttacttaaaaaccttcctattaaatagattcaaaatatttctgaagaacagatggtatagactagaggaagaaataaacattgtatgttaaacattttattgatcaattaaaatatcataatttaaaatgtttattctactatgggaattatgcatgtctgtgtgtgattgaaaaagacacagaaagaa

SEQ ID NO: 475939 - DNA, 791 bp, Homo sapiens
ttccttgccttctgccgatcttggctttcgccttgaggagaaagtcttcaaagaaacagaaaaatggctgtacagcctcggtggagtcaacagggaagtatgcctgttcccagacctagactctttcttccagtgattacaacacatctgttgctttcctacctaaaactcatcacaaagcactccagaaatcttcacaagaaagttgtaagcttttcagctaccttcctagcagattgtctgaggccttatattcctgatactatctgcgcctcattcatcatcggagagggccacactggtgaaatggaggttcttattgggccatgctccaaagtcagcatccggtttctaacagtgatgatgaagcatgataacattggcgaatttgaaatcattgatgataacagagctgcgaaaattgttgtgaacctcacaggcaggctacacaagtgtggagtgatcagcaccagatttgatgtccaacttaaaaatctagaaaaatggcagaataatctgcttccatcccaccagtttggtttcattgtactgacaaccgcagctggcgtcatggaccatgaagaagcgagtcaaaaacacaggagggaaaatcctgggattctttttctagagatgtaatacatatttacaaaaaagcccctattctataccatgaaaaatcaatgcaatggtttataaattactcatggttatatttttctcaagattatatgtttccatgaacgtgtttcacagttttaaaatactacaacatccattacagactaatc

SEQ ID NO: 475940 - DNA, 872 bp, Homo sapiens
aaagaaagaaagaaagaaagaaagaaagaaagaaagggagaaagaataccctttgggatcactatgcccagcaggtcccaaagagatcttagagaccttatgattagatcccctctagagaatgagactacggaccaaaagaacgtccagcttccatggcccgagaaagagaacatcaaatttccaaaagaggcaatgagagaaaactcaaagtcagagagcattgttgatactggcaattcaatacgcatcgccttatgtctttatgtgggattagaagtgaataaacaggaccctttgatgggttgccacggtcatttcaaaagtgctgcccaagaagaagtcataatatttcaaaatacttcagaacagtttaagcctgtttggaaattctgggcaactaatagtgacctccacaagtatttcttcaaaaagccacataagcatcctaaaccaagatttactaatcctaaaatcagcgagtgctggattaagggttctcatcatcaggccactgaatctcttggggctcctgggataagccctgtggtctggaatccaggaagcagggaagatgaagtggttcttccgcttggaaggacagagggttccgtacctgccattcttggaccactggtcaaggaagttcggatcatcatctgaaagttgtctgatgccttcatttgaaatgctctctgcagctctctatttattctttcaattgttcctacagagaactccccctgtaaacttatatttccaggatttgaaagtttaaaaagagagactgttgctcctcttacatacactgacacacagacttacaggaaagctttttaaaacagtacacttatgttcttaaaataggaatg

SEQ ID NO: 475941 - DNA, 928 bp, Homo sapiens
ataggtaaacaaatcatcctccccagttaagacttccctgacagtcccactacgagaaagctgtggtgtgcctgggaaaagactaatcatatgaaaacactggccatgagaatggatgccctggtctcacttgatcaaagaagagaaagctgttaatgtactggagcactcttgctgcggaaatgagtcacaccatagagcctggctgctgtggcatcatacggaaactgtagcaaaactcaagggccgctctggagtgaaggagagcttggctgatggccaggaaaagggagctggaaaaaaatggagaaagccacacagtgttgaactaaggccaggatctgctaactccatgccccaactgtgcaaaggtatctccagtctcccagtgactgacagccatagcagagtggttggggtatgccaaagcttgcagctggttcttcatatggagcgggtgaaggtaaaaggaaatgtcagaaaattaagcctaacactagagggtattttcttttacaggtttccagggaaagctttgtttccatttaacaggctccgttagtaatgaaaatgtactcagcatttccactttggccttccacagctcagtcatgggaaggtttccttttctttctttcatccctcacctggatataatactacctaagtaaagagtcgcatggctctggaagcataggaagcacatcattgctgttgctgcagatccatttcccctcctgtttgtagaaggtgaaagatagtgggagaaaaatggatggaccctactgactttgaagggctgattgtggctaagttcagaaaaacaaacaagctgcttcgccatttgtgagaataaccagcagatcaaaaaaaaaaaaaaaaaaaaaaggtgtcttttccaaaataggtcaaatgttgaaacagtatt

SEQ ID NO: 475942 - DNA, 533 bp, Homo sapiens
agcagctcctagaggttatgtcttatgactcaccaacatgggccacgtttgcaccaaaaccatgaagaaggctgcctgggtcatcatagaaaagtactacatgcacctgggcaacgacttccacacaaacaagcacatgtgcaaggagattgccattatccccagcaagaagctccacaacaagacagcaggttatgtcacccatctgatgaagcagattcagagaggcccagtaagaggtatctccatcaagctgcaggaggaggtgagagaaaggagagacaattatgttcctgagatctcagccctggatcaggagatcattgaagtagatcctgacactaaagaaatgctgaagcttttggactttggtggtctgtctaacctgcaggtcactcagcctacagttgggatgaatttcaaaatgcctcggggacctgtttgaatcttttctgcaatgctgtattattttcaataaatctgtgacaacaacaaaaaagaactaaaaacagaactaccatttgaccaagcaa

SEQ ID NO: 475943 - DNA, 714 bp, Homo sapiens
caaattctacgcctatacgccgtggccatgccctcctcccagcacgttcgggacgttaactggtcgagttacagatgactgccagagttgccctccgtgcagcctgggcaagtcacgctttgttaagtccattggccattatgctgattttaaaaattttaaagagcatttttatgcagaggactctctcgacagcaggtgtgacccctatttgggctctggacgcctctcgcctgagtcagctccagaaggctgcagcccttaggagagaggaggaaaagcgaagagcagggtgggcaggaactaataggttttcgaacaagtgggcgaaaaactacctgaccttgctagcttgtgaccagcacgcgggctcccggagccgtgtgcgacggctcgacgcaggctggcgcggcgcacgcgcggttcgttggcccgcggtccctgtgcccggagcgtgtgttattacccagtctcccaactggtgtcggtgattgagctctggaaacctgaaggaaagacagtgggagtgcgccggcatgtgacccaggggaggggcatggcgggacccaagccgggaaagtagacccggggagatgtttgactgacctcatcctgagtaagcccatggggttatttatgaggcctgatttaaagtagtggctgccaggaaagtgaaaaaggagctcacctcaagctatgagaggagctacagtc

SEQ ID NO: 475944 - DNA, 917 bp, Homo sapiens
gagaacgggccatgatgacgatggcggtttcaagaaaacacagcatgatggaaatggcaaacccatttgaccatgagggactccgggatccggttttggtgcttctttggtcttgtacgtgggccctagtgctgctccctccctccggttccatggatgcaggggccattttgttcagcaccacatacccagcaccgtgctcagacgaggacatggatgaagctggaaaccatcattctcaacaaactatcacaaagacgaaaaaccaaacaccgcatgttctcactcataggtgggaattgaacaacgagaacacatggacacaggaaggggaacatcacacaccggggactgttgtgggcaccagacatggaggaacatctggcctaggtcttcatctgttgatgctggcttctgtattttgtgatgctaggcctggaagtctgccaactacatttctcataaccctttgcaagctggattctaatttggttctgcaatggggcacagatgggaagtggaaggaaggaagaaaggggggaaaggatgttccagcatatttccagttcctgctatcatccttccagcagaagagacaatgacctacatttttattggcctagaagtttgagaattgttaatagtagaaaggttagtacaatgtgataccaatcaggtttcttgacacattcaggtttatacggaccaaactttcattcaattagccccttgcctttgcagccaggaacctcttgttttcagtgtcttaactaaaggacaatgaagttataaaaacaagctatgaaaaaagaaagcatcttaaaagcaaaagttttctctgatcactgtttctgttctctttattgaacacagacctgaatgcttttgtgcctctaaaggtttagaatacagccatc

SEQ ID NO: 475945 - DNA, 653 bp, Homo sapiens
agtgggtgcagcacaccaacatggcacatgtatacatatgtaacaaacctgcacgttgtgcttattcttcagtgttggcagtggtggaccagccatgcctgatcatggaccccacgatggcatattgtagcactagtgtcagtgcgaccaagtgggacaattcttgggcctccaggttgcttgcctggatgccagtctttgcagtagtaagccactggaattggtttggagcctgtgaatccccttacatgtcagaatttgtggaagctccaagtgctgagtctttcttaaatcttctaggaggtcttagaatcatcaatcacgtcaaaaagtgtttgataagtgccaagctctttgtcctggatgctgtgcaagttaaagaagatttgcaagttccatgtgaagaagaagtagagtccttggacctgggaaaagaagggtgaggtgccagaggccctattccttttgttctatttttaaaaagtctgtttcctctctgttgttcagattgggtaattttcattgttctgtctttaagatcactaattattttctcttccagcgccattcctctgttaagcagaatccattctttttttaaaaaaattatgttgtatttttcagttccataatttccatctaattctttataa

SEQ ID NO: 475946 - DNA, 1931 bp, Homo sapiens
ctctcccctcagataggtctttttattgtttatttgtggatttgcaagtggatagtggaaaattgcgaaatactttacactgcaggatgacatatttacaggtgcacttttgctactccgtggagaatgaatgggccgcagccaagagtgggagcagggaaggcatgccacagttcattgctgaaggaagagcatatcctgtgcgacttccctttattcaatttgaatataataaaaagctagaagaattcacccatccaggatttcaatggtatgaaaatcctggactaactggtctggattatagggaggaaaaactgcttgggtgtagaattgaaagaactgaagtggaggagaagagagacagaactgacttaatgcagcacagcaatctgtggtgtgatttccaccatcgggcagccaaaccaggaatgtttgatccttttggagccctagaaggagaatgctttgaaaacagaagcttatgctttgcaaatcatgagccagaaatttttcaggcctctctagatgcttcgaaattgcagagctacattaaatagtccagccctgtatttcaaaaatggatggtttagatagcctttcttaaactgagtgctacagaatatatgtagattgttaacaggaattctttgaaaaaatttttttcataatcaaaataatgtttggaaagtcttaaataaaacagtgtatgtggtttcttcattttaggacatttcagtgatatttttggaccaaaatctataaacagatagaatacattaataaaatttaaatatagtgtatgaagaaagtattttcacaaacattcaatgtgcacttttactgtgtcagacattgaagctatttagggatataaaatgaaatgcagcatctaacatttaggaatttgaagttaaaagacaaagttcaatgtgtatgcatgagtaaaaaagtacagtttaatataaaaaattacagtataatacaatatcttaaagccaaagttgcctacacaatgccaaagtaagttagagaaagaggcaattacatttggagaagaggtggacttcatagagaaggtgggatacacctgtatctgttgtgaaacaggaaattgcagaaggaagaaaaggcatttcagacaagggaaaagcatgtgtaaagtcacaagatttctctggactacaataattttttttgacatatatgaaacagtataaaatattactagtttgatttagaagagattggtaaataaaatagactgataaatacctgaatattatgtttcctgcacaggtatggtcatcatgacattactataatactgtttctatacttgttattacttcatagagatatgtttagataataaaataagtgaacctacttctcattattatctaattggattatctaaggtgagactattctaactaagcccaaatcacctttcagttgaagggaaaatttaaaaagtatacattcaatgaatactaaaagtactgtgtaaatttcatgctgctactggagttttactaaatatttgtaatcactttcctttatgctagtcaatgtagtttcttaatataaattatgttataccttcaaacacgtgtatattttataacaattataatcatagcaccaatggctaaaatgacagtttaagtacttattttactgacatatatcatgtttaaaaactccaaagcaactggccatgagattcatgtaaaaagcatgattgtatttattttcctagtgttaaacttatgtctcacacagcaagtttccttaacacagcatggcaagtgttttttcaaatgtggatttcaatgttatttattaatagaacagtgattctctattgttagatcactggaaattattagaaatgtgaatatgtggcccagtgtttccaaggcctt

SEQ ID NO: 475947 - DNA, 1654 bp, Homo sapiens
ttcctacagaaagggtgacacaccatctgtacattttggaggcattcttaggctcaggattgacaaataggtacctggtgatttgcagcttgtctctctccactctcagagcagctcctctttccatctgcagccccagtgctgacagtggatgcttttctgcaggcacacggaggcacagccacccagaggcaaccatgtcctatagacctttctcctgctgccttaaaggtaggaggagctctaagtgtccaggtggcaatcttaacttcttgtttaatagaaccattgttgtgtctcctggtggcagttctcctctctctggaactgagacctctaggcctgcagaacataatgtcatggaacgagtggagcataaagttcttgtccctgatgaaagtccacccctctcagccccaagcagggagttttggggctctggaccctcagctgcaggtctgttggagtttactggaggtccactccagaccctgttttcctgggtatcagcagcggatactgcagaacagtggatattagtgaacagcaaatgttgctgcctgattgttcctctggaagttttgtctcagaggagtacccgaccgttcagtgtaaaaggtcacccaaattagatgatgcaaatacgtgatataatcattgaaattattttaaagttgtaatatatttttaatcaccatatagtttttattctgtaataggagattatgtgcaaataaataatgtgtttttagattcagtctttttgaagatgaatataaggacaaagacaacgctgtctgtatgaccaatcatagctaatgagagaaaattagggattgaaatatggactaaatgcaaaatttaatcttgtgcatgacataaaaagagcctaggtttcaaatttagagtacataaatcaagaattataaaaggggatattatttatataatttaaaggcaaaaatgcatttgtctttattattaagttattccatataattccagactgttgccaacaaatatacctgcgcatgtggtactgtccactaggctcctgaaattcttgtgtgggatggtaaaggcaaggaaatattttcacataaatatttctttacaaaatatatttactcatgaaaaatatttgtaaaaccaggagatttcaacattgattgagccacaataaccagtgggctgaactactacactgaaattcagatattacagtggtcatttgtgaagaaggtgacggtcttctaggcagctgtgatttaaagatgcttagtatttgcacatttaactctcacccatactgggtgagtattgggcatgtgcaaagaagcagacaatcagataatacaaagtaattattatctccctattaatttatttaactttgatttgttgaatgccagagaaaagttttaggaaatgcctgtggaggttatgcatatctatagatgaataaaaagaagaaaatatttatttctaatacaggtatgtttcaattctcaagagagaattgcaatgtagaaataagaacatgatttaagattacctaatataacatgtgtttcatatttctacaccataaaaattctgttaattttggaaaattactttggaaatataggaaatggttctcacctttcccttc

SEQ ID NO: 475948 - DNA, 2350 bp, Homo sapiens
ttggcttcaggggtggagccctctcggagaatgtcttttagagcagttatctgagtgtagaatggaaagatggggtcagagccccaatacagagtccccactggggcactgcctcatgtagttgtaagaagagggtcaccatcctccagatgccagaatgttagatccaccgacagcttgcaccatgcacctggaaaagctgcagacactcaatgcaagactgtaaaggcagccaagaagtgggctgtaccctacaaagccacaggggtacagctacccaagaccataggaactcacctcttgcatcagcataatctggatgtgagacatggagtcaaaggagatcattttgaaactttaaggtttaatgactgccctattggattttggacttgcatggagactgtagcccttttgccaattgtcaaaattgtgaccaaagtgccttactatgaccagatggtcactttcaaaaacattgctacaaaagtctttttgtgaatagtcagggtgcttgcacatgtatggatctgtatatttgtagcacgtgtattgaagaatattgggagttttagcattgagaagcttggagaaatgactctgcaaagctgacactcagacctcttaggagggtgtgccacccctcttttgggggcataataaggcttatccagtgaagaaattggagactgaaatgaactatcactaatggggagacctgttgctggggtatggtggctgtggcagcagccaaaaagaaaggaacaggctttgtcctttggccttgcactcttcattgagtgcttcctattggaagaacctaacagaaacttagctggaaagctgaaacaatgaaaagaacattatgaatattactgtttttttttctgaaatattcatcgtatatgtgagtcttttagtttgcaaaaaactttcttatatgtttttctctctaatcaaagcagcgataatatagtgagtgttgaacaggtattactacctttctttatattttggagcctcacatatacgtatatatatatatatgtgtatatatatatatatatagagagagagagagagagagcatcttttataaatagtgtaacttcatactggtttttatattgtgattcttgaaaacttaagatttcacagagacaccatagaggcaaatatggaggaaagcaaaggggagaccaagcagggctctaggaccctcacctttacaccagctagaaatgctctgcttcttctcttttatctgtgaagaaggatttgcattaaatcatcctctctccctcccctggtactgttataatgaactgacctgaaaataagtgcattaagtggccatagaacatgaagacactaattagttcacttggggatcaaatccatgataacagactgattcatgcttttctctatccccaaaactattcagataaaagcaaagagagaaaataaatctatcatacatatgacaatcctcaagaacaaacacttaaagtttcaaatatgatcttgttgattctgtcagaggaaaataattctatcactagttaagaataagcgataattgagtctggacaagtagcaagtaagatttcacagcaaaagaaaggcaaatagccaaaaaacattaaaaaggcttagcctctcttgtaagcaaaaaaaaattataataatattacagtgagactattttgagactttcaatttggcaaatatgttttaagttattatataaaatgataaaattgtctcttcatacactgttttacatagcacatactagtaaattatttctggagggtagtttagcattttgcaagagccttaagcatattcttatgctttgaccagtatattctacttccagaaacatccaaaggatacaatctcatattaggcaagaatacatactcaagttttatgttagcagtgtatataacttaggctcttttaaggaacagatacaagtttaccttcaggcattaggggcttgttagataatggaaaaaagaatattatcagaagtccaggggtgggagcagcgttgaaaactttcaaacttaatttgtccccataatttcagatatgagaaattcatatgaaaaatcaaagcactagaaagcagaagctaaagactcattctctgcatctctctgttagactagagcttctaatccctgttatcaatgctttacacgaaaggtttgaagggatcaccaactgccggcatacaggtttaaaccaagtgaaatacaaaatcttgaacttaaattctgctctagagacttaggaaggctgccagctccctgtctctgacaagccagcttttatc

SEQ ID NO: 475949 - DNA, 541 bp, Homo sapiens
tttccactttccatttgcaaacaggtgctctgctccctgacagtggtggagccttggtttcacacgctcaattaagagacctaatgcaaactcttgtttcccataacccatggttcctggaagaaggcacgttagacctagagctctgggaacaagtgaggagtagtcttaaacaacatcatgcacaagggcaacgggtcacagtaacatctttaacattatgggccttagttagggctgctttggccccactctacccagaagagcctaaaaagcgaagaggggaagaaccatcacctaccttactgcctgctcctcctcccttagccccaccattacagggtaaagataccaaagagaaaacaaaggtttttcctgagctccctcctccaataaattggaagaaagacaagggatacactacagctgtgggaccctgtcttaggcaagcggcattagaaggggagctcttagcctgcccggtaatgcaagattggcaaggcaatcggatgtatgtacccatttattttggtgcttagaa

SEQ ID NO: 475950 - DNA, 678 bp, Homo sapiens
gtaacctcgggaaagtatgggtcaggctaagagtaagtttgctaattacttaagcctggtgcggccgttattgcgctgcggaggggtaattgtgagtacccaatatctcacatctttgttccatctggtagaaaagtattctccttggttcccggaatatggaaccatgaatgtaaaagattgggacaaggtcggatcagacttaaaaccagcacaacaagagggccacgatattcccttctccttttggtctgtgtggtcggcaattaaaacagcactggagcccttccacactgaggaggaggaggaggagtttcaggatgacatagataagtttaataatcaggagtccgatgatcagcaaagtgaaccatcacagtctagttttaaaaagggggagaaatgggaaggcagccattcaccaggcacgagaaataggggatttggatgcttggcagtttccagtaattatttcttcggctgaggagcccggagaacatgctcaagcacgctgggagccatttccttttaaaatattaagacttaaagtaagccattggaaaatatgggccaaattctccttatgttcattccttgttacaatctgtggcttataaccggcgtttaaaacctctggattgggagtcattagcccgatccaccctgtacccctctgaa

SEQ ID NO: 475951 - DNA, 2876 bp, Homo sapiens
taagaaacgcctgccagaagatattatttcacttggcatgctatgtttttaagtggtgtgtttagcccatttatattccagctcttgaattattttactgaatggcttggcttccttggatgggatttaaccttgttcctggctcttgatgagcgtccttgccttccagattctatgttccatgactttcatttcagtcatttcagactggttgagaaccattactggggagctagtgggctcatttggagattgccaaccagtgaacaatattctcacctgagtaaccatgcatctacaggtgatgtcaacctacttacatctctggaagtgtatgaattcttaaactccagtcttcccaaagaccccgtatatgatgagcagtttgctctgcttgaagatacaattcctaatcatttcttaattataatatattcagaacaagtaaagctttactcccttttggagaagtatattattaagtcttcagaaaaaaattttaaaagcctgtataccctgagtctattcttataataagctttatttttactttaataaatttagtacatacattttttgaagacattaaagacagcttgttccacataattgcctatcatggtgaaagatgctcttggttttccaagtaaaaattatcaaagaaaagaaaaccaatatttctaaaataaaatattaattttctgctctacttttcttagttacaccttttattttctcccctgtgggaatttccccaaaaggttttccatgtttcctgacagtacatttgttctgattctcaggataggaactattggctttgtatataatttgtggatgcactattctggttaataatacatctagagcctcctgaagtcacttgtgtgtgtctgatctacagacaagaaaactaaaagctgaaattttttcaagaactctgctgtctgttgtgccaaagggatgaagttgatggcatttgttcttaaatatgacttaagccatgagtttaatattgaggtcaatttattaaatcatacctaatccacgatgacgtactctaattttactaattctccatggcctgctttttcctactgcagcctaatattttacaattatattggcctcctttataatgtattatatgtagcaatacagtgtaatttatgataccagagcataaaacataagaagagttttttttctgctcaaaacatataattcaaattctctttcaactataaaattgaaagagagagagagaattcattaatttgtattccttttggtctctgagcacatatcggaatggtaatttggatatcatgattttattatattatagaacttttatttgccatacagatacatttgcatgttattaatttagaaactgataacagcattggttgtctatttagcaaaaagacatttttttttcattctttttatgggtggtagattcaactttgtgctttcatgaaggtagaagagtgatagtaatgtttagttctcaggcccagcttttacataaatatttaaattgccctcaataagaagccttcaaaatagaaaatgttatgtgctatttcacaaaagtacgagagaacatcacatggtcagtatgtcaggaaggaatggggataggttagtgccaactattaagcagagagagaaaaaatggataactaatttgttatcattgcaagcataaagcctctttgcccttagaaattatttttgttttattctaagtattaagtgaactgtttcaatttatcctaaaattatttttgtaaatctacacttctttttctttttccttttaaataaagcaggaataataataatattttacttgcatacttgctccaaggtttaaataatataatattgcatgtcaagtgctttagaagactatctgtactgagataggagactggcaggactcgttttatggtaacaaccctgaagactaaaacaggatctggtccagacaggacaaagtgaagaaactggcaggaatcagcacatggctgacaaaagtgatccctagctgcccttattgctcattggcataagaccctcccaccagtgccatgacattttacaaatcctgttgtaatgactcagaggttaccacccctttccatggcaacagtccagaagttaccacccattttctagaaagttctacacaacctgccctttaagttgcattaacctgctccttaatttgcatgttattgaaagtgggtttaagtgagtataaatacagttgttaagagtgcaaaccttgctgactctgggtctactgcctaggagtttttcctgttcttactactactactactattactactgctactactactgctgctgctactactactgctgctgctattaatactacttggtttcatcccctttgctagtccctaaggtataataatacaaaaatcacaagatattactctacactttcagaatctcattgtctatgacgaagaagatatttcatatatattgaatatatgctgtaaaagccatctatacatagtgctgtgaaaagacagtgaggaaagtcaccgtaagttctgaaggaatagaaagtctccaaagaggagataatacttgatcaaggtcttaaaggatcagtgaaacttcttcagcaaaggaattgtatgtgctagagcataaaagcatgagaaagcatgatatattcaaagcaccagaaacacttaaaacagctgtaacataaagttaactatagaagatgagcagtatctatatatgtctgatttcttcatttcagaaataatatttattgtagtgacttaaaagcaaaatcatttatttagagacaattatgt

SEQ ID NO: 475952 - DNA, 2553 bp, Homo sapiens
accacttccgaaagggggcacaatccaactcttaacaatcccaatggatttagtacttgtcactattccatccaatttatcccctgtggctggagtgaccacaaaagtggcagcaggggagtttctgcagggggtacttcaaactctcctgagtgggcactggttgcaattccaaagacagaagcaaatggagaacctggaagtgggtcaatgtgccttttttcttatagaaattttactgagtctacaggatctgactctggatacaacaatcgatgtttcagtgttttccatttgtcacatttctctaaggaactctccagttctacttttgagaagcaaatggatttgcagcaatgagccaaccataaaggataattcatgggtattcaaatgtgaatttaatgtgaatgtaggcttaagatgggatgtagctgcaaaattcatatcagcagaattttaagtgaaaataaagcaatgattcattttaagtttggcaatagagcctgaatttctcttctttaagagtgttggtctttcattagaattgaagacctgagttattatttatttggagagtgttaacaggccaattaataaccttacaatggactcgaggtattcatgtggatggaagggttattggcctctcattttaatttgaaagctagagataactatggttagtgaggaaggaatgtcccaatccaagatatactgaaagcaaggcctcttacaccaaatggatttaatattttttcaatgtttttctttctatgtttagtcaaattgtaaggtgctatatttgccttagaatatcttttgtttgtatctttaaggctgcagcctctttctcatatttattttctaaaatttaattctaaaattaagaaaaaatacaggtgactgacactcttctcttcatgaaggtacataaagcataatgaagtgatggggagtatatattcacattcagagtatatagacttctgtatgattagggagaataaaatatttctctatttaaatttattttctatttgtcttgacatcttttttttttgtcagacctgataatttagggcatttttatttatttatttatttatttatttatttatttatttttattatactttaagtttcagggtacatgtgcacattgtgcaggttagttacatatgtatacatgtgccatgctggtgcgctgcacccactaactcgtcatctagcattaggtatatctcccaatgctatccctccccgctcccctgaccccacaacagtccccagagtgtgatattccccttcctgttgtcttgacatcttataaaagattaatttaaaacactaatgggaattattaacaagctgctaaaagatataactcctgaaatacattctcagctcctctaggaaatcttcaatttcaattatttgaagaaatatgacagaaagggtcacagaaatatcatcatcatctaaggagacaaggtgtctgcttttaaagggcaagattttaaggctagaccaaaatgaacattttgaaagtttctactttcctgggtgagaaataaatttagacatcaaagcatactttcttttgttctggaaagatctaatttttaagtacatttatttagttattcacttagttcattagcctatgcttttgatcagtattctaataccatgaaaaaaaagccaaatgcatattcattagagtgaaatagtaaatattctgttcagtattgtgaattgaatatagctatggcagaatgctgtttctgtgaagttggaaaaattttatggtctaaatatgaatttctgcctactcattgctaaaaaaagaaacgataagattctaaatgaaatagaattaaccacagaacggatgtagcagaagaagagattggaactaaattacaggacaattgaaaatgtctagttagaaagggtagagacatgaatcacctgtatccaatacaccctccattcaagcacatgttaaaaactgtttttttctcctaccataggagaataatgtatgttaaatgtatagttaatttatgtcttctctcacttctgtattctttgctgtgtttacctttttctacatgtcaactaacttaactgcttgcttccatcttttcttccttggacacttaccaatcgctagtagatgcttaggttattgaaataaataaaacatatttctgtccttaatcagctcatcatctactgtccctctgtcttttagcttctcacctaaggataacattggttaacaaatttgggaataaggatgtcaggaagatttaggatgcaaagggcttttctcagtgttaatatgaagattgctgtccctctaatgctactgtcatgaagataggtaaatctttttttgaagataaaatgttttataaattgacactgatatttcctatttacatttaaaactagagaggttttgattaattttgcttaaaaatatattatattattttcttgtatgcttgcattttcttgtatgctttcttgtctttcttggtt

SEQ ID NO: 475953 - DNA, 2634 bp, Homo sapiens
tgctttagaaacaagccttttttttgtcaaggtgacgatgatgatgttgatggtggtggtggtgatggtgatggtgttggtggtggagctggaacccacttgtgaactgagtatggagggatctaggttgtgcaacctctatgagaatctaatgctaatgcctgaggtggagcaaagtcatcccaaaaccataccatctcccacctctacccccatccgtggaaaaattgtcttccacaagaccagtccctggtgccaaaaagctatgctggcaccaaaaccacaagatgcacttcttcccactcttctctcccttttctccaagcagaggagtctctctccatattcataccaccacaggcccctgcatggcattagtcctgctcaacaacttcttgtagcagaatccaggaaatcatctgctacacttagctatcaaagctcaagctgctctcctgcagagtagctgatcagtgacatgaaggacacagtcatcagcaaccatttttcttagaatctaggatcccatggactgtaagaagcatggcgcccaagtcatgaaaataaagaaggtttaaaagaaaaaagaaaagaaaaaatgttataaattgcattgtaaaatgccatcaattgtaagactcagcatcatttcggagaagttaaaatatgaaaacatatgtctttgaattgatgaaatatgataaattgttcctcttaaatctttagcgagtttatatctgaagattaaataaaagaaccaaactggcaagaagaaaaagagtatttttaaagtaaataattagcttacatttttaagttatcatctacaaaaagtaaatagaacacatgaaaatgagaaattgtgaagctatctaaatagcagtaaggagttgagattaaaatttaaacatctttcacattttcattatacaagagtgtgtgtgtgaagtttttgtctgtgggacacaaagggttgggggcgggaagtgtctgtgcatcttgggcagttttatctttgtgtagtcatgtgatagaacataattcctttccatattcctccaaatgcaatcagtgtcaataaactacatgcaaggctacaaaaggaaattagtggaaaattagaaaatttcttgcagaaagaaccaggaaacataatgaggattacattgcttgcatgataatcaagaattatagtaatgaaaaatctcttaaaggcgtctaaaaactccatctacaatttgttagaataaacaaacacatagacaaacaaagtttgaccatttgtaaaaattataaccagcacttatttgaatgtgtacaatgtattagtcattgtgcaaattattatttgttttaattagcaaccatactatgaagtccctatagcatgggtatgttattaccctcattttatagatgagagaactgggttatgcaaatagcaaatattacatcgaagattacacaatccatttattaaacgatcatgacttacagcctcaaacttcaatagtttttagttgtgacaatatcatcctgtaggggatattttggaaaatagtgtgatggtattctattttgtttatttggttagttggtttggtttgattttttgtttttttatgtaatatttgagtaaggcactgctgtctatagctgatgaaggaaaggatgtttagcatcttgcaatgtgtgggaccactgaaaccaggaaaaaaaaattgtcctatgtctcagcagacactcatgtacataaattttttaaaagtacatataaatgatttgagcatagcaacaaactacttaaaatactttagcatggattaaataagcatcacattttcatggtttgggactggtactctggtccctttttcaaattttcacaaaagtcattcaccatttcatcatactaaaaataccatgctttaattttgtttagattgtgtttaatctacatcaatttgggaagaactgatatttggcaatatcccatcttccaaaagttgaaaagtctatatctctgcacttatttaggttttagtttatttttcttaacaattatttttagtattatcagataaatttaggatataaattatcaataataaatgttctagtggctgttttaaaatgtcaatttccaatcaattgttagtagtttagagaaagaaaaggtatttttctattttgatgttatattctacaatcttactaaattcactaattttgtctagaagcactttgtagattcttggatcattgcatagaagcttggagttgaaattcttactttttttcaaatttcatcctgaaagcattgctcttctactattgcatatgatattcgctgttggtttttcaaaaagccctttactgagttgagaacatttccctctattcttttttatggacattttaatcatgattgatgattcatcatgtagtataattacctgatacagaaaaataaaatatttcttaataataaataatttttctctattttaaatttttatttgtactattattgttattttatccctgctttcgttggattttattttctctcttctttctatacatttaaagtttgaatcttaggtaattgatttgaaatgcttcttcttcact

SEQ ID NO: 475954 - DNA, 985 bp, Homo sapiens
gaagggaactgccgccctctcgtagagatgtttatttgtccccaagagatgatgtgtagtctactaaagacagctcttcaagcagagattacccaagttcttgtaatacaagagattatgcaccaccaccacgagattatacttaccgtgattacagtcattccagttcatgtgatgactatccatcaagaggctatagcgatagagatggatatgatcatgatcatgactattcagatcatccaagtggaagttcctacagagattcatatgagagttatgataactcacatagtgctccacctacacaagggcccccaccattttatgctggaagcagtcgctatcatgattacagcagctcacgtgacggatatggtagaagtcgagacagttactcaagcagccgaagtgatctctattcaagtggtcttgatcggcttggcagacgagaaagagggcttgccccttctacagaaagggggtacccttctccatgtgattcctacagcagttcaagctgcagagcaccaagaggtggtggccgtggaggaagccgatctgatagagggggaggcagaagcagatactagaagcaaacaaaactttggaccaaaaccccagttcaaagaaacaaacgaaaagtgaaactattctgtcatagctaccgaaggactactaaaaggaaaaattgtgttaccttttttaaattccctgttatgttcccctccataatttttatgttcttaaagttaatattttcttgtctatttagcattgtgagttaactattgttgtgattaatgcagtttcttgatttcaagttgttctcatttgtttgaatcctgaaatagctttaacgaatggactgtgactataaacaattccaattaaaaagcaatcacttttcaactagctttacaagaattgattttctattaaaatactcaggccgtgtttcaatcacaatgcaataaagttccca

SEQ ID NO: 475955 - DNA, 703 bp, Homo sapiens
gtactcaggaaatagagcttttctttgtaacaacgagtatatctcttttgtgggcaccatctgatcagctgccagcacagctaggatgaaagcaggcagaggaacgtggaaaaactacactggctacgttttctggcctccatctttctcccgtgctggatgcttcttgccctggaacatcatacactccaagttcttcagcttttggacacttggacctacaccatttgtttgccaggggctctcaggccttcggccacagaatgaaggctgcgctgcgggcttccctatttgtaaggctttgggactcagactggcttccttactcctcagcttgcagccagcctattgtgacacttcaccttgtgatcatgcctccactaaagcagtgcttctgcaatggaagcctggtgcaaaaacagcaacaaacaagtttgacaaacaaagagcttgccagtccgggggaggtgaaatgcagaagaatctccacttttgaggtaatataaacctaagatcctgataaatattactctgaagcacaggcagacaattttttaaaaggatacatacccacgtatttacatatataccctgaaatatatatcctgtcagctaacaggaatgagaagcaatgagcccagtagtaatgagaacacctagcacctagttcgcagtttctaataccgttcttcagtaaaaggaa

SEQ ID NO: 475956 - DNA, 981 bp, Homo sapiens
gcagccagagccagccgggtgacctggaactgtctatgtgtgccgttgcaatgtgtgctcgaccacacaaagttgataggtgtgtagtggaaccaaagagagctgtttctagagaggattctgtaaatcctggtctccatttaggagtgaagaaactttttgttggtggtattaaagaagatacagaagaatataatttgagagactactttgaaaagtatggcaagattgaaaccatagaaattatggaagacaggcagagtggaaaaaagagaggatttgcttttgtaacttttgatgatcatgatagagttgataaaattgatgttcagaaataccacactattaatgggcataattgtgaagtgaaaaacaggggtggggactttctaaacaagagatgcagtctgctggatcacagagaggtcatggaggtggatctggtaattttatgggtcatggaggaaactttggaggtggtgaaggtaattttggctgtgatggaagctttggtggaagaggaggttatggtggtggaggtggtggtagcagaagtagttatggaggagatgatggtggatagaatggatttggaggtgatggtggcagctatggcagtggtcctggttttagtagtagatggggctatggtggtggtggaccaggatatgcaaaccaaggtggtggatatagtggcggtggtggaggataagatggttacaatgaaggaaaaatttttggcagtgataactatggtggtgttgggaactataatgattttggaaattatagtggacaacagcaatcaaactatggaaccatgaaagggggcagttttggtggaagaagcttgggcagtccgtatggtggtggttatggatctggtggtggaagtggtggatatggtagcagaaggttctaaaaacagcagaagagggctacagttcttaagaggggagagagcaagaagttgttaggaaa

SEQ ID NO: 475957 - DNA, 2220 bp, Homo sapiens
tatgacagaagagagccagtaatgcccatatctccagctgccagggagtggggcaaatttgccggtgagtttgtctttggccagccacatgaacacatgaatgataagaatgaaaaacagacttactgctatggagaaagtttgaaaggtctagatagaagatcaaatcagccacaacattcccttaaaccaaagcctaatccagagcaaggctcaactctcttcaattctgtgaagtctgagagatgtgaggaatctgcaaaagagaaatttgaagctagcagaggttggttcacgaggtttaaggaaagaatcatttccatacataaaaatgcaagggagatggagacccatggtgtgggatgtgatttgcttgaggaaaagaagacactgatgtctgcaggatttatgtgctgtcactgcagtgacaccttggtgattggcccagtgggcccagagcccagaccttcccatctgatatggtctcctttcattttcccaggtgtatgcgatggtgtctgtacagactactcccagtgtactcaaccttgccctccagacactcagggaaatatggggttttcatgcaggcaaaagacatggcacaagatcactgacacctgccagactcttaatgccctcaacatctttgaggaggattcacgtttggttcagccatttgaagacaatataaaaataagtgtatatactggaaagtctgagaccataacagatatgttgctacaaaagtgtcccacagatctgtcttgtgtaattagaaacattcagcagtctccctggataccaggaaacattgccgtaattgtgcagctcttacacaacatatcaacagcaatatggacaggtgttgatgaggcaaagatgcagagttacagcaccatagccaaccacattcttaacagcaaaagcatctccaactggactttcattcctgacagaaacagcagctatatcctgctacattcagtcaactcctttgcaagaaggctattcatagataaacatcctgttgacatatcagatgtcttcattcatactatgggcaccaccatatctggagataacattggaaaaaatttcactttttctatgagaattaatgataccagcaatgaagtcactgggagagtgttgatcagcagagatgaacttcggaaggtgccttccccttctcaggtcatcagcattgcatttccaactattggggctattttggaagccagtcttttggaaaatgttactgtaaatgggcttgtcctgtctgccattttgcccaaggaacttaaaagaatctcactgatttttgaaaagatcagcaagtcagaggagaggaggacacagtgtgttggctggcactctgtggagaacagatgggaccagcaggcctgcaaaatgattcaagaaaactcccagcaagctgtttgcaaattgggctatggatgccctttggccattgctgccatcactgttgctgccactgaacctggcaaaggctatctacgacctgagatctgctggctcaactgggacatgaccaaagccctcctggccttcgtgatcccagctttggccatcgtggtagtaaacctgatcacagtcacactggtgattgtcaagacccagcgagctgccattggcaattccatgttccaggaagtgagagccattgtgagaatcagcaagaacatcgccatcctcacaccacttctgggactgacctggggatttggagtagccactgtcatcgatgacagatccctggccttccacattatcttctccctgctcaatgcattccaggtcctccacctctcatctgggcttttaccaaatagcggtaggtttggtattgttctcagcgatgaataccaggttgtaacatctttatggtgccagctgtatacaacccatgcacctcaacaggcctctggtgtttggaaccatcctggatccaaaggtactgaatgtaaattcttcttgttgctttttctgtattatcagtacctggccatgtaaagacttgtaaaggctatttattgaaaagctttcacttcagtcatttgtacagatgtatgaagtctggatcactgctgtttacaatgcaaatgatattgaccagtttgcaagctcttatgggaataaatgttttatgtacattagggctgattcttaaaacaattgtaggtattactattttca

SEQ ID NO: 475958 - DNA, 655 bp, Homo sapiens
ctctttgatataagatttcctttcttttggatagaacttccagcaccatgttgaacaacagttgtgaatgtggacatctttttcttgttccagatcttacaggaaaggccattttttcctctcatcagtttttccccattcagtatgatactagctgtgagtctgtcatacatggcttttatggtgttgagtttaactggttttgtaaacgctacaaaggtaacctctttgattacctccctcactgccaaatatattttcacagaataatgttgggccttactgagaccatggcactgagtgatctgacccatgaccagaaacctgaatccagcaaaggacaaagttgcgcacattgcgtcagatacaatttctgccatttaccaggaagaactaggggaaccaggagaagggccacctgcttggggcgggtgagtccaggcgcccagatgacttgggccttttctaagagtgaccggaggaatgctaccgtgggactgtgcattgaggtagctggtgattttcctgtgcctgtaaggcccaatttctttgaacgcagagatattctgcgctgttctgtgagcctctaagtgcttctttatcaagggtgggggtcgggggagcgcatgaaatgtgtctgatggaggccactcaa

SEQ ID NO: 475959 - DNA, 597 bp, Homo sapiens
aggttagggggcatggtgggtgaaaaggcaactttttgggcacgaaacaggaatgtctgttctcatttagaaccggggaagagtctctcccaaagctgtgagctgtgctgcctggaactgggggaactatggcacaagcactcccttggctggccagctgatatctcactgggttgtgtgcaccccaagtccactggctccaaacccagcacagcatcaggacttgtccaagaattacagtccttgtggcctagattgcctttccagtttatttataaccccagagtgtgtcagttcatggtggtggaattagctagaactcaggttctaaccaccgatagggacaattcccctctggccagggctggtttaattgctccctccatgggtgccagcttaactctgtcctgtgttgcattccactgtttagtcctcaaagatggattaccccaaccatttctgccaggaatgtgaactaagagatttggaaaagccagcaatcatctcatagcatatttacaccttctatatacctatcaaacaaacaacaaaactttaagtaccatgtttactgaagcttttttaaattacagaaat

SEQ ID NO: 475960 - DNA, 1035 bp, Homo sapiens
agggggttgtggcccaattccctcaactccactaagcagcaccccagtaacatttatcagttgttaatatgggcttgttgtcacaactatcatctcttaatcctcacaacaattttatgagacttgttcttactggcatcatcaaaaatagagagctccatagtgccttcaaagtcctgttgaaaaacagacctcaaacactcatccaatcatggttcagcattgtggactggaagaatattatacatgtggaactgtgcaatgtgttggagctggctcacactggagctacgtgcaattgtgttcatctcttccccacttcatgttcagggatatcatgtggattacttgaaatttgctatggtgggagtatttacaccatggatattggcaaattgctgaaaacatgtcagctgagtacaaaatgtctggacaagtgtgcaggaaaagtttattaccagaaaatgaagcaaaatgttactgttggacagggcacctggaggagtcactaatggctccatcctgaagtgacttcagttctttcctgggtctttgttgaaggttaattcacatatcataaatttgcccactttaagttacaattcgatgattttttaatgaggaaactgagacttagagaagttaaataaacttacccaggtcatggagcttggtaaagagattcaagaactttgctatatggtaatgctttttaaacttgctcatcataatgaccacctggtatattgttaacagtgcacatctcaggattcagaaattctgggataagatcacaaatctgtgttttctacaaacaccatagatgattcctatgattagccaagtttagagatggttgctatgatgcttctcatcaatattgaataaatattaaataaaaaataagctaactaaaaattttggtttggaggattagggaaatgtgtaggtcttgacagaaatgagaaagacaaggctgccaaagggaggaataacatgtacaaaggtaagaggcttaatgtgtgggttgtgctt

SEQ ID NO: 475961 - DNA, 660 bp, Homo sapiens
tgagcgagaacacgcagtgtttggttttctaagtgtcagggtaacaatgggacaggtgtggggtctggttcgtttcaccttggaactttttcacactgatgatgaggaggaacgagagtataatgaagtaacagaagaggttacagaccaggtctatgtgccagctaaagctaaagcggcaaaggagggagaggttcaaccctacctttctgcaccccctccttattattttgaagaaaagaccctccagatctttcttttccagaggacactgggcaaaaaaatacaccccccagatcaacagggaaatattatagctacatttgagccttttccttttaaattcgggaaagcacatttagttgattatatcaaggcctgtgatggtatcggaggtaatctgcataaagctactctgctagcacaggcaatggcaggactgagagtggataaaggaaatactctatttcctggaccttgttttaactgtgggaagcatggtcatactaaaaaagaatgtagaaaaaatcagtgagtcaggctgccagatatgggaaaaaagaaaactgctgatcctgaaatatgtccaaattgtaaaaaaggaaaacactgggttaatcattgtcactctaagtttgataaagatgggaacgcgatttc

SEQ ID NO: 475962 - DNA, 707 bp, Homo sapiens
tccttcagacatgaagttgggcaatgatgcctgagcttaatgtaaattaccttgtaggttggtgtattaacacaaatgagggaactgagcccgagcaaggtgaagtaacttgctcaaggtcatacagtgtggtcctcaagccagcaacatcagcatcacctaggaacttgttagaaattcaaattctcagaccctacccagaccgaccccagaatcagaaattcagagaggaagacccagcactctgtgtcttaacaagccccctggaaggaaggaaggccctcctgttgcttccacaaatccgttgtcagcagcagcacagtagctgctcttatgttcccagatgttattgcactgatataaggagtccaacagaaccctgccccaagggcctgaatctcagtccctggtcccctgctgctgcatttaaccatttatcatcaataacaaacaagggagtatgaagaatgaattccttgcgtgacaaacatttttctccctgcccattgtgcaacagaagtgacacttcctccagatattcagggttaattacctctgctagaattgtgacttgaattactgttttaagccaactcattctttaatcaagttcagacttttgcctcattcattcgctgattgttacagaggtgaagcaaacttagtgatagagagtcatactcaggaaatgtgttacagattgctct

SEQ ID NO: 475963 - DNA, 926 bp, Homo sapiens
tctgctgccagtctgatccactacagctttctgaatcccagcgaaaccattacgtctaagaagtatgctcaggaaattgatgagatgcactgaaaactgcaatgcctgcagccggcactggtcaacagacagggcccaattcttctccatatcaatgcccaaccgcatgctagttgactctaatgagtatgcagggaaggttggtctaaaggcaaaggcaatctacggccataccatcctggacgcacctgatcttatctacaggcaaaggcagtactggccagtcacagcaattccacatgcttgtgctatgagaggaatgtccgttggggatggctgtgacaactcgaggcatgggctgtctcaaaggggactgtgtgaaagtgtttggagccagtacaccagggctggcaggggtgttggagtaaccttgacaattgcaagccgtgactaccaatggagccgtgagatccagaaatctgcatttttcaaaagctccctaagtggtcgtgatgtggccatttcagaactggttcccagatctgtgtttagaaatcactgagctaaatgttctcttgatgcctgtgtcagtcagggttccagcaggacaaaaaaggtgagaagcatgtgaaacagcaacagattcaaaggatattggaaagtgcctgttgaccagacaagcagaaacatttaaaatgtttttttaaattttgtaatttcccacaatgctgtttacacaacgggcaatgatctgtagcttgaggtggcaactccttagaaacctgtagattgagttgcacttgaactaaacagagagttttgcttcagatgagggagagtcagctctcagtgactggctttcttccaaaaccctgaaaatccattccattaattctggaaccttgaacccaagagtcagactagtg

SEQ ID NO: 475964 - DNA, 659 bp, Homo sapiens
tctgctgccagtctgatccactacagctttctgaatcccagcgaaaccattacgtctaagaagtatgctcaggaaattgatgagatgcactgaaaactgcaatgcctgcagccggcactggtcaacagacagggcccaattcttctccatatcaatgcccaaccgcatgctagttgactctaatgagtatgcagggaaggttggtctaaaggcaaaggcaatctacggccataccatcctggacgcacctgatcttatctacaggcaaaggcagtactggccagtcacagcaattccacatgcttgtgctatgagaggaatgtccgttggggatggctgtgacaactcgaggcatgggctgtctcaaaggggactgtgtgaaagtgtttggagccagtacaccagggctggcaggggtgttggacggttctaccacctggtggaccggtctctccaaaacaaacaggctcctcatcatgcctccaagcctgagccctgtgctgatccccaaatgctggggaacagagatgacccatggactccttatcaagtgccttcaaacaccacttgctcataagaagtttttacattcattaagttcatgctaccaaaggtcaagttcccactgcagaaatgaaaaaaagaaaaatgaggaagac

SEQ ID NO: 475965 - DNA, 604 bp, Homo sapiens
agaatcaagtagccttctctggttgacaataatctgtgcgtattgtcatgcatcattgccagaggagtcacattcctcattctactgggacgttggtcactgccattgcagcccaggacacacttctttctgagtgcccctatcaaggacagcttcacggatgtgtgacctgtcatgaatctgctctttttcccaaccagttctgtgcctccagcttccgtgtcttagttcttcatggattccctgagaacagtagagtgaaggaattacagaaacagtctaagttaggatcattcaacaatgataagccaggggaagtggtttccatccaagtgctacccacgccctggcatgaggttcagcccagacagactgtgaaggcagcttattccgtctgtacttctcattccagaaaagaagagtcaggggagaatacctcgcattgttccctaacgtgttcagtatttgcagaatatatttagtaatttagacccaagtaaagagacagcgcattctggaaaaagtacagaaatttaaagaccttgtggaatttgacttctgtgtacttttctatctcccaggtttgggtcatctgcaaaaagac

SEQ ID NO: 475966 - DNA, 955 bp, Homo sapiens
cagataaggttaagaaggttaatctcaggttaatctcaaggagagaaaaggtccgttatgtcccctaagctgcaaaaccagcaagtttttattagggattttaaaaggggagggggtatacaaacaaggagcaggtcacaaagatcacatgcttcaaagggcaataaaaatcacaaggcaaaggcaaaattagaattactgatgagggtctatgtcccactgtgcacgtattatcttgataaacatcttaacagaaaacagggtttgagagcagagaaccagtctgaccaaaatttatcaggctggaatttcccaatcctagtaagcctgagggtactgcaggagaccagggcatatttcagtccttatctcaactgcataagacagacactcccagagcagccgtttatagacctccccccaggaatgcattccttcccccaaggtattccttgctgggaaaagaattcagcgatatctctcctatttgcatgtccatttatacgctctctgcaagaattaaaatatggctctattctgcccgaccccacaggcagtcagaccttatggttaccttccttttttccctgaaaatcgctgttattctgttctttttcaaggtgcactgattttcttattgttcaaacacacatgttttacaatctatttgtacaataatggtcctgaggtgatgtacattctcagctgacaaagataatgggattaagaaattaaagtaaagacagacataagaaattataagagtattattagggaagtgataaacatccatgaaatcttcacaatttatgttcagagattgcagtaaagacgggcataagaaattataatagtattaattttgggaactgataaatgtccatgaaatattcacaatttatgttcttctgctgcggctccagctggtccctccattcgaggtccctgacttccc

SEQ ID NO: 475967 - DNA, 568 bp, Homo sapiens
ggttccggtgtccgaggcactgttccagccttccttcctgggcatggaatcctgtggcatccatgaaagtaccttcaactccatcatgaagtgtgatatggacatccccaaagacctgtacgccaacacagtgctgtctggcgtcaccaccatgtaccctggcatccccaataggatgcagaaggagatcactgccctggcatccagcaccatgaagatcaagatatcgtgcccccagagtgcaagtactttgtgtggatcggtggctccatcctggcctcactgtccaccttccagcagatgtggattagcaagcaggagtacaacgaggtacaggaaagagagaggaaaaaagggcagggaaggaaaggcccagtgggtaatgacagacaacctgtccccagaagcagagaaggggatggggggtttccatgttcttagaatccccctgacctgatcttcctgaattgggctgacaaccaccagagattccttgaatctttgctgttgtccttagacagccataggacccagaattgtccctattgatatttaacctgtagaagac

SEQ ID NO: 475968 - DNA, 647 bp, Homo sapiens
agcctttttgggaaggtgatgagcctcttactacagtttttcccaaatagacagttcaaagactactgggagcaaaatgaaacatacttcaacattactgttcttcaaaatcaagccatcaccagtgctgtattagtctattttcatgctgctgatgaagacatacccaagactgggcaatttacaaaagaaagaggtttaatggacttacagctccacatgcctaggaaagcctcacaatcatggcagaaggcaaaaggcacttcttacatgacagctgcaagagagagaatgagagtcaagctaaaggggtttccccttataaaaccatcagatcttgtgagacttattcactaccatgaaaacagtatgagggaaaccacccccatgattcaattgtctcccatcaggtccctcccacaacacatgggaatcatgggagctacaattcaagatgagatctgggtggggacacagcgaaactctatcgagtgctcacacatgcagaagaattgcatagacttgccataagtagaatctcaagctcaattttgtttataaatgtattaacttaaacaatctttgctattcactcaacatgatatgtttttggtccattgtgtcattcttatgcatttgcatcctca

SEQ ID NO: 475969 - DNA, 656 bp, Homo sapiens
tgtgagcgaaaccattaggaggggctggctctagagcaggcctgtatgaaaatgactgctatggaaatgcttctgacccctgcagacccaggcaggggaggaccaagtgtgtcttcagaaagggactctgctctgatcgccttttctctccacctttcctgtaagctgagatcaaggagtggaagtgacatcagcctaagagctgaaggatctgtaacctctgtcctgggaaaacccagggagagagagtccaaatgtcctgccagccagcagggcttggcagcagttggagatgaaatgactgtgccttatctccaagcagacaagtccaaggtctctgaggattgccaagccccagcagcagcccagcgatcctacggatgcaagaggagggcagagactagagtttcctggagctccagcaggaggcctcatgtcttaggttggcaccacgtgctgaaagagccgctggacccaaatcgacttttgtctgtatgtgagggttgtggccaagactccaggatgggaagtgctcaactcggtgatggccagcacggacatcccacagatgaggatgacaccccgcagcccaccctcactgctacagaaaccccctagatgaggatgagaccaccccagcccaccctcaccagtac

SEQ ID NO: 475970 - DNA, 655 bp, Homo sapiens
acatagaaagttatcctttattcattgtgttctactttgtattatggtcatttctgctcatgttttatctccttatgtaaattctcctgaacacatcctttgggccaaacactgttttggcccagcatgcaagctagatcccttgcatgtgcagtttacaatgggctgtgcgttcctaagagaatctaatgctaccactgatctaacaggaggcggagctcaggcggtaatgctggcttgcccactgctcacctgctatgcggcccagttcctagcaggccacggaccactagcgcagtttcaggttcacagcaaaattgggcaacaaaaggtacagggagttcccgtgtgctccctgcaccagtgtggccctccagctgcaggggcatttaaagaaagaccaaccaagcccacagcatttcgaaaattctatgagcgaggtgacttcccaattgcccttgagcatgattcgaaaggaaacaaaatcgcctggaagaaggctgggaaatacagtccagctgtgtacctcaaaggaaaagggaaatggtctgaacagtgagtctttcccacactagttattagaacccccttattaacatcatttttttttattattatactttaagttttagggtacatgtgcacattgtgcagg

SEQ ID NO: 475971 - DNA, 1975 bp, Homo sapiens
tgctcgtgtgcgcgcgcgtcccgggtgccgcgcgcccttcttatgcacagctgcggctcggctcgcgcggcgcggccgctgcgacttcctggagttctgcctgccgggggcgcgggcgggtgtgtgagagagaaggcgaagggagccgcggggtgggagaggagggagtcccggcgggagggcgggggagaggctggcgggaggggggctccacggagctccagccagggccgcggttcgcctgcacgtcacggctactcaaacccaagcacgtcccgaaagcggtattttctgcgtctgggaggtttttgcatcctcagttcccaccgctggggctggcggcgaccaactcgcagacctgtcgcagccagagagctgtcatttcagtaccgggattcagaattgatccagtccgcagcggagggggcacatcccagctaccgagctgctgagtgtctctggctggaacaatagtatttttttctctgcgaggctgcaattaacatcttatttgttctggctccatacaggctttgtcaggatcgcggtgcggcgaccgacgttgggctcttgcattgctttgtgcttggcaatggaatcatggtttcggggtctaaacttttgtttcgttttgtagtcttaatgtatctgattctttttcaagtttccctagtaacaggtttggggacggggtgggaagaagcgagaaaaggggtgaagagaaaaaaccagattatatagaaaggaaaaagggaaaagggatgtttccccaccttttaatctaactatctatctgtctgtctatctatcatcatagatagtcattttgcctcctggacagttggctgacgaagtgtctgataaaccagcttcagatacatgctacaaaaggtcattcgcctcctgattatgtttctacttgtaaacgcagttggtggtttgcaaaacaagtgctaaaatagtgcagtgatgtggtgggaggaaaccataatgggtaattcatataaagtgctggaatcttcgtaagggtgagtttctcgagcggcaggtgaagttgaataaagcaattttccatcatttgttcccctcactcttgcatttttttcctccgcttgtttctctcccctggggcgattatggatagccaagaacaccattttaaaagagattgatagtgaaaacaggaagtttatggtctgttatccactggagttgtttgaaatattaaaattggtcctttacttcttaatgcatattaatagagtgaccctcttcaaggctttcccgtcttaaacgaatgcctgggataaacactgtaaggggaaacagttaataattccccagcaggctttaactattttcccagtaacaaatcaccggcaagagagcagcctgggtggcattttggttttgtgtcattttggttctttacaatattttttattcatttaaggaaatgttaaaaggaaataattagggtttatgtccagaacaaattttgaaacaccgtttaagcaacacattttcttttaaaaacaaagaacattgagcaacacaaaggagaaaaacattttatttatttcaacttccctagagatcgtaattatgattttcgcaaggcaatttggtcagttctgttactttatccagaggaaaaaaaagcatgacagatgtggaataaaaacggaggaaaaaatgctttggatggtttatacataaaaaggaaagaatgtaatgtgaggttcagttatacctctattttgcatctagtgatttctcatattatcttgtaacactgattttgatgtttcttagaaattcttaaagtcatgacacagtggcataagaataacagctgaaagggacaatttaaaagcctaaatcctaaatggaaaggttcacttactcccaggatcatttatattcaagtagaagtcagggcagggtcagaaaagaaagccacccttaataaagc

SEQ ID NO: 475972 - DNA, 539 bp, Homo sapiens
tccaacaacaggattgagggtgtccagggcaagcgccagcttgtgtcatcaccctcactgagccccggaatcgaggccatcaagctacagatggtcttacaaatggaaccccaaatgagttcaactaacaagttataccgaggacccctggaccgacccactggcacttttactggcctagagagctatcctctggaggacactacaactgcaggaccccttcatcgccccatccagcaggaagtagctagagcggtcatcagccaaattcccaacagcagttgggggctgcacgtggtgcttatgggtcagctagagttctggataggcgtgggcttggtgggcccctctcttggggtgaacccatttcagagcaccctgcccttcacaaagaaaagagaactctccccggggctccagctggcttctccgggatcagtcacgttaccacactgtggaagctttgttctttcactctttgcaataaatcttgctgctgctcactctttgggtccacactgcctttatgagctgtaaca

SEQ ID NO: 475973 - DNA, 827 bp, Homo sapiens
caccaccccctctgcaggtcgccattcactagcaagtttgggaagggggtttgctgcaggacggtgtgtgggttagtcgccgatgcacatgtgtcccccttgccctctgcagcttacagccccgtctgtgtcccttcagtgggatactgatgtcgccacgctggccatggtctacaggacggtgataggaggccacacctccctgtactgctgtgttcctgatgcccccagtttctcctgccagcctctcactgaagaacataaaagtcaaagtgaagtggaaagtgctgatggaaaagctgcagcaagttatccaaaagacctagtaaagatcactgatgaaggtgtctacactaaacaacagattttcaatctaggactttcaaagaagttgattccaactttcatggataactttgagggggtcaagatttcagtggaggaagtaactgcagaaattgccatagccacatcagctttcagcaaccaacagcttgatcaatcaacagccatcaatatcaaacaaggactctccaccagcaaaaagagtaccacttgctgaaagctcagatgatcattagcattttttagcaataaagtatttttaagataatgtgagatggaacaagtttaaacatctgaaacatacatagagttcatctctgcctctgaatcattttgtttttaagttggctattcggaacttggaatttgttttgcctctgaaacagaagtaaggataggtagccaggcaaaaatagactatttaacctgtaaatgagcttcattaacatatagaacttaaaagttcacttattatagttcct

SEQ ID NO: 475974 - DNA, 983 bp, Homo sapiens
gaaagccttcttcaagagtgcatggtctaatgttctcagagatatgggaggagcttttaggcctgtcctgtatgtggaattgaagaagaatgggagaaattacaacatatatcgtataacgaaagaaaaatcaagaaaagagtttgaagaaacaggggtagatgggagaattgctggagtgttgtccatgggtggtgaaaatggaaggtttcggagcaagtggaggagcaaggagcacagtgagggcatcaccgggtcagcacacaagtgcacagacgctgaggctaggagtgaaaaccaaggagaaggtaaagattttaggggagatgagaaggtacagtcaccagggaaggcatcagtgagaggtgacaacatgctagcagccctcggttgctctcggcgcctccttggcctcggcctccgctctggcctcgctcgaggagcccttcagcccacctctgcgctgtgggggctcctctctggggctgaccaaggccggagccggctccctctgctagcagggaggtatggagggagaggccccggcaggagccggggctgcgcacggcgctcgggggccaccgcgggttttcagtgggtgtgggctcggtgggccctgcacagggcgccgggcacctgctgggcttggtcgggggtaggagctccctctgggctgccggagtgcccaggataggtgcctcaaaatcccgctgagagcgccagcgagaggtgaagctgactgggcttttcggaggggtggggcttggagaacttttctgtctaggctaaaggattgtaaagacaccaatcagcacttggtgtttaactaaaggtttttaaatgcaccaatcagcactctgtcaaaacggaccaatgagcactctgtaagatggaccaatcagctctctgtaaaatggaccaatcagcaggatgtgggtggggccaaataagtgaataaaagcaggccacccgacccagcagcg

SEQ ID NO: 475975 - DNA, 1068 bp, Homo sapiens
acagcagccaccttgcaaccaggaagagaaccagcctgaagacaaagctgacattgtgaggacggcagggtggagagcattggaaagacttcaggacggtgatgacaccactgaatatgccctgcccccgaggtagaatctacagaggcagtaggccttgctgagctgcagtgggctccgtccagttcaagcttccctgctgctttgtttacgctgtgagcatagaaccgcttactcaagcctcagcaatggtggacgccgctccccacccaccaagctccagcatcccaggtcgatctcagactgctgtgctagcagtgagcaaggcaccatgagcgtgggacccaccgagcaggcatgggagggaatcttccggtctgcctgttgcgaataccgtgggaaaagtgcagtatttgagcaggagtgtacttttcctctaggtacagtcactcatggcttcccttggataggaaagggaaatcccctgaccccttgcacttcctcggtgagggatgccccgccctgcttcggcttgccctccatgggctgcacccactgtccaaccaatcccaatgagatgaaccagtatgctggtaacagtactctgatgggggtgctggccacacacttcatcaaggtggtggcagcaggatccatgcctgtgcatttgtgccagcagaagcaggggtacagcaagatgcatacatctgtgggagcggggtgcctgaaggatatttcataatgataaaggatcaattcctcaagaaaaaaatctaagtgtataggcaccaaataacatagtttcaaaatacataaaataaaaaatatatttaaaaggtaaaagaaaagtcttctagtcctaatcagaaacattaacaatttgtattttatagaataagcacatgaaatatctgtaggaatatagaacatctgagcagcactcaatctaattgacaaatatagaacactgtatccaacaatcgcagaataaatgttatttaagtgtacatgcaacatgcaccagtatcaaccatatgcaggaatataaagtaaatcaataaatttcaa

SEQ ID NO: 475976 - DNA, 666 bp, Homo sapiens
aaaaggcattggctcatctgtgaatttccctaacttcctcttcagattctgaaacgaggggcatgcaacaacattggccatgggttgttatgttctaccacttgtttgccaagataatactgcttccaactgctcttgttttaagaactacatcaagtgcctgatttgtgcaaaatattatgggttgaatgtatcccctcaaaattcatacatcaaagtcctaacccccagtacctcagaatgtgaccgtatttggaaacagggtcattgcagatgtaagcagttaaggggatgtttgggcacaggggctcgaacacagggagaacaccacgtggagattggagctatactgccaccagtcaaggaatgccaaagctttccaaaaaaaccaccaaaagctaggggaggcacatggaacagatacttccctggtgcatttgaagtgaagaacactgagtacagaactcatcagcttcctcaaagcttcaaagtgaaacattgatgggtgggatttcaaatccagactctatggtatgattgacggtactcgagaggcctaagcagtactcgagaggcctaagcaggcaacaggcttgacggaggagactaaagagaaggcttactaagtgaatactgtcttccgtaactgacataactttctgccac

SEQ ID NO: 475977 - DNA, 1824 bp, Homo sapiens
tctggagaagcatgagggactgaaaatattggaaacttataaccatggcggaaggcaaagaggaagcaagcatttcttcacatggaggagcacgagagagagccaagggggaagtgccccacacttttaaacaactggaactagaagccccttctggtatccataccagggccttgccctggcctccagagcccctgatcctttttatcagggaagcagagtgtaaaactttgaaaaatttgcatcctgaccatgtggtagaaaaaaaaaacccattttctggggagaaattcaagccagctgaagaaatctgcataagtagcgaggagccaaatgttaagcatcaagacaatggggaaaatgtctccagggcatttcagagagcttcatggcagtgtctcccatcaccggccctgaggcctaggagggaaaaatggtttcatgggctgggtctaggccactccctccacaccctggacatggtgccctgcttcacagctgcttcagctccagaggtggctgaaaggggccaaggtacagcctgggccattgtttcagagagtgcaagccccaagacttggcagtgtccatttggtgttgggcctgtgggtgtgcaaacaagagttgaggtttgggaacctccacctagatttcagaggatatggaaacacttggagtacaggcagcagtctgctgcaggggtggagccctcatggagaatctctactagggtaatgcagaggggaaatacggggttggagcccccaaacagagtacccactggggcactgcctagccaagctgtgagaagagggccaccatcctccagactccagaatagtagatccaccaacagcttgcactgtgtgcctagaaaagctgcaagtactcaaagccatccagtgaaagcagctgtgtggggtattccctgcatagccacaggggtggaactgctgaaggacttgggagcccacttcttgtattggcttgccctggaaagaagtatggcctggtggaatgcaggcattgttactatctcttgacatataacattttctaatacagatttcatagatttggaatagttgaacttttctgctaagttacatctttacattgactctactccttagttttggtgctcattcctgtgagtacttcggttatgtaacatttttctctgacatggaaatcagcaaacaggcatgctatggccaaaggtaaagcatcacaataatgaagaagcttacataaagggaacattgatgaatgcagcagcatgtgtttgtgattaaatcaaaggcacattcaaggctgcctagcaatccaacctgattaactgttttccaaatcctgatatagtacaaagtaattgacaatgacagggatgggggggaaatcagatgcaaaattgagtatatcactgtcagatggttaacaaaacaaagtgcccaatgtcttctaaagtttcaatatttctagaacttatttctgaaaccaaactcattttcacagacaatagaacagtttagtgtctagacaatgggaaaacattaagttgttaacaagagcagataaaacatcatcttttttttgccatctgtaaagacacaaggcctgttttctgttattttgtacactacaccttctaagtcagatcccaaactcacagattattctgggattgtatgaaatccctaccttttatttatttaaataaaatgatattgaagttagtgaatataatagctaataaaagctagtatttgttaggtgccatgaatataagacattctttttattttgttataatttctaattctc

SEQ ID NO: 475978 - DNA, 1154 bp, Homo sapiens
atcatcttttcctggaagaaagagatcttctcgccggtggggccggctgggactcgccgctcgcacgcccttgggcagcggcggggcgcctgctcttccttccgcttgcgctgtgagctgaggcggtgtatgtgcggcaataacatgtcaaccccgctgcccaccatcgtgcccgccccccggaaggccaccactgaggtgattttcctgcatggattgggagatactgggcacggatgggcagaagcctttgccggtatcataagttcacatatcaaatatatctgcccgcatgcgcctgttaggcctgttaacattaaatatgaacatagctatgccttcatggtttgatattattgggctttcaccagattcacaggaggatgaatctgggattaaacaggcagcacaaaatataaaagctttgattgatcaagaagtgaagaatggcattccttctaacagaattattttgggagggttttctcagggaggagctttatctttatatactgcccttaccacgcaccagaaactggcaggtgtcactgcactcaattgctggcttccactttgggcttcctttccacagggtcctatcggtggtgctaatagagatatttctattctccagtgccacggggattgtgaccctttggttcccctgatgtttggttctcttacggttgaaaaactaaaaaacattggtgaatccagccaatgtgacctttaaaacctatgaagaacagtaactttaagttgtgtaagtatagaatgaaatacatataggaaagtcagagtaaagaaatgtgtcttcaatatcttttcagaagatatggtaacccatgtatttatttcatattctccaaaatacataggaaagggctccaggacaatttgggcaaaattcatcttatctgtcattggtggtgctttctattcattttaaatatactgttagggccttaggaagaatttcactttcattaataaagtcaggctatctttcctagagggacaagctatttttatgctgagggggaaaggaaaccatcataagtgctctcacactgatgcattcctgttgcaatgtactgcagcaccaatgtcatccttagaaacaaaatctataactagagctgtcatttagctct

SEQ ID NO: 475979 - DNA, 796 bp, Homo sapiens
tgctcacagataagatagcagacagcaaggctctttttccttctcctcaatgtgaagacgacgaggatgaagacctttaggatgaagacatttttgacaacccaggaacaatactttgcatccttcaatcctgtcaagttgacactcgatattaaccatcacaagtccacccttgtcaacttgaacccatacacatctgaaatcatatgtaatcttcaaataaagacaataataaggaatggtgccatattaagggctcagtgttggtctctgctgctggcaaattgggcactcagcagtggccatagccaggtcagccttggtgagtggaagtccatgttgctgagcccatgcgtaacctccattcctgccaccatggccactgtgttcatgggcccattgggcgatgacagaggtggctggggaaagaggctgagtgttgtccacacaacgagtgatcctatccacttgattattaaaatccttttctgtggaggtcacctgttggtgaacactcatatgggatacaaatatcttcagtttttgaccactcagagagttccatccacgtacctcttccccagatttctttgtcaccaattttccagtcatgcttcttccaagtccctgaccatccagccaaaccattggccatagcctgtgaatcagtatgtaatcacacatctggccatttctccttcatgcaaagtgtacaaccaggtacactggtcgaagttctgcccactgggaagatttcccttcactgctgtccttcagggatgtcctagaaaggggg

SEQ ID NO: 475980 - DNA, 601 bp, Homo sapiens
tctggcttagttaagaagagttatttggatccttgtggcaaccctatgttggtccatgcaattaacttgctcttgtccagacatgctgagccacatcttctggtagtctatattggatactggaagataatgaatgtcataggagttgtgagagagcattatttttggcttacaactctgtatgcaaaagttctaccagatgagtcaataggattaaaagaaaatcagacaaataaagaatcaggaaaacaatcttcccaaactgtgtttctgaatataaaaccactactcaccccagtgcttgtgaagacgcatgcctttagaccacccataaaactcaacccagaatcacctgtctttatcagtggaggtaacagcaacagagtttctggaaaaagttatctcaaaccttcctgggttgagactatttctgtggatgtttgggaagaaatctgagaaaattttgatttgagggtactgattaaagcttatccatctcaccggtggtcagagaaacttgatttattttcttgtattgaatgcacttcatgtataagacaactttctggaaagtgaaatttgttatattttggcttttgac

SEQ ID NO: 475981 - DNA, 626 bp, Homo sapiens
acaaatttccgcatatccatctttttttttaaagcaaaaagttcttagacgtcatggtttttcacattcactgctgctcccatctccagactggtgtctccacttgcttttccctcggtccccagtctaccccatatagcagctctcatgtctccaatgtggatgttgagaaagatgaccagaatttggagtcccaaattcctaaatcctctccagttgctgatgaagctactgtcaccccatgtgagtttgccaaggaaggacctaggcattcattccccccagctaccaggagtgttggccaccgatggctcgtaattgcatccttctccaggaatggccttggtcaaaggaagctgccttgcccaagcacacagacctccatggtcaacgttggagagagtgatggcaagggcctatctgtcatgccaaatttccactccctcacaccagagtcacaggacatcctggaccatgaccattcataccagtaccctccaactctccctggaaaccaacaaggactggaaattgggtgatgtgtggtctattctaaacgcttccacaaaaagctgcccatcttgggtttttctgtgtcagacatttctggctcttggttagacaat

SEQ ID NO: 475982 - DNA, 596 bp, Homo sapiens
aaaacggaccaatcagctctctgtaaaacagaccaattggcgctctgtaaaatggaccaatcagcaggatgtgggtggggccagagacactactttctacaactgtaatgctcactgtgagggtctgcagtttcatttttgtaagtcagaccaaaaacctgattgtggccgttggggaactctgcgtcctttgtagctactggtgtgagtgtaaattttctgttgagggccagcagtgtttgttaactctccgggagtgcggggtggcagagcccaggcctgcacacccggaactcgagctggtttgcaagggctgctgcaggcctgattcttgcctgcgcctctccatacgtgcctgcaagctgagggaagaccatctttggaagacagctgtggcagtttgcccttgtctgcaagagcttgccaaaggggacactgatgcaacattaatcatattccaagctccatacagtgcaggtgaagtcattagaacagcaaacaccctgtctgttccttaagagacagatgattttcattcggtgataactggtattttttgtgataatgatggggaaggtgagggcttcacgaaagcc

SEQ ID NO: 475983 - DNA, 595 bp, Homo sapiens
ggaccaatcagctctctgtaaaatgggccaattggctctctgtaaatggaccaatcaggtgttatggtatatgttattcacaagtctagaagcagacaagagtccctgaagaaggaagagacagggcagcagggtgtccaaagtggcctgggaacagcatcaaagacaggcttttccagcccaagactttccctggggtcatttgtcctttccttccatttcattcaggtgctgcaaccttctacgttttggctagttccaaatgattccaaggttatacaacagccagggacaatccctctctcatcacaatgtgggctggagcctagtcaagctattcctaaatgccagtccaggcatgggctacttcagaatcaggccagcccagacctcctaaacctctgcctgagggaagattctggaatctgtgctttagctggttccaaaggatggtcagccagaagaggtgaggactaatctggtctttaaagttggaaagggtcaggaaagcagaaagaagagtcactctgcaaagaaccaatgggaactgtttttctaacctgtaacaccaaatgaatcatgcccctctcacctt

SEQ ID NO: 475984 - DNA, 726 bp, Homo sapiens
gcttcctggagatgtttttcttgccagttctgttatgcaaggtagacgtcttaactgcatcctggaacagctggcctccagtcaaagagttacaggcagatttggggaatataattgtgtccggaattggttcctgccggtgggttcttggtcttgctgacttcaagaatgaagctgcggaccctcgcggagtgaagctgcagaccttcacagtgagcgttacaattcttaaaaagggcgcatcagaagttgttcgttcctcctggttggtttgtggtctcaccagcttcaggagtgaagctgcaaagctttgtgttcaggaatttccccggtgtgatcaagttctcatgtcggcagctgagaaagccactgacagctggggagctattttctcctttagtcacatgatgatagagataatcctggatgggaagtgtgggggagagaaggaggagaatgttcgttgttctgtccagaattggtaagggggctcctagagcttcctttcctgtagactcagcatctaaataactcgtgatgttatcttattatggcttctcttttaacttacaactacaaaatataccacatagaagagatatgaagagaaatgaaagaatacacaaatacatgctgttaggatgatgtgatatttttatctgttctatattttcattacttttaagattctatattaaaatggaaaataaataaacttgctttctt

SEQ ID NO: 475985 - DNA, 925 bp, Homo sapiens
tttttctgaattcaaggtttcaaggttaagtaccgaatatttctgtacaattactcattacaaattcagagttctcatgagatctggttatctgaaagtgtgtagcacctcctcctcctctctctctttctctcctgccagccatgtaaaaatgttcttgcttctccttcactttctgccatgattgttaagtttcctgaggcctccccagtcatgcctcctgtacagtctgtggaactgcacttcatcttccccaaacttcccgactcctcatctcagcaagaccgccaagctctgctgagactccaattcgctgtgccacggtataaatctaacaaaacatatgaggaatatgaggaaaactacaagattctgattaaagatatcaaagaagaattaaataaatggagagatattccatgttcatgtataggaagactcaatattgtcaagatgtctattctttccaacttgatctatagactcaaagcaattgcaatcttagcaaaaaatccagcaaactatttagtgtatatcagtccacaaactgactctaaaattacaatggacaggccagagacccagaataaacaacacaatattgaagaagaacaaaattggaaggctgacattacctgactttgacttactatgaaactacagagccttacagacaagggtcccatcagttctctatatatttacgcttcttcagagcccttgcttgtgttctgtctcacatgtggaataaagtccctttgcctaaaaagcagaaagaaagcatttccatgaaggtggtgataggtgaccgtgggaattttggagatccaggttaggggaagttacattgggaaaacatttagtttaaattcggtagaatatatttatgtggtaggcagtcacttctgtatattgctaggttatc

SEQ ID NO: 475986 - DNA, 610 bp, Homo sapiens
tataggaaaaggccaatgtacaaaagtagatcctcaccagcatctgttatttttttggatttttaataatggccattctgactggtataagatggtatctcactgtggttttgattcccatttctctgatgattactgatgtggaacattttttcaggtatttgctggccacttcggtccacggcccaaagccaaagccacagccacattaccacacagagcccccaaagagggaaactgatttcaacactgtatattttgctaatatgtgcctgctacttacagtatcagccacaactgaatgtccacaaattgcaggcttgcaaaattcaagtgagtttggcaaaaggaggaaagcacttacaagtgttccaaaatgggtccaaaaactaaaacaaagagaggcgggaaggaggtggagaaagggagaggagactttagatctaatttcctaacttcctagttcctaggactgttattggaaaggagtcccagtccacaccctaagagagggttcttggacttcacacaagaaagaattcaggcaaggtcgttgtcacctgtaccttgtgtcgacttcctatctcatcttgtgactaagaacgtctaa

SEQ ID NO: 475987 - DNA, 629 bp, Homo sapiens
tgattcctttagcgtcaagaatgcattccacatactcactggcagactgtgctgtacagaacctaaggcgaatcctgtggacattgatgcctgtcttccaggtgcttacagactgtgtggccacagggaagtttcttaatttctttgtatctcagtttcttaatctgcgtaatggggatagtaatgtgtctatttcatgggtaacaaaggctccgaatggaccgcttctggatgcctcctttatgagaagaaaacgtctccttcccaccaagggggtgtatcctctcccccagcacacagcatcctgtcctgccagggtaaggttcttcaccttccccagagactctcaaggaactggaccaagtttgttgcagctcagcccagttggggttgtgggtatctgtagcagaggctgagagttgaaccttcatatgtattctctccttctgccatagtaatagcatttttagttgggtaagtggcttcctagaatgaaggctccattacccagccttccctgtagggacaatctggaaagcccgagtcctcccattgtctggaattgccttttcctttcatagccactccaagtcccacctcatttctggtaggatttttgaagtgcctca

SEQ ID NO: 475988 - DNA, 497 bp, Homo sapiens
caggacagctgaagagaaaaggagggtatgcgtatccaggcagcaggctttgagagtgagaacggctctacttatcctggagctttcatgtggtgggagaggcgcagtgctggaactcttttcatcttgcaaactgaaagtccgtacctgctgaacaataactccccacttccctcctccccagcccctggcaaccaccgtttactttctgtctgtgtgaatttgactactttaggtcccttacataagtggatcgtgcagtatttgtcccttgtggcttatttcactcagcacaatgtgtcaaggttcactcatgttgtagtgtcagaacttccttcccttttaaggctgaataatattccattgtatgaatggaacacattttgtgtatccattcatctgttgataaacacttggattgtttctacctcttggttgttgcaaataatgctgttatgaacacaggtgtacagagagctgtttgagcctctgctttc

SEQ ID NO: 475989 - DNA, 741 bp, Homo sapiens
gccattctcctttgctcatggccctccagccacactggtcttttctagtttctagaagaatccacaccgaccagcaccatgcccgtgacactggggtactgggacatctgagggctggcccacgccgtctgcctgctcctgcaatacacagacttaagctatgaggaaaagaagtacatgatgggggacgctcctgactatgacagaagccagtggctgaatgaaaaattcaagctgggcctggactttcccaatctgccctacttgattgatggggctcacaagatcacccagagcaaggccatcctgggctgcattgcctacaagcacaacctgtgtggggagacagaaggggagaagatttgggaagacattttggagaaccagcttgtggacaaccacgtgcagctggccagactctgctacaacccagattttaagaaactgaagccagaatacctggaggcactccctgcaatgctgaagctctactcacagtttctggggaagcagctattgtttcttggggacaagatcacacttgtggatttcatcgcgtatggcatccttgagagaaaccaagtatttgagcccaagtggttggacgccttcccaaacctgaaggacttcatctcccgatttgagggcttggagatctctgcctacatgaaatccagctgcttcctcctgagacctgtgttcacaaagatggctgtctggggcaacaagtagtgccttgaa

SEQ ID NO: 475990 - DNA, 1960 bp, Homo sapiens
ccaggacaccttgctaagattttttttcggatgcaaactggaaccacagagaagccacatttgaaaactgctcagcaaagatgaaggtgagaatgccttggcttctctcttctcactgccttccaaaaggcaccctcaccagagtctccattgttgaaggtagccagagccaggtggctgtggatcatgaaaaatgcaatccgaagagaaagattaataaaataagtaagatgattatttacccgcgtattccacttcaaggctgtgggtggccggagcccatccagtggccaaagcgggagccagcagtggacgggacgccatcccatctcagcactggctcacatacccccaccctcactgagactgggaccactcagaaacgccagctagcatgcacagctttgggatgtgggaggaaaccagagaacctgcagaaaacccacgcagacatgggaagaatgtgtgaactctacacagacagtggcctggaccgggaatcaattttccttctcatcaatgttataaagaaacggcgtggttttactaccgctaactaccccatctacaaccacactggcctgcagaaaactgtctctgggagaaaggagagagaagtgggttagacaagcatttatggtgatcaacacgtggtgtgagaagccttttgtattattaaaaaatgggttactaacactgctcagtgaaaggcgctgtttcttttacaatgcataccaaatccaattatggaaaaagaacagtggaaattctttttttattgagagctaaaccagcttactagaccatgtaatttttttccagtaagcctagaacatagacatgtatatgtattaaaagaacttttctccatgcattgactattacacattatcaaatatttttttattcctgccaaatatttatttctccttgttgttttattgttttaattatttttcatttaaaatatatttacgtgggataaataaattgaaaatgaataatagaagaacttcagaatcaaatgatctagggaaaaatgcatttgaaaatattgtttttatttaaatatgtttacacttctgggtctttatattggaatacatattatatatagtataaattaagaaattaatttagaaattatatgtatacataaaattataaatatgtatacaatttttattaggaagatattgatttgtaaatttgatatataaatatgaagttttatataaatctaaaattttcaaattttatatgtgttaacataaaaatatgtttgttagtagtcagatttttccaagcaataatttggattaatttctcttattattttccatataacaagccaaatatgttttgattttttaaacatactgtatttatgaatatatggttggcattgtacaaaatccaaaatttttttaacagtccattgatagcaataggtaagtatcatacagatttatatttaattttataagagaaattttaaaaaatttataatttttcatattagccacatatttttaacttcttaattgtaaacctaccttgatccctagaactgttaaatccttttaatctaaggtatgttaaagtacattgtatttggctataaacttctcttcaaatgaaattcaatcaataaaataaaaaataaacaagaaaggagtcatatttccaagcatacaagaggcaaattcaaatgcattcttctatttgttgtgctattggttgagtatgttttctccctggtacaataattgtagcattgcagttttctggcaacaaatggcttctgggggtcaccaaatgtctctgatttgctaaagcatttaatcttccacaaaagctgtttactgcttcatatatgctgaacgccaggaacattatcttttaaatcatgcctagctgctaattaacggatgtataaacgtctaacagccaagtcttt

SEQ ID NO: 475991 - DNA, 870 bp, Homo sapiens
gagaggaacagcaaaaggaaagtttctgctgccttttgttcagctatgccctgcccccagaggtggggtctacagaggcagcaggccttgcagagctgcggtggcgtccgcccagttcgagcttcccttgccactttgtttacctactcaagcctcagcaatggtggacgcccctgcccctgccaagctgctgcctggcaggttgatctcagactgctgtgctagcagtgagcaagggtccgtgggtgtgggacccaccaagccaggtgcaggatataatctcctgaggaagaagaagaagcaggaggaggagaaagaggagaaagagggggaaggaggggaggaggggaggaggggaagggggaaggaggggacgaggggaaggagaagaaggaggaagagaaggaggaggagaggaaggaggaggaggaaagaagcagaaggaggtggaggaggagaaggagaagaagaaggagaagaagaggaagaagaagaagaaaaagaagaagaaggaggaggaggaataaagaaagaagaaagaagaagaaagaagatgaagatgaagaaggagcagaaagaagaagtcatccctggccttgaacagaggccctgactttttataaactgcaaatttcaagtgggccttatccccttttggtttgttggtctttcaacaagatacctctaactctaatttacataagagtggataggagaagcggggttgggtggggaggatagctctctgagaacttttatggagaggttaaaataattacagagtttatgagcccatgaagtttactgttagtcctacagaactttcaatttcttgcagagatttctttctaaactgtaaaatttcattct

SEQ ID NO: 475992 - DNA, 563 bp, Homo sapiens
acatcaaagatcaaaggtagataaatccatgaagatgaggaaaaaccagtgcaaaaaggctgaaaattccaaaaaccagaacacttcttctcctccaaaggatcaaaactccttgccagcaagggaacaaaactggacagagaattggtttgatgaattttcagaagtaggcttcagaaggtgggtaataacaaactcctctgagctaaaggagcatgttctaagccaatgcaaggaagctaagaaccttgaaaaaagattagaggaattgctaactggaataatcagtgtagagaagaacataaatgtcctgatggagctgaaaagcacagcacaagaacttcgatattatccaggagaaattccacaacctagcaagacaggccaaaattcaaattcagggaatacaatgaacaccatgaagatactcctggagaagagcaaccccaagacacataattgtcagattcactaaggttgaaaagaaggaaaatattgataagggcagctagagagaaaggttggtttacccataaagagaagcccattaaagtaacaacaga

SEQ ID NO: 475993 - DNA, 820 bp, Homo sapiens
gaaagttaccctggtgatggtgatgggggagaaatcactctaaagtggcatggaacctgaaaactacagaatgagaagcagcagctgtccaggggaagagtcaggggaaaaaccatcaggcttagggaatggcacccacaggatggagccagtgtcactggagccctgtgagcaagagccggagcagagtgaatggcagtgggagagggctgcaaatgttcatattccaagacagaaccccatcctcagacccaagtcctcggtggttgattgcatttgtgtcttacaggatatcagtccagagctggtacagtgtttctgtgataccataaagaagtggctgtttgtttacttctgcttcactgttggatttttgccctcgtgcttggtgcttcatggtagcaagatggcagcagctacaatgccatgtagcatgtcttacttcaaaggcttcatacctaaaagccttgtgaaattctgttcttttttctagggagacaaagctttcaagagggggttcccaacagatttcccctgttaaatcaagtttagcctaaagctgcctccttagcatatttaagttcagcctgaaggtttttctgtacattgtgaataataacaagtagaggtgtaaacagatcgtagactacatttgtgccaatcactgagttttggccaagcaaatgtagccaactgttcaaacaatgttcgtgtaacacaaatgctgagctgtaaccaatccagctatttctgtacatcacctccattttctatacattgctttcctttttctgtccataaatcttcttctgccacgtgg

SEQ ID NO: 475994 - DNA, 645 bp, Homo sapiens
tatatccaaaggaaatgatattatttttaaagcctttgctaactggtttggatctgtttcatccaggcatggttgagggattgggggacctcccttgggagatcgatcccctgtcctcctgctctttgttccatgagaaagatccacctacgacctctggccctcagaccaaccagcccaaggaacatctcaccaattttaaatccgaacaccaggatcttgctacaagtgccagaaatctggccaccaggccaaggaatgcctgcagcctgggattcctcctaagccatgtcccatctgtgcgggaccccactggaaatcggactcagctgaagactgacactgccgtatcgcctcagaagcctacaggaccatcacaggtgctctgggtaactctcgcagtggagggtaagtccatccccttcttagtcaatacagaggctacccactccacattacctgcttttcaaggacctgtttcccttgcctccataactgttgtgggtactgacagccaggcttctaaacctcttaaaactgcccaactctggtaccaacttagacaatactcttttaagcactcctttttagttatccccacctacccatttgccttattaggctgagacactttaactaaattat

SEQ ID NO: 475995 - DNA, 964 bp, Homo sapiens
ttcaggacctgtgttgtctgaggaagctgcattgtctggggccatgggtcctgcagggttatttccttcatttctggtaccaggttggagggtgacaggcaaacaagaaatgattagcatgaagctcattattttctgttgtctgaaccatagtcaaaaatttaagtttctagacagtggaaatatagacacaacatttagtttgcatcacttaatgagggggatacattctgagaaatatgtcattaggcaatttcatcattatgcaaatatcacagagtgtacttacacaaatctaaatggtatagcctactacacaactaggctatatgaaagaaaaggagtgatgcagaaaattctgggtcaagaaggttcttgggcagaactctcccagaagtgtcgttcccttaaaacaatttggttatttgaaaaattaaatggtagtgtctttgagctctaaaattctttcctcagcttggtctattctgctgttaatacttttgattatatttgagattcttgtaaatttttcagctcaaaatttcagtttgggtctttcttaaaatggctgtttgatctttcagctcttgaatgattttacttcatttcttggcttcattgaattgagtttcaactttcttatggatcttaatgagcttccttgttatccagatcctgaattccatgtctgtcatttcagacattttagactggttaagaaccattgctggggagctggtaggctcattggaggaaaggggacactctggcttttgaattgccagttcttgtgctgattctttatcatctaggagggttggtgtccctttaactgtggtataaattaaggacagtcagttggctttatttctggaagtttcagaggtccaaggctctgtacagggtctttgtgattgaattcttgtccttggttgtgcagtggggagaatcagtgttgtagttc

SEQ ID NO: 475996 - DNA, 509 bp, Homo sapiens
atagaaggagaaggagaaggaggatgaggaggaggaggaggagaagaagaagacaaaaagaaggagaagaagaaaaggaagaagaagaagtagaagaagaagaagaggaggaggaggagaaggaggaggaggagaaggaggaggaggaggaggaggaggagaaggaagaagaagaagaagaagaagaagaagaagaacaagaagaagaagaagaagaagaagaagaagaagaagaaaagaaggaggaggaggagaaggaggaagaggaggaggaggaaaaggatggggggagaatgaggaagaagaagagaaaaagaaggagaagaagaagaggaaggagaagaagaaaagataatatggtttggctgtccccacccaaatcttaccgtcagttgtaataatcccatgtgttgagagcatggccaggtgaagatagttgaatcatgggtgcagatttccccatactgttcttgtgttatatggataatttatatccatgagaacagact

SEQ ID NO: 475997 - DNA, 818 bp, Homo sapiens
ttcaaagaactaggaacgtggattcattgagggttgggtttttttcctagatgagtcaatggaaagaaaacaggcaaaggagttggcacaaaatcttccagatcttaaacttacagcctccggactggaaaaatcaatttctattgtgtgtaagataccaagtttgtggtattttgttacagcagcctaaacggactaagatagatccatgcacttgttcttttaaaaatgggctactaaaagaatatggtgtccaaggtgatgcaatttcaactcccttcctgaatgacagcagtcctcaagaagacatgcacatgattttgtgggagcctctagcagttcagaatggccctcagttgacttcctgcaaggaaacgggggcctcagcctacaatctacagcagcaagagactgaattctgccaacagcccgaaggagcaggaaacagattctctctgggagtcccaaaaagagaattcagccctcctaacacgttgattttagcccagtgagatctgtggcagatttctgaccaacagaactataagataataaatatgtgatgttttaagctactagatttgaggcaatctgttagaaatagaaaactaatacattctggtttctgaatcatagtcaatatacttgataggttttctgattttatgcttcttgtcttttatttttatttgatactcctctctccccttaacagtttcttaggaagcagcatcagcatttccttacaagagcgggttatacattcagattttctgggcttcaatcgtatgtgatcttggacaagttatttacatacc

SEQ ID NO: 475998 - DNA, 1201 bp, Homo sapiens
tctgatggttttgtgaagaggagtttcttcgcacaagttctctctctttgcctgctgccatctgcataagctgtgacttgctcctccttgccttctgccatgatcgtgaggcctccccagccatgtggaactgaggacaatgatttcatgagccattcccagggctctgctgccctgcacaaccttgggacatggctccctgcgttccagacattccagctccagctacggttccaaggggcccaggtacagctcaggtcactgcttcaaaagatgcaagccataagccttggtggttcccgtgtggtgtccactgacagcttgtacctcatgcctggaaaagcctcaaccactcaacaccagctcttgaaagcacccttaggtggggaaccctgcaaaaccacagggcagtttcccaaggctctgggagcccacctcttgcatcagtgtgccctggataagagacatggagttaaaagagattattttggaactttaaaatttaatgactgccctgctgggtttcacacttgtaagcgctttgttttgataaatttctcttttttggaatgggagtatttacccaatgcctatatccccatttcatcttggaagtaactagttttttattttacaaactcataggtagaaaggacttgccttgtctcagataagactttgggctttggacttttgagttaatgctggaatgaggtacaccaatcagaggtagattttatcttttcccatggtcccatatttcttggagtctttgttcatttctttttactcttttttctctaaacttctcttctcacttcatttcattcatttggtcttcaatcactgataccctttcttccagttgattgaatcagctactgaagcttgtgcatgtgtcacgtagttcttgtgccatggttttcagctccatcaggtcatttaaggtcttctctatgctgtttattctagttagccatttgtctaatctttttccaaggtttttagcttctttgtgatgggtttgaacatcctcctttagcacagaaaagtttgttattaccgaccgtctgaagacttcttctctcaactcatcaaagtcattctctgtccagctttgttctgttgctgttgaggagctgcattcctttggaggagaagaggtgctctgattttcagaattttcaccttttctgctctc

SEQ ID NO: 475999 - DNA, 1223 bp, Homo sapiens
gcagcatgacctggatgaagaatattttgttgtccagatgagaagcaaatgtgtggaataatcgggttatttctccagagagtagaatgggtccttatgtagttagtgaagtgtctgagctggcgtctgcatatctgggccacaagaggcttaggcaagatttggaaggtggaagtgatgtagcaacatcttccctttttatacctgcaagctcagggaagaacatgaggcactgctgcctcacacacagtgttgctcatttgccagctggcctggatggcatggaggagcagctaggccagcctccacagcacctacagtccctgctgggtcatccttcagcttcctggactcctgggggagacattgacaagagtttcagcccatccttttgggttacaggtcatcagcgccttgcttcctccatttcacatccatttgcccttcccaaatgcctgccctgcagactccagggtacagcttcagtataatactattaatagctgtgggtctgtcatatatgatttctattgtgctgagatatgctcattctatacctatttttatgagggtttttatcacgaaggaatgttgaattttattaaatgttttgtcagcatcaattgaaatgatcatatggtttttgtcttttattctgttgatatgatgtatcacattggttggattgtgtgggaattgaacaatgagaacacatggacacaggaaggggaacatcatggacacaggaaggactgttgtggagtggggggaggggggagagatagcattgggagacatacctaatgctagatgacgagttagtgggtgcagcgcaccagcatggcacatgtatacatatgtaactaacctgcacattgtgcacatgtatgctaaaacttaaagtataataataataataataaaaacctgcacatgtaccccttgaacctaaaagttggaaagaaaaagtgtttaaaaataaaaattaaaaaaaaaaagaataataatagctttggtgggtagggtattcttgatggcaactttttttttccttcagcactttgaatctatcacctcactccctcctgccctgtaatatctctgatatagtttgaatgtgtgttgccaccctaatcccgtattaaaatatactccccaatattgaggatgggacctggtggaaggtaattggatcacgggtttggatttctcttgaatggttt

SEQ ID NO: 476000 - DNA, 1270 bp, Homo sapiens
agattatatcctgcacctggctcggagagccctatgccaacagaggctcgctcattgctagcacagcagtctgaaatcaaactgcaaggcagcagtgaggctgggggaggggcacccaccattgctgaggcttgagtaggtaaacaaagcagcctggaagctcgaactcagtggagcccaccacagctcaaggaggcctgcctgcctctgtaggctccacctctgggggcagggcacagacaaacaaaaggcagcagtaacctctgcagacttaaatgtctgtctctgacagctttgaagagagtagcggttctcccagcacacagcttgagatctgagaatgggcagactgcctcctcaagtgggtccctgacccccgagtagcctaactgggagacactgcccagtaggggcagactgacacttcacacgactgggtactcctctgacacaaaacttccagaggaatgatcaggcagcagcatttgcggttcaccaatatctgctgtactgcagccaccgctgctgatactgaggcaaatagggtctggagtggacttccagcaaactccaacagacctgcagctgaaggtcctgaccgttagaaggaaatctaagaaacagaaaggacatccacaccaacaacccatctgtacgtcaccatcttcaaagaccaaaggtagagaaaaccacaaagatggggaaaaaacagagcagaaaaaccagaaactctaaaaatcagagtgcctctcctcctgcaaaggaacgcagctcctcagcagcaatggaacaaagctggatggagaatgactttgaggagttgagagaagaaggtttcagaagaccaaactactctgagctaaaggaggaagttcaaaccaatgacaaagaagttaaaaaccttgaaaaaaaattagacgaatggctaactagaataaccgatgcagagaagaaatacagagaacgccacaaagataatcctcgagaagagcaactccaaaaacacataattgtcagattcaccaaagttgaaatgaaggaaaaaatgttaagggcatccagagagaaggaagagagtgaaggccaatattcaacattcttaaagaaaagaattttcaacccagaatttcatatacagccaaactaagcttcataagtgaaggagaaataaaataatttgcagacaagcaaatgctgacagattttggcacaaccaagcctgccctaaaagagctcctgaaggaagcactaaacatggaaagaaacaacc

SEQ ID NO: 476001 - DNA, 1081 bp, Homo sapiens
tcttcacagcagccactccagatgggtcactgctgccatcaccaggagttcaagaccagcctgggcaacacaaactttactggggcctgctgggctcacccttcccgctcagcctggcaggctgcactcaggctgcactaccagcctggatcttgcacctgccgcagctttgaactggtctggtgtgccacgactggcttccgccttgcttgccagtgtccggacaagggggatgtggcattgcccaaaaactcagagatgtcagcaactgtggagccccaagtggtgttacaggttttgctcagggagtcccaaggtctgagcccccagggagctttagagttcagacccccaggaagtggcaacaacagcagttggaacctgaggaaaaaagttacaacagctgatgaagaagttgaagaaagaggtattacttcaggccttctcaaaggggacataaagctgaaaacagttgaggaagagaaaggtgagaaagaaaaagaaaaagatgatgaagaaaagcccaagattgaagatatggcttcagatgaagaggatgacagtggtgggaattgaacaatgagatcacatggacacaggaaggggaatatcacacgctggggactgtggtggggtggggggaggggggagggatagcattgggagatatacctaatgctagatgacgagttagtgggtgcagcgcaccagcatggcacatgtatacgtatgtaactaacctgcacaatgtgcacatgtaccctaaaacttaaagtataataaaaaaaaaagaaaaagaattagaaaataaaataaaataaaataaaataactccttaggtgatgaaagtaagatgtgtttttggttaagggaaaaaaagtttcttatgtatcctcaaaagtttctttatttagatctatatttaataaagtttctttatttagatctatattttaccacgtgtgaaaatatttttaagtttgtttatgcctgtacaagcatatacaaatacacatgcttgttttcactccattttacacaaaagtaatatttatatgtatattataagctaaatgtttga

SEQ ID NO: 476002 - DNA, 1471 bp, Homo sapiens
tggctttgtttacactgtgagaggaaaaccacctactcaagcctcggtaatgatggatgcacctgcccccaccaagctcaaatgtctcaggtcaacttcagactgctgtgctggctgcgagaatttcaagccggtggatcttagcttgctgggctctgtggggatgggatttgctgagccagaccacttggctccctggcttcaaccccctttccagggaatctcctggtctgtgggttgtgaagactgtgtgaaaagcatagcatctaggccagaatgcactgtccctcacagcacaatccctcatggcaccgtccctcatggcttcccttggctaggggagggagtttcccaaccccctgtgcttcccagcttgccgtccgtgggctgtacccactgtctaaccagtcctaatgaaatgagccaggtacctcagttggatgcagaaatcacctgccttctgcgttgatctcactgggagctgcagaccagagctcatcctattcagccatcttgccagccacctgaatcccaatcttttaaacaacaaaataacctgttatgtaataaatatatttgagaaacttgtacaatattctaatttgttagtgtgtatattactgcctggtgtcacttgctttcagcctgaataacatctgtaagtatttcttgtaagggaagtctgctagcaatgaattatcttagtattgtttaactttgaatatttttatttcactgttctattttaaaggccttttgctttatataagatgtttagttggcattctttttctttcaatgcttagaatatgtcatttcacttcctctggcctgcgttgctttcattgagaagtcagctcttattctcactgacattctctgatatgtgaagcattgtttttctcttgctacttttaagatgttatttttatctttgattttaaacatttttgttatgatttttctgtgtgtggatctctttgcttttaacttgttaagagttcatttatcttcttggttgtatagaccagtgtttttcatcaaattttggaagttttcagccattattcctttaaataatgtttctatccctttctctctctctgtttctggtactcctattaaatgtatgtttgtgtgcttaatgttgctccacaattttctgagttctgttcattgttttcattcatttttttctctcagtttcagcttccataatctctgttgacttacctttaagtttgctgattctttcttctgccagctcaaatctgttgttaggccccactagtaaattactcactttattttacttttcaactcaagaattttcattttgttctttttataatttctatctttttattgctattctctatttatgagacatcatcataccttccttttgctctttaatcaagatcttgtttgtttcttcaaacatatttataacagctgctttgaagtcttc

SEQ ID NO: 476003 - DNA, 1369 bp, Homo sapiens
ttggacatgctgtgttgttcgggccctacacatgctgacacatgctgaattctataaagatacccaaaaatgtggaagcaactttgaaactgggtaacaggcagagattggaacagtgtggaggctcaggagaagaccagaagttgtggcaaagtttggaactacctagagacttgttgaatgattttgaccaaaatgctgatagtgatatggacaatgaagtccagtctgaggtggtcttagatggagatgaggaacttcttgggaactggagcaaagctgactcttgctatgctttagcaaagagactggcagcattttgcccctgccatagagatctgtggaactttggacttgggagagatgactttgggtatgtggtggaagaaatttctaagtggcaaagcattcaagaggaagcagagcataaaagtttggaaaacttgcaggctgacaatgcaatagaaaagaaaaacccattttctgaggagaaattcctgctggctgcagaaatttgcataagtcagcgctgtcttaactaatctaggttttctagtcatctggtgcttccccaggcctcaataggatgagaaacaaatgtgtgattatgtaagaagtcagatgctaggtgtaatatacaggaggaagaggcacaggatttaaagccaggatgacctggatttgaatcctggatctgtgccttgctctctgtgtgactttgggtatgtaacttaatttctcgaaatttcagaatcccagattctgtgttgtgtctacctcacaagttagttgtgagcatcaagttacacaatctgtatggagctgcctagcacataatgaaaaactaataaaattcaaatatttgaggagcaaactttcaaagtcaagaaagtggtttattaaatttatggtaaaaagcatatagaaaagctttgagagcaatccggaggaaatcagattagcataactttcctttttaataatatttattatgcatattccatatagaacatgtttattcagtatgcaagtaaatctttcatttgagcatttggagaatagctgaagaggaaaagaaatactgaataacctaggagaaaaatgggtgtgaatttacatatatatttataattatatatttatatataaacatttagtgaacttatatataattaacatacatatgaaacatgtacatatatgttaattttattgtgatttattatttacaccccatttgcttcccaaatgaattcaaagtggcaagttatattttttctttcccattttgggaatgtttataacatttcaaatttcataactggtagagagctttggattctgattttgccaactgctgatgtatttt

SEQ ID NO: 476004 - DNA, 714 bp, Homo sapiens
tgatgttttgcattagcaaaagttgatgttttgcattaacatagtctatgttttgaaaaatactgtagcacatgaaatgagattacctggtgcatggaaacagcaagttccaattaatcagctcaattcatttaaatcacgtgccagacactgtgcttggtcctgggggctaagacacaggtcctgccttcaagtatatcactctaaaagaggggagaagagggagaagaggatgagaatgaagcctggaaaagcagagagcatgggccttggtgttttctcagtgctcttagtgaacaagtgtgtgggctgtgaagacagcttcctgcctgggcagaggctgtgggagggcagagccccagagagaaggaatgagctaactggacacaagatgatgcagatggtgtgcaggcccgagatgctgtgcctacttctggagttgaaattaaagggaggaaatagctactcagcaaaaatgctgcaaaggtcttagatttaagtctttgatccatatttagttgatttttgtttaaggtttggtcatttaacataatcccaaacttcttggcagctttgttcatttttaaaaattcttttctttttgtcttttttggattgggttaatgcaaaagccttgtcttcacattctgaagtcctattttctgcttattcatttctattgctgagactttccagtgcattgtgcatttctct

SEQ ID NO: 476005 - DNA, 806 bp, Homo sapiens
ccaacagcaaagaccaaaggtagataaatccacgaagatgaggaaaaaccagcacaacaaggctgaaaattctaaaacccagaacacctcttctcctccaaaggatcacaactcctcgccagcaatggaacaaaactggatggagaatgagtttgacaaattgacagaagtaggcttcagaaggtgggtaataacaaactcctgcaagctaaaggagcctgttctaaaccaatgcaaggaagctaagaaacttgataaaaggttagagaagttgctaactagaataaccagtttagagaagaacataaatgacctgatggaactgaaaaacacagcacgagaacatcgtgaagcatacacaaacatcaatagccgaatcaatcaagcggaagaaaggatatcagagattgaagatcaacttaatgaaataaagcatgaagaaaagattagagaaaaaagaatgaaaaggaatgaaaaaagcctccaagaaatatgggactatgtggaaagaccaaacctatgtttgattggtgtacctgaaagtgacagggagaatggaaccaagttggaaatcacacttcaggatattatccaggagaaccccccgcaacctagcaagacaggccaacattcaaattcgggaaatacagagaccactacaaagatactcctcgagaagagcaaccccaagacacataatcatcagattcatcaaggttgaaatgaaggaaagaaaaaatgttaagggcagcaagagagaaaggtcaggttatccacaaagggaaacccatcaaactaacagtgga

SEQ ID NO: 476006 - DNA, 889 bp, Homo sapiens
gcgtatgtggggctctggagtttaagcttcattggattcaggataaatccacttctgcccagaacagaaagggtatctccccatagccactacaagtaggaatgtggtgggtcataactgaaggcaacacagctctgagtctcacgcaagttctgtgggtggactctcccagaagaacactccaaggccaggatttgagtgccagtagggaggaaaaagagaactatgactgtgagattgagaggcactcaggggaaattaagtgcttcaacattccaccccctctgcgttgccacccacatcacagtgctgctgtggggattaggcagaagcgagaagactacaaacctctggctacaagttttcattattcattcatctataatgtgggaggctctgcgaaagtcattggagcttacatgaagataaagaagatctgttctccactctcaacaggagggtcccaatctggtgagaacagaagatctgtcaacaacagcacctattgaaaatgtgagaaggagtatgatatatgtgtcttagtctattttctgctgctataacagaatactacagattggattgaagatgtagccttttttcattcttctgcaagtagccttcaattccttctatccttttgacgaacttttacttaattttggttagatcaatattatattttaatgattggatcatgtaaactttattcaaagctctcttacacctctttttgctctccctggaattatttgttttagtttcaaaatatatacttatcattaatttatacccagactctgtcagttgtttaaatatccttttgatatatttgagcacatctggtatgctatcaattttgtctttctggaaaactctgtactggaag

SEQ ID NO: 476007 - DNA, 522 bp, Homo sapiens
tctcccagcagggagatagactaagtttaattgggaaattgctaatgtcagtattcttaggtctttttcttctagactgttcttatttcccagaagagaatctcctagtattctatctagaggacagaagcatcactgaaaatattctgagatccgactgggaacagggtgatgggtctcaagattcttcaggaccctcagctgcaggtctgttggagtttgctggaggtccactccagaccctgtttgcctgggtatcagcagcgaaggctgcagaacagcggatattggtgaacagcaaatgttgctacctggtcgttcctctggaagttttgtctcagaggagtacccggccatggcatgaactgagcagaggagaggatgcgagggtggaggaagcagctgggcatgctcagcacaggctgctgcgaggaggagccctgggaatgctgcttttaatgccacagcggtgactttgcttagcagaagccttcacagtctatggactgcaggaggaggctc

SEQ ID NO: 476008 - DNA, 494 bp, Homo sapiens
tctccccacaacacaaccaccaacccctgacaggccccggtgtgtgatgctccccttcctgtgtccacgtgttctcattgttcaactccctcttataagtctgctggagtttgctgaaggtccactccagaccctgtttgcctggctgtttgcctcaccagtggaggctgcagaacagcaaagattgctgcctgttccttcctctggaagcttcgtcccagaggggcacttgccagatgccagcgggagctcttctctcaggaaattatggagcctgagaagctgcagacctaggaaatctggtaatgtaattcgttctgagtctgaaggcctgagaaccaggggagccaatggtgtaacttccagtcccagggaagaagatgagatgagatgtcccaactcaagcaatgagtcagaaaacaggggcaaatttctcctttctctgcctctgttctattcaggtcctgaatgaattggatgatgtttactcacat

SEQ ID NO: 476009 - DNA, 540 bp, Homo sapiens
acatagaggaggaatgccatgtaacaacagaggtggagattggagtcatgcaactgcaggccaaggaaccccaaggcttgctggcaaattaccagaagctaggaagaggcaaggaaggattctcacctacaggtttcagagggagcatggcactaccaacaccgtgatttgggacttctgttacatacaagatctatttaattgtcacagcaagtccatgatgagggctgcacaaaagaaggagattcttttcctgctgacaacggatggccaggaagaaagtgtgaattcaacagagaagtttcacagaaatgagctgtgctcagcctttgccataagagggcaaataagcttttctcacttggaggaaacttctttaaaaagtatttactgatctaaatgtctttcaataaggctgttaaataaattgtggtacaacaatctacagtttgaaatatttcagtctttaaaaaaggagaagcatacctatatgtatgcacacagaaaaatagatggttgtttttaaaaaagaaaaaatgc

SEQ ID NO: 476010 - DNA, 581 bp, Homo sapiens
gaactgggtatctcagttggaaatgcagaaatcacctgctttctgcgtcgatttcactgggagctgcataccggagctatctagttgtttgataagtttctggtgcttcccccttctctttctctctctcctgatgccttgtgaagaagctatttgcttctcctttgccttctgccatgattgtgagtttcctgaggtctccccagccatgcagaactcaagagaatgcatggtggtttatgttgaggaaaccagccccacaccacccagcgggtaccccgagtcccggggcgacaaaggagttagaaagagacagaataagcatttaaaaggcgggtccagaggaccggagcatcggaggcttgctcgcggcccagagctctcgggctccccacaatttattggtttacaagctgtttgttcttcgggcagatgggagttgggaggaagggatgaggaaaaggatgaatcagtggaggagaactcgtgagtcattctataagatgtacagcagtggcggcttctgtgaatttccttgagcaaaggcgtgtgtctaaactacttaagatctttaacttatc

SEQ ID NO: 476011 - DNA, 552 bp, Homo sapiens
tatgaagatctgtacttgcctaaggccacatggctgtggagtctcagtggctcctagtggtgctcagcaagaaagctcacacggtgcctcctcatcattcatctcctatcactcagcagcaagcagaagctgcaaacgtagagagcaagctgccaccgatcaccagggaaatcacaaaagtaacttggaaagcaaacgtggcttcttctagcagtatcagattacctgtcatgacaggctttacactttcctacacgccaccaaaaaagatagcttcttacctaattctggaggacacaacttgcatattggataatggctcccctgattcccatgagtttaggccaggtggaaccaagcatcttgaggaatcaattcagcttctccaggacttagtaccgcccacttgggatagtccactgtttctctggatcactgctgttgggttgtcccatttgctgtgatagtggcccagagatttgggaggttcagtttatgtttgccatggaggggttcatctgaatttgtttttgtaagagacttcttattttc

SEQ ID NO: 476012 - DNA, 711 bp, Homo sapiens
cgattggctctctgattctctctcgcctgccgccatgtaagatatgccttttgccttccaccatgattgtgaggcctccccagccacgtggcacttcctgcatactgagtgggggtctggtcgtgctggaagcactgcccttggtggaggattcaccagcagccagagactcaagactgggcagtccgaagaggccaaggaggaacagggaggactgacattctctgcccctctagggacagtgagggctgtagggcttgtagaattattgcatacactatccagattttatattgggctgtgcagtttgaccaacgagccagcagatggcacttataggaaaactcccccttatacatcattgaatcctgtgagactcattcaccaccacaagaacagcacaggaaagacctgccccatgattcaactaccctccatcgggtccctcccacaacacatgggaattcaagatgagatttgggtggaggcacagccaaatcacatcactctccatattgctgtattctgagaaacaatatttagtcgctgaaagatttgattaaaacacaatttgggtcaaataatatccatttattttcgtgggggatttggattataaagttccacagttgttgggttattgattgtgtcactattcctgacacttgctaagctcagttgggatgggttgagataaagcataatagtacc

SEQ ID NO: 476013 - DNA, 927 bp, Homo sapiens
aggattaataggttttgacagctgagattttaagaaggggcacctgccagatgccagcccgagctctcctgtatgacgtgtctgttgacccctgctgggaggtgtctccgggtcgggaggcacgggggtcggggacccatttgaggaggcagtctgtcccttagcagagctccagttctgtgctgggagatccactgctctctttagagccagcaggcaggaatgtttaagtctgctgaagctgcacccacagtcaccccttcccccacagataccctgcccagggaggaggaatctagaaaggcattctggctacagcagctttgtggtgctgcagtggaccccagccagtatgaacttcctcgtggttttgtttacactatgagaggaaaactgcctactcaagcctcagtaatggcagtcgttcctccctccaccaggctcgagcatcccaggtcaacttcagactgctgtgctggcagcgagaatttcaagccagtggatcttagattgcagggctccctaggggtgggatccactgagctagaccacttagttccctggcttcagccacctttccaggggagtgaacggttctgtctcgctggcattccaggcgccagtgaggaaatgcattttcaactgactattggtggtgactttgagtactgggttgaagaaaatgatgaggcaaaggtgcaagccaatgagaaagaatacagtgtctgttgtgggtgtagaaaaaggagagacagcatgaccaccgggcctgcataacaaagtaccacaaagtgggtggcttaaaacaatggaaatttattatctcacaattctggagtctaaaaattcaaaatcaaggtgtcagcaggtccatactctcctctctaatctgtaggatagaatcctcctttgtgtctttcttgcttt

SEQ ID NO: 476014 - DNA, 1206 bp, Homo sapiens
attacccagttccaaagttgtttccacattttcaggcccctcctcaaattcgacatgagaattgggcagagacacagatccaaaccatatcactctgcccctggaccctctatcaaagctcatacttcgttgtccatatcactatcagcattttggtcaaaaccattcaacaagtctctaggaagttccaaactctcccatatctttctgtcttcttctgagccctccaaactcttccaagctctgcccaatactcagttccaaagtcccttccacatcttcagcacttgcattaatctagctgatctggctgctgctgattctcctgtcatctcattggagaaggacaacatcttcaaaggctcaaacatcattcctcagcccataattcctacagttttaccaatggaacagtctattttgaatgcttcttatgaatgttcaggcaactggaccccaactgaataccagagcttccccttcctgcattaaccagtgccccgacattgtaaactatcgcaagaacaaaaaaccaaaggccgcatattctcactcgtaggtgggaattgaacaatgagaacacatggtcacaggaaggggaacatcacactctggggactgttgtggggtcgggggaggggggagggatagcattgggagatatacctaatgctagatgacgagtcaatgggtgcagcgcaccagcatggcacatgtatacatatgtaactaacctgcacattgtgcacatgtaccctaaaacttaaagtataattaataataaataaaataaaattttaaaaaaagaaagtggtggtcgcttaacacatgtttgaattctattatttttattcagtcagattattctttggcttcatttattctctttcattctctaatgctccttcctttgaagatataaaataattattttttcactcctatgatacagttgctcatattttatgagaatgcacattgttagtttattttaaaaagtgcctctattttgtcctaataatgtgataaagtaaggcaaaagaaaaaaaaaaaaaaaacttatagctatagcttggtatagcttcactggatgcaccaactgtggtcccttggtgacacacttttataactttctaattttgtttatggcagttttaatggtgaaacatataatcacaactttctagctctttgggacatcaagtg

SEQ ID NO: 476015 - DNA, 614 bp, Homo sapiens
atcacctcggaagccccatagaccatcacagacgccgagctttggataactctcacagtggaagaattcaggcctgtcctcagaatgctacaagggctctgcgaggatgatggcatgggctggtggttgccccaggcaccctcagtcctgctgctggatcatccgagcttccaagatgatggcgagccccttccaagatggtggtgggctgcttccaagatggtggcaagcctcgtgttctcggacctgggattcttggcttcacagattccaaggaatggaatcttggtccatgtgccatgtgggaacaatggcaagcctttagcccagttgggagtggcaatgggtgccttgctggatcaggagcacagcggacaccctgccagatctggaagaatggaagtcagcggtgggtctgcgatggtggcaaaacagcagtggtgcccagcaagcaaaagctctgctcgagccgtaacgaacacggaccagaagcttgcagttgcaagatttaatagagtgaaatagagtgaaaacagagctcccatacaaggggaggggacccaaagggggttgccattgctggctcaaatgcctgggtttatatcctgatcatt

SEQ ID NO: 476016 - DNA, 1302 bp, Homo sapiens
cacctctctgctgcagctggcatgatgtcacgctgatgcaagaagtgggttcccatggtcttgggcagctccacacctgtggctttgcagggtacagcccttctcctggctgccttcacaggctagatttgagtgtctgcagcttttccaggcattcagtgcaagctgagagtggatctaccattctcacatctggaggatggtggccctcttttcacagctccactagacagtgcctgagtggtgactcttctctgaccagttaccaccaaacatacaacaggatgaccaataagaaaattacatacaaagtgaatcttctcaataattcaaacataccctgctttctttcacacttcattcattcactcaacagactactccagtctgccaataagctctgtaaggttgggcccgagaggtctcctaagcctctgaaagcaaattagacagcattagcagaaaagaatttgacaactagtcttttttggggataattgtctctgttttttaaatcacaaaacttactgcttgaaaactaaagtgtttctccatctgtttatgttattttgtaaattatgtttagctctttatatttgtgataccattaggccactgtcagagtactttcaacactggctaagcagtagatttggcataatagaaaggcatagactatcaagccagactgatatggcctgaatcaaactctaacacttattagctttctgtggtatctccctgagcagcttaataataaacctcaattctttatctgccaattcagagatttctttgtgatttggatccattgctggggagctagtatgatcttttggggtgttatagaaccctgttttttcatattactagaattacttttccgttttctcctcatttgggtggatcacttcctaaaattgttcttaaattcatttttgattgttctgtgttatttttaatttaaatttctttttttctctcttaaagatcagactttaatgtttatttttgcctaattttttatttggtgcttgtgggggtgaagactctttatgagattcttagttattgaaagtcttgtgcactcactttcccaaagctggttgtagcagttatattcttggtgtgtgggtgagttcacagtctcctatggatttggaatgtcagagatctgttgaagtttatgtcattttctcatggtgtacaacttatttatttattaatttttttccaaatgttttatttactcagtttataattcagacttcaggtcaatagggaaagtatctctgattaggc

SEQ ID NO: 476017 - DNA, 529 bp, Homo sapiens
tcacttctgccagtgactaacttaggaatggatggattccatttgtcttacaactcagtggaggcttatcttagtgtggacaacatacttcaatcagccagctttgattctagactgctcctaggtcttggaggaggaccctcaattactgtatctatgcccacaattccatttttgggtgttctggtccatagtgctccgctaggcaggggccacagttggcagatatgccttatgcttacttggtctgccctaatctgctgtccacgtccttcccagggaagcataggtttctgcctgcctgcagagtttaggcagaagtgggaccactgggctggaagcactagcaatgtgacccatctggccacaggaggtggaatgagtgaagtttcctgccctgccatctggtgcttccagtacaaaaggtggctgtgtaccttgacaaattcaggtagaagaaagactgctcagctggaagctctagcaagcataaacttcctggctaccagaggcagaggtaggtgaggtc

SEQ ID NO: 476018 - DNA, 553 bp, Homo sapiens
ctcatttactcatgaccacaaatttaaataaagtctccactgatttcagcctgaatgtaaggcaccttatagtgagcaaaaaccatgaaacatggctaagtctttcacatcaccacccagaaaacctttactacatagcttattggttaagagctcttctccaaagccagactacttcagtccaaatcctggttctggaagaaccagctgtattaattcggaaggttctagacaagaaacactgttctgtggtcagtaaaaaaatgatgttccagttctcaacgagttgttgcacagacagttcaaaattcacctattccgaccttgcttgtgaccctggaacgttttcccctcacaagtcaactcagtgtaaagctctatcagtgaatggtacaatagggatcctggaggaggaaggcatttgcttcccagttctggtgtactcttttggcagtcttccgtaacgcaaggtggccagcagcacagggcaccttcctatggacagcttccccagcacacttttgggcagttttgcagattgacttggcaatgc

SEQ ID NO: 476019 - DNA, 2463 bp, Homo sapiens
ttgctagcagctctggtatgggatggttaggacattctcattgccagtggctcttttgcttatagtaagcacactgattctgactcaggggctggcaatttggggactcttgtctgggcatcccagctgccaatcgtataacaatgttttggctcatgatgctggtgatggtggctgctggtcagaagtggccacacactctacctcatctcagaggacagcccagtgtaaaggcccttataagagagaaagaggagaatttgatatcagccaatacaaacctttctctcagctggctggcctctccactgtcccctataaaggattaagcagaactcagtcccattccagcacatcaggcacaaaatgtctctttgatctttctgccacttttaagaaacatctgcatctttgtaaaaaggcctagcaggatgagccaaacatttgagaatggacatagccacgtgcagggagatagaaaaaattattaggggaactgactctttgttagattcccagagaccagaaagaaggatgacagtgtctggggcttataaacatgaagtaatttctctgagttggacttcagaggtgacccattctatcaagctattaaacaagataaacagaatggtaggactggttttaaggttatccaaacattcacttcacaaataaggaaacttacaaccccaaaagttcatacttgtacattgcccttttctattttttaagatatacatattgcaaatattcatttgcagtctttagtatgtttttgctttcttaactatgtttttcaaagagaaaaataattatgataaagtcaaacttaactttctgtggtctatgtgctttttatattctatttaggaagtctttgcctaccccaactttgcaaatattttctcctttgttttttctagtttgcaattttacatttcattttgcaataatattgaacatatagaaaagttgccaaaatagtacggagagttcctgaagacccttcacagaacttcctttaattttaacattttttgtgatcaagttataattatcaaaagtaagatgacaagattgctaaaatactattaactaaactagagacttgtatttcattagtttttacactaatagaatcccaaaatcccacattgcattcagttgttaagtctcctttgtggaaataaaggaaaatcactcaaatgagaacaagtaaaggttacagcttttttccaggtgctctaagttggaagtaagggaaaaattagagaagctgtcagttatatgattctggctttttagggctcatttctataggggttattgtttggctgcccggattgttagctataaataatagtttgagttcctgaactggttactgaaggtaatgagttggcttcctggactggtggctgcagattgtgggtcagagttctatttttaaacatggtatggccattgtctgtattttcagcctcttatctttgtctcctccaatgagtaacagtgccagtcttctttatgctttatgacattggcaattttgatgacaactcctcagttactctgtagaatgtccttcatttgtgtttatctaacattatttcatgattaaattgaagctatgaatttttggcaagaataataaatgagatttccttctcagtgcaatataccaaggagtacatgatatcaatatgtcttattacttgtgatgttaactatgatcatttggttaaggaggtgtttgttggatctgtcagtgaaaagttgttatttttctctacatagaatgataggaaaaactgatgtcagtagcaaaatttccatctgtttggctatgtgaggtctgttagctcacaacctctcccgatggactcatcttcatatcctaaaatgtaaatttgaaattcattattaacatttaaatacttctttaaagtttgggataccaaaaattatttccaacacatggcaaatgtttcttatggtagctaatctcagggcctcagtggatctacatgttctttcctcttaataatttgcatgttgacaagaatatattggaccacctcatggtatttaaaacattctgtcccaaaccacaatagaaaacaaatatcaaatcttcttaaaagttttagggctgttaaaagattgtaaagagtaaaaatagaaaactatagtcaatacctactttacattctctgatatcactctctgaattttaaccacaggactttccacagtcgtaagttgtttatgtgtgtgtgtgtctgtgtatgtgtgtgtgtgtctgcatgtacgtgtgtgtcagagagagagttccattgttgttgctgctgttgttgtttttggttcattactatttcttcgtcaagtctgtaaactattaaaggtcaaggggcaaatcggttaggctgacaatgggagcctaaaatctatttgttgaac

SEQ ID NO: 476020 - DNA, 684 bp, Homo sapiens
agctagttgaaactatacattatggttaactatagtgaccctactgttagtttcatagttcaggtcttacagttaagtctccaatccattttgatttttgtatatgatgagagatacgagtctagttttattcttcttgcatgtggatatccaatcttcccagaactatttactgaaaagactatcctttccccaaaactgacttacctgatgcttacttcagtgatgtccttttttggttgtcggaagctctaccctcttcttccacgtgtgtatgaaaatgctccatcagaagtacacacagacacactgacatacacacttccggatataaaaagaataacagcatttattgaaaagactttcctttcgacattgtctgttcttggcacctttgtcaaaaatcacttgatcataaatgtgcagatgtatttctaggctctctattctgttccattggtttgtgtgtctgttttatacaaacatgctgttttgattactacagttttgtagtatattttaaagtcaggttctgtttactcgtctttttctagttccttgaaatgtgaagctaagttgtttatctgagatctttttactttgatgggggcagtgattgctgtaaccttccctcttaaaactgcttttttttgcatcttgtaaggttttgtatattttttgtgc

SEQ ID NO: 476021 - DNA, 1763 bp, Homo sapiens
ttgtgaaggtatttttctacagtctacagctcccagtgtgagtgacacagaagacaggtgatttccacatttccaactgaggtaccaggttcatctcactggggagtgtcagaaactgggtgaaggacagtgggtgcagcacaaagagcatgagccgaagcagggtgaggcatcgcctcacccaggaagtgcaaggggtcaggtaattccctttcctagtcaaagaaaggggtgacagacggcacctggaaaattgggtcactcccacgctaatactgcgcttttccaacggtcttagcaaatggcacaccaggagattatatcccgcacatggcttggagggtcctatgcccacggagcctcactcattgctagcacagcagtctgagatcaaactgcaaggcagctgcgaggccgggggaggggcgcccgccattgccaaggcttgagtaggtaaacgaagtggccaggaagctcgaactggatggagcccactgcagctcaaggaggcctgtctgcttctgtagactccacctctgggggcagggcatagccaaacaaaaggtagcagaaacctctgcagacttaaatgtccctgtctgacagcttggaagacagtagtggttctcccagcatgtagctggagatctgagaacggacagactgcctcctcaagtgggtccctcacccccgagtagcctaactgggaggcacccccagtggggggagactgacacctcacaaggctgggtactcctctgagacaaaacttccagaggaacgatcaggcagcaacagttgctgttcaccaatatccactgttctgcagcctctgctgctgatacccaggcaaacagggtctggagtggacctccaacaaactccaacagacctgcagctgaaggtcctgactgttagaaggaaaattaacaaggagaaaggacatccacaccaaaaccccatctgtacatcaccatcatcaaagaccaaaggtagataaaaccacaaagatggggaaaaaacagagcagaaaaactggaaactaaaaatcagagcacctctcatcttccaaaggaacacagctcctcaccagcaatggaacaaagctggacacagaatgactttgacgagcacttgttcatgaagaaaatcacactaataattggagccttgcaattttcagtagtgaattgtaaatacttgacactcagggattcatattgtgaaagcatattaacctataaaaaggaaactgcgatgtcagttaataagacctcccaccctcatcctccatttgaagaagaagaaacaaaggttaattgcccaataaattctaaaaaactaaggccttcagtaatactacaaattctcaaatttggtgtgaaacgggattttcatgtttttacccaacttaacctaacctttaacacttttcctatttgtgcatctgttgcttcactgaaacttttcaaaattggcatcaataaaagaatctttttctccaataatctctcagtaaagatagattgacaaaaatctggatatactgaacatgaatatgtgagggagcttcatgttttattgaacttgaatgtgtgaggaagattcatatccatgaagtcgtcattaaacacaatattgttagtatttattacggtgacagattgctatggtttgaatgtgtccccttcaaaatacacatgttcaaacttaatggacaatgtaatagtattaacaagtaaggtctttaagaaatgatgatt

SEQ ID NO: 476022 - DNA, 455 bp, Homo sapiens
gtgcaaactctagcaccattatcttggcttatgtttctggcaatggcatactccctgctgttgaggtccactaggttctacagcattggcaaatctttagaaggcttagaattttctctttttagttatggaataattgccataaacaacaatgtaggcttaggtttggctgatgccagggttcagacaaaggaatgtgctagtggcaatggcctgtataccgttttcttaatttcattccctgccatcaacccaactcctcagcaaattgagaagactggatctgatcccatgttcactgaatcagatcatgttcttaaatattactcatattacaaagattgtgtttccaggggaaccatacaacactttaacatggggggaaaagagaaaaagggcagaaaaaagaaaaatggagactaataacttagtggataggaaaatattttcatggt

SEQ ID NO: 476023 - DNA, 1012 bp, Homo sapiens
cttttatcactttcccttctcagaagtcgggcctgtcctcggaatgctacaggagcccatgttctttccactcttccatactacttttatagacataccaacattctgcgttaaatctgtaaaagaactcagaaagcatacaatcaaaatcctcatgttaatcatgagaaacctggaatccagaccaggtactcaaagggacatggaccccaagtccaataacaatgtggttttgcagactcataaaggtacttctttggtggtcctggataagttgcagaattctctaaattacaaagcagagactcttgtctttttcttactttctcccaaagggagtctctacctctatgctgagttgcctggaactgggagtgtggtgatgcaagcacccctgtggccaccaccactggaactgtgctggatcagacctgaacccagcatagaactctgtcttgcccagggctcactgtaatcactacttggttactatctatgttcactcaaggacctatggctctatgatcagcaggaggtggtaaagccaaacaggtttgtgtccttccctttagggctgtacaccagtgaaatgtagatttggtcttttcacatagtgccatatttcttggaggctttgttcatttcttttcacccttttttctctaatcttgtcttctcactttatttcattaatttgatcttcaatcgctggtatcctttcttccacttcatcaaattggctattgaagcttgtgtatgcttcacgaagttcccatactgtggttttcagctccatcaggtcatttaagctcttctctacactgactattctagttagccattcatctaaccttttttcaaggcttttagcttccttgtgatgggttagaacatgctcctttagctcacagaagttttttattaccaccttctgaagcctacttctgtcaactcgtcaaactcattctctgtccagttttgtttcattgctggtgaggagttgtgatccttt

SEQ ID NO: 476024 - DNA, 520 bp, Homo sapiens
gaatcagcctcctggaacacagagcaggatggatcagggtggaagtggatctgaaatgttactgctctacacagtgtacgtacctttatgtgtaaatacagatttcaaaatctctacagatgtaccctgggtcagagaggtttttagcagatccagaaaatgcgtggtcttggtttctcacaaaaagaatatctatgagataatgataaagagaaaaaagttaatcaagtggaagaatttgcagagggatattaggttcagaaataaattatttcaacatgtgaggtttttactgggctgccaaagaaaatctatggaaaagggtgctccttgcagattgaacaatggcaagagcacacttcaacaaagggacccaaatgtgtatcccttacacatttgggtcatcctcattgctgtgtcctgcatccattggctggagctggacctcacagtcttaagctgatacccaattttctaataacctaaaactttcctaaatagaaaaacaatagtatcacaa

SEQ ID NO: 476025 - DNA, 636 bp, Homo sapiens
atcacctcggaagccccgtagaccaccacggacgccgagctttgggtaactctcacagtggaagcctagccctcatgtctgcctgcagcggctgccgctgctttaatacttttagaggcctttcctacaagaagtcagacctgtcctcagaatgctacaagatgttagcctccaaacggtttgaagaaattgcaaggttgaaggaaactacagtgaaagttccaattcagttagaaggaaaaacaatgaagtgtagaggaaagaatatagcaaatatttcaaaagaagaacattttcttccaagcttggtagccaaagctaactttgctccagagatctcagagacatgtgacctgtggcctgtgaaagatttatattacttacacttttgcaggttgtttgaaaaagtttcagtgcaatgtcaatcctgctatgtaaccataggaaaagttgttagagatgatacaagttttctctaaaccttctttgaagaggataacaatagtacctccctaaaaagtttgttgtgaggattaagtgaaataatctctgaaaatgcttaatatagtgccaggcagttaataaacagcaaatactacttctgattattgtaatcatcattattgttatgtcatc

SEQ ID NO: 476026 - DNA, 593 bp, Homo sapiens
tctgtaggtgtccaaggtgttgatgggtgttcctgggatcatcttcatctctaactgatgaagatgagtcaagtcctggtgaaatactatgaagtatttgtctgtaacttttgtttctgcgggctgtacaggaagcatggccggggaggcctcaagaaacttgcaatcatggcagaaggtgaagggaagccagcacatcttatgtggctagagcaggaggaagagagatggggggaggagtggctttacatggtgaggaaatcaaattgtcaagggtctttggtggtgaccactgcctgtctgcccctttgctcttctctctttttccacactggtcaccacctggtgttcccaataaagtttgtgatggagactttcaatcagtatattctagacacaagtccttatcattctgattgctgggtctcctcaagttccctggatcttgttgccatagctgcatctctcttggccacatgggagaagcatcctgctgtttcaaatgccatgacatgctgggtagcctgaggatttagtgatacttttctaggttcatctacaaaggaggatacctacaggtctttctaatctat

SEQ ID NO: 476027 - DNA, 753 bp, Homo sapiens
agactccaggggatgtatcagaaagcctgggtgcccagacagaagcctgccacaggggcagagtccccacagagaaactctgctagggtaatgttaaggggaaatgtgggggtggaacccccacacagagtccccaccagggaactgcctagtggaactgtgggaagggggctgccgtacaccagacctcagaatggtagagccactggcagcttgtatccaaagcctggaaaagctgcaggtactcagctccatcagagtagttgtaggtggctgcactctgcaaagtcacaaggtcagagctgcccaaagccttgggagcccattccttgcaccaatgtgcctggatgtgagacatggagtcaaaggagattattatggagctttaagatgcagtgtattccctgtggcattttagacttgtgtggggccagttgcttctttcttttggctgatttctctcatttggaatgagaatgtttatacaatgtctgtacctctattttgtcttgaaagtaaataacttgttttgattttacaggctcgtaggtggaaggagattgtccttgaatctcagtcttcaaaatccagagtgtattttatacttaacagtacatcacatttcatactcagacactttcactggaaatacttcatctgcatttggttctcacaaaatttacagttgaaaaagtaggttcatatacttacattgttccaagtatacttaaaagtcttccaataaattcatga

SEQ ID NO: 476028 - DNA, 897 bp, Homo sapiens
aggcagggctctctgctcctcctgtttgacagacagctgcatcttctcttgcattgccaaccacatccctgagacaccatggggaaagtgaaggttggagtcaatggatttggttgtattgggcgcctggtcatcagggctgcttgtaattctggtaaagtagatattatcgccatcaatgacccattcattgacctcagctacatggtctacatgttccagtatgatcccacccatggtaaattccatggcaccgtcaaggctgagaacgggaagcttgtcatcaatggaaatcccatcactatcttccaggagccagatccctccaaaatcaagtggggtgatgctggcactgagtatgtcatggagtccactggcatcttcaccaccatggagaatgctggggctcacttgcagtggggagccaaaagggtcatcatctctgccccctctgctgatccccccatgttcacgatggaacatcatccctgccactactgggctgccaaggctgtgaggaaggtcatccctgagctgaatggtaagctcactggcatggccctccgtgtccccactgccaacgtgtcagtggtggacctcacctaccatctggaaaaacctgccaaatatgatgacatcaagaaggtggtgaagcaggcatcagagggccccctcaaaggcatcctgggctacactgggcaccaggtggtctcctccgacttcaacagtgacacccactcttccaccttcaatgctggggctggcactgccctcaacgaccactttgtcaagctcatttcctggtatgacaatgaatttggctacaacaacagggtggtggacctcatggcccacatggcctccaaggagtaagacccctggaccaccagcctcagc

SEQ ID NO: 476029 - DNA, 1457 bp, Homo sapiens
acatcaaaaagactgaaagacggggaggagccaagatggccaaataggaacagctcctgtctacagctcccagcatgagcgacgcagaagacaggtgatttctgcatttccatctgaggtaccgggttcatctcattagggagtgccagacagtgggcgcaggtcagtgggtgcacgcaccgtgcatgagcagaagcagggtgaggcattgcctcactagggaagcacagagggtcaggaagatccctttcctagtcaaagaagggggtgacagacagcgcctggaaaattgggtcactcccaccagaatactgcgcttttccaacgggcttaaaaaaacggtgcaccaggagattatatcccacacctggctcggagggtcctatgcccatggagtcttgctgattgctagctcagcagtctgagatcaaactgcaaggcggcagccaggctgggggaggggcacctgccattgcccaggcttgcttaggtaaacaaagcagctgggaagcttgaactgggtggagcccaccacagctcaaggaggcctgcctgcctctgcaggctccacctctgggggcagggcacagacaaacaaaaagacagcagtaacctctgcagacttaaatgtccctgtctgacagctttgaagagagcagtggtcctcccagcatgcagctggagatctgagaacaggcagactgcctcctcaagtgggttgctgacccctgatccccaagtagcctaactgggaggcaccccgcagcaggggcagactgacacctcacagggccgggcactccaacagacctgcagctgagggtcctgtctgttagaaggaaaactaacaaacagaaacgacatccacaccaaaaacccatctgtacatcaccatcatcaaaaaccaaaagtagataaaaccacaaagatggggaaaaaacagagcagaaaaactggaaactctaaaaggctcgagaactacgtgaagaatgcagaagcctcaggagccgatgagatcaaatggaagaaaggaccaaatctacgtctgattggtgtacctgaaagtgacggaatgaatggaaccaagttggaaaacactctgcaggatattatgcaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggaagccagagagaaagttcagaaactctacaagccagaagagagttggggtcaatattcagcatgcttcaagaaaagaattttcaacccagaacttcatatccagccaaactaagcttcataagtgaaggagaaataaaatactttatagacaagcaaatgctgagagattttgtcaccaccaggcctgccct

SEQ ID NO: 476030 - DNA, 993 bp, Homo sapiens
accacatgaagatatctgtgaagagtctgatattgatgacagcatgagcttcaacacttgctccaccttctccacctgctccaccttctccaccaactaccagtccctggggcgcctggacagtcagcgcgtggccagcatctatgcaggtgctgggggctctggttcccagatctccctgtcccactccaccagcttacagggtggcatggggtccagaggcctgtccacagggatggccgggggtctggcaggaatgggaggcatccagaatgagaaggagaccatgcaaagcctgaacgacctcctggcctcctacctggacagaatcgacaatgcccgtcttgctgctgatgacttgagagtcaagtatgagacagagctggccatgtgccagtctgtggagagcgacatccgcctcaaggaggagctgctcttcatgaagaagaaccatgaagaggaagtaaaaggcgtacaagcccagattgccagctctgggttgactgtggaggtagatgcccccaaatctcaggacctcaccaagatcatggcagaaaactgggcccaatatggcaagctggctcggaagaaccgagaggagctggacaagtactggtctcagcagattcagaagagcaccacagtggtcaccacgcagcttgccgaggccatcttggagaacagcctgagggagatggaggcccactacaccctgcagatggagcagctcaacaggatccggccgcacctggagtcagagctggcacagacccaggcagaaggacagggccaggcccaggagtatgaggccctgcagaacatcaaggtcaagctggaggctgagatcaccacctaccaccgcctgctggaagatggtgaggacttcaatcttggtgatgccctggacagcagtaactccatgcaaaccatccaaaagaccaccacctgccagatagtggatggcaaagtggtgtctgaaaacgagcaatgaca

SEQ ID NO: 476031 - DNA, 758 bp, Homo sapiens
cctggatgagccaatgctgacggtgcaccagacggtgagcgatgtgcgaggcaacttctaccaggagaagacggtgttcctgcgctgtactgtcaactccaacccgcctgcccgcttcatctggaagcggggttccgataccctatcccacagccaggacaatggggttgacatctatgagcccctctacactcagactggagaaaccaaggcctggtacttgccagtgtgcacaagggcaacctcagacccagagaatcccatgatgaggcactgccaaggctatggagagtgtagcatccaccccaggctcaggacccctggggctaaatggctctggtgctgggtgaatgagtatgcgggatccctggagactcaagcaggcacctcaccccagtggtccactgctgcccagggggagaccaaggtcctgaagctgaagaacctgcggccccaggactatgccagctacacctgccaggtgtctgtgcgtaacgtgtgcggcatcccagacaaggggaggaccttccggctcaccaacaccacgggtacaggcattttcctccccatactccttccctacctgagctaactcccaaccaggagatagtgccccaccccacagggactccaggcacactgccactaatgtctggcccctcccctcctcttcctgctccgtcttctaccctctcatctcccctgagggcttctccagcctctatggttttcctagccccttactctgcccaacatac

SEQ ID NO: 476032 - DNA, 462 bp, Homo sapiens
aaaccagttagagcaatactggggcaatgcctgctcctccaagcaggggaccagtggaaattgagcagaatcctcgtgtcacaacgtgggcaatgacttcagaacatcacttgctggagccatattttttcaagacacatgccagtcactctgctcgtctgaacatactgcaagggtggtctctgcaggagggagaacgtgaggcgaccaccctcctatgccagtactctgctctccctggggctcttctttgcttttgccacaatgtctattttatccttccacctccgttgggactgggatctggtccttcaactcttggttcattgctgtcatcttgttacctgctgaaaactgtatatgatgctgccagcctgcctggattgccaaatatcagctccctgcttattgaacacgccctgacgcctactgcttgcattgacagttcacattagtcaagtg

SEQ ID NO: 476033 - DNA, 680 bp, Homo sapiens
cttaagtttcaatgaagtgtaaatgagaactgacttcacccttgacttttatttttctctccaaggcaaaggtactgggaacccagcctcttgccctggcgttcctctgggattgttaaggttggctaagcaatctgctcttgagaaaccaggtgtagagagacctgggtggagagatccgggggttgtttgtggaactttctcctcctctgtggcatatgccagcgtctctcaggagcaatcctgcaaggttgcctccagagctaggtggtgtcgacctgtctttgttatgcaagttgctgaactcacagtgttccagcggagtgttcctggccagcgcatgaatgaggaaatggatggtcaagagaacacattgtgtccgattggagagtatgttagcatccttgcacagctgtgctgccaaaaagataccttttcagctgccaaaaagctcctttcaggagcaaagcataatcaatagcgtctgcaagcctagttctgcatgttaaaaacaaagcacaatgttagccgcacagagcagctcatgcttctccccacacagagacaataaaggaaagaagaaaggaggaaggaagaaaggaaggagggaagggaagggaagggaagggggaaggaagggagggaaggaagaaggaaaaaaggaaggaagggagggagga

SEQ ID NO: 476034 - DNA, 811 bp, Homo sapiens
tgacagcagctctgctgccgaagcgtcctttgtctagaatggccatgcttctgttgatggatataattaggaggtcaaagccaataccagtaactgaagacaaaccgtttttaaatcatccttcagttttcctactggaccttgaaagatgggtgacatttgactcggtgaagggactagcagaggatatttcagacaaaggagagataggtaccaaagcacagagggaaggacagagcggaatgtggggagctggttctgatgccagcccagtggaggaggagaggccgagggtccaggcagagagaacagcaagtatagaggcgctgtggggattcctgagaccagggcggctggaatggggtgaggcaggaggaggggcaggagaagaaacaggacagacagtaagtgactctgctgtgtcaggtcttgcaggaaatgacaatcattgcaggtttcattctgaggccaacgggcagctcttggaacattttgaagcaggagagggttacctggaaacagactctgagctggcaatgcacaggcagaagccctgttctcccaccagcagaagaacaagagagaagcagggctgggaagagggagaacgtggggtatctcaacacagacccccaactgatcccgccaaagctgtggggttgggaggacccttcagagtttcctccagttgaggcaagagggctggaccttataaaccagcatcaaccagttgctgtctcccaagaggggttatagacttgggctaggcagctccctgtgggagcggatgcctggagagcgacacagctgt

SEQ ID NO: 476035 - DNA, 744 bp, Homo sapiens
agggctgcagtagcgagacgcaaggggacaaataaggttcagtgccatttggcccttgatcaagtgtaaacaatgattttcatgtggaagggctggagcttgggctgcatctgccgtgcacttcattcgctagggctacagtggtcaccagagatttttcttctatcacaggtgattctacccaagaatgattcgaggaaaggggaggtgtgggcaggaaaccaattggggactttcaaagtttatattctgaatgcaacaattacaacaatgttccagaacagaaattgcattctggaatgcaccagttgggaagtgggctggggatacattgatgaacaaggcaccattgtagccttccaacagcttccaggcttgtgggaaagacccacaggtactcaggggaacactggtagggaaactggagtgattttgaacactaaggaagccatcagagaagggaaaaaatattatgtagttggaatcacccaactcgtggccttttcagattgacttctttcacttgtgcatgtacattaaggattgttatgtcttctctgagtattgacttctcaattatcattatcattacataatgtccctctttattcctgataactttctttgcgctgaaatctgttctgttgaaattaatataactactctcactttccctggattagtgttggaatggtaaatctttcttcatccctttacttctaatctacttatgtatttatgttt

SEQ ID NO: 476036 - DNA, 881 bp, Homo sapiens
gtgccacattttcttaatccagtctatcattgatggacatttggatgacgtctgatttcccggagtgccacagtaccggacctgggacgatgaggttccttcacccctccggtagagggcgcactctgcgagcggcttttgcagccagtggcttcctgggcgctttacatcggtggccttgtgggcagtccgctttgtgggagagcaggtctgttaggctctgaaaagcacccgacagctgcccccacatccgccttgcgctgtgggtcagtgtctgtttgaaggagtcactgagtgggcaagccattgttagaaatgcctctccgtgctcaaacagcaacagctgctcctgggcacatcctgggcaccttgcagagcagatgttctctgcttttgcagctcctgggccccgcggctgttctgcaagaaggaactgtggtagtccctgctgaaggcagctgccctaaaagagaaaactgtgaaagaagaagaggaagccacaaaggagagtcagaggagcagcagaacaggcagaagaaccagggattccagggttggaagtttaaagtgagggtcatcagtggtgccaagcattttcacccacaggcaaatattttggcaaccaggagtcacggccgactttcaggagatacaaaccactgccagccccaacacgtgcatcagagaagcagaaccaccgtgagtgatgtgcatttgggatcatctcttatggcaattgggctgtatgcaatcatggaagctgatgaagacatcttggaaggctgtagcctctgtgttcgatagcagggggtctattctaagtcagcaggaccagaaattaagaaaagcaagacatgaatgaagcacaggaaattgaggac

SEQ ID NO: 476037 - DNA, 917 bp, Homo sapiens
tgacatccaggagcccaggcattgattgttgacttcccctgacaccccatcacaacccattagtactgaaaactgacaagcccagctgcagcagcaaaatggcaagtttgaaagaaaatatcgaaagcacaggcaaagcccagctcttagggacccgcacgagacccaaatgcagtgactcctccccgcccccacgacaccttcgcggagatggctgctctggcagaggaggggcccacagagaaatcccagtgctcctaggcttcagggccttcccctggaccttgctccatctgccagggtacaggctgggccccagtcggagagagctcctcagtgacaaccatgcaacctgcagacatgcagatacacattatagaatggcttgcctggtgcatgttccagcacccatcccgagtcagcacttaaacctggaagttgtggcttcagctctgcctttggctctgaaccaacccttttcttcatctgcaggagcctctgagaggacctggccctgcactgtcctcggtgcttctaaaatgacagccttgtgcttctccgtcctgtccccagcatctgcaggactcagccccgctgacaccacccgagtgcctactcgactccctcggatcacttgttctcccctgaccaagagcagccctttgagtttgggctgggtctggatctttggcagaagatttgacagctccaacagcttcctggttttggttcatctttggactcttggccctgtgtgccaagtcctcattcggccatcccgggacttggtttcatgctccgagcccagccctgtgtccacctgcagatgaccagttcagatcgtccgcgttctagcccatttgggccactcttgcatccaatctttctggaaagcattctttggcattatttggttg

SEQ ID NO: 476038 - DNA, 569 bp, Homo sapiens
tgcctcagatggagcagtcaagggcgggacctggtgggaggtgattggatcatgggggcagtttcccccatgctgagtgataagacactctttccttctggccttgaagaagaaagtggctatgagttctacagctgcgaggaaattaatcctggggagcttgaaagcgaattttccccgcgatcatctgagcgttctgcttggcacatagtcaacaacaataaatgtttatcgaatattagcaaattcagggcctctctgagttggtaccaccttacattaattggcactaatgcaagtattcacagctgtgcgtgggatgcttctgagtgcaaaatggatctgtctgtgcctgggaacggttctttcacttcagaaaaagtctgtttatatgctcttgtccctcttctctccctgtcccaggagttctacactctcacctgttattcaatgctagttagccttgtagtagtgggataatgggggggaatattctctgttgttatttaatagaagggaaatcactcttcctttatatttctcatttattgatacaagtgttcctgctt

SEQ ID NO: 476039 - DNA, 467 bp, Homo sapiens
ccttctcaggtccttccttccagttttatgatcaaggggacggtggtggcagctgatgaagccagaagggacagcagacatcaggcaatgcaaggtagttctgtggtggtgtgggtttcacctgacgtgcagtggagtccacagagtgttaataagcagtgcggtgatgtgaacccatgtggagaagggccaatcgggatgcttgtggagggtggaccagggcagcaagatagacatgaaagccagtcaggaggctacaccatcactgggtggaggtggctgatctcagttgaggttgagtgggtgccagtgtggaaagagtgtgggagtcagcgccaggatgatcagctcatccggtctgcccaggaatgttctggttttaaacctaaaagtctgtgccctgggaaaccctttagtctcagccaaattgggacagttggtgactctaggcttgggacaaattagac

SEQ ID NO: 476040 - DNA, 702 bp, Homo sapiens
ttttggaccaattttgaaaatgctgtagggataaacattctcagatgtgctgaacttgggatgatgtgtggatactttaagaggagcaaaaccaaacaaaacaaaatagcggccttttactcagacagtgttccagtcagagatgggcgtgctgtgtatgagggtgaagttcgtggcgaggtttgcacttgtgatgttgtgcaagacagcctgggtccatccagctgctcccatgaggctgatgggcgctggaggacagggaccatgcgtccctctgcttctgctaaagctcattactgggcagtgctctgcatggtgacagtggacctgcttcaccgtggctacttctatggcaaatcaccactggctcacatttctttattcaaattcacaacgctaccggtgtctgccatttcatttttcttaaattcttcagaattagcagcatcttctttcccttctgcctctggtcctggtcgttcgattcattgattcattaataagcatttgttctacacaaagcgtggccaaggtattatggacaagaagctgtttggttttaaccaagaggtataattaaaaaagagactgtttcaggtatttaccagcggacctgcctgggctgtgaacaggagactcatgaaacatttgtgctgtgctcagaagggctattcaactggaaattcccttcactgttcaact

SEQ ID NO: 476041 - DNA, 851 bp, Homo sapiens
ttgatacaccggggcctcgtgtctgtggcacctcgtcaatggattttccgtcaagtatcaaggactgcaacaaggggatgcctgtgcacgtctgtgtctgatgtatatggacagcagtctactgcccagacacctctgctctacacagggcaattgctctcctccattttattcctgctcttaggagcatgaagggagaatcaactcttggcctcatctagcgtctgtggcggctgacatgccttggcttggggctgcagccctcccatcggtgctccatggtcacacggcctccacgtcttctgtctctggaggagcatgcttttgaccaactccatgaacggttgctcacggtgacccagattttagggtacaggggcatttctcagataaatgcctatgagaattcagagcacctggtcaagggaggagacacagccctaccagcggtcagccatggagagatggttgagggcggcgtggaggggggtgggtgttgtcagttgttgagcacctgtggatggtggcgacctgggacagcttcagcaggaaagagggggtattctgagcaggtgacatttcctgtggtcagggaactgcacagtctgaggcacaaggatggatacaaaggcacagaaatgagcagcctggctgactgtagcccagcaaaggtggctgtgtggcagtgatacagtttttgggcatttcagtgaccatcagtttcccaacttggctattgttcctcccaatcagaaagtgttctgtggctggtttgtcattgcaggccgtggctgctcagaaaatagaaatataaatcggcatctttatttagcctttttccagtggggtag

SEQ ID NO: 476042 - DNA, 1073 bp, Homo sapiens
tcactcaggatgctagttatagcgagtgaaggtgagcacagtcagatgccttcctggggtggaggtggttctaagagcctggggtcggggataggcagcccggtcacaatcctggctctggaagtatggtgctggcatctgcttctggtgaggccacaggaaacttacaatcatggcggaagcaaatgcaacatctattcaaagggtcagaccaacatctctagaggagtcacagcacaggtctatcagagaagggtgccagattccagggacttctctccccaaaattcaagttcagtaggtctggggtgggagcctggaatctgcattttcagcaggtactcagatgcttctgatagagttagcatgtgctcagagccaccttcagaaccactggcctggaagactccatttctgggcagtgaatgggcccatctgtctccctgctggataaagcttgcccgggaaggtaccttaagtcccatatttcaccctccagagagatggcagaagaagctggaggcttctttaacctgtaactcttttctggagaatctgcagaatgggataggtaaataccaggtgacggcaacctttgtgaggggccttgatgcggagttcgggctgaaggagaaatgaaagaggggttaaaagaacatccagcaaagttatgaagaaaagtattataggagtatgctagttatttagttaataaaaacattaatggtgctgttggatttttatgatctgtgttgaatttatcagcttaaattgtgtatataatttgttgagatttcttttctcaataatgtataaaatatacttctacaacaattctatatttataattttgtactctttttcttcaagaggggccctaagattgtaatatcttccagtccactaaggctagatcctttgatagctcttggcttctttatcttaagatctggctgctctttgtggcatccaactaattcttttttatcatattcaagccattttaatatccagtgataaaatgaatattatttgaatatgctgctgactcacagataaatgatggtgttatc

SEQ ID NO: 476043 - DNA, 690 bp, Homo sapiens
gtaccaaagccaccaggctttacctcttaaagatgatctacactgtacttctagcaatttgccaattacagttcaagttctcctacctggttcccgcagggtttctgctaggaggattctgctctgaatggctattgctgactcctggaatgctgtttggaaaagactacggagagagtgattcttcatcagtgattaagcatcttttcatgagagaatttggaagtccacctcatcttttgctagggaggcgagggtcagcacagacaagcatctctcgtttccactcagctcgtgctctgacacaggctctccctcagtgccacaccctatgtctccccgtctctgagcaggcctatgtaggaaggtgcaaagataagttaacaaaggatggtagccctggtcagaggccttcagttaaaccttcttcctgcaggtctctgcacagagtgagaagcaacttgactgggccacacatacagaagagaggaagggagggtggaaaggggtcccatgtagggagaagactataaccatgtgatatgtcttcagaacactggctacccatgtgcttcattgttgagagagctcttggagagctgactgcatggtactgaaatgacctgcttagggaatacatctgttaagtccagtccagggaatacacctgttccctggactggactgtca

SEQ ID NO: 476044 - DNA, 1317 bp, Homo sapiens
cccagagcagtgggaggtgactttgaaagacggcacagacagcctagggaccctggcagaaatgtggcatatgggtggagccgctgcagagagtccacactagggcaatgcctagtaaagccatgggagtggagccatccccaagaccccagaactgtaaagccaccagtgtgcaatgccagcctgagagagatgcaggcatgagactccggtctgtgacagctgctgagtgggctgagcaaaatcataaagaacatatatgtggaatcagcacacaaaactggcaagagcactggttccgctgcagaaattacacacaagaggagctctttctgtgtgctttcatgcatcagtctagagccagttcttcctcattcacattgaaacgtcagagatcaataagcactggaggagagttttcccctatcaacagaaagacaggactgactcacccaggagaacaattgttcttgttcccctccctggtatctcattattcactacaggaaagaagaccaaaaatgtaagcatacttgaacatacatttttcaagataatgagtgtctcaaatgattatttaaattccaaagagaactatttacaagttaatttctgttccagttattttccttagtaatcatttattgcacatcaatagaattcctcttcccaccctcccatagcctgttctgccaggatccaagccttcattctttctgtaacctcaagatgaagaaaatctgtagtcggtgttgagcacaccttttgcattttcatattttcaaagatcacaaccagactgcctgaaaatgattgtttcatacatcttgttcagttttgtagaattttttaaatgtagatccagtatttcctgtaagctttgcactctaattgcatttagaaaattaagctaaaaacattgtaactgagtaatttctgatgtcagattgacaaaactgtaaaggcttatggcttatggtacacagttctacacatccaacagcctgattgggttcattgcctaagtcaccctagtttcttccaaaatcattaaaaaataccaagcaaccctgcaatataactgaagctttaaagagaggaagccgtcctcaattcagaagcaataaaaggtcagtcagcttcatggctgtctgctttacaatttttttagtgactgaaaaatatcggctttctctctttttgtcttcctttttcttgcatacatgccatacatagccttagatgctacaatctcagcaaataggtttttatctaaatccatattttttcagtgtttataggaaggtagaaatgaaa

SEQ ID NO: 476045 - DNA, 654 bp, Homo sapiens
tgagaaatgtttctttttttccttacccagacttaggtattctattatagtagcacaaatagactgagacaaatgcttcaatagtaattttgatgaattgctggcatgaaagtgagacactcctggggctgcagttttgggtgggaggctttcacaaattcttcacaagcttcaccagatggacaggagggagacaggacaagctcagcttgctcatggccagagaaagagctaagctgctggccctggaggcaggggagagttggccatgcagcttcaggtatgggaatggcaggagccaagataatagccgagataaagaagcacaaggaaagagcaccactcactgtgttggtcaaggaaggcctctagagcccaatgtgtcctgggaactagaatcagttcaccagatttcaggtgcctcaaactcaacaggaagaataattattccctgggctatgcccctaaaaacaaatcctagtgaaaaaacaaataaggacatgtactagataaggtcaccaagggattaaaggaaggtggaggagggaaggtgtcagaaggagagctctgggtctccgacacttaggaatgggaaaggaagaaccgagctgtccacgaatgacttctgcatgggcagcactgtatgtgtagagc

SEQ ID NO: 476046 - DNA, 1298 bp, Homo sapiens
agattatgtcccatctaagttgaagtcatatgggcatgtgcctcctatgtcacagacaaaagtcataaagtctgagaggaaagtgatccaaaccgaatacgtaaaattgattgacgaagacgactttccagtgaagtggaaaagtctcataaaaatccagaagtggaatacaaggaacaaggtgactctgagagctgctaggactgagcagagagccctggaaggcttctgtactagcgggacagcagcagcatctgcagaaggagaaggagtcccgagagcttgtgcactggccacgtgtagagaaagaatctgccaagtgccggaaggggagagaagaagggaggagtctgaggaggagcaaggtggcccggccttttgtcttctgtggcccgtaagagccagaacaggagcaactgcagcatctggaacagagatggtcaaacaatgacttgtgtacttttaattattccattttaacgccattattagctactgtatttgcctgttctgacaatgctataaagatactacacaagacaaggctgtctcttcactcttactgtttcctttgctttgcagaagctttttagtttaatgtaatgtttgtctatttttgcttttgttacctgtgcttttgaggttttatcccaaaactctcatccagttcaattttataaagtatttccccaatgttttcttctagtattttcacagtttcaggtcttatatttaagtgtttaattcgtttaaagttgatttttatatagagagataagtaactagtttaattgttctgcatttggctatttgattttcccagtatcatttattcaagagaatatcctttccctgaaatctgttcttggcacctttgtttaaaatcaaacaaaaatgtaaatgcatggattaatttctgggttttttattcttttctattgctctatgtgtctttttaaggtcaataccatgctgatttggttactatagctgtttagtatattttgaagtcaggtagtgtgatattttcagctttgctctttttgctcaaaattactttggttatctaaggtcttttgtatctccatatgaattttaagattattgtctctctttttgtaaagaaagtcattgatattttgataggaattgcattgaatctctagatctctttgggtgacatggacatttttacaatatacctccttcaatccacaaacatgaggtatctttgtttatttgtgtcttcttcaattttgtttatcaatgttttatagtttttattgcagagatctttc

SEQ ID NO: 476047 - DNA, 999 bp, Homo sapiens
agtgttgctgagcacacagccgctacaataattgctgctgctgatgcctgctgacgttaccatgaaggctgctgccacccaaagcttttcatcactctaaatgtagtctgttccacagaaactggacagaatgatagcactgggctccactcaggaacacatctcctaagatattgacgagcaagctgtgccgcagtggggtgagggttggaagagggaaggctccagagcccgggcttcattctctcacgcgaagaaacaacagggagaggacactcttggaaactctccagctccctcactcttctctaagaaagagagttgctttatctcgttgacaaatttggaagcaaatactgggcatgagcagctcagctcctgcccatacaggactcaagctctggtgtattctccacatgccaaagctcaatggcacactctgtccctgcagcgggagcctatggcattgcctgtgattgggggtgaggttatctattctgagattcaagatggaagcctccattgcccctcctaagccatgctttccagcactgtaataaaactggatttttttccctctatctcctttattccaccttatcacttggaactaatggatgaaagaggtagtgaaagaccaattcagtatgcaaaactgcttcaaataaacattaaagacttaccagaccaaatggccatatgggaacacttggcaacaaatgaagactatgatataattagcagaattgaacccaactttgttaaccctcagatgcagattgaaccaaggaagccctcaggcacaaatgaagtacagaacagccacagcaaaatagttcttccctccgcacacaaggaggccaaaatcagatgtatgagtctagggacagaaggggatggttggaatgccactggcaaggtaaaagtaaaagatagaaagtatgtgtttgagaggagaaaagaacagttgtagaggtgtcccacaggggaaacactaat

SEQ ID NO: 476048 - DNA, 850 bp, Homo sapiens
cagcacgcaatgaagggtgatgtcaatgctgacagtccacagacactttgtgtagaaaggccatggagacaggagaaataaaagaatccagaagtataaaacataaaatgggagagaaagacaatccaggaaaaccaacatgtgcaactaactggattctcaagaagagaaaacaaaaaacttggagacaatattgccaaagaaacaataggaaaaaatgtcctagaattggaaagggattcaagtcttcagattcaaagggttcattgagtgctgagcaagatgaatgtaaaaaagacccattcctagacacattcacgtgcagcttcagagccacagaaagtcttgcattccaggaaactcagcccaaggcagaccaagatggtcgctcatcttccttccaggtcatacccctgtacaccacatgtgagggcaagctcaccatggggaggaaagaggggatgttcaagggccacagataattcttaaattacttttaatattatctaatctcattttgagaataatctttagtattttctttgttttataataaacttgaagtttatatttttatgtatttcagcttgttgcagttcttacaacttattattgagcccttaagtctatcttgtctggacatgtagcagaaaacaactttacgacttagtaaagtatgaggaagggcctacttttgataggaaagtgtagcaaaaagacttaatgacctctcctttgtcatggatcattgatagccttatattattacttgcctgtttcctctgtattcctcctcattaagataatatattcctcaggtatggggactatatttatatttattctgttt

SEQ ID NO: 476049 - DNA, 589 bp, Homo sapiens
ccattactacttttgtttaataaaatgactttctaccagaccttactcttgttaattggattttgcgagtgggaagcaaccagacttgcatttggttacattgcaagtggccttataagaaaggcagaggaagatttggcacagacacaaagaagagaaggtgatgtgaaaatgggacagaaagagatttctagaaatactgatcttgaatattggagtgaagcagccacaagccaaggaatgccagaccctgtcagaacatggaagatgcaaggaatggatgctcttgtgcagaaccttaagcctctttctactccaactggtgtctctttatcaggcagctacaaaatcaaacagttgctgctgactgtttttaacaagtgccttggaggaaaaagggagctttccacctacaaaaaggaggagattcaacattaagattaagtaatactggctgcaaaaataaacatcaaaaaaaacctttccacttttccaccttgaatgtttattcttatcagcgctcatttgggagcaacttataatgtaccaggtattggggatataatgatacataagacagtttcagtaa

SEQ ID NO: 476050 - DNA, 1441 bp, Homo sapiens
atattgccctgggtattgggatttcaagtttaggactttcttccagcatgcggatagcaacctgcagctggagtgcatcagtgtgtactgcaatgagaccacaggtggcaagtatgtgccccacgctgagctcatggatctggagcccagcaccggggactctggtgtgctcaggctccttcgtgcagatcttacggctggacaacttcatcttccatcagagtggtgccggaaacaactgggccaatgggcactacgcagaaggtgcggagctggtggattcggtactggacattgtgaggagggaggctgagagctgtgactgcctgcaggatttccagctgacccactccctaggagcagggactgggcctaagaggggtacccctctcatcagcaagatcccagagaagtatccagacaggatcttgaacaagttcagtgtgcccttacgcaaggtgtcagacatgggggtggagccctaaaacatcaccttctcagtccaccaactggtagaaaacacagatatgacctattgcattgataatgaaactctccataacatttttctcagaatatagtgagctctcaccaacatgaaagacttgcacatttgtagagtgctattatgtttattaatgtattttcacatatactgttaaaatacaatttcatatgttaatataattatgattataattattatacattctatttttaaaaacttagaaacaaaaagtattccagagaaaattgaccataatcacatcaagcactgaccgtcacactttctgcatttcttgctattcttctatgcataatttatatcattttgtaaatgtctttactgtgtttgcacaagtaacctggttctagggggataaaaatggctctgctatggtgtaaataggcatagatggcaagtaaattcttgctattaatagttagattatgaatgtttgtacatgactaacattattataagttagaatggatgaactgtactttcatcagcttgaattctaatgtgctttctgagcagtagtgacaggaaggatggagttgaaatgggcatggtggatttggacacagccccaggcacagctgtggaatgtgctgtgtgtgaatgttccgtggggagtatcacctcagagaggagctgaaatacctgctgtactacatcttctcctttttgtctttctaagggtaaatacaaattaaaaataagaggcttaactttacctttttaaaataatggaagggactccttgctacccccccatccttttatttcagcttttgttttagaaaactttgtgaaaattgtaatttctgtttctgaccctttgagatttatgaaattctttctaaaacgatttctttaaaatatgccttttgccagttttaccacaaaggagtatttctctcagggaacatttct

SEQ ID NO: 476051 - DNA, 1709 bp, Homo sapiens
ggtcctacagactgacacttcatcaacaccacctagaaatctgctgccccaggtgattgttgtcattcaaacaagttcagccaaggttatcactacatgtgtagatgtggagaaacacttgacggcttgactcgcaagcctggagagacacttgcacgtagtcattgcattttctcagatgacagctggagagcctctcctgcgcagctgctccctctgtcgcagccaatccagctggcaggggacagcacggccctttcctccatcaagtgcagcacaggggctgtctttcctgtggcctctcataagaggcagtctcctacgacaagaggacccccagtgctaagatcatgtgggatggactctagagccttgagcctgagggcaagtcccaagaggacagctggagcatgtcctgttcacattaagggcaaatgtgaagacttcttaaggatagaagaatgcaaaacaaataatgataatgaagtcataattgagaggatcaaaaaggtacaagaatcttttaaagaaaaatcagttcaacaaacttttgacaaaattgatcagaataacaagaaaacagtcagaaatactttgttaagaaatgattaagggggcacaatttagctacagtgcatattaaaaagataacatagaatatcataataacttggtttactgaaatctgaaaacttaggatgagtgaacatatttgtagaaaaattactatccaaactgaattcagaataaatagaaaggtgaatcatcttatatcattaaagaagctaaattattagtaacaatctttacatttacacaaacccatactcatatgaataagatgaaaacaacacatggcaaggacaattttatagataagttactccaaactttcaaagaatagtattgtcataattttgactggctttggttgaaggaggtgataaagctctatgcaaactaaaatgctctagtttggagattttcatgtctttctaataaagccactgattgagtgctgaaccctgtgaattcaactgtccaagctaggaaaaaaattcttttctaatgacatgaattcccaaagcaatctcatccaatttcatggctttaaatatctgaaatcttaaaacctttaactatttgtgcaaaggctttccaagtttatatcaccaactgagctgctcttcagagttttggacttgtgcatctgaaagacttcatgacatctttgatgttaatattttatatattaatatttttacactctgcttcctcctactagaatgtaaatctaatgagagtaaaaaatttgtccatttgttatattatcttgaaaggatgcatctgcggattttattcatcattccatttatcataaggttcagagacaagtattgcattaagtatatttggtacagagggagttgcagattcttagaactggtttgcaatgcctctcagaggcagtaactgggtaaaaactgagtacaagaactgtgacctgaaatgattaatcatgtcatgtcaggatttaacatcaacatgattttggtagctaaagaaattttattctgaaataacacaggtcttcataaagtgagacatgtaaatagtacaaaacaagttatattttgtatagatcatgaaatagaaagtatagcttgtatggtttgatttctagtaatgagtcacattgctcatgaaac

SEQ ID NO: 476052 - DNA, 1919 bp, Homo sapiens
tctggtcgggaattgatccagggtacatgtgcacaatgtgcagaatccatgttagatactggggatacgaagagaaatcaaacaggatcccatccccagaaaggagacagacaaagaaactgatggttgaaacggcaaatgtggagagttgttcagggtgccataggagcacatataggacagaagccagagctgtgaagactatacttggaggatccaactactcccacaatagccaggaggcaaaacagggaaagcagaggaagaaggggccatatcgggcttgtagctggtggtctagacactacgaacgtgtctctagatatcatcatggccacctatccagatgcctcaatccagagactctaagccgaagacataagctcacagtcaaatcaaacattggagaccccaaaacacaaatccgtggagcttcagaatctaaaagagaacttgccgtgatccccagtcgctatgagagggaaatggccacaatggtttccttgggaatagctcttgagtacggccataccaccatgaatgtggctgatcttgtctgatctcggaagctaagcagggtcgggcctggttagtacttggatgggaggaatacgtcttaaattttataaacaggactcagacatctatttttatgcttatttttaaatgtcttgataaaatgttatactactattacattcttgggaaaaatctcacttggtttttttttgtgttatacttttaatcaccagattttgtttgctaaaatgttatttagaattttgcatgtatttttcattggcctgtgattttttctttttatataacatctttttaaaggtctttattaatattacactcaagtgttcttctgttttctatgcgctgaatccaagcagttaaaatccatgggaaatatttttccttgatattttctaagaactattcatgtaatattatattgactgctcactcagcccctttccctaaagcctggtaacacaattaactcatgattccccgataaatgctattttctcattcctccatttttatctatatgtaaggctcttggctttgaatttggtttctatctctttgtttggttaagttcatcttggtaaaacagtaacactctcagcatttgttctcagttctgtgagttagagttgataaactttctcagtaggacagacacatattttgctcaatgtgtgttctccataaatgcagatgaggaaggagggataattagaggaaacagaatgagaatctcaaccatttgagcccttacacaattctatgataaactacaatttgtatattttctgagtcatgtgaatttgtcataaaatctattacttcttaattcacaaaagttccttgttttatttaataataaaggaggaagtttaaaatacccatttttatagagtcatgtgtatgtggtgtataagtctttataggaagcatgaacaaaatataatacaacagttttgatatctggggatttgtaatataagtgactttttaatttatagaaatgtaacaaatttgtaaacaaacaaaagtcatttcagaacaagcttaaaaatctagtgatcctattaatttactgaaagaaactagtaccattcatctgcaagacttatatagataacatgtgttcattttcttggttaaatacttaaatatggacttgtgaggtttcattagaaactatcaaattatattccaaagtagttgtagcatttttcactcccttcagcaacatttctccccacttagtattgttatgatactggcaggctgggggaggttcctgaatgccaatgggaccttgagcccagggtcgtacgggctcttgacaccgtcatgagaatgaattcaagggcgagtcaggaaatagtgaaagtact

SEQ ID NO: 476053 - DNA, 772 bp, Homo sapiens
attccaagtgaagatgctgctgacctttcacaaatctcctataggtgtttggtacccgcatcagctaactttatggctcaaaccaataggacaatttgtggaggtatttgaacaccttctccagcgaatccctgatctctcaaaatttggatgtgagacttcacaacctactaaaaatgagcttttgggacctacctatctaggaataaaccatcctcgccgtaagagatcaggtggaaacctgagaccagagtgtcaggcttctgagcccaagctaagccatcatatcccctgtgacctgcacatacacatccagatggcacatggaaaacagagagaaaacaattccatgtggaagctttccaaacgttcggggcctaatgactaagacattatgagagagaatcactctgtcggtttacactttctcagcagtgcaggacaattgtccattccccagctttctgagaattttcagatttgtcagattttttgtcatgtgcttttagtatgccctgcatttcccctgtctggaaattacctattcataacaatgaagttttctaattgaagagtaggatgattctctacttttaatattcagaagctgtgctagtaccctaattggacaataaattatatagtcagcttatatactaccaaattctttgtagtttggttttgtaacttttctttttactcattttcctttttttcttcctacaacttttgtttactttcttgttttactataaatacatattctttttta

SEQ ID NO: 476054 - DNA, 611 bp, Homo sapiens
gacataagcatgttttgaattaggcttaagttagtagctggctatggaatcatcgggccttaagattgaggaaaataacattggactttgtctcatttccacaactttccaaaagaccaacgcagcttttgtggcacactggattttgagcccacaaaacgctggagtaaatcatgagaaagaagcacaagtagccccaggtaaagacgttatcactccctatttacagtcacttgttcattcagctaaagatggggttctttgtcccacagccatgaaaattaaggctcacagacaatttgaatggattgataaccctgaaggaggagctccatgggagctggaggagctggggacctggctgcagctctcatcaaaagatgtatggatgaattatggcaatatgcatgagccccaccagggcctggcaacccacaccaattttccccgtgtaaagccactgctgctttacctttaccctccaaatctcatgcagaatttctctttagtcggtctctgaccctggttcctgacccacagctcctaagatctttgtgatttcctgagtgttagcagcatctaacacagagctccgaaatacttcaaaattt

SEQ ID NO: 476055 - DNA, 641 bp, Homo sapiens
ttctcagtccatgtcctgtttccagggaagaaacctttattccagtgcttcagccaatgccaatgagaatcgtcttatgttcatctccctgaaccaactaaaattaggggtttatatagtaaggaaggcaggaaaacaggaattaaggaggggtaaggaagaaatcatgatggatgaggagtctggtgtctcattgcctgtatacagctatctgataactttcagctccttgcctgagagaggaattcaggttaatccagatatcctacagacattaaagttatcatatatccaaaattccagattacttttatcgccttttatcacaaagtgccctaaactgaaagctttcagttgttttctaattgccacgacaactaccatcaccatcagcatcactgtcagaaatgtaatatctacctattattgaatgttcactgtaatccagggatcattaaatgatttgggaacattatcttatttaatcatcccaaacactccatgtaacaataaaagaaaatgagggaaggcaacacttttttatcttcatttttattctcttaagatactgcttagtttaaagggtacatatgcatgtttgttatttagatctacttacatgtttaccaatatttacctat

SEQ ID NO: 476056 - DNA, 886 bp, Homo sapiens
ctgtcaaaatatgagtaataaacgactggcaatcagaaagcaagcatattatgaaagcatatatcttatttactggtttgatggtttaggcttcaggccagtaggggaggtgtccctgggtaggaatcagttttggctaaagcaggcacaccaaggctgtctgactgttggattagagctgaagactttccctactgtgcccagcattgcaactgtgcctgtgttgaaagaaacgtcccacaagcagacagggcaagctgcagaccctttgggtgtcgaggaatgggagcagttctcaggccactgggttgatgttccagaggggactgttgctgcctctgttccactctgcttcatgcaggaagtgaaccccacacaggcagcagtaagccctacacagatcccacatacctgcctgcgctgcactaagtgctgggacactggggttgttcacctaactcccactctcagactgtgaataacttcattggaagagcttaatttactcatattaatatctgtcataatgaagcaatgtatttcatagtttacgtacttattattttttgtacaaatgaatcacatggaccaaaggactagccattatattgctgaatagaccatcatgaggatttttatctgtacttatctattctgtgattgttttttcaaatgtaaattgaagtgttctgcatttctaatgatttatgcttgttctttactcctttcacatttggacaacttccacatagaagtctcccttttttcctttcttttttcattcatttaaaggcctgtattgctttctcttgccaaattctgcaaagaacttgcaaagatgagtaaaacatcatcgatgtcttcagtgagctctcgtaaaagttac

SEQ ID NO: 476057 - DNA, 595 bp, Homo sapiens
acagcagcatcttgatgaccatatgatacagctggcatttgtaatttctgttaccacagttatagtctccgtgagtctaaagatcttggttctcagaatggtagtgctttccactagaggatacagtagagtcctattacagtttaagctagttctttcatatggttattttggtcttctcatgtcaaggggccggcaatcaagtgaaggagtcaccatttcagtgggtggtcagctcagatcagcaggaggaggcagggctgctgctgtacaatggggatggggtggaaagtgcttgagctcaggtgacctactaaaacatctcttggtgctctgttgtccagttttaatgttaaacggaaagaaaatgagtaaatacatggcgcccgtcctgaaaactcatcacctcactcatgaaagaaaaactcctagcctcaagcatacatacctaggtgtagtcaccacaattggcaaccaagcatgagtgtctcataattataatgacagaagcatttactgactcattaatatttatgatggtatatagtcagtgttaatttaagaaatgattacttgaagttacttcaagcaacaa

SEQ ID NO: 476058 - DNA, 900 bp, Homo sapiens
aggctctgcaacaggtccaggctgctatgcaagttgctctgccacttgggccatatgactcagcagattcaatggtgcttgaggtgtcagtggcagatagggatactgtttggagcctttggcaggcccctataggtgaatcacagcagagacctctaggagttttaagcaaggctctgccatcttctgcaggcaactactctccttttgagagacagctcttggcctgttaccaggctttggtggaaactgaacatttgactatgggtcatcaagtcaccatggaacctgagctgcctatcataaccaatctagccataaagtgggtcatgcacagcagcattctatcatcaaatggaagtggtgtatacatgatcaggctcgagcaggtcctgaaggcacaaggagtgaagcaagctgtccctgatgtgccctatccaatttcctgacggaatcctgtgtatgtgtctttatgagttgagttccttgtaagcagcatgtaactaatggggttatgtttgtatatccattcagctcttctacatcttttaagtggaaagtttaatttgtttatattcaaggttgttattgataggcactgaaaatttgaatatttggtcactttgtgatgcctcatatgtaccattggttttgttcattctgctttattatttaaaaattattgttctgattgggttattgcataagatctgtctcaagctttaaagttctttattccacttgatctagtgcattattgaaaacttatgaacatattttatatttcattcaatgaatactttagctcccgaatttatgtttggttcttttttatgatatctattcggtacattgctcatttgtatactgattttttaaaaatgtctttttatcattttt

SEQ ID NO: 476059 - DNA, 991 bp, Homo sapiens
taatctttgccagaaatctgaagaatgaggattctcatctttttcctctccttccctaaaatgcctttgttttatgcagttttaaccacagtggaaaagccagtaagtgttctagggaacattgttatacagcctttgtcctacattgtctcccactacacccgcgtttctgtgccacttctggagacctgcatctcccctgctgccaatcagggcccagcaccaccccacagcctcaccgctgatgatcagcacgcccctccagggcccatccagcctttttcctgtgggatctattatttaaaaggaccctttcatcttctcatctactctattaaaacttccattttctggaagaagaagaaggagaaggagaaggaagaagaagaagaagaagaagaagaagaggaagaagaagaagaagaagaagaagaagaagaagaagaagaagaagaagaagaagaagaggaagaggaagaggaagaggaagaggagaaggaagaagaagaagaagaagaagaagaggaagaggaagaggaagaggaagaccatttgcacctagctgttttctcctattaattactgtttctgaaaagtgccttggcagaaaatgtttttgatctttatcaacttggcacagtgttaatctccaaatcacaggaatttctacacaatataaacatcttgagaaaagaatgcagagattaaagaaaaaaattctataatggacaacactacatacacggatgttaaatacagatattatcacttggaataattctgttgcagttagagatttggatactgatttacatatggatggacaagggattgagggatagagaaaagagggggaattctagatgtatctgaagagttcatctattgctatggaaacagatacatcctagcaacagctgcttgattcagtgaattgaggcaaataggctttttgaacttgaagaccttccttggtgaccaaatgtgggct

SEQ ID NO: 476060 - DNA, 1508 bp, Homo sapiens
aaccaccactcaaggaaggatagaggtaccgggttcatctcactagggagtgccagacagcaggtgcaggacagtgggtgcagcgcatcatgcgcgagccgaagcagggcgaggcattgcctcactcgggaagcgcaaggggtcagagagttccctttcctagtcaaagaaaggggtgacagacggcacctggaaagtctgattactcccaccctaatactgcgcttttccgacgggcttaaaaaacggggcaccaggagattatatctcgcacctggctccaagggtcctacgcccacggagtctcgctgattgctagcacagcggtctgagatcaaactgcaaggcggcagccaggctgggggaggggcgcccgccattgcccaggcttgcttaggtaaacaaagcagccggggaagctcgaactgggtggagcccaccacagctcaaggaggcctgcctgcctccgtaggctccacctctggcggcagggcacagacaaacaaaaagacagcagtaacttcggcagacttaaatgttcctgtctgacagctttgaagagagcagtggttctcccagcacgcagctggagatctgagaacgggcagactgcctcctcaagtgggtccctgacccctgacccccgagcagcctaactgggaggcactgcccagtaggggcagactgacacctcacacggccagattaagcgagacaggaagcaaggcgagtctacggttgccctggcttagtgccttgagtttccaggccatagcacaggaagaggaaaccgaggcagagcatctgagctgtgaagagaggaagcaaagagcctaagaaaagcaaggcagccagagctcaccaagcagaatactggagagagtgttgcttcaccgaccagaaacttctgtgacaggtggtgcctctgcttgggttttgcttgcatccactgggctcgggccaggcacagtggctcatgcctgtaatcatgcttgctcattcggcccagcaggttgctctcagctcgcagtactggcccggatcccatgcctgccaagaaatggaggaagtacatgctgactggtccatggatggccgtgggcaggccttaaaaaagcaccatccagctggccaaaagacatcaaggaagttctcactcctggtcgcagactccacttggaacagccatcccggcccccaggctttagaccatccctggcttgaaggtgaggtttcactggggactcatcccttcccaactagtaacctgtctgcctcctactgccatcaacatgccatctgcaccacccagactgttcattctgagggacacctgcaggcccatgccgagccccaccgtcagccccctgccaaatttgttcctgagctagttggcccccaaagtttcagagtgggctgagatgcattcagtttaaggcagcaattgaaacagaaattttaaggtcagcagcaagaaaaaataagctcattttgataaataacataca

SEQ ID NO: 476061 - DNA, 853 bp, Homo sapiens
ttccttatatccagcattagactattttccaggaacctcacttgcacctgccctgggcatgtgcagagatgttgtccaagagccacgttctagagtcaaaaaccttagaactctatctggtattctattgtactgtggctgaagtagtactcaaaccacaaaatgcagtccttcccacttttcctttttctttccaaaggcagaggagcttcaccctgtggccagagccactactggcccatggggagtactgccagactaccactgctgttcccttaagccccaaaggctcttcatacctgagtattgctgctggttattcagggcccaagggctcttcattagcaagtggtaaatttttccaggactgggttcttcccttgaagacagcaggttcccttctggcccaggtccactgtctactggccacgttcagcactaggacttgcctaaaagttgcagtccttgtggcctagatagtcttttgagtttatttaaggccccagcgccctttagcccacagtggtgaggcttgcaggaactcaagttcagaccactgggattagtgattcccctctggctagggctgggttaaatgctccctccatgggcaggcatcaactgagttggggtctctatgtctcttccatggggctttgctaagttcaaatacagattcacatattaaacagtgccgcctttaaactctgatctgcctttaaaatctttggatatacgtaagactgacattttgtaaagtagtatatgagcaatgtgacaacaaattaaatgtttcctttaaaaaaaaactaaacactctagaatatgaataaatgaaagcaatctttttaaa

SEQ ID NO: 476062 - DNA, 562 bp, Homo sapiens
caggcctgtgtgtgctgctctggctgatcttggggcttttatggcctcagaggtgaggaaatgcacacagattggtccatgggtggccatgggagggcccagaaaggcaccacaagttcccactccagttggtgggactggcagcctggtccccagtcttcaggccctccctggcctgaaggtggggtctcaccagggacctgcccccttccgccctggcatctgtctgcctcctgctgcctcctctctgtccacacccattgccatcatcctagtccaagccatcagcacctccctcttggaccactgcaagaacatcctaactgatgtcccagtttctctctggcccagtgatttttttcaatgcacatctgactattcacctctgtccttatatccctacaatggtcattggtctttaaataaagatcaaaattgtgaaaacttcctacaagtgaggctttgcaccatctgaccacgacctcatctccggcccttccttgggttgtttccgtatctgtttctatctcccttactcattgtctttttttttttttaagtc

SEQ ID NO: 476063 - DNA, 754 bp, Homo sapiens
gctatgcattgtgagataccttatgaacaagatactgactctcacttctagcagtttacagtctgatcgtcaaccagctgatctgagcctctattcagggacaattggagatcccgggggtctccagggagggggaactaagaggaaagccaccttctcctgctgcagctgtctccactccaagctgatcacacagatcttgtgtgttataattaactccctgggatcagcaacctactttccacgggccgcttttggcttgctgcctatttttgcacagctgggttggcgatacatggtggtggaggtggaggtggagataaagggggtggtgttggaagtggtggtcgtaggggaggtgatggtggaagtgacggtggagatggtagaggtggttgtggaggcgatggtggaggtggtaatggagatggtagaaatggtgattggagtggtagaggtgatggtggaagtgacggtagagatggtggaggtggttgtggaggagatggtggaggtggtggtggaggagatggtggaggtggtggtggaggtggtggtggagatggtggttggaggtgacggtggaggtgacagatggtagaagtgatggtagacatggtggagatggttgaggaagtgatggtagaggtgatggtacagatggcggagatggtggttggaggtgatggtagtagagatttttcattagtggaacatacctgaactattttaataatctgaaaataaaacaaac

SEQ ID NO: 476064 - DNA, 873 bp, Homo sapiens
gtgaacgcagcaatagaagggaggggatccgcattaggagtcatgatctttggagaagagctctacagcggaagcttgcctttggacttgtgggctgtccactgtcattttgatcccagggatggacagatgaagggtagtggagaaaatgtgtgctctgtgctagggaagagggacacaggagggagaaatagaaatacggagacccaggaaattgtggatctttgtatttatgttgctgttataccacaaaactggaacactggcaaaatgaagggtctaagacctgagagtgaagcctcagcagactcacagtgcatgctgattggattcggagaaaacttagaactattctctgaacagacaagattggaaaggacaaacattcctgctcccaggaagggttggcgatacatggtggtggaggtggaggtggagataaagggggtggtgttggaagtggtggtcgtaggggaggtgatggtggaagtgacggtggagatggtagaggtggttgtggaggcgatggtggaggtggtaatggagatggtagaaatggtgattggagtggtagaggtgatggtggaagtgacggtagagatggtggaggtggttgtggaggagatggtggaggtggtggtggaggagatggtggaggtggtggtggaggtggtggtggagatggtggttggaggtgacggtggaggtgacagatggtagaagtgatggtagacatggtggagatggttgaggaagtgatggtagaggtgatggtacagatggcggagatggtggttggaggtgatggtagtagagatttttcattagtggaacatacctgaactattttaataatctgaaaataaaacaaac

SEQ ID NO: 476065 - DNA, 545 bp, Homo sapiens
atttcccaggtctgttataagaatgagtgagatacccactaagaagcatcccgcacaaagcagtcatcggataaaattctattatgtgccaagtattgaggattcacgagtgactcagacaagaatccctgttctcatggagcctacgtttactatggtttgtggagaaaaactggcaatcaaaggaaatgcccacacgtccctcacattcgatggtgaggcggatatcctgtccttgggaaagagaaatccatggtttattgctcttgccaataacaaaaatgttgaaaagtcgagtggcaaagctgttgccattggcatctttaacataaactacgtcaaaagatccagggtgcttctctcagttgatgatcacaccaattcttcccaggttagtacctctagtcaccagtgtcgaactcgatgaaatcaatactcttgccagtctccaaatcaatctgaatggtatcattcacctcgatgaggggtcagggtagcggacggtgcaagcatcatgagtcaccagatcatatggtctctggaat

SEQ ID NO: 476066 - DNA, 1041 bp, Homo sapiens
aaagagattgctgtgactgtgaagaaggcagataaagtggagtagaggaagctgctggagtagtgtgccaggaccactctgagctccaactgatctcacagcagaaagctttctttgctaagatggtggtggatgcagtgatgacgtgtgatgatttgctgcagcttaaaatgattggaatcaagaagataaaagtccacacggttgaggattatcaggcgattgttgatgccgagtggaacattctctatgacaagttagagaggatctatcattttggagccaaagttgtcttgtctgaactccccactggagatgtggccgcccagtactttgctgacaggaacatgttctgtgctggccaagtacctgaggagaatctgaagaggacaatgatggcctgtggaggctcaatccagaccagtacgaatgctttcttagcagatgtgctgggtcgacgccaggtgtttgaagagaccctgattaaaggtgagaggtacaacttttttactggctgcctcaaagccaagacaggcaccttcatcctccatggtggtagtgagcagtttattgaggagacagagcggtccctgtgtgatgccatcatgatcatcaggagggccatcgggaatgagtcagtggtggctggtggcagggccattgagagggagttctccaagtacctccaggattcctcaaagactattccaggaaaacaacagctgttgattggggcatatgccaaggccttggagattgtctcattccagctgtacaataatgctggctttggggccacagagattctcaacaagctgcaggcatggcattcccaggggcacgtgatatgaggtggacatcaacaacgaggacattgctgacaactttgaggccttcgtgtgggagccagctttggtatggatcaatgccctggcagtggcctcttaggctgtgtgcctgattgtgtctgtggatgaaaccatcaagaatccgattgactgtggatgctcccccagcagctagctggggccgtggtcgtgg

SEQ ID NO: 476067 - DNA, 1356 bp, Homo sapiens
tctgtttcttgatgtggaggccaacaccaggccatcacgatggtccaggatagtgctgtggccagggctgactgccaggagcttggtggtaaatttgaagccaagatccaggaaaatgctcagagagtgggccagctggatatgagggctaccctgacccggcacgtggatgagatgaaggagctgtgctccgaattggacgagaccttccatcagatcagcaaaatggagccagagatggagatctgcctggccctgaaggagcaggtgctcggttgggactcgctggctacccgggtggcagccctggagcaggccacgagtgggccgtggcttggagcccccatggccggcagagcacttggagctggcgaccacttgggcccagaagaagctgtcctaaatctggggaagctggaaaccgtgcccagcaggaaaaggaagcagaagcagaaaggcccagaagttccccggaagagggacaggaaagaagctgagcctttgccagacacacacatcaaagggccagtgccagatgccttgaacactgagctctggcaggcaggctcccctgtggccttctatgccagtttctcagaaaggacagctgccctgcagacatggaagttcaacactagctacatcgacactgacagcagcaacttccctgaacatggctactaccaagccggagtttgggctctggccaaggatggtctgcagatcatcctgttggtctatctcttccctggacagcttctgcgagagagtgtggtgtacgtggtctctgtctagcgcactgggtttggctatttctcaatgacaagggggactggactacttctctgggtgggacctggttctgagcttggtatgccttctcagacagcacaggctggactccagccctttgccatactgtgtattctacagctgctttggtggcgtgctcctcttgtggatggaagcttctgtgcagcactttaactctttctcctgcttcctattctcttctccctaattgttggctacaaagtcatctttcccagaaggagtctctaagatggaggtgacatttggacagtattggaaagcagtctccaacgactagaggacagtggaataaagccaacctgtttggtctctgtcagccagaaatggagaagaaaacctggttgagtcaacaagagaaagaaaattagtatctttcgtttcagttattccttgtatttatctgtaattttaatttcatatctttctctccttgccatacacagagcaaaggcccaaacatgccaaatgtgaaccaaaatgtatatggccttcaccatttttacttcctccagtatctttggg

SEQ ID NO: 476068 - DNA, 451 bp, Homo sapiens
gctgggctggggacccggagcatgcatgtcgtggggcggagaaaaccttgggatggttggaaatgaaggacgggagggagaaccagagaaagggagaggaaggaagcagggagggccagagaacaaagagaaacctccgccaggaaaatgggaagaggatgacacaggcacagccctacactccaccaactctcagtctcctgctctctgccttgtaaggaacgcaggccccaccccctccagcctcacagtgtttggggtcacccattccagcgggggatggaatattcatgaaaattcctggaagaaggacagggattctcagaactctggtgcctcgaatttttacaccaaatatgggcattctcagaactgctagggagctggctgtcaccttggtccacatgctgtttctcagcaacttaccagcccagagctgctgcagatattt

SEQ ID NO: 476069 - DNA, 948 bp, Homo sapiens
caacatcaatagccattacggaaatgcaaatcacagccacaagaagatgccacctcacacctagtaggatggctgtcatcataatcacagtggataaaaggccttttcttcactatgactgtgttagccataaggccaaagcctttgcttctctggggaagaaagtcaatgtcacaaaagcctgggaagaacagactgaaacactaagagacatggtggatttcctcaaagagcaactgcctgactctcccatgcggccccttatccactccgacaagatgaaagaaacaatcacgaaccaggaaaaacttgccaaactgcaggcacaagtgtgcattggtgggaaaggacctgcttgcagaaagaagaaggtggttcatagaacagccacagcagaagataaaaactttcagttctccttaaagaagttaggggtaaacaatatctctggtattgaagaggtgaatatgtttacaaaccaaggaacagtgatccactttaacaaccctgaagttcagacatctctggcagggaacactttcaccattacaggccatgctaagacaaagcagctgacagaaatgctacccagcatcttaatccagcttggtgtagacagtctggctagtttaaggagactggctgaagctctgcccaaacaatctgtggatggaacagcaccatttgcaactggagaggatgatgatgatgaagttccagatcttgtggagaatttttatgaggctttcaaggatgaggcaaactgaattgagtcaacttctgaagataaaacttgaataagttactaggaactgctattttatattatgactgctttttaagaaatgtttgtttatggatgtgataaaatctaggtgtctaatacttttgagcccaagcctcttggacactgagctcttttcagtttttgcatatacacaatttatt

SEQ ID NO: 476070 - DNA, 1335 bp, Homo sapiens
gtgaccctaggaatgctggccctcactctctttgctatgacgtcaccatcatccctaagttcagatctgaaccacgttaaatccttcagttccctgcggaagaaaataaatgtcacacgggcctggaaagcacagaatccagtactgaaaaaggtggtggacatgctcacagagcaactgctggacattcagctggagaatgacacacccagggataagtttaaaatggtccaggacaggagggagcagacagtagtaggttggaggcaattattgatttcctgtagcaatataaatccgagagggccagaggcaaggacaggatatggcagcgagagcaagagcaggaggttggaagtgggacagggtggtggcacaggatttgtcaagaccagagctgatctctttccaagggggcagaacccctcaccctgcaggccaggatgtctcgtgagcgggaaggtgatggacatagtagtggatcttggcatttagactttgatagacagatcttcctcctctctgactcagagaagagaaagtggacagtgattcatgctggaggcagacagaagaaagagaagtggaagaatgaagggaagtgaccatgttcttccagaaggtctccaagggacattgcaaaagctagcttatggacttccccattcacagggagaagaggctggagctcgcaggtaactgacagcagagcactgggagcgccctggagatgccgttgaagtacacccttgtgtgtgtgtgtgtggggggggtgtaggtttatgtgtgagagtgtgtgtgagtgtgagtgtgtgtgcgactgtgaacatgaccccctcatgggaggctcctcctagtcatgctggcatgcctgtgctctcccatcctcctctcccttctccctcctgactcttcttcctcactgcacttgcttctgctccactcactgtggatttctcaccagcctcgaaactgtgggtgtcactgtgttttcagacctttctccttagtgttccctctcttgagaattacttttcctttcctctctgtggtctgtttctagaaatccatcaaagccacctccaatggcaatgaacaagcttttcaaacactcagctattggttttgttgagttctccaatgtttttctcttctctacttcatttatttacacttttaatttctattctttgtttattttgagtagatggcttcttttttgagtttcttcaagtgaaatattaggttctcaatttgagattactcctttgtttcttttatctttctcaatatattcacactgacagcaatacatttccctctaaggactgcttt

SEQ ID NO: 476071 - DNA, 1210 bp, Homo sapiens
agccggtgtggggctcttgacaccgcatgaggaaatgaattcaaggacgatcatcactggtagcaaatatttacagaatgtcaacatcacactgtgcatcctcttccggcccgtctctagccagcttcctcgcatcttcgccatcaccggagaggactatgatgagcgtgtgctgacgtccatcatgactgagatcctcaagtcagtggtggctcgttttgatgctggagaactaatcacccagagagagctggtttccaggcaggtgagtgacgaccttacagagcaagcagccatctttgggctcatcctggacaacgtgtcctggacacatctggccttcaagaagttgttcacagaagcggtggaagccaaacaggtggctcagcaggaagcagagagggccagaattgtggaaaaggctgagcagcagaaaaaggtggccatcatctctactgagggcgactccaaggaagctgagctgattgccaacgaactggccacctcaggggacagcttgatggagctgagcaagctggaagctgcagaggacatcgcgcaccagctctcaggctctcggaacatcacctacctgccggcggggcggtccgtgctcctccagctgccccagtgagggcccaccctgccttcacctccatggaccgacggcccacagacccgatgattcttaacaccgccttccttctgccccctccccagaaatgactgtgaaatttcatgatttgcttaaagtgaaggaaagaaaagtaaaatcacttcagatctctaatcagctactgaggacctgggggctcccctcccactcttcctccccacaaccttgttccccgcccccgaatcatctgtcaccttcctatgcccgatgcaatgcacctgctcattacgttcacctgctgtccccactggagcagggattttgtctgttttcctcagggaagcatccgcagcacagcccattgttggtgctgaggctatactaatcctcctgctacacacacacacacacacacacacacacacacacacacacacacacacacacttgcttctgtttctctggagaatcctagtataagaagaataggaacattggtgtctgtcaagtattaggacaatgttcaagactgacagtcagaggtcctgtaatttagaagtgttgtttagttaccttcttcccaaagagtctagc

SEQ ID NO: 476072 - DNA, 932 bp, Homo sapiens
ccaggagccaccgggagcatctggggggactgctgtttttctccagcggccccaaaggccatccaggagttctccattgagacctggacgtcaaggggaagccttgggtggaactgcgagcgggtggccttgtctttactggtctttttccctgctttgtctgaaccctccctgaggccccttcgactgggatccatgacattctttcgctttgccctcttccggccacatctggttctcactggggctccacgcttggttcctgggaaacactgggaggtggccgtccccatgcagtgcctcttctgcctctattggcacagctgccagcctgccagatttgtcaagtttttcgggcctgggtcagacacgagctccctgtgtccccaggagctccagcttccagaaggcctcttagatctccagataaatgacactggcaatatcaggcccttcatggatacccagcccccgttccctggcacagaggccattgtagcacctttatacagtgctaccaccccaacagtcctaagaggcccacacagtgctttccagagagtgcgtcctgaactgctgccagttggtgagtggtttacaattggtccatggagccttcagaatcattccaacttttgcagatctgagaatgactgctcacagccagaaggtgcctgcttccccttctgccacgattgtaagtttcctgaggcctccccagttatgcggaactgtgagtcagttaaacccatttcctttacaaattacccagtctcaggtagtatctttacagcagtgtgagaacagactaatacaatggtgaggtgagaacttacgttagtttttgagacaaaattttagacttgcaacaatgattgctgttgctttttttttttttaatgcaagcaacggccaaattattttggaattac

SEQ ID NO: 476073 - DNA, 1938 bp, Homo sapiens
gagccattcagtgcccacagacacagcaaggagggctgcttgctgcctgacagctttgcgcaactggctacacccaccccttctatcctgtacccctgcatgtatgcacaaggtgaagcatgcacaggatgccatgtgcacaggatggggcatgaacagcatgccgcatgcacaggatgccacatacacaggatgccgcatgcacaggatgccgcacgcacaggataccgcacgcacaggataccgcacacacaggatgccgcacgcacaggatgccgcacgcacaggatgccgcacgcacaggatgccgcatgcacaggtggcctgctcagctgctggaaaggaacagccccggacacacattctgtgcagccacagttctggacacagttccaccacaggactgaggagtagccatgctgactcgggtcactcacctcctaaagacattgcaggacaaatggaaaatacctcctttccttctgtctccatgccagcagtgagctaacaggaacgggtccctgtatctgtcttcctttgtcctccatgtgccaggggcaaggacagcccaggcagtggcagtatagtgactacctcctgagctggcccacggtgtccacaagctgggcatggtctgcattcaatccacctgaagatgagcacctcattttattgttccactttgaggccaattttgtaaactctgaaagaaaaagaaatccttggctaacatctgtaaaaaacatacccttggcatttaataactgacattagtgtggcatttcattgttttaattttttaaaagtcatttgatattctcatcaactctgtgaagcagcacctagtcctcatttttgcatcagcttgtgaactgcagcacctgtggttattaatattaatttcaaaactcctgttttaacatgcaaagtgacccaattacgaaatcaaaattgattttaattgttagcatgccattactatacggtattctattctcagttgtttacatgccgctctcctcaagcacagtgtataataagtccctttccgtgaggctgggagcttacagattcctttactgcaaagacctgcatagttggaaggtgccagagaagtgaattatagcaactgaattgagctcttcgagttctggcaacagccaggaagctaaaaagaagctttgtcttaatggtggcaggagcccagaactgcctcagtttagagtgattaagagtatttctgaatttcaccctactgctgtctgaaacagcagccaagattgaagggcgggggtgaaatgctgcaaactgcaccaggaaaggggaggattagaggagaccgaacagcttccctaaacccttactgctctatgcagaggtgatgtcaccaggagctctacaagacatagagatgctttagggtcctgaagctaagaatcatttttccttttttaaatgattatggggggagagcaaaagaaggatgatattttgtgacatgtgaaaatgatatgaaattcaaatttcaatgtccataaatatttagtggaacacagatcacacccatttgttttaaatgttgttcacagctgctttccacggtaactgcagagtagttgggaaagagcccacgtgacactctcagcgctgttctctgctgcctgcacacaataaatcgcagcgatgctgcccaaccctgggttgggaagtcttccctgctgtccccatgcagctgaaccacactctgtacttgggtggggctggggtgtgttgacatgccccctccatgtgtttctttttaacagattttactttttttagaaaagttttaagtttatagaaaaactgagaggctagtacagagacggcccattacctcatacctagtttttcctgtccttaacatctcacattagtatgatacatttatttacaact

SEQ ID NO: 476074 - DNA, 567 bp, Homo sapiens
gctgtggttgtctttgtgtttgcctaccctatgaccacactctcccacctaggacactcttctcaaggggtaccaggaccactgcagccaccacgtggggcaggaagttgggcactgtgcaacttcaggaaggtgccttttacatcacaggtgtctagctggtatgagcatggtggtgatgcaggatttttcttggcccctttgccggactcacagaaggggtgcccatctactcagcccactgtgctcagccccttgtgggtaggtgcatgtgagctagtgagtgcaaaatccagcccatggctctgggcactgacacaggagcaaactccgtgcagggcttgtggccagaccagctgtgtcaccttgaggggaatgcagcagcacccaggtgagggtgcctgcaaccctgaggcccaagagggggcgttacagtgctcctttaattctgccatccacagacagcagcatgttagtagatcaattggccccttgtatcattgcatggggcagctgccctccaccagtgagggcaaagggccagtgtgacagcctttctggggactc

SEQ ID NO: 476075 - DNA, 531 bp, Homo sapiens
gagagtgcccttgcagccctgactgcaacgaggaatgatgtcttttcctcccggatttcaaagcacccattgggtaggagcatgggccctggagccagacaacttggccctactcctaaatggtgatcttgggcaagtgtttcaacacctccatcgaagatctacatctacaagtagacaggggaaagtgatcacaatagtccctacttcatggaatcagtgtaaggattatgaagttaatacatttagggatcttagaacagcacttggcaaacaatatgaggactgtgattttgaaaagattcctaaatggtcctgtgtactcagccgtcttccagcaaggctcctcagaatagaaaacctgctttggcatgcctccatggggcagtatttggacttagggatcaaatatcatcaatttttagcttttaatcaaacacacactatttctagcagtaagagtcaagtgctggcttggcatcctgccaagtgtcatctggcaaggactcaattaaactagaaggaggaagt

SEQ ID NO: 476076 - DNA, 576 bp, Homo sapiens
ctccttaaagatgactcatggctagacaatgtccccacagttcatgtcctgctccttggaaaaaggtacctttgtctcactctcggtgaccaactatgctggtttttccaggaccgtcctggttttagcacagaaagtctcacttcccaggaaacctttcagtcctggcaaaccagggtggtgggtcgccctagaacatatggacctgaaacagccacacctctgcacttcagctgcggtgtcacacaggaggcttttcaggtgtgaattaaatagcatttcttatgcccatcaaactccagcgacttatggaaagccttccaaatggccagtgaagcccctcctcaaggcttgcgtggaaaagcgactggagaggggaccaaatggaggtgatcgggaggaccatagtggcatcagcggatgcatgcagcagtgtagagtcaagtcagaggcctttctggaaagtggtcatgtggccaggttggtcatcccagtggtagacctctctcaaaatgctaagcggtagaggaataaaatccgcgacgccccccagagaaatttatgtaatataattgc

SEQ ID NO: 476077 - DNA, 581 bp, Homo sapiens
atgggttacatgggatatttcagcacaggcatcttgcatcttcatgtcctccgatgtgcactttgcactgaaacgttgcacccctgcgtgggatcctaccttggggtgactctagtccttacctttatagggacaaaaccagatcaacaaaggaatttcatccaagaagcattagatcctaagcagctgacaaagatgtttggaaggcatagaaataattcatttttactcccttttccttttctgctcctcagcccctctctgctgcatatgtgtgaacaagtttcggcatcgatgttttctggccacattagttttatggtaatagtaggaaataaggcttggattgtgactatagggacagtgaaggccccggcaccaggccccttattgaccttgacccctcatggtctatgtgaccttgggcaattcattcatgcaacagaaaatggggataataatggcacatattcatatgattgtttttaggataggttgaaattataaacttaattgacttgtcacagttccaagtactgtgcgtaataaatgcattgcaaatgtcagctaccattattacc

SEQ ID NO: 476078 - DNA, 627 bp, Homo sapiens
agtgcttcctgcaagccagacgggcagaagctagcgcagatactgcattttttacaaatagaaggcttgtggccacacttctttgagcaagtctattggtgccatttctccaacagcatgtgctcacttcttgtctctgtgtcacatttcggcgaaagcctaatccagagcaaggccggaactctcttcaattatatgaaagctgagagaggtgaggaagctgtagaggaaaattttgaagctagcagaggtgggttcatgaggtttaaggaaacaagccgtctccataacataaaactgcaaggtgaagtaacaagtgctgatacagaagctgcaagttatccagaagatctagctcagatcactgatgaagatgagaagttgcttcttatggataagcaaagaaagtggtttcttgagatggcacctactcctgctgaagatgctgtgaacactattgaaacgacaacaaaggatatagaatattacataaatttagttgatacagcagcagcagattttgacaagattaactccaattttaaaagaaattactctgtggggaaaaggctatcaaacagcatcacataaaataaacctttcatgaaagaaagggttaattgatgc

SEQ ID NO: 476079 - DNA, 541 bp, Homo sapiens
aaggcttaaatgtaaaggactttgaatagtacttgacacagataggacacaataaataggagatggcacctcctacttgtctatctaatacatacagaccaagttcagccatatgtggtgatagcattagagaacatcccgccttacacggcagtgctttctcctcctttgaggtgactccacctctcccacccatctcccccacgcagatgtccagcaccctctgttgtcttcttggctggccaggtaaggcactcttactgtacctgtccagggaagcccacaccagacagaagcccgactctggagtaagcatgaaagccaccacccaggactttgcaatgaaggttttgatttcgtctgagattgcccccagcccccctgcctggggccctgccctgctcctgctggctgacatcgctggccactgctccctgagctggggtcttgtatctcttggtgttttcgacttggggcagtaataaattatattaaaatatcttatgtgactaaatgttcccattaagcaacgtggatagaa

SEQ ID NO: 476080 - DNA, 618 bp, Homo sapiens
tccgttcagcttgcctcttaagcacagcttctgaactgaaaatgaatgcaagcaaggaaacagggacctcggtcctacaaccaaagaaactgcattctgccaaccacctgaacgagcttggaagtgattctttcccagagctacagatagtgaactccttgagcatgaggttgttggcagagaacccagctgggccacaccggacttctgacctatggcaatcaaagttttcaggaaaaggcattgtgatcacaggagacgacagctccatgcatgttattgcccctgaggaccctccagtgggacaagatgtggaggtggaagacagtgatattgatgatcctgaccctggtcatgtcacaggtctttccattcactcctcactcactcagtcactcactcacccagagcagcttccagtcctgcaagctccattcatggtgagtgccctataaaggtgcaccatgttttattttttatatcatatttttatggtaatttttctatgtttagaaacagaaatacttaccattatgttacaattgcctatggcattcagtgcggtagcatgctgtagcctaggagctagaacgctgtaccatataggctgtaccatat

SEQ ID NO: 476081 - DNA, 963 bp, Homo sapiens
ccagagcttctccccaagcccagcaaaccactcatggctcagctttgatgattgtatcaacggtgataagtcttcccatgtctgcaggagcagctgcagctaattatgcttactgggcctatgtgcctttcctgcccttaattcgggcagttacatgggtggataattctattgaagtatatgttaataatagtgcatgggtacctggccccacggatgatcgttgccctgcccaacccaaggaagaaggaatgatgatgattatttccactgggtattgttatcctcctatttgcctggggagggcaccaggatgcttaatgcctacaacccaaaattggttggtagaagtacctactgtcagtgccaccagtggatttacttatcacagggtaagtggaatgtcactcaggccacaggtaaattatttgcaggacccttcttatcaaagatgattaaaatctaggcctaaggggaagccttgccccaaagaaattcccaaaggatcaaaaggcccagaagttttagtttgagaagaatgtgtggctgataggacggtgatattacaaaacaatgaattcggaaccattatagattgggcacctcgaggtcaattctactgcaattgcacaggacaaactcaatcgtgtcccagtgcacatgtgagtccaactgtggacagtgacttaacagaaggtttagataaaaataagtataaaaggttagagtctctatacccttgggaatggggtgaaaagggaatctcatcacctcgaccaaagttagttagtcctgttactggtcctaagcgtccggaactttggaagcttactgtggcctcgcaccacattagaatttggtctggaaattaagctataaaaacaagagatggtaagccatcttatactatcgacctaaattccagtctgacaattcctttgcaaatttgtgtaaagccccctt

SEQ ID NO: 476082 - DNA, 831 bp, Homo sapiens
agtggttgtgaggttgatttggtgttcatggcaaagggcctccacgacttgacatacatgggctcatcacagttgggtacaagcacacaaagatgggcttggcacttgtctaaggcttcggcagcttcgtgaattccacgtgctaggccatcgtggatgagggcggtcttcagcacctcttgtaaagcagtattaacgtccattacacctccagcagcaatgccttccttggccatggcgcgcgttaaaaatttctgcctagatctgagagacctcctcttaccattgccaagccaacctattgtgtcttttacaaatattgacttttacaatattgactttagttactgcattgactttagttactgcactgactttagttactgcttcgacattccatctaaggactctcatgagattgcatttaagctgtcggccaggggctgtcatctcaaggatcatttgacactggactttacttccaaattcactgtcgtagttgttcatagggaaaacaaagaagttataatcaagagagaagcagtttcaaaggtgaaggtgaagagttgccagtctcagcgaaggctttgtaactagagaatgaatctttagggtagagttaacggtagattttaaactgttttaataattaaaattattattgcactttgaagggggtgtctgaactcagttgtaaaatgtttgacatttgtgaattcctttaatgttatatttgaaactgttttggtgcatgcacaaggtgcccaactatgactctacattttattgttaaacctcatgtgacccgtctttctggagaagtatgtgtgc

SEQ ID NO: 476083 - DNA, 712 bp, Homo sapiens
tttgaagaagcatggacagcagggatggctggaacgctggggcctcatgctctggcatgctccaggacctcactatccatggggcctctccagcaggctggcccagtattctttccatatggctcaaggctccaagaaagcagcaagacctcttatagcccaatctcagaagctgcactatgtccctgtcacttctaccacattctgttggttaaagcaagtcacagggcctgcccagattcaggaggagtggaaacagagggagaaatggcaaaggcccatttgcaaaagggcatcacctgtcaagtataagccatggttacatacttgccatggttacataccacagcagaaaccatgggtagcccagagaccaatcttcacattcttcagagcactctcctggggagacatccccagacataggctgagctccagtgcagagcggccaaggcagcagccaattcactgagcagatcccacgctgagtttcttaaaggctttcagggttcttgtagtgtttttcagtttttatttaaattcagaaagattctacacacatgattttttaaattcaagaacttctatttctaggatattttcaacatatctcttctttgaaagctgacagtattcaaatgatgtcagcaaaagaaaaaaagcaatcaaggcttttcctgttctgttcaactatacatttctgaaatggtag

SEQ ID NO: 476084 - DNA, 642 bp, Homo sapiens
agagtgcagtgggcatgatcagggcagccttactggagcctcaacctcccaagctcaagcaatcctctcacctcagcccccaaggagctgggactacaggtgcaggcccccacaccccactaacttttttatacttttttcgtctggaactcctgcaagcagccctcccacctcagcctcccaaagtgctggtaagacagccaggtgggaaggattccttggcagaatctccttttgacctgagcactgggaggaatgcaccctgtggtggagccttgggaaatttgcgccatttgcagtggggaggagcctggcccctccttttcctaggtggaacctgggattcagtctaccaggcaggaagcactctggctttggggagagtctctgtttccctttttttctttttgcccaataaattccattctcacccttcaaggcatctgacttcaaaaggggagggggtgtatgaacagggagtaggtcacaaagatcacatgcttcaaagggcaaaaaggagaacaaagatcatatgcttctaggccaataaatatcacgaggcaaagggcaaagcaaagaccacaaggcaaagggcaaaatcaaaaactcctgataaggttctatgttcagctgtgcacatat

SEQ ID NO: 476085 - DNA, 926 bp, Homo sapiens
gactttaatttcttttccttacttctggatgccttttctttgctggttatatttttttcttatacccacagatgtgggggtccctagtcctctttttacttcatacctcctactgactgcttttaccattgctgttgtgtggacagacttgaaatcttgccagcagtctgactgcctaagctccagttctaaattctcccctcgacagttccatctgatgctcctgaaggcatctccagttcatcacgctctgaagccctttattcctcccagccccacatcagctcttccttcttactcccctgtttatgttaagagcactaccagttccctccctgggctcaaactctggaaggattttattgtgaatgatgtggaagggactgaaaggttctgcatagcagggtgaaaagttctaaaacatatcacactgatggctgtgtgaatagatagggggatggagagacaagagtggaaactgggaggctactgcaacagtctaggcaaaggatgagacgagaggtgctggagagatggaggagctgtcaaattctggttatattttgaaggtagtgctgacaacacttgctgatggattggacgtcaagaaaagagtcaaggatgattcagaagcaactggaaaaatacaattgccattaactaagctttataaggagactgtgggaagagaaggaagtctgttggaggagggaagttccgtttttggtgtgttgagtttaagatgactatcagacatgcaagtgaagatgtcaagttgtcagttggaatttgactctagcattgaagagagaaatccaggctagaaatatatttggaagttgtttgtgtctggagggtatttgtgttcagagattagcagggttcacttagagagaggtcagcggatggagcctgggtcactgctc

SEQ ID NO: 476086 - DNA, 580 bp, Homo sapiens
tcctcctattaagtccagtttgggtgattttctccaagtgcagttccttgcattttccccttccatgaaatgaggatactaatccctgcttcagagagcacccaaacagaatacaaaggatggagtcatttgatggccagggatgacagtgtgatatggtttggctctgtgtccccacccaaatctcatggctcagaagaagacaagaaaatgaaggaaagtttggaacttcctagagacttgttaaattatgaccacaatgcttatagtgagatgaacagtgaagtccaggctgaggagatctcagatggagaggaagaacttattgagaactggagtaaaagtcactcttgctatgctttagcaaagagactggcagcattgtgcccctgctctatggatctgtggaactttgaacttgagagagatgatttagggtatctggtagaagaaatttctaagcagcaaagcattcaagatgtggccaggcaggctgcatgcagtggcacatgcttgtaatccgagcattttgggagacttaggtgggtggactgcttgagtccagctgtttgagacatgc

SEQ ID NO: 476087 - DNA, 689 bp, Homo sapiens
gtcagccagacggaagagaaagccatttcctgctgatgcatttctgccacgagctgagggtttggggttgtcagtgaagtgaagctgagtggactctggccacatcccttgtgagaaatatcagctgcttcaaaaaccagttcatgtaaaaacttcacatgtaaacctaaaacaaatgaatttacctttcatgatggtttccggctacaaacctagaaagtcccacctacaagagcacaggacccagggcaccataaggcccagtgcccagggactcagggctttgaaaaacctaccttctagcccagaacaggccctgcagtatgtgggaaagtgggtaaaaatactaatgctggagatcttgtggactacatcatgccatctatatattaaaaatgaggaaggtaaaaatagaattcagggtcagtggttggagcatctgtgttctcaagggttctccctcatctgtggtcccaaatcaatttctgtcatcaaggctgaacgccggttcaccagtggagttgttcagtgtggtttgccctgtgcaagtttgggcttccgggttccacgatatgaaccggttgaggagctggtgggggtgaggtgggtattcacacaatgaggctggtgttggcaatggggtagactgaggatggggagcgtacatccagggccatatgcatttctgc

SEQ ID NO: 476088 - DNA, 819 bp, Homo sapiens
tatcacccccacaaagttttccggtgtcaattaattgtgccacacatgggggtatgacaattggagaagctcttcgtgtgtggtcatgtgtgtgcgcatctgagtgtcccattcccacgggagctgagaggagcagagggagaggagtgaggtgtaaagaaagaaacggctgcgatgaagataaagagcagtgggtagcaaagagcagcgtgtgtgaggcctgcagctgctggagcttgaacaggaatcagacgagggctgactcccctggctccgggccccctgtctccacacatcctaccccaattcaagaaactctaaacctggttatgtggacagggaccatcgctcacagttccgcaggctgcacaggaagcatagtgccagcatctgcttctggcaaggccatagggagtaagccaattatggcagaaggcaaagggggagcaggcgcctcacatggcgaaagcagcagctggagagagaatggagggggaggtggagggtgccaagcctccttcactcttgaattctgtatgcctgcaggcttaacaccacgtgaagccaccaagtcttatggcttgcaccctctggaactggagcagcagcctgagctgtacctgaacccccttgagcctaggatggggctggagcatcctgaatgtgggaacagtgtccaaaggctgcacagggcagccaggccctgggcctcacccacacagccattcttccctcctacacctatgggtctgtgatggaaggggctgccttgaagatctcagaaatgccttcaacatcttttttccattgtcttggcaa

SEQ ID NO: 476089 - DNA, 1044 bp, Homo sapiens
tacaccgcggagaccgcgtcagcccagcgagcacagaaccttgtccttgccgctgcgccttgcgtccgcacccgccgccagctcaccatggatgatgctatcaccgcgctcgtcgtcgtcgacaactgctccagcatgcgcaaggctccccaggccgtcttcccctccattgtggggcaccctaggcaccagggagtgatggtgggcatgggtcagaaggactcctatgtgggcaaggaggcccagagcaagagaggcatcctgactctgaagtaccccatcaagcatggcaacgtcacgaactgggacaacatggagaagatctggcaccacacctacaacgaggtgcgtgtgactgctgaggagcaccccgtgctgctgactgaggcccccctgaaccccaagctcaaccatgagaagacgacccagttcatcatgtttgagaccttcaacaccccagccatggatgtggccatccaggccgtgctgtccctgtatgcctctggagaagaccctcacccagcacagctacagcttcaccaccacgctgagcaggaaatcatgtgtgacatcaaggagaagctgtgctacgtcgccctggaattcgagcaggagatggcctcggcggcctccagctcctccctggagaagagctatgagctgccagatgaccaggtcatcaccatcgacaatgagcggttccgctgccccgaggcactcttccagccttcctttctgggcatggaatcctgtggcatccatgacactaccttcaactccattatgaagtgtgacgtggacaaccacaaagacctgtacgccaacacagtgctgtctggcggcaccaacatgtaccctggcatcacagacaggatgcagaaggagatcaccaccctggcgcccagcacgatgaagatcaagatcattgctcctccccagtgcaagcactccgtgtggattggctactccatcctggcctccacgtccaccttccagcagatgtggatcagcaagcaggagtaggacgagtccggcccctccatc

SEQ ID NO: 476090 - DNA, 669 bp, Homo sapiens
ttaagagttgatgatgcctcatggccatgagaagggactacggggaaaagtgggctttcctaaagcctttgctttctctcatctgattacaaatccaaccaatttcatgcgttccaattcgaagtgctcaacctaccctcatttatctatagttcgtcacagccctcaagattgcttaggggatgggggacctgtcttagcactacttatcttaagaacttccctgaaaccccctactccctacccccagagattttccactcccttccaggagcccccattccactggaagtacacttctttgaaacctctgcaaagctttcctggtcctgccgctccttccctttcttcagccactactcggcactactcaggcacttcggaagcagtgactcaggagaccagcaggtggcacatgggaaccagactacacactcctgtggcccaggacaaagagatgggagaggaaggatttcgtgcaaggccagctggctgatttcctcagtgttggcggattgaatgctgcccatgaggactacagaaatcttcatggactgcaggacctcaatgattaaagacagggaggcagggaggagggcaagatcagggtgacactaaaggatggggacattacagtcagtctttcaacctctgctaatcctctccctt

SEQ ID NO: 476091 - DNA, 739 bp, Homo sapiens
gtaacaacagctgccgctactctaactcacgtatttggctatgccaaaagggcttgtgatggttaatattgaatgtcaacttgattggattgaaggatacaaagtattgatcctgggtgtgtctgtgagggtgttgccaaaggagattaacattggagtcagtgggctggggaaggcccacccacccttaatctggtgggcaccatctaatcagctgccagcaaatataaagcaggcagaaaaacgtgaaaagaatggtctctttgtgcacgttgatgagagtttctttaggatacaaatggctgttcattgcacagttccaaggtttgtgcaatgcagtgacccaactgacatcttcacagacatgcatgcagtggtggcaaagaagggagggggtgagaacataggctttgaggctgggcagactccactggactcccaaatcacctactggctgtgtgactgcttgttttgccatctataaaatgaacacttcacaggattgttgaaagaactaaatgaaataatgcatgaacatgtgtttggcatgtcataagagttcaataaattgttgatattttgttgttattgctataattattatgtttaaatatcccttctgaactcctagccaatattttcatctgcctttaaatatctctccccagacaactcttatgaatacatcaaactcaatatttccaacactgaacactttagcattcttgggaaatgtatt

SEQ ID NO: 476092 - DNA, 703 bp, Homo sapiens
ggttgcagcggaagtgtgagggaagggcagcactcctggaccacgagggtgaaggggacagagcccatcccagggggcagtggcagcctggcaatgaccctgtcaggatttgaatgatagcctggggctgaagcacacgccaaggcgttttcaacactaagcccaggaagaaagcagtgcaaagcagcgtctcttgtgtgcagtcactgctgtggacgctcaagatgcacgcagtgtttcagagcagtgtttatccggccatgtgcagctcagcaggggcccagaaactgcttccagatccctacagcaggttccagggaaatggaggaaaggcagcggctgccgccctggtggacacgttcccaggccctcgcggggatctgttgaacccagggagcttggagaacgggcagcatcacgtctctcccttggcagcttctgcctctgcgttggtgtctctgatagacagaaacgatagtcagggcagagtatcagccctgcaggagggcaggtccccatggccagcatgcccagggtcacaggagactccaaggcctccctctggagcaggtgtccctgccagcgaggagagacagacggcgctctgtgtggtgaccactggctgggactggcagctctcggctccgcacagactttgacttggcagctgttgtcctgttacctaaattctcagttcaacttc

SEQ ID NO: 476093 - DNA, 803 bp, Homo sapiens
tacttggtcccccagcagtgccggcccaccagcgctgttctcgatttctcgccgggccttagctgccttcccacgggggcagggctcgggacatgcagcccgccatgcctgagcctcccacccactccatgggctcctgtgcggcccgagcctccccgacgagcaccaccccctgctccacggcgcccagtcccatcgaccacccaagggctgaggaatgcgagctcacggcacaagactggcaggcagctccacctgcagccccggtgcgggatccactaggtgaagccagctgggctcctgagtctggtggggacctcaaggtttgtgaatgcaccaatcgacactctgtatctagctgctctggtggggccttggagaacctgtgtgtccatactctgtatctagctaatctgatggggacgtggagaacatttgtatctagctcagggattgtaaacgcaccaatcagcgccctgtcaaaacaggccacttggctctaccaatcagcaggatgtgggtggggccagataagagaataaaagcaggctgcccgagctagcattggcaacccgctcgggtccccttccacactgtggaagctttgttctttcgctctttgcaataaatcttgctactgctcactctttgggcccacgctgcttttattgagctgtaacactcaccgtgaagatctgcagcttcactcctgagcccagcaagaccacgagcccaccgggagcaacgaacaactccaggtgctaccttaagagctgtaacactcacggcgaaggtctgcagct

SEQ ID NO: 476094 - DNA, 1399 bp, Homo sapiens
tcctcgcccccttccagcttcacccgaggacaccaggtgcactggaataggctttttcaatctcgactttccaatcacgatccacaatcccttcaggatggctgcccaggtgggtgctggtttcctgcaggggctcgcacccacatggctgtctccctcatgggtgggttcagggggatgccacaggtccagagctaatcctgtaggtgccaaggcagcctctggagctctcacaatcacagaggcttcagagagctttgtcagctggcagggagcatccaatcacgagagcatctggacctgttggtccatctccacttggtcattccatgggaagcacccactcactagaggtcttgtgagacttattcactatcatgagaatagcactggaaagacaggtctccatgattcaattactgcccccccagatccctcccacaacacgtgggaattctggcagatacacttcaagttaagatttgggtggggacacagccaaaccatatcactagagaatttcgacctgtaggtccatctccacttggtcattctatggggagcaccattcactagagtatctgggccagaactcactttccttcttggctctcatctctgacctctttctggcacctgccctgacatgacccctgtggggtccagggggaaaagatgtttcacgtgccagccatggaggtcagctctggttgcagagctagctggagaacagagcagagaagacctggaatggagacggcgcaatgagatgctcctgcctgcactgcctgggctcctacttgcctgataagttgtgtggtctcagcatctggagttgttgtcacattttctctcactgttcctcacccttccactttaagaagcattaggtttcccatcatcctccttttatactccatgagcaattctgtcttcattgccttcctatcctttaggcctgcatctattcctcctgtctttgcccagttgaagtagaaaacatctagtccagtgtttttgtttttcaaatgtggactatattaatactcttcttaggaggctacagtcctagcacaatttttttaatactgtatttttatttttatgctaatctaaacctaattacttttactagttatgatgacaaaactttttctacagtgaaaacgtgcagttaaacggtatccctgcaggctaaacctctgcttcttatgtatcctcagagaaatgcagagaagatctatatattttccacatttaaaaatgctcgatgttacattctcacagaccccatcctcttggtcactatttagcacttggccttttgaagaactttagggttagtgaggaaaggacactgggaactgggtactccccaagcacacagtggtgttcccgt

SEQ ID NO: 476095 - DNA, 1477 bp, Homo sapiens
gccttcagacagcagcccagctcgacgggacctggaagagcatggtgtggaaactgaaagaatgcagctgcatcgttgtcgtcatccctatcacctcatcatcttcatcatcacctcctcctcatcatcatcctcatcgttatcttcatccccatctcctccttctcatcatcatcctcatcataagcatcttcatcaccatcctcttcctcctccccatcatcctcaacatcattttaatcaccatcctcctcctcatcctcataatcatcttcatcaccatcctcttcctcctccccatcatcctcaacataattttaatcaccatcctcctcctcctcatcctcatcaatccatcctcctttttcttctccccatcactgtcatcatcaatcatcttcatcaccatcctcttcctcctccccatcatcctcatcaccatcttcatccccatctcctcctcctcgccatcatcctcatcatcttcatcaccattgtcctcctcatcattatcttcatcaccattgtccttctcctcctcctcaccatcatccttaccattaatcatctttatcaccatcctcctactcctcaccatcattctcaccgttatcttcaccaccatcctcctccatccccccattatcctcgtcatcatcttcatcaccatgatcctccttctcctgatcatcttctccatcaccatcattctccttcctattatgctcatcatcatcttcatcaccatggtcctcctcctcctcaccataatctttacgatcatctctttctccatccccctcctcttcaccatcatcctcaccatcatttccatcaccatcatcctcctccttctccccatcatcttcatcatctctatcaccgtcttcctcctcctccccatcattcttaccatcatcttcatccctgtcttcatcttcctcctccccatcatcctcctcatctctatcacaatccccctcctcctcatcatcattctcacatcatcttcatctctgtcatcctcatcatcatcatcctcatcatctctatcaccatctccctcttcctccccatcattctcaccatcctcttcatccctgttatcctcctcctcaccatcatcatcatcaatgatcttcatcaccatcctcctcctccccaccatcctcatcatcatcttcatcaccatcatcctcctcctccccattattctcattatctccaataccatcatcctccttctccccatcatcttcatcatcttcattaccatcaccctcttcctcctcaccatcatcctcatcgtcttcatcactttcctcctcatgatcttcatcaccatcattatcctcatcctccctctcctcaccatcatcctcatcatcaatcatcttcatcaccatcattaccctcctcatcacaaacatttattgagcacttaatcagtgcaggtcacttggtaattgagccccac

SEQ ID NO: 476096 - DNA, 1456 bp, Homo sapiens
ggtgcagtaacccagcccctgctgagcgctaagcactccacacccagttccaggccataagggcactgggtccagggagctggcaggagggctgctgtgctcaagggaagggctctgggcggcaggccagggcaatggacgcaggcagtgtgcaaaggcacagatgcacctctgctcacctgctcagcctctaacacacctgtatgccagacattgccacaccgcccaggagctgccaggccaggagccaggaggccgcgagtctgctgctctccaggacgcctcctgcatgtggttctcatttggcacggctgagacgcggcagtgttcttgtcctggctccaagtaaaaaccctctccttgaaaactcaggagaacagggagaggtggtgtcctcagaatctctgaaagccaaaaagtggctcaaaaagatgcattcatccaggctgggcgcctggcagggtgctgaaggcggctccagctcatgccacccggagccaccagcgtctgctagagaaccctggcatccagcctccccagggtcagaaaaatacacatggagtgagagtcaagtgtatttaaattcctgggaaatgtcaaagtgctaattaagcctaatattctccaggtggccagctcctatggcaacactaaagctgtgtctgtctcctgcaccaaccaacagccatggaaagcggcagccatggaggatgcaggaatttcttcccatattcaaagtaaagagaagaccagtacttagcatgagctgaccatcgggtgaatactttgtgccttgatttttttgtaatgatagaaaagaaacagcattctttgtgagatttgctttcatgtttttagtatgagttagtctgtttagcgaatgcatgggatgaatgtgattcagctccttgcacatcttgcacccccagtcccctctggttcctctgcttagtgctcccaggtaggaagaggagactggaagcccctgggactctcgagaaatgccacctggtttccttgcagcaagcgcagcgcaatttgccaagtattaagctaactcccctgaaagcctgttgctctgcagcccctataactagcagcatctgagccatccccaaggtttgggccccttgtctcctgtctaggcagggctccattcatggcactcgtgaggacaacttgttgggctatcaaatgtcactctgttactcccatgcagaaggcaggtttgtgaagcaatgatgagttattccaagcaaatgccagggctggacagggcgttgatgctggaatgcagggtgagagacgttgccagcttccatctcaccaccaaaagtgcgagggtgcatctgccccatacactggcccagccccttcaggtcctgtgcctccaagctgtggaggaaaggacacacggccttcatgtgctcaggcctgtggcagtatttttttgatt

SEQ ID NO: 476097 - DNA, 998 bp, Homo sapiens
gaggaggctgggatcctgcggcctgcaggtcatgctgctgaaggcgggggattcacgtccctggggtgccggaagtgaagccatcagcaatgccccaacaagagctctttgaagtcttttgcttctatattaaaatcaggagagatgaacgctctacacccaaagtctatccagagcccgacactcctcgcacaggctgctccgtggccggaaccgcccacctctcccacgtggacccgagcagacacctcaccactctcctccttcagcccttcccatctgttgtctacacaaacatggaaaccagcagtcctctaaaacattccacccaagccttccaatggcctcactcagagaagcagccagaggcttctgggctatgctggaggcggggtgggctctgccccatccacccatgtggcatcacatcactccggatgcctgttcctctccagtgcccgacttctccccacccctggggcttgctgggcatggcgttcctgctgtcctctgcaggctgctctccacccgacggcccttggttctcctctgctcctccagtctccactcactcgcaccttgcagggcctcctccctgcccccatctaacgttccagccctcctgaccttcccttctgcctcctccacaagcaacccctatcgtgctgtggggtttcttatttatctgatgactcgcttccacaccaaagtataagccttaaagagacacacattcctgtgtgtttactgttattctgtcaatatctagagcagaaagtacttggtcaatagttttcaaatgaatcaatagatgagggaagtatccttcatcccatattccttgattaactgttgatttctatccactcaataaaaaacatggagtaaagagcaaaattgctctattttcaaactgtcttcccttgccataacgcaaatagaaacagagtatgaaaaggtgaaaaacaatttgcaattaggtaaattgcaaaaacatc

SEQ ID NO: 476098 - DNA, 840 bp, Homo sapiens
gatgtgcgactccgtggtgagaactgaagatgcatgaggatgaggggcgctcgatccctgtcctctgtgatctggtacaacagaatcaacccctgcatggtgggccccagtgagcagcctgcgggatgcacggagccacccagaaacacacagaatggaaacacagagagttacagagatgtgatccaggtgggggctgggaaggggcttcctgcagaggtttatacccaggctcgtggagaaaatgccctacgagggaccaagccaaggactcaagcaaacgcagggaatgagacagcgtttccaggccagaatgcgggagcccttcagcagaatcaggggttaggaagctcggtgacttcaggcaggaaggcgatggaacgggaacagggtctttctgtttcacgtgatggaacaggaacggggtccttccatgtgggaaatgctgagcctgcgctgccaaccgcctccgggtgagacatcttgtggacagctgggacaggcggcagagttcaggcctatactttatattttaaaagctcaaattattttataatctcctgaaaatacatcatcttgccatttgctttcaatactgcactgcgaccttttataatctttcaaaaacatgttctccctttggataaatgagaaaataaatagtattcagtgaagaccaactactgaattattttaaaatatcttgtttataaaaggtttttaccagtgagaggatttaagagttgcttggctcttgaagccagcagagacttctgtgtgcattgcttcatttgtgggggaggactctagccccacatggcagatgaaaaactgtgcctc

SEQ ID NO: 476099 - DNA, 613 bp, Homo sapiens
tcgaccttgtccatgttatacacaaaattcctgcagcacagtaggcatgtatcttcaacagcaaagggtattcacctggggagaaatatggagtctatgtgttgttgtgaagggcagatggagaacgagtgcataaacagcacagtaaaacccaggcctattagaacatggaaccacagtcatcactggaatctgcagtcacagcggaagccccatcacgggggctcagaggtgaagcgggaagaagctcggctgaaaggaaagctcggtggaggtgagccactgacgtttcacactgagaaatacggcaggtgggcagtgccattgacactttacactgagaaatatggcaggtgggcagttctgaggcgagtgcaagcttccccatccacagtgaagctcaggtcttccacagcaactcctggttgccttcccggtcttctggactctgagcactccacgacctcacttgaattcctgcgtgtgcttccgtaaattgtagaagcaaattttaccctgagttctttcagaaaaatagcagtagaggagacaggccccaaggaagagtgtgtccttatttaaggcaagttttctagtctgttttatttattta

SEQ ID NO: 476100 - DNA, 525 bp, Homo sapiens
ggcacctgctgtcaccaggcacagtctcccctgtcttgaaatgtttgcagtaagagctgcagctgcccagcaaggctgttgggatcttgatgacacagcggtcagtgccctgtagggagcccggttcagggctgctgcttcttcttgcagttcaagatcaaggtgtcagcagggctctttctgaggaccacgaggggatctgccccaggcccctgcttgagtctcaggggaatgacagtgtgaatgtgcgtattatcgaggtgaagtcagtcccgtcagcaatgatgggcccaactgtccctgcccgtctttgctccaacgtcctaaaatacacctcaagtctggcactgtttttaaactccttctatgatgggtcttcgtgtccagcaacaagctggagcggcctggtgtggtatgtgggtcacgactcaattgcttcaatccctttcttccctgagcaatccccgctctcccaggtgcaactggtcagttcaatgaacctgaccttcactgtattctaagcac

SEQ ID NO: 476101 - DNA, 752 bp, Homo sapiens
gcaagcaccatggacctcccatcatgttcactgccgaagaccccatagtgttcactgctgtggaccccaatctcaccaccaagggccctcacatttttgcctttacagaccccagatgcctaagccaccactccccttcccctactgctggagctgccctagccagtgtgacggttggtgctgccctagccagtgtgacggttggagctgccctagccagtgtgacggttggagctgccctagccagtgtgacggttggagctgccctagccagtgtgacggttggtgctgccctagccagtgtgacggttggagctgccctagccagtgtgacggttggtgctgccctagccagtgtgacggttggtgctgtggcttcaaacccaggacagccactgtccatgcccacaaatgtccctcccaccagcagcccctgcaccactatcacatgcatgctcacgctcatacagctcccaccgccagcccttgggcttgctttcctggaggcaatcacaactagacaactagacctagacgtgatgctgaagcccccacagccaccgtggatttccccaacagcttttggcactgagggccacgcaatggccagtgtcatagatcccagctgcctgagtcgctgagctgccacctgaccctctggagctagagccactgcgtgacgcagagccacccggtgccctgcacaccaccagacccagtgccataacgtgcttctgcacgcccttctcagt

SEQ ID NO: 476102 - DNA, 1335 bp, Homo sapiens
ccgaggctaccggtgggtatcgaatgccctcgagttgttcacggtccggcagccgccccgcatcggggtgtgcctgggcctggtccccgcaggtggctctcggggccggttctcggtgccgccggttctcggtgccaccagttctcggtgccgccggttctcggtgccgacggttctcggtgccgacggttctcggtgccggttctcagtgccggttctcggtgctgccggttcttggtgccggttctcggtgctgccggttctcggtgctgccgattctcggtgctgacggttctcggtgctgccggttctcggtgccggttctcggtgctgccggttctcggtgctgccggttcttggtgccggttctcggtgctgccggttctcggtgccggttctcggtgctgccggttctcggtgctgccgattctcggtgccgccggttctcggtgccgccggttcttggtgccggttctcggtgccggttctcggtgctgccggttctcggtgctggttctcggtgctgccggttctcggtgctgccggttctcggtgccgccggttctcggtgctgccggttttccgtgctgacggttctcggtgccggttctcggtgccggttctcggtgctgccggttctcggtgctggttctcggtgctgccggttctcggtgccgccggttctcggtgccgccggttctcggtgctgccggttttccgtgctgacggttctcggtgctgccagttctcggtgctgcccccgccccccaggcaggacccaccaccccctctgctctgcccgcagcgaccctgtccctgcaggccccgcgccccaaagaccagggacctcgcccatccaggttcctaaatatgaaggaaatggcggtcaaggacaggaaagagtaggttttcgttatcttagtgaaatgaatgggggctcagtagatgattctggtttcgagaactctcgctgcccccatctcctggcactgactcctcagccaccagcggggagctgtgcagagcccggggactcactggggtgggtggagaacgtgtcctgtcacccagagccaccaacaaatgccactttctacgtgtgctgagaccttcgaaatatcagggatgtctgatgggagctttaatcattactttctgaaaaaaaaatctctatctctatctgtatccatatatacactgagctagtttacgtggtgtataagaggggtttctctcttgcttattgggggagccacgaagtcattactgaactcagtacaatttttaaaagacttaaaactatccaacccctacttcattttcaaatgttcacct

SEQ ID NO: 476103 - DNA, 623 bp, Homo sapiens
tttatgaatttgtgttgggccacattcaaagccgtgctgggatgcatgcggagcacgggccatgggctggacgagctcggtggagacgaatgtggaggatgtgactctggagatgaccaagcaagaggagggaaggtcttcctggacccgccccgaggcattcgcagggttggaacccctcagccccgtgcagctgagggcctggagccgagaagtttccattcgacggtaaccacaacggggacatccctcaatgagatcaacgtttttgtctgtgttgctcactgcaccctcagaacacagaacagtggctggcacataataaacactcaacaaacattgattaactggaaacctgggagtgattatagcaatgggtcctgcacaggaccgactggatttgggggttggaaaaatttataggaatgcattctgggcaggcctgccctccgaaaccccaatttcctcgctgtttgtcttcatgccccctctttcctcccatgcagggcccagccatgtggacaacggggaggagctggggctttgggcacagccctgctgcagagcctgggcctgagcagctctttgtgagccagggtcctgtcacatccgtcttctgtgcc

SEQ ID NO: 476104 - DNA, 1198 bp, Homo sapiens
ccgcggaagaaggcgttttcattactctgatactaaattaaaagctttctttgtccttctgtctaatatggagcactggcattgccagcccggcacagtggcgctggatgacagggactacaccagaatcatgagggcagccatcctgggaccgagggaaaaggcacagcatttgattggcgagtctgtttcttgtctccgggctgctttatgcttttccctccagcattgtggcccctccatccccaagtttatagcattctgcgagcctcgggtaagagagtatttccatcactggccctggtgcatgaaagccacactgccaacttgtcattatcaccagtctgggttcctttccgatggagtaagggaaactccaggcccagactggaagaagcttatctccgccggggaaatgtctgcaggagattccactggccctttaagcaagaaacgacttcacagttgaaaccttggtttggaagactcttgtttcaaatctcggcagcatccaatgagccctcctcatcagctgatggtgaagtagctgcatatcaagaattggtcttcccaaagcctaggctttcaggagaacttggaagttttcagacaaaaaagaacggtgtttgtaaaccagttaccaaacccaaaccttcccctaaccacacaatacctgaagtcaataattagctcagagcatgaaataaaaaatctaaagtaataataatttactgaaaatatatttctgtcttcaaaagttttaacaagtatgacctcatttaatgtctttccctctgaatgtaagtaatggtagtgctaatgccttagctttctgcacgactgaaataagacactgcttgtgaagatgtttttgttgttgtctcacaagcgcttctgaaacatttgctaagcttgacccaactctgaatcccgctacattttaaagtattggcatcataccgagcacattctctgaccacagtgtaataaaccagaaattaataacaaaaagatgactagaaaatactcatatgttttaaaattaaacaatgtacttccaaatagcatgtgccaaattaaaaatgtaaactaaaaattaatatgaagtaaatgacaaggaaaatactccacatggaaacttacaaaatacaactatagccatgcttaagggacatttatggccttgaatgtgtatact

SEQ ID NO: 476105 - DNA, 1373 bp, Homo sapiens
agaagccccctctgtcttcctgcagcacaggaagcaggtgacctgagcaggtggggctttcagcaggtgacctgtacaggtgcggctttcagcaggtgacctgagcaggtgcggctttcagcaggtgacctgagcaggtggggctttcagcaggtgacctgtacaggtgcggctttcagcaggtgacctgagcaggtgcagctgtcagcaggtgacctgagcaggtgcggctgtcagcaggtgacctgagcaggtgcggctttcagcaggtgacctgagcaggtgcggctttcagcaggtgacctgagcaggtgtggctttcagcagagcagaggaagctgcggagacatgaggactaagtgtcacgtgggatcctgcgcaggagggaagactgaggggacgcggatcaaggacgccctgagctgatgttgattatcaacactgcctccatgacgctgactaccgacgccgcctccacgacgctgactaccgacgccgcctccacgacgctgactaccaatgccgcctccatgacgccaccaatgtggcctccacgacgctgaacaccgacgcggcctccacgacgctaccgacactgcctccacgacgctgactaccgacgccgcccccacgacgctgactaccgacgctgcctccatgatgctatcaacgtggcctccacgacagtgaccaccaacgccgcctccatgacgctgactaacgacgctgcctccacaacgctgattaccgacactgcctccatgactctaccaacgtggcctccacaacgctgattaccaacgctgcctccaccacactgactaccgatgccacctccacgacgctgaccactgacctggcctccacgatgctgaccaccgacgccacctccacgacgctgaccactgacctggcctccacgacgctgaccaccgacgccacctccacgacgctgaccactgacctggcctccacgacgctgaccaccgacgccacctccacgacgctgaccactgacctggcctccacgacgctgaccaccgacgccacctccacgacgctgaccactgacctggcctccacgacgctgaccaccgacgccacctccacgacgctgaccactgacctggcctccacgacgctgaccaccgacgccgcctccacgatgctgattaccaacactgcttctatgactgaggcagatgcaccacaccaggaaaaacgttcacggcatcagaaagtggtgtggggcttgtgggattccagtactgctttctcagtttttctgtaaatgtaaaataaaacagagttctaagaagtttgcttaaaaaaaccacatccatgtcagacatttcagacatgtggaaagcccc

SEQ ID NO: 476106 - DNA, 793 bp, Homo sapiens
tccttgccctccttcctgaaacagctcatctttgtcctggaaaaatgtcatgcttgaggcactttggcccttgggaagaacaagagggaagacgggaacctcctttttctggagctcctactgcgactggaccttgctggccggggccagcacctgctcctggaatgaattaatcagcaaaatcattgcagcccccacattattttcaacaaatattaaggtgttctctaatctttctcccattttggttattcatagtgtatcaccactatctgaaatcaccttgactatttgtctaggtgaattatctgtctccccacgaggatgtacactttatacttacaaggtcctgttcatctcactagtccctggttcttcctgtctaaaacaatactacgcctgtagtaggagctcagctgctattcaggtcaatgaaaggtatgaaggggtgactgaataatgatttaatgcaacaaggtaggacttcaggtgcccttggcggtcctgtcattagcggagtcattgtggaaagaaatgcaccagtgctaagtagaattaagcacgtaaataaagcagtcgatttgttaggttaatcccttggcaatagctctcagtttattttatgggcacattcttattttatttcattatcatttattagattcaaaatattatgagagccttgaggacccatttaaaataatctccacatccacagccatcgcagattatgacaacaaatgtgcttaattgaatcatgaactgtcacactgactccgctgccccacgctgc

SEQ ID NO: 476107 - DNA, 677 bp, Homo sapiens
acacacttaaactctatgaaaatggttctgtgtctgttctctaagattaggagctcccttctttcacaaataagggaaaagtacactgaaaaaaaatgttttgccgtgctgtgtcctctgcgagtgtgtattcagaactacaagaaatcactttgttccttctcctgtgtactcacggaacttgattcttgccctgagaagaaggcaggaaccggacacctccatcaccctctctttttacactttccaacatttctccttaatgtctttgtgtctatggttacccccaattttaccctgcggtgttcttcagatgagaaagactgcaggttacctactggagtttcactgccccacatggcctgctggagcctggccttggggtagaagctgtgaagctggtatattcactctgtgccaactcctctcctccaagtgctaattccagcccagaaactgcctgctttggagcatgatgtaaacttggcctcccttcatgctacatacagaccacggaaatgggacaaccaccccagggtgctctgggaccagcttgcattgatttgcaagagtgattgttgaacattctgcaatttccaagctggctgttccatcatttgtagcttgaaaccagaagttgattaaacatggtgggaccatttataccatggtacttg

SEQ ID NO: 476108 - DNA, 833 bp, Homo sapiens
cagtctgccagctcagagacagcaggagcaggagagctccagcacgatgggggtggacaggtggtctcggctgcaggggtagcatggggacggaggcggccggcccgaaggaccatgggtcagaagctgagtggcaggccctgcagtggccactgtgagtgtggggtgtggctatgctgtgaccacacgaccaggctgagggctgcttggagcctgcatcccaggctcacgctggccaggctcatcactatctgtactcagagctgggttgaccgtccttccgggcctccgtgtgtgccctggactgacctccagcctggggtgtggacagcagcatgctccctccagcaggctgccttgccctcctctgcaggcctttggctgctgcggccccagctctgggccatgagccgggctgggtcctttggcaggcctccgctcgttcatcccccaagagatccacgatgccaagaaggtggccggacagaggtgaaaagccagctctggaggtttagatgctatgttcccgacttcctcaccatgcttcttcctgacgtccttaactcctgcctctgagcaaagttcctgtgcatgtttcagaaattaagaatgatgaacaagggaacactgagagggagggaacttttgtgaattgatgatgatatttaggagccgttgctggaaagctgtaactgcctgaactagcggtgggtcaaaacttggtccagttatctcaaatacccacttgtatgtttctgggtagtcttttcaagaattaaaggaaagtgaaaaaaaagaaaaaaaagcatcgtttctcagcctttctcatttac

SEQ ID NO: 476109 - DNA, 1210 bp, Homo sapiens
taactgtccagaaacatgtgcacatgaggtgtggagaggaggctttcctgcccagcttgggatctgcaggggtgggcagaggtggcacaggccttgtgggcagaggtggcacgggccttgtgggcagaggtggcatggaccttgtgggaagaggtggcatgggccttgtgggcagaggtggcatgggccttgtgggcagaggtggcacgggccttgtgggcagaggtggcacgggccttgtgggaagaggtggcatggaccttgtgggaagaggtggcacgggccttgtgggcagaggtggcacgggccttgtgcgcagaggtggcacggaccttgtgggcagaggtggcacgggccttgtgcgcagaggtggcatgggccttgtgggaagaggtggcatgggccttgtgggcagaggtggcacgggccttgtgggcagaggtggcacggaccttgtgggaagaggtggcacgggccttgtgggcagaggtggcacggaccttgtgggcagaggtggcacgggccttgtgggcagaggtggcacggaccttgtgggaagaggtggcacggaccttgtgggaagaggtggcatggaccttgtgggaagaggtggcacgggccttgtgggcagaggtggcacggaccttgtgggcagaggtggcacgggccttgtgggcagaggtggcacggaccttgtgggcagaggtggcatgggccttgtgggcagaggtggcacggactttgtgggcagaggtggcacgggccttgtgggcagaggtggcacgggccttgtgggcagaggtggcatgggcctgccttcaggccctggcaagcctcacctgaagtgctcacggctctcgcgcgcagacatggcttcacccccactgtgcacactggcgctgggccctgcagatgctgcccgtggggctgctgacaccctgggccagcgggcttttccacggagaatggaaacggcctggactgaaactgcacaggggcagcagagtcaacagggcagctgctctccctgctctgtgactctcaacgggactcaagcatttctccttcgtagtggagtagcaaactcgtgttaaactaggcaatgcctgttactagctgaaatttagtgaagaaaaccaattatacacaagtttatatattccattaaatattgcatgaaataaaataatgcttttttggaaggataaaa

SEQ ID NO: 476110 - DNA, 721 bp, Homo sapiens
aggctgattggcgagtggattccagcgggactcagggcatatcctgttagtgatgatactaacaggacgcttcagcttcaggtggcaggaggagaaagaaattggcccaaacacgctgaaatcaaaaggaaattccttatctcctgtggcccaaacggcagcttcattccaggtcctgcgctttgcatatgcagaagatgtcaccacaagggagggaggatggggacagggtcccaggtccagggcccctagtctcagccggttcagctgccctaacaccagagcccgggtagtaaccacagacatctatgtccttgtctttctcggggttggaaggcgaaggcctctggcaggggtcacagaccagcaaatccgtcagccaagtgctggaagtgggggagggcgtctagaggctcacggcagccacatgtatccaaataggaggacaggagaaaagaatgaagactattccatgaaatcaaagaaaaacagaaaaagtggagataactgagaaaaacctgtgaattactaatttcaaaacgagcaactagcggaaacaattgttttctcaattccaccacccagagaccctgccgggaatagaactatgttttcagtcctctccggttctcctttatcctggtcttcatctgtccgtttctctctttctctccctttctgtttcatttctctccttctcaacctttccgtacatatattt

SEQ ID NO: 476111 - DNA, 791 bp, Homo sapiens
tttgtcagagaaagtggaggccggagcccgcggctcacccccagcactgccagggctgagaagcggccaatgcccagcctgacgctggacagcttgatcaaaataaataagcaaactttattcaatgtcagatgatgataagcaggagggcagccggacctgctggcccagaagagccagctgcaggcatttcctcccagcatggaattcagtgatgcccagaagagctacctgcaggcattttcccccagcatggaattcagtgacgcccagaagagccagctgtaggcgtttccccctagcatggaattcagcgatgcccagaagagccagctgcaggcgtttccccccagcatggaattcagtgatgcccggaagagccagctgcaggcgtttccccccagcatggaattcagtgatgcccggaagagccagctgcaggcgtttccccgatccgcggaattcagtgatgcccggaagagccagctgcaggcgtttccccccagcgtggaattcagtgatgcccggaagagccagctgcaggcgtttccccccagcgtggaattcagtgatgcccggaagagccagctgcaggcgtttccccccagcgtggaattcagtgatgcccggaagagccagctgcaggcgtttcccctcagcgtggaattcagtgatgcccagaagagccagctgcaggcgtttcctcccagcatggaatttggtgacatcactctgagggcttgaagggaactggccatggtgggtgtggaaagccccgggtgatgggtgct

SEQ ID NO: 476112 - DNA, 803 bp, Homo sapiens
tacttggtcccccagcagtgccggcccaccagcgctgttctcgatttctcgccgggccttagctgccttcccacgggggcagggctcgggacatgcagcccgccatgcctgagcctcccacccactccatgggctcctgtgcggcccgagcctccccgacgagcaccaccccctgctccacggcgcccagtcccatcgaccacccaagggctgaggaatgcgagcgcacggcacaagactggcaggcagctccacctgcagccccagtgtgggatccactaggtgaagccagctgggctcctgagtctggtggggacctcaaggtttgtgaatgcaccaatcgacactctgtatctagctgctctggtggggccttggagaacctgtgtgtccatactctgtatctagctaatctgatggggacgtggagaacatttgtatctagctcagggattgtaaacgcaccaatcagcgccctgtcaaaacaggccacttggctctaccaatcagcaggatgtgggtggggccagataagagaataaaagcaggctgcccgagctagcattggcaacccgctcgggtctccttccacactgtggaagctttgttctttcgctctttgcaataaatcttgctactgctcactctttgggcccacgctgcttttattgagctgtaacactcaccgtgaagatctgcagcttcactcctgagcccagcaagaccacgagcccaccgggagcaacgaacaactccaggtgctaccttaagagctgtaacactcacggcgaaggtctgcagct

SEQ ID NO: 476113 - DNA, 1556 bp, Homo sapiens
tgtcctccttccagccacctctgctctctctctgcatcctggtgcagagctgtgggcaccgcgtggcattgccccgcctcccagccatgctccgcagacccctcctcccactgcctcctctgagcgcaaactcatccatcctgtggctccactccggggagcctgtgcctgggactctggccaggctcgaggctcgagcccctgggaacagtcagtccctgtcagctggcagggagcatccaatcacaagagcatctggacctgttggtccatctccacttggtcattccatgggaagcacccactcactagaggtactattccgttttcatgctgctgataaaaatatgcctgagactgggaggaaaaagaagtttaattggacttacagttcctcatggctggggagcctcagaatcatggcaggaggtgaaaggcatttcttacatggtggcagcaagagaaaaatgaggaagaagcaaaagcagaaacccctaataaacccattaggtcttgtgagacttattcactatcatgagaatagcactggaaagacaggtctccatgattcaattactgcccccccagatccctcccacaacacgtgggaattctggcagatacacttcaagttaagatttgggtggggacacagccaaaccatatcactagagaatttcgacctgtaggtccatctccacttggtcattctatggggagcaccattcactagagtatctgggccagaactcactttccttcttggctctcatctctgacctctttctggcacctgccctgacatgacccctgtggggtccagggggaaaagatgtttcacgtgccagccatggaggtcagctctggttgcagagctagctggagaacagagcagagaagacctggaatggagacggcgcaatgagatgctcctgcctgcactgcctgggctcctacttgcctgataagttgtgtggtctcagcatctggagttgttgtcacattttctctcactgttcctcacccttccactttaagaagcattaggtttcccatcatcctccttttatactccatgagcaattctgtcttcattgccttcctatcctttaggcctgcatctattcctcctgtctttgcccagttgaagtagaaaacatctagtccagtgtttttgtttttcaaatgtggactatattaatactcttcttaggaggctaaagtcctagcacaatttttttaatactgtatttttatttttatgctaatctaaacctaattacttttactagttatgatgacaaaactttttctacagtgaaaacgtgcagttaaacggtatccctgcaggctaaacctctgcttcttatgtatcctcagagaaatgcagagaagatctatatattttccacatttaaaaatgctcgatgttacattctcacagaccccatcctcttggtcactatttagcacttggccttttgaagaactttagggttagtgaggaaaggacactgggaactgggtactccccaagcacacagtggtgttcccgt

SEQ ID NO: 476114 - DNA, 1546 bp, Homo sapiens
gagttctgctagcatgtgcggctctgtggagcctgggatggcagacacaggagatgccagccctgcgccttcagacagcagcccagctcgacgggacctggaagagcatggtgtggaaactgaaagaatgcagctgcatcgttgtcgtcatccctatcacctcatcattttcatcatcacctcctcctcatcatcatcctcatcgttatcttcatccccatctcctccttctcatcatcatcctcatcataatcatcttcatcaccatcctcttcctcctccccatcatcctcaacatcattttaatcaccatcctcctcctcatcctcataatcatcttcatcaccatcctcttcctcctccccatcatcctcaacataattttaatcaccatcctcctcctcctcatcctcatcaatccatcctcctttttcttctccccatcactgtcatcatcaatcatcttcatcaccatcctcttcctcctccccatcatcctcatcaccatcttcatccccatctcctcctcctcgccatcatcctcatcatcttcatcaccattgtcctcctcatcattatcttcatcaccattgtccttctcctcctcctcaccatcatccttaccattaatcatctttatcaccatcctcctactcctcaccatcattctcaccgttatcttcaccaccatcctcctccatccccccattatcctcgtcatcatcttcatcaccatgatcctccttctcctgatcatcttctccatcaccatcattctccttcctattatgctcatcatcatcttcatcaccatggtcctcctcctcctcaccataatctttacgatcatctctttctccatccccctcctcttcaccatcatcctcaccatcatttccatcaccatcatcctcctccttctccccatcatcttcatcatctctatcaccgtcttcctcctcctccccatcattcttaccatcatcttcatccctgtcttcatcttcctcctccccatcatcctcctcctcatctctatcacaatccccctcctcctcatcatcattctcacatcatcttcatctctgtcatcctcatcatcatcatcctcatcatctctatcaccatctccctcttcctccccatcattctcaccatcctcttcatccctgttatcctcctcctcaccatcatcatcatcaatgatcttcatcaccatcctcctcctccccaccatcctcatcatcatcttcatcaccatcatcctcctcctccccattattctcattatctccaataccatcatcctccttctccccatcatcttcatcatcttcattaccatcaccctcttcctcctcaccatcatcctcatcgtcttcatcactttcctcctcatgatcttcatcaccatcattatcctcatcctccctctcctcaccatcatcctcatcatcaatcatcttcatcaccatcattaccctcctcatcacaaacatttattgagcacttaatcagtgcaggtcacttggtaattgagccccac

SEQ ID NO: 476115 - DNA, 1763 bp, Homo sapiens
ggtgcagtaacccagcccctgctgagcgctaagcactccacacccagttccaggccataagggcactgggtccagggagctggcaggagggctgctgtgctcaagggaagggctctgggcggcaggccagggcaatggacgcaggcagtgtgcaaaggcacagatgcacctctgctcacctgctcagcctctaacacacctgtatgccagacattgccacaccgcccaggtggccagctcctatggcaacactaaagctgtgtctgtctcctgcaccaaccaacagccatggaaagcggcagccatggaggatgcaggaatttcttcccatattcaaagtaaagagaagaccaagcccacagcagaggcctcactcacgtgcgctctgggccagagcaggcctcaggcacttcagctccagggagaccggccagcaaggtcgggtatttggaaggagctcaggaagcgttcccctgcaggaagccgaaagcaggagagacaccaggggccgggagatggaattggaatctgcagcattcttcaggggcggaagccccaagccgtccatgtgaggctgttggccaaggggctgaggggagggcacgaagtaactcactagagacaagacacaggtgagtcctccaggcacccactcacaggaacagcgtgaaggtcagctttcagaaacttcagtaattttaaaaggatctgaagaggactttaaaaatatctaagatccttaaagggatctggtgggaagagactccacaaaaacacacaggacatgatgaggtgaggagtgcaaatcagggcctaattgctgatgattcatctgcagaaataaatacttttgtcacgctggatccagacacgcatgtgacctcgttttagcttggttatctgtgaaaactctatttccaaataataatatagttccaaacaatcaaatacaattttaaatattaccacattttgaagtactgagggttagaatttcaacatatcctttttctggggaacaggacacaactcaactcttaataccctcttacctgttagtgtgattaccagatattttagttatttgatattaatattggtatatcagagtttcactatcatttcccttcctcttagtttcaaattgtttctttgttttaagaatgtcccccataaacagcataaaactggattttaaatttcaatctcctaacctctgtcttgtacaaggtaagataactctccgtgtatttattgtgactattgattcaattagaataattttaatttgcattctattcttactttgctttgtttttctcctcttcccttcttctggcttgtgttggaacggaaaagttttatctctttagctcattccctttgaaggatgtttggatgtttatagttttacatcctattaaagattacctaaacatcttagtatgctattcaattttatattatcttacaaagttttgagttattcattatctctgctctcctttcaacaaagggtcttgccacagtttaaccctccttggaacccctcggtcttctgcacctgggatacctgaaatgtacgttcccccttaacaaataagacatagaaatcagctttgccaagagcttacaaggccattttgctgagagcttcggctgttttccctcttattcctgaaggctgttttcttctgctgaactacgtgtattaataaacctttcatcagtgcttgcaggttttaaattcagtttccctaccc

SEQ ID NO: 476116 - DNA, 558 bp, Homo sapiens
actaactttgcatctgcagaatacatgggtgtactccttcctttttcaaatacttttatcaaattcaatccagactcaggccaggaaaaacacatgtgggctgagctgagaaaccaaggcaaggagagaaatggaatatttgcatccctgtcagacgagatgcaaacagatgtgaactctgcagttgctggcatctcagaggcttgcaggccagttccggggtcagcttcctctcacccgggctctgctgatgtcctggtgtttaggtgcaggggactgagactggtgcagggcccttggcacaccccacagaaccacatggtgcccatggcacgcgaatgcgactgggcagtgctatcactcggaaaagggcctacagtcactgttactgtgaggcatttgcaagggccgtttaatacaccgcgtggaaaccgtgttcagtgtctactcacgcagaggcctgccttctgacacacacatcaatcaagctcagaatcgtgccgttcaaccatacctcttgttgttgttaatttgcaatttatgtttttgcgcaagaag

SEQ ID NO: 476117 - DNA, 2986 bp, Homo sapiens
gcccagcagggctgcgtgggactcgggctatgtgggactcggactcgggctgtgtggactcgggctgtgtggactcgggctgcgtgggactcggacttgggctgtgtgggcctcaggctgtgtgggactcgggctgtgtgggcgtcaggctgtgtggactcgggctgcgtgggattcggtctacgtgagactcgggttatgtgggactcaggctgtgtgggactcgggctgtgtggactcaggctgtgtgggactcaggatgtgtgggactcaggatgtgtggactcaggctgtgtgggactcaggatgtgtggactcgggctgtgtgggactcgggctgtgtggactcgggctgtgtgggactcgggctgtgttgactcgggctgtgtgggactcgggctgtgtgggacttgggctgcgtgggacttgggctgtgtggactcgggctgtgtgggactcgggctatgttgactcaggctgtgtgggactcgggctgcgtgggacttgggctgcgtgggacttgggctgtgtggactcgggctgtgtgggactcaggatgtgtgggactcaggatgtgtggactcaggctgtgtgggactcgggctgtgttgactcaggctgtgtgggactcgggctgcgtgggacttgggctgcgtgggacttgggctgtgtggactcaggctgtgtgggactcgggctgtgtgggactcgggctgtgtggactcaggctgtgtggactcgggctgtgtgggactcaggctgcgtgggactttggctgtgtgggactcgggctgcgtgggactttggctgtgtggactttggctgtgtggactttggctgtgtggacttgggctgtgtgggactcaggctgtgtggactcgggctgcgtgggacttgtgctgcatgggactcaggctgtgtgggactcaggctgtgtggacgtgggctctgtgggactcgggctgtgtggacttgggctacgtgggacttgggctgcgtgggactcgggctgtgtggacctgggctgtgtggactcgggctgtgtgggacttgggttgcgaggtactcaggttgtgtggactcaggctccgtggactcgggctgcgtggactcaggctgtgtggactcgggctgcgtgggactcgggctgcatgggatttggtctacgtgggactcgggccgcgtgggatttggtctacatgggactcgggctatgtgggactcaggctgtgtgggactcggtctgtgtggactcaggctgtgtgggactcaggatgtgtggacttggtctgtgtggactcaggctgtgtgggactcaggatgtgtggactcgggctgtgtgggactcaggatgtgtggactcgggctgtgtgggactcgggctgtgtggactcaggctgtgtgggactcgggctgcatgggactttggctctgtgggactcgggctgtgtggactcgggctgtgtgggactcaggctgtgtggactcgggctgtgtgggactcgggctgtgtgggactttggctgtgtgggactcgggctgcgtgggactttggctgtgtggactttggctgtgtggactcgggctgtgtgggactcaggctgtgtggactcgggctgcgtgggacttgtgctgcatgggactcaggctgtgtgggattcaggctgtgtggacgtgggctctgtgggactcgggctgtgtggacttgggctacgtgggacttgggctgcgtgggactcaggctgtgtggacctgggctgtgtggactcgggctgtgtgggacttgggttgcgaggtactcaggttgtgtgggactcaggctgtgtggactcaggctccgtggactcaggctgcgtggactcaggctgtgtggactcaggctgcgtgggactcgggctgcgtgggatttggtctacgtgggactcgggccgcgtgggatttggtctacgtgggactcgggctatgtgggactcaggctgtgtgggactcggtctgtgtggactcaggatgtgtgggactcaggatgtgtggactcggtctgtgtggactcaggctgtgtgggactcaggatgtgtggacttgggctgtgtgggactcaggatgtgtggactcgggctgtgtgggactcaggctgtgtggactcgggctgtgtgggactcgggctgtgttgactcaggctgtgtgggactcgggctgcgtggactcgggctgcgtgggactcgggctgtgtggactcgggctgtgtgggactcaggctgtgtggacttgggctgcgtgggacttgtgctgcatgggacttaggctgtttgggactcaggctgtgtgtacgtgggctctgtgggactcgggctgtgtggacttgggctacatgggacttgggctgtgtgggactcgggctgtgtggacctgggctgtgtggactcgggctgtgtgggacttgggttgcgaggtactcaggttttgtgggactcaggctgtgtggactcaggctccttggattcgggctgcgtggactcaggctgtgtggactcgggctgtgtgggacttggactgtgtgagattgagactctgcctccttccggtcactcagctttgctccttccggtcactcagcttgccccaacttgcgtgtggtcattctcaggctaggtgtaagaacacaccattgcacctaagtagacgaaatccagtggagaggggaaaatctcaatctctcctttgaaaataaagttgaattaaatcacagacaagcaaggactgctgacagttctgggagaggctcgagggactgactgtctcttgcttcagccaggagaaaagagaggtcccgggggcctggccgcccgagctcaggcgtcagccggtatcagagccggaacaggaggactgtgcgggagattgttggactcaccgcgtcccagtgggacttggcagctctggccagttgaatatgagtaggtgtttaactcaagtagaagaggaaatc

SEQ ID NO: 476118 - DNA, 758 bp, Homo sapiens
gttccctttcctgtgtccaggtaccattggaaaagcacagtattagcatgggagtgacccagttttccaggtgctgtctgtcacagcttcgcttggctaggaaagggaattccctgaccccttgcacttcccaggtagtatggaggacagtgcagagactgactttccattccagtgacatcaccatcatccacatgtttgattgggcaaaatcttcaagctctccaaatgaactatttcacagcttctcacacctgtgcttggcttcagattgggatggcacttgtgtgaggtgttttcttctacctggaagactcaggcacttcaaattcaacattttggctcacaaactggctcctaacaagcaaattaatatgtattctaatatatgtaacacaaacataatgcacatattttttaaatcgaattttcttaaatattttcccaactaatacaaaacattttcaatttttacaagagaatcttgtaaaacttgccccatagacatacttacgtatatatatatgattattatagaatttattatatatgtatataaagaatgaataaaagaaaaaagtaaaataaaacaaccattaattattaatatgtaaaatccccagaagaccttcactctgttgaagaaagtcttctgaacagattttcagacataaactcccttcacagcacaactggggacgaatttcatgtctttgacagatggatgagaaagcgtgccaaaaacagagtcattttcc

SEQ ID NO: 476119 - DNA, 563 bp, Homo sapiens
agactttatgactaaaacaccgaaagcaatggcaacgaaagccaaaattcacaaatcggatctgattaaactaaagagcttcttgactaaaattttcagtttttatttcctggagtcttttaaactgaagcattgtgaagaccaaaaacttaaaagacatgttgattgtaggacatatattagtttactcaaatacgcaatgtgtttgtttcaaaaccacatgtataagttgactactatttctgagtgggataaaaaacttcatggaaacagtttatatagagaagagggtccaagtttaaaccacaaatggctccaatctgtagaaggagagtgcagaaagcaaaatgaacaaacagaaaactgccagaaatggagactagaagaaacagcaagacacctcagaggacttgctggtaaaaatatagaagaattattaatattcattgcatttatacatgtgtattgaaaagtgtttggaaaacctaaatgtaatatattcacttagtctcaaaaggattggaataaacctttgtccctaaaggaagttcttaaaaggaatg

SEQ ID NO: 476120 - DNA, 3168 bp, Homo sapiens
tctcttccgatcgaaggtttttatcaattgaagagtttgtggttccacgggcttcaaagaatgaaggcttggaccgcagcagtgagtgttacagctcaatttgagaagcatgcagacctaaagagagtgctgggtcaagatttattaaagccaaaaattcaggcacagctgaccagtattaacattaaaaaagataccttcagactgacaaagggaatctttgtaataatgcgacaccaacatgatagacagcaggccctgatagaaatccaagtgttttaccccaaaatatatttctttgacatagttttaaatggccctgcaaagctgtctcttttggggaaaaatctacattctgtagaaaatctctgtacctttttaagtcagacaagaaacatttgcaatctattctctctgatgcctgctacctggaggcttcatctacataataagaaccttggtctctacaccctcttatcttaagccagacactcccttctattgatttcaggtctttagataaaactctttcaaccaatagacagtcagaaaacctttgaatccacctatgacctggaagtccctctccacacttcaagttgtcccacctttccagacccaaccaatgtacatcttacatgcattgattgatgccttatgtctccctaaaatgtataaaaccatgttgtagcctgaccaccttgggcacatgttttcaggacctcttgaggctgcgtcacagtccattggtcaatcatatttggctcagaagaattctcttcaaatattttacagagcttgacacttttcatcaacagactgcataatttttcctggcattatacatttctatattcacttcaatcactctgatgctcatgatttagcacataaattatacggaaaatacttaaatgtaatgttcaatttcacaatatagattagattgttactgagcaagatggccttaaaagttccccttggcttgactacactgtacacaggtttcttctctggtctttgatcttcctttccttagagcatttactttagaaaacttgaaaccaaattctttctctgtgactttgagatataaatcttcttttagcttcttgatggttttacatcccaggattctttttcatgtggaccttggaactgtccttttgaaatgtgatcatcaagaaagacagtgctcctattctctcctttctgtgggaggggaggagcctgctttccattagtaccaattatagaacacagataacctaatcacaatgacaaattttttccctaaaatcttccaatttttaaaaaatttatttagaaggaacaaatgcagatttgttaccaataatttttcagtagctcatcctagccttaataactctctggctttgtgtttcaatagatttgggttcagtctctctccctttatttctcttcagccctactgcaatcatcttgaataaagtcttccttacctctttaactcgtctggtgcaatttttctttgacactaccagatgttatgctttatttgaaatgttttccaaagacatagggccagagatttatataaaagtataattagattaggcaacaaagttaaataggagaaaaatacatttaagaatattatgtgcatattaaaatgatttcatacatttaatatagaaaaaattcattaaatctaaaacatatttttaatgcacttgatatggatctagttttaataggaaaacagtatcaatcatacatatatttgtgtgtatgcatataatattcatcaaaacagcaaaaggatacagtggtcttcactagaaagagatgttattttataatttaaaatttattttcttatatttctaccagaaaggggtcccaatccgttctccatgagagggttcttggatctcatgcaagaaagaatttggggtgagtccataaagtaaagtgaaagcaagtttattaagaaagtaagcaaggcaaaactgcagaatgtggtatctgaattttcaaggtgccagggtgacttgtataccattttcgcacctagaaactagtccttaactggttatataatttgtagatatcttctctgcatgtgtaggttagtctattaactttgaatgtggtatgtttgttaaacatacggttaaatgaagtcgattttgtccagtttttcgttcttggttgtacattttatatctcatctacaaaatctttcctactgtcactacataaagatattcttctctattttatttttaaaattacacaattataatatttatgtttaagtctttaatctatctgcaaattactaacatataaagtgtgataggcaaatccaatttcatccttttttcctgttacattattacattggttcattgactgtctctgtgctggtatcatactgtttttattgatacagatttatataaaatcctgataaatggcaaacttattctcttttttaaaaactgacttagttattgatcacttattaactttttattaagattttaagatcagcttgtgaagttctgtaaaaaaagccattaaaattttgaatggaattgcattgaattcataagtctgttgaaatagtatgttttatgaatacattttataatataaaaatattttacaaattctgtgataaattttacttggttattatatatgatatatatataacatcatatataataatatataatatatactaacatataagttatatacataaatatatttgtgcattggattaagtttactattattatctttagcatgtatagacctattttttatatgagagattacctataattttactggtatagcctttacccagttttaaaattaaagtaatattagtttcctaaagtacattgagaagttttagcccttcttttttattttttaggacaatgtacatgcattcatatcatctgtcctgtgaaggtttgatagaacttgtatgtataaacttatgggaaggagaagagagtgttgtatgacaaaagcaatgtgaaaatattctttagcaatacagatagtgttgatttgctccaagaagagaaagactgagaattgaccatataatttagcaaaatggatatcattgttgattctgattggagtacatctagtgac

SEQ ID NO: 476121 - DNA, 476 bp, Homo sapiens
tctgcagcaagcatgggcagtcccgcagcccctttactcacttataagtgtacttctgtgtatggcttaaattttcgccttttttcagggggctcacaactttttatcttcagcttatacctcccctctgagcatcagacctatttatttatccaactacctaatttggggttctactgtatatctatcttaagagaaatgcaaatcaaacttttcaaaactgaatcttacgtttctcctacatcttggttctcagcaccattccattgcagacaacaatcatctcaggccacccttggatctcccagtgctgatcataatctggaatgtcaaaatcccaaaggagcaaaatccctaatatttaaaattcctaatgtaaaatatcccaaaaatcacaatcccaaacaaacagttacaatcctatatttcaaaattctggaagttgaattctgagaaagggattagattgacttggc

SEQ ID NO: 476122 - DNA, 988 bp, Homo sapiens
aataggaacagctcgtctatagctcccagcgtgagcgacgcaaaagacaggtgatttctgcattttcaactgaggaaccgggttcatctcactggggagcatcggaaattgggtgcaggacagtgggtgcaatgcactgagcgtgagccgaagcagggtgaggcattgtctcagccgggaagcgcaaggggtcagggaattccctttcctagtcaaagaaaggggtgacagacggcacctggaaaatcgggtcactcccaccctaatactgcgcttttccaatggccttagcaaatggcacaccaggagattatatcccacgcatggctgggagagtcctacacccacggagcctcgctcattgctagcacagcagcctgagatcaaactgcaaggcggcagcgaggctggtggaggggcgcccgccattgtcgaggcttgagtagtagtattccatgtattacactaccctcattactactgtgttaaaatcagtcttcccattttgtggtttaaatcctccaactttgttttcttcttcaagattggcttatttatacattttagaatcaacttgtcaatttctaccaaagatgggagattttgacttggattggattaaatctgtagataaatttggagagattagcttaattacaactttgaggtttcaaatgactaacacgatatatacccctatttacttagattttctgtccttttgcctctttcctacccaacgctattatccctttattatcctgtcttcatctcttccaccgctggaaacagataatatcttgactatagtagctgaaaaacatgactccctcacgtcaccgggtcaccagtgggagctgaattgtttaaatatgaatgatggaactgaaggagcatgagcaaacttcagggtatttcattgttagctgtggtgtttgacagatgtttgtagagtccttccatttgaaatgtctttctaggttgaatt

SEQ ID NO: 476123 - DNA, 597 bp, Homo sapiens
aaactgctttttatccagtaaaatatgaaagctggaatagggtcaatttgtttggaggtctccctggggcacccaggagactcctcagagcatgctacaaccaagcacacagaactgctgctaggttattttaaaaggcctgcctcctcccttgggctgggggagctggagcagggttgtatcacccggctgacagataaatataaagtaaaacctcagatgcttttctgtggtgatctggcactgcaaaaccagaagaccatcaaaaagtctcccaattttgctataccccagtgggaccctctgtctaaaccaaacttccattgccagctttccctgtatcaaaccactatggtatgcaggggcatactgagcggtataatggacattggagtctcagaagtggggaggatggaaagaggggtgagggatgaaaaattacctatcaaatacaacgtgcactatttgggtgatgggtatagtaaaagtttttgtttctaggcatgtgttcctgtttggggtggagaaggtttatttttaataattaggaaatgttttctagttcagagatgagataattattttactaacctagta

SEQ ID NO: 476124 - DNA, 3436 bp, Homo sapiens
gcattcagtctgtgaggttattccacagcaacccagaatggtagatccaccaatgtcttggaccgggcacctggaaaagtgcagacattcaatgccaacacatgaaagcagccaagaggggagctgtacccaacaaagccacaggggaggagctgcccaagagcatgggagcccacctcttgcatcaatgtgacctggatgtgagacatggagtcaaaagagatcattttgggactttaagatttaatgactgctctattggatttcagacttgcatggtgcctgtaaccccttggttttggccattttctcccatttggaatgggtgtacttacctgatgcctatacctccattgtatctagaaagagactgtgggctggacaggaaatcagaagggaatatattgcagtctcaacaagtagaagacgaagtgctaccaaaaggagtcctgccacaagcacaaggaacaattttctcctcagggaatttgccaggttttgaaatccgaagtgtttgcaggataaagaattaagctcaaaaggacagaatttctaagcccacagtagtacaaatcagtgtaatatttgttaatcttactataacttatgccaaataagttaaattttatttattctatcccctggaactttaagcatctaaattactgaagaaagctaaatgattgacttgaattattttcaattcggttaatacattactaagaagtgttttaaattgattatagaagagtaatcaacgctaagggcatactaccctgaatgtgcccgatctcctccgatcttgtgggctaatcagggtcgggcctggaacactcttccactggtttgtcccgtgactcgttccttctcgtcaactatgtctcatctcaaagcggatatctgaaagacctgccccacccatattatttaaaagcctgctcacatctttctattttagttagtctctggcacatacttatctcttatttccttcttagcacctgtactaatattgctcatttggatttgtaagcacagatctgtatagtccttcctctcaccaaagtttattccatgagagtgagaattttgtattatgcttcctgttgtatacttagcttgttgaacactttctcacacaggagagatactctgaaaatgtcaagttataaaatgaataagatattgatttaatctgcttaaatttataaatgcctagtaaacactaaaataatgtataaaatatttaataattatttcattagctatgagtattgttttaactaaaactaaatttttatttacaaatgaatggataagttattacttagctatacaatagaaacttacttattaataaaagcaatgaattattgacatgcaacaacacggatgagtattaaatcactatgatgagcaaaatatctagacaaaatatgtatgtactgtgtaatatcctttatatagatgtatacataatagagttctctctacaacagaaagccagtcaatggttgcgcatgtacagaatctaaagacatgaggaatattaatatgtttggtgtgataaaaatgtatttttattggaattttggttccatgaatgtatgcatatgtgaaaatccatcaaattgttcactttaaatatgtacagctaattgtgcagaaattattcttcaatgaatttgcaaaaaatacatccaaatgagaaataatttggattggtgtttcttggtgtttcattaggaaattcttaaattgaaagtaagcttgaagaggaatgtagctatttattactagtgataatgcatgtaccaaacaccatggtgataggtttttacattccaatatgcagacttttgtgttaggtacccacattctgatgatgagtgtcctgctgcaaaattgaacaatgtcaagtgaatcaaacttcagtgcagtgataataattgtttttcagcagagaggaaagtatattgactatttaaaatatagtttttctgccttctcagtaactggcattaatttttctttgacagctggattccagctgtcatccatttcaaagagaaattatttagatataaaatgtttagactggttccctatcatgtctgcttcattttatagttaaaagaaaaatcacaaatccagcctatacataagtgggtcaactccatctcatgatgaaaaaactgcaacatcaaattaaaagaatatggtagaaaaaaatgagagtaaagatttgtggctctttgtaatgtatctatcaagaagtgagaatgaacaaagggtgcttgtaaacttagcatactgaatacagtgcttctcttgtctttgtcgtaaagaaactggccttcctgttatttcatacatctataatttatgctggcttctatattcactagtatgctaacataacttctatgtcacaagaaataataaattagttgaaataggacaatattaatgtaactctgcctcttgttgaatttagtgcttgagaataaattggtaaagagttgtgagccttcgccaatcaaaagcttatataagaagaaatttaaataaacttgaaaataaattgtctacgtgattctatctataatgtgacaagatttggaaggtttttatttttaatcttatggaagttgaaaaatcacaggatgataaccattgctattctattgctatgggtttgctgataatattgtgagactagggtgaattattactaatatgaaaagcgaagaaagaaatgtaagctctgaatctatttattaaaattcctgaggatagacaatttatttaaggcatagattagacatttgtgtggatgttactcattttctccatcttggcatatgtttctaaaatacacgtctggcagaaatatacatggctttacctgttcttatcatcttatacatattgccagggagtacaaagctaatattgatgatcatttagagtaaatattttggaaaatattttggatattttcaatcttctcagcctaaacacttcattttaatgtaacttattttatatttattttatcaaacttttttgctttaaatatagcttattcaaatcatacctgaagattgtgaatgaactataaaaattacaaatttttctatcatcattttcatattcatctatttgaaactaattaatatagaaaattttctgtgacataatatgaggcacatatgttttcaatgagaaatcatcctagaattatattttaaaaataaattgctttgggaatgatattcaaagtattctttctccttcaatttttaaaaataatttgaatacaactactttttttaatatttggtagaactcagcagtgaagtcatcaggttcagggctttactttgatgggacactttttattactgatttaatctccttatttgttattggt

SEQ ID NO: 476125 - DNA, 792 bp, Homo sapiens
gtaggttaaattgttaaaaatgatgaatgtagtttcattatatgtacaagagaaacttaaaaacctgagcctgtttgcaaaaacataccagaaacttggctcccagaggagctccattgccctgagaagtctactgggtggggcactgctgaaaagacaactgaaaatggggaagcatctttggaactgggtaacaggcagaggttggaacagtttggaaggctcagtagaagacaggaaaatgtgggaaaatttggaactccttagagacttattgaatggctctgacaaaaatgctgataatgatatgaacaatgaaatgcaggttgaggtggtctcaaatggagatgaggaacttgttgagaactggagcaagggtgactcttgttatgtcttagcaaagagacttgtggcattttgcccctgccctagagatttgtggaactttaaacttgagagagatgatttagggtatctggtggaagaaatgtctaagcagcaaagcattcaagatgtaacttgggtgctattaaagacattcagttttacaaggggagcagagtataaaagttaagaaaatttgcagcctgacaatgcaatagaaaataaaatcccattttctgaggagaaattgaagccagctgcagaaatttgactcagtaatgaggagccaaatgttattctccaaaataatggggaaaatgtcgccaggaacatcaaaaggtttcttcctaattataactttgtatctgttggttgaccgacctttcctggtccctgcttcttgctatg

SEQ ID NO: 476126 - DNA, 935 bp, Homo sapiens
acatcacacaccagggcctgtcagtgggtcgggggtaggggaatgataacattagaatacctaaagaattttctcttccagagtggagctgatatttcttcagcattccccatctactgcatgaatatgtatcctttaggacctctgcagaaacatggaacaagaagcaggaactgtcaaaaccaactttgccctaactctggaaagagtcaaagatttacagaaaccaagcacaatttgaaccaagaaaaagtcaacttaaaaatagtaaaaaagcattgtgacatcttaactttctctttctccaaactctctcaactgtgcgggactcctgaagacaatagcctgcattccaagtgtgagaccatgatccttgatcccaaagggagcagagcatacctaattcacaaagaattgtctgggtcttttctaacccatcaggagatacttgaaaaactgatgaaaggtgttcatctctgtttcaccgaacttggagctctcccagtgtggaaaggcagcaggctttgttcaaaacacattgtaaagtggggtgaaacccacagctaaaagaattctccctatctcttcataaacagagcccctaataacctattttaacttaactcactatattttaattgatgcatcatttatgtcttccaataagattgcatttcttaagaacattgaccatatttatattcatcattctacttccagtatataggcatatggtaaagtgactaacacatagaaagtcctccatgaaaaaaaaaagactgacataatagaaatagccgttgtaactcacacagaaactgaatttcatttttatggaaatctttattttagtttaagtatttatttaagattttacatttaaatacatgctgtttatttaaaagttacaatgaactaatgcaatctcctttagc

SEQ ID NO: 476127 - DNA, 679 bp, Homo sapiens
gcccagacttatattaataactggtccttagaattgagggcctcttgtggtttggcccctgcagggagctcatggcccttcagttggcacaccccacccatagcgccttatgctgcacaccgggctccccagcattcttctcaatatccaggccctttcactcctgtcttctcccatgcacttccattggccttcctccacttctcctcctgaagaactccaccccacccttcaagagcctgatattttttctggattgtgctgcctgcagggctgggaatgggccacaggaggcaaaggtggaggcagagacaacagtgaagcggctacagcagttactcagatgagaggggagggtggcgtggataagagcagtgggactgatgaccatctgctaccacagaggatattcacatgtccagctgtgctggtgtcattagaagtcagctacaatttccaggcaggacaaatttccatccacacaccagcaccccttcactggaaatcttcttaacagcccagcactcatttggatgtagattctggcataatatggtttttaaattgtgttattctgcaatggtggatcatccacatatctttaaagagacatttgagctaatctcaataccaggtatatttatgttctcttaagctactaatttgttctgatgttatc

SEQ ID NO: 476128 - DNA, 840 bp, Homo sapiens
tttctgagggtgacaccagatcagacacactaggaaaccctcaatgtaaagatggtctcctgtcccaataacgtgagctttacagaggaggatgccagcagaggacccaaccatatcaaggaatggaggatagcaacgaacacaaacagtcatgacttggatccttgctgcattcagaccattggcagctcaaggctgtggaagaaggaacataggagcttgacccagagagagaaaagatttggagattttagtcagcaacagacactgaaggtgggcaaggtcaacatttacaaagttatgacgaaggcctttaaacaaggagattcctaccatcttcttagtaggaagttgtcgttggaggtcaatgaaatggaagccacttcctgcaaaagggatcttccagaactgtggatccccttccctgaaaaaaggttcctcattgcacaaaaggtgtggtaataccaaccttggaggactgttatgggactgaatgagataatagacgtctaaaaaatggcaaattttattatcagaggcatcactgttattatcttacaatgcatgatttatacatatctgctcgcattctgagagttacctttttactttgttgatgatcacattatttcttacagctaattttgagggtggattgtcttcccagaaaatggggagaaataatgtctcaattttttaaaggtagaagacccaggatgaataaagtttcaggtctaagaggaaaaatataaattcttaagctatagaaatggtccttcacctgattttgtacctcacagtaatgtaaaactgaacctgtttcaaagccaccttttctgt

SEQ ID NO: 476129 - DNA, 422 bp, Homo sapiens
ttggctctcagtctatgccacgagaacatgctgtgggagactggcccacagaagtggctctgctgcagagcacagacagatgggggctctggctgtaccaccacctggggctgcctctcccgttagacttcctcttggtagcaggtcaaagccctggaactgttgagccgcctttggctagtgggaaactagagcagaaagctggaaaacaaggaaccttaccaataccctcatcccccatcagccacagcatcagtgtcgtgtggggagggagaaaggaggtgctgaaggagaggacaaggtgcaggaaagaggaggagagaagccggtgggctgtccaacgtgatggctctgaagcaccagtggctcctaggccctttaaggtcaatgtgattaatcacgttccatgtacaaggtgactt

SEQ ID NO: 476130 - DNA, 607 bp, Homo sapiens
ggaggccacatttccaggatgcagagccccgtgctggtgcgtctctgggctccctgccagtcctgattttcataggatggtctcaagccaacaggtctgtctctactttcaaccagcccagcaacagacaaccaacaacctcagagcccagatacaagaggcagcaagggaggaagatcctgctttaaagctgaagccccactgggcagggtccagcgacgcttggtacatgactggcaccaccacacaaatacagaagactgtctggttgcaaatgcatttacagatttggattaaaaataaagtccccggatggacccaccaagcttatattttagaaggatttctttctctctctctctggaaatgttctggactcctgaaaatagaggtttattatggaaatgctgacagacccttaaatagagcactgtatttgcaacactgtaattatgcctccattgaaaagctccaaagaaaacatgatttccttgtgcaaataaatcatgcatggctttaaaggcccagatttggatcatttgaaccataaggaaccatcgtcttccatatgtgaatgaattataaataataatggctttaaaaaagg

SEQ ID NO: 476131 - DNA, 3669 bp, Homo sapiens
ccatttttaagtgtacagttccagtgaggtggaactcagcagagcccaggagcatggcagtgagcacacttgaggaagggttccaaggaggaaggaaacacataggctccttggtggcccccacggcccagccatgccctgaacagagagggtgctggcttgggtggctcatttccatggagctgatgggtctgttgtggccatctacccctccctccagtggccccaaccttctgctgcccctttgcatctgggctgtggccacagccaaggaggcgagagtccggctcctgtcaccatcgttccaccaaattcctcaagcccagaaccacatgggccacatggaagagcccccgttaacaactttaaggaccagcgatgtggacttcacaggcaaaggagccaaaaccatccccagaggcaaagaccacagctcgctcttcaaacctgtgttctgagtggctggccatgatggaaatctgcaattagctgttttaatccctaaaatagctttgctactattgtatatagtcacgtaggaaaagagaaaaccagggaccatcacagcaagtggtgaagagcatggagggagtatctaactaggatgcatggagtgtggaagtgactaactaggatgcatggagtatgggagtgtctaactaggatgcatggagtatgggagtatctaactaggatgtgtggagtaggatgcatggagtatgggagtatctaactaggatgtgtggagtaggatgcgtggagtatgggagtgcctaactaggatgcatggagtatgggagtatctaactaggaagcgtggagtatggaagtgactaggatgcatggagtatggaagtggaagtgactaggatgcatggagtatgggagtgtctaactaggatgcatggagtatgggagtgtctaattaggatgcatggagtatgggagtgtctaactaggatgcgtggagtatgggagtgcctaactaggatgcatagagtatggaagtgactaactgggatgcatggagtatgggaatgtctaactacgatgaatggagtatgggagtatctaactaggatgtatggagtatgggagtatctaactaggatgcatggagtatgggaatgtctaactacgatgaatggagtatgggagtatctaactaggatgtatggagtatgggagtatctaactaggatgcatggagtatgggaatgtctaactacgatgtatggagtatggcagtatctaactaggatgcatggagtatgggagtatctaactaagatgcatggagtatgggagtatctaactaggatgcatggagtatgggagtatctaactaggatgcatggagtatgggagtatctaactgggatgtgtggagtatggaagtgactaagtaggatgcatggagtatgggaatgtctaactaggatgcatggagtatgggagtatctaactaggatgcatggagtatgggagtatctaactaggatgcatggagtatgggagtgtctaactaggatgcatggagtatgggagtatttaactaggatgcatggagtatggaagtgactacctaggatgcatggagtatggcagtgtctaactaggatgtgtggagtatggaagtgactaactaggatacatgaagtatgggagtgtctaactaggatgcatggggtttgggagtatctaatttggatgtatggagtatagaagtatctaacttgggttcaaatcccagcttagtttgaatttcctcatcagttaaataggaataatagttaactgggtcatctgacttaactgagttacctcatcagttaattgggaataatatgagtatctccttacaaggagaaaccagacctgctgacaccttgattttgaacttctagcctccagaactgtgagaaaataaatttctgtttaagccacccagtgtgtggcattttgttatggcagcctgagctggctaacacacgggggaaggccaattagaaaaacagaaggaaggccccagaaaatgctcatgatttcaaatactttgcctgtgatttctcaaacattctagctttctgaagaccttcaagtcttagtctcttgggagatgaaggtagcggggagttaaggatggattcagtttccaagtcctgggatacaagtgtgtagctgcaggcttgcatttctaacaccatccagtcctgatgattctgctgagtgccatcctgtccagttgctccacagtgttccagaaacatttcttacatgtccactcaaacttaatcacctaaatacctgccatttctcatgtacttttgaagggttctgtctgctttgtagtttaaggaaagcatttgatttttctacccttgtaaaaactgcagttgggagaaataattttactttcgcttccaggtttattttgtttaactaaagccattagaaatagcttcagttttacatttttcttcagtctgcttgcaaagtgtgttaacacggtggttgaatttcaatggtttggattgctttgaatgacttctgtgttttcattcccaattcctcacatattggttgctatctaggtgaccagatgaaagagttaatttttttttattgatgtgtaatagatgtacatatttttgggatgcatgtgacaatttgataccctcaaataatcaaataaaaatcttaattattaagaaagtattttcactaagtaaaggcttaaatgtgcatatcaaagttgaaaacctgatgtccccgtagctacaagttcaacttgtataccaagagacccagcagccagatttttctctttgcagaaagtgacttaagacctcacaaagtgaagtccctgggacacatgccatggccctggggagcacagcctctattaggccaggaaataaaaccaccaggaagggtctagcagagttgcactaccctggagcctgtcttgtggcaaacgatgccataggaagttttcacttaactaatataattttgagaggctcatactagatttccagactcattatattttcctaaccatctgatagagccaggtgctgtttttattatcatcatccccattgtacgtgaaaagaaacaggacaagagaggttgtctaaagctgccttctatgtcagttttcctttgtgactgttgcttgccaaccaacagtttgctggtggggtcactggtgggcaggagctgggttctttcactcctttatatcccctcttggcaccttgtaatattaggaacagcatcatgggctatgattctcaatgatatttgcaatttaacaagatgccctcctgtgcctgctggagatgctcccctatggcgaaaccagggacctcttgtgtgctggtactggtaggatcacatgttgtgctccagctgccaaggaaggctctttcctgcagttgatgtgcagaaaacagcagttaggattgacctctaagaggagggtgactcttgagagatgagaatcaagaaccaaaagattcttccccccttactggttttggagtatctggggctcgattttattgaagaaaccaagcctttatacgaacatacatcaaattaacaggaaagcctctgactttttgctgcagaaagacttctgccttaagtattcattctgaa

SEQ ID NO: 476132 - DNA, 589 bp, Homo sapiens
tataaatgaagaaaaggacgccgtagtgaggagaggcaagctcttcatcatatgcctctggctggcctgtgtgtgttgccagcattttcgtgcctcacagatggccatgtggctttgcagaaagtgttcatagacacccaagaagtttgcagcatcctacagttggaacgggaccgagagtatgctgaccaagccacccattttataggcaaggtgggactcggagcagtgaccagtgaggtatctattgctgctcaacaaattaccccaagactcagtggcttaaaacgacaccattcatttgtcatctctcacagtttctgtgtgccaggaattttggagcagctcagctggtcggcacctctttatagcttacagctagacatgcctgtggccagggtcatcctgaaggctgtgtttggcagccgggaggggaaacttgaatggctggggcccctcgggactggaacaggagactcaaggctcattgtcttcttcatggccagcattaaaatattgagggagtcagataagggggtctgatttgggggattttctctagagtgttacctcatttttaagctgtcct

SEQ ID NO: 476133 - DNA, 729 bp, Homo sapiens
tcattgccatacacatcagttagcgtggaaccactgatgaatggacaatctggcctcctggaacccaagtcttgccaattaccttgtaatatctctgttcattcctctctgttctttctaccactgccttgttcaagttcccatcactcctcctgggattcctgcatttattgccaatcaaccccattgtcaaagaataggttttatttccctctcatgcttgagaactctgatggccacctatattggcctggaagtgaagcatttggccataattctcactctgcttgcttctgtcggcgctcttggtccatgtgtttgttcttcccagttcgaatttgtgctcagtgaccttccggactataacttacttgtttgtgggttcccattgtcaaatatggtgtctgacacaaagtagattgttatttgactctgctcagtatgaatgagtgagttttaattagagcaaaagaaaaaattcaggaaggacccagtacagtgactgacacacagtaggctttcagaaagatgcattgaatgtgtaagtcttgagcaatgcctttgcatgcaacagtgttctctaaatgctgtttggttggttggttgattgacaaagccagccaaatcagggcaggctcatctgcttctcttccagaagatgccctggactgaggcttggagacttatttctcagggttaatagagtgagccttgttgagattgtcacag

SEQ ID NO: 476134 - DNA, 794 bp, Homo sapiens
aaagtgaacatgtctgttgaccactgcccagaacaagaaagagaatgtcaccagtgccccagaaacgcccctgtgtccctcctagatactagtcccactgtcctcaaaggccctcctgatagctatgaggatgatgaggatgatgatggaggaagaggaggggaaggagaagaaagaaaaggagaaggaagagaaggagaagaaagaggagtaggagaagaagaaggaggaggagaaggaggaggaggagacaaagaagatgatgttggtgatgataaagatgttggtggtgatgacaatgttgatgatgatgatgaaagaggaagaggggaggggaaaaaggagcaggagaaaagggggaagatgatgtcagtggctgtaatgatgttgttgacgatgatgataaaatgaaagtgttgatgatgttgataaagctgatgatgatgatagtaagaaagacaaagacatgatgaaagctaataattattgaacattcaccatgtcccaggcattgtgctaagcatctcacatttatcgactgaggaaactgaagtgccaagagggtaaatatgagggcaaaaacatcaggccaaggaattaagagttcttgtaagacaggctgaagtgatggcatataatgaagggagtggagatagaaggggctgatagagtggagaaaatgaagtagctaagggtctgcaggtcttaataaggttaaaaacagatgctgtgagattagtggaggaaaatgctagaagcacagtgatccttactggactgtgaaaacttcagtt

SEQ ID NO: 476135 - DNA, 2115 bp, Homo sapiens
cacttgtagcaccaaatatgagccccggctgcagggcacccccttacttgggccgagtaggggtggcagacgaggggcgcacagacacagcgtaccgcgtggtggctgaccacatccgcacactcagtgtctgcatctctgatggcatcttccctgggatgtcaggtcccccgctggttcttcgtcggatcctgcgtcgagctgtgcgtttctccatggagatcttaaaggcaccacctggcttcctaggcagcctggtacctgtagtggtggagacactgggagatgcttatccagaactgcaaaggaactcagcccagatcgccaacctggtgtcagaggacgaggcagccttcctggcctccctggagcgggctgaagtggcctggtccttgtcactgtgtggagacctgggactccccttggacatggtagagctgatgctggaggagaaaggggtccagctagactccgctggactggagcggttggcccaagaggaggcccagcaccgggcacggcaggctgagccagttcagaagcagggattgtggcttgatgtccatgcgcttggggagctgcagcgccaaggagtgcccccaactgacgacagccccaagtacaactactccctgcgacccagcggaagttatgagttcggcacctgtgaggcccaggtgttgcaactgtatacagaggacgggacagcagtggcctccgtggggaaaggccagcgctgtggcctcctcttggacaggaccaacttctacgcagaacaggggggccaggcttcagaccgtggctacctggtgcgggcagggcaagaggacgtgctgttcccagtagcccgggcccaggtctgtggaggtttcatcctgcatgaggcagtagcccctgagtgcctgcggttaggggaccaggtgcagctgcatgtggatgaggcctggcgtctaggctgcatggcgaagcatacggccacccacctgctgaactgggcactgaggcagaccctgggccctggcacagagcagcagggctcccatctcaatcctgagcagctgcgcttggatgtgaccacccagaccccattgaccccagagcagctccgggcagtggagaacactgtgcaggaggccgtggggcaggatgaggctgtgtacatggaggaggtgcccctggcgctcactgcccaggtccctggcctgcgctctctggatgaggtttacccagaccctgtgcgggtggtatcagtgggggtgcccgtggcccatgcattggacccagcctcccaagccgcactgcagacctctgtggagctatgctgtgggacgcacctgttacgtactggggctgtaggggacctggttatcatcggggaccgccagctttccaagggcactacccgcctgctggccgtcactggggagcaggcccagcaggcccgagagctaggccagagcctggcccaggaagtgaaagcggccactgagcggctgagtctggggagccgggatgtggcggaggcactgaggctgtccaaggacataggacgactcattgaagctgtggaaactgctgtgatgccccagtggcagcggcgggagctgctggccacagtgaagatgctgcagcggcgtgccaacactgccatccgtaagctgcaaatgggacaggctgcaaagaaaactcaggagctgctggagcggcactcgaaggggcctctgattgtggacacagtctctgctgagtctctctcagtgctggtgaaggtggtacggcagctgtgtgagcaggcccccagcacgtctgtgctcctactcagcccccagcccatggggaaggtgctgtgtgcctgtcaggtggcccagggtgccatgcccaccttcacagcagaggcctgggcactggcagtgtgcagccacatggggggcaaggcgtggggctcacgagtggtggcccaaggcaccggaagcactactgacctggaagctgccctcagtatagcccaaacctatgccctcagccagctctgacccaggtccgcccagggacccacatggactaaaggcaatgccaggagccctgaaggagccagcagaaccttcccacatgctg

SEQ ID NO: 476136 - DNA, 1623 bp, Homo sapiens
cctggtatagacgttgttccctgtgtgtgatttcaggaccctggaccctggtcctgaggatgcagaggccaatatccgtcggatgcgccggatcattgctgaggatcctgagtggtcactggccatcgtgcccctcctcacagagctctgcattcagcacattatcaggaacttccagaaaaaccctatcctgaagcagatgctcccggaacaccagcagaaggtcctgaaccacctgtcccctgacctaccactggctgtgaccgccaacctgatagacagtgagaactactggctccgctgctgcatgcatcgctggcccgtgtgccacgtggcccaccatggcggcagctggaaacgcatgttcttcgagcggcacctggagaacctgctaaagcactttatcccaggcaccacagaccctgcggtgatcctcgacctgctgccgctctgccggaattacgtgcgcagggtccacgtcgatcagttccttccgccggtgcagctcccggcccagctccggccgggcgaccagtccgactcaggcagcgagggagagatggaggagcccaccgttgaccactaccaactgggcgatctggtagctggcctgagccacctggaggagctggacctggtgtacgatgtcaaggactgcggcatgaatttcgagtggaatctcttcctcttcacctaccgtgactgcctctccttggcagccgccatcaaggcatgccacaccctcaagatcttcaagctgacccgaagcaaggtggatgatgacaaggcacgcatcataattcgaagccttctggaccacccagtcctcgaggagctggacttgtcacaaaacctcattggagaccgtggtgcacgaggtgctgccaagctgctgagccacagccgcctgcgtgtgctcaacctggctaacaaccaggtgcgtgcacccggtgcccagtccctggctcacgctctggcacacaacaccaacctcatttccctcaacctacgtctcaactgcatcgaggatgagggtggccaggctcttgcccatgccttgcagaccaacaagtgcctcaccacgctgcacctcggtggcaatgagctgtctgagcccaccgccacactcctgtcacaggtgctcgccatcaacaccacactcaccagcatcaacctgtcctgcaaccacatcgggctggtgagccacctattctgggcttgtgagggtgggtgtggaatccaactgccaggggtacttgtgggataattgtgaagatcacagagtttacatactacatactgcatcaagtatgcacacatactgtgtatcccaatgattatttttcctttaatccttacagttacctaagtaactgtatattaaccctaagcatatttaaccctaaatatatttaagtatataactaagtatatttaaccctactttctagatggaaaactaagtttcagagaggatagtgagttgcccaagggcatcaagtcagtagcaagtggcaaggctacgattcaaacccaagattgattgaaagcctgagtcctttctaatagactgtgtctctaaaactttcttaaccaagtctgagagtaagaaatgcaatttac

SEQ ID NO: 476137 - DNA, 1425 bp, Homo sapiens
ccgctgtgaggctttagaagcttggcatatgtgtgtacccaatgcacctgtcacccacaaccctacaatagcacatggtcatcataccttctccggaagcaactggaaggagaggaagactctgcctactgggaagtgggggccagcccagctgcccgctcccctcaatataccaggcactgactcactggccctgccatgcccacgccactgctcccgctgctgcttcgattgctgctgtcctgcctgctgctgcctgctgcccgcctggcccgccaatacctcctgcccctgctgcgccgattggcccgccgcctgggctcccaggacatgcgagaggctttgctgggctgtctgctgttcattctcagccagcgacactcgccagacgctggggaggcctcaagagtggaccgcctggagaggagggagaggttaggcccccaaaagtgaggccacaagtcctggcagcagctgtatccacaaaatgctttcttttggagtaggataatcctggcaccagcactgaccgaagcctgcccagtggacagaagatatagtgagggttgtgcatgagagggatctgccacagacatgcctctccactcccaacagaaatgtctttctggaagaatgccttgcatctagcacaaaactgattattgcccctctgtcctccagcagttcctcccaaagaccactcctaatcacctctggcctcaggcgggaggggaactaacacccacccacccctgccctccctgcaaatgggaacatcaaggttcccagtgcttaactgagggacaagtgacaatttagcagagaggcaagatttgaatccagactgtcttccagactcaggacctaccttaaaataatatctgagttgcttatggaggcagacctgcctgcaaagcccagcactcagcaagtgctcaataaatatttgatttgaattctttccatggctttgaaagtctaatcacccagactgctgctctgcaaaacagtttaacctggcctggcagttggtgggggtgggggagaggagagatggacaattgtacaagggtttattttgctacctattccatcgtggtttcagtcctcacagcctggaagttgtttccccctgctaagtttcggtcagtatgtcacactgtgacccagaaatggcttgagtccatctaggaggaagtttgcctggctagctcacagtagggaggaaaatatcctccagcgagtttgaggacttctcagctagtggtggtgggaagaggggtgatacgtttgctaagagactgggtgggaggccacccagggaggcagtgcagaaatgcatccccttgagggtcatcccaccctagaagagactagggttgggtgagttgccttaagaactgacttcatcatttcctcctccct

SEQ ID NO: 476138 - DNA, 1108 bp, Homo sapiens
ctcatgtgactgtcccggaagctgcgggctttgctgcctaagcttcacttctgggtgtgggatgcaaatgagggttgtgttccatgctctcctgcctgctccacaatacagtgactcctgtgtgtgccctcggctgccctgtcaccaggcgctctctgcttgtacgttatcatcagtgctgcgtcttcacttctgaggcctccgtgatgcactccatcaaggatcctaccctgaaccttaatagttctcacaattgcctcggcaaaggcccaccacgggatgactgcagggtggatttacgtgtaaagcgtctcctgcagcagcggaggcattccccagatggcaggagggaacagccagccctcgctgtggtggatggcaaggcctgctccaggagactggcactgttgtggaatttcaccctttctgtggacttttattattcttcctgggctagcttcacctcctgctcaagggtttcgacttgttctacccacacctgtgaaaacagcctcccatgccaagtattcccacaggatcatcctaatagattccaggacctggcggctcctcttccaatgccccaaactcttacagggatcagctttctcctgctcggtctcgaggatgctcagggtctggcctcaaccctgtcatcattgtcaatccctgtggctcctccttccaaggaggccgggcagaacagcaacaggagtaggtgcaaagggacagcagatggtcagggacaacaggtgctcgggggcagcaggtgctcagggggtggcaggtgctcagggacaccaggtgttgggggcagcaggtgctcaggggacagcaggtgctcagttggcagtaggcggtcagggacagcaggtgctcagggggcagcaggtgctcagggacagcaggtgctcagggacagcaggtgctcagggacagcaggcctgggtctagacctgctccagcttgcgtccttggacacctcactcagtcccatggggctccctttccccttctcctggtggttgttgtgagtgtcagataagactttagctccaagataggccatggacacattttggttgctgttcttaggcccttggactcc

SEQ ID NO: 476139 - DNA, 835 bp, Homo sapiens
tgctgcaaggggcaatcccaggaaactaggaggatgttatgttagtttttaatcaaaccctgactaccatggaaaagcaggtcaccctgcaagaagcagagaattttggggatgagctttgtatctcatatagtgccagggaagaggaggagccttatccaaatggaaaaatatcagtaccattggaggaccctaaatggggccccagtggtgaaatgggagaatggaaaaggaaacactttcaggcatgcacactagtgggcttacaaaggactagaactaagcctctcaattactacaagccatccctggtagacaagggattagatgagaatcccactgccttcctagaaaggctaagtgtggccttggtaaagcacacctctctatttcctgatccagtgaagggacaactgatcctgaaggataagtttattacttcggtagcttgtgatatcaggacgaagctgcaaaaacaggctacaacaccagatagcactttagagaacctcctgaaagtgaccaacttggtctttcacaatagggattgggaggaagtccaaaaaagagaaaataaatacaagaaaaaggtagaggctctaatagtggccttgcaggctcacaaacctcagagcccccaagatatacatgttacctgctacgaatggggcaagccagggcaatttaggaaggactgcccaggcaacataaggaagccacctcaaccctatccaatttctgatggggaccactggagggcagactgtttacagagacacaggtcactgggtccagagccagtttcccaaatggtccagcaggactgacaggttcc

SEQ ID NO: 476140 - DNA, 848 bp, Homo sapiens
agctgagtgcagcccaccggctgagtgggtgaaataagcccagcaggcccaagcaaaactcagttcaaaatgggtcataaagcagtggagacaactctcaatgtcagcaatgcatttggtgcagaaactgctgaagaatatacagtgcattggtggttcaagaagctttgcaaaggatatgagagccttgaagatgaggagatagtggccagccatgggaagccaaacttgcaccaaaaagagttcatggtcactgtttcgtggtctgctgctggtctgatccactgcagctttccgaatcctggcaaaatcatttcatctgagaagtatactcagcaaatcgatgagatgcatcgaaaactgcaatgcctgcagccggcattggtcaacagaaagagcacaattcttctctgcaacacccagctgcatatcacacaaccaactcttcaagagttgaatgaattgggccaccagcttttgcctcatccgttatattctcctaacttcttgccaactgactaccacttcttcaagcatcttgatgattttttgcagtttgcagggaaaacacttccacaatgagtaggatgcagaaaatgctttccaagacttcatcgaatcccaaagcacagatttttatgctacaggaataaacaaacttatttctcattggcaaaaatgtgttgaatgtaacggttcctattttcattaataaagatgtgtttgagcctagttataatgatttaaaattcacagtccaaaactgcaattacttttgcaacattacttttgcagcatcctttttgcacctagcttttgatttaaagtgaaagaacacttgaacactt

SEQ ID NO: 476141 - DNA, 1064 bp, Homo sapiens
aagtggggcctgcagaacaatgctgcttggcttcctggattcagctactttcctagaagaatgtacagatggatctctcaccttactgggattcccagcaccagagtctgtaaaactccaggatctctatgcaaagaaacctgagaccgcagcaagtggagctgtgggactgaagcttcctgtcagcaaggcccaggtgtggcccataggacaagaaaaccttcaaggcctggggcactgctgccctgcactacctgctgcttcctatcttctggccgcttcacttccacctccagccatggctcaaagagacacaggtactgcatgggtcatcactctggagggtgcaagccatgagcatttgtggcatccatgtggtgttaagtctgcagatgcacagaatgcaagaataatggaggcttggaagcttctaccaagatttcagaggatgtactggaaagcctgggtgtgcaggcctgccacaggggtggagccactgcagagggtattcactagggcagtgcatattggagccatagcaacaggggccttacttttgagacccaagaattatagagccaccagcccaaagccatgttggcgagcagggctgcctgaagccttgggagccaactccttgcaccagtgtgctcagggtgtggaacatggagtcaaagactatcttggagctttaacattgaatgtctgccctgctggctttcagacttgcatgagaaagcccctcaacagtcaacaggcaagccttgtgatgtggttccaaagcccagggccactggagcttgtatggtactggggcatacgagaagactgggctgtctgtggttgacacagcattgaggcaagctaaaagaccaaacagttttgtctttgaagaatttatctatgcagacttatttcttaatgactcggagtaactatgatttttcagtggtttgagttaactggtaagccaatgtttgcaataaccagtgtattcctttgtgtgacaactgtattagaaaattaaaatattatgatttcttattgatcattttatatttgta

SEQ ID NO: 476142 - DNA, 1063 bp, Homo sapiens
gcggagggcatacaccccccgtgatatggtttgggagcacatcccctccgtgatatggttcgtaatatcctggggtggagaggatgatattactcgcaatatcacagggggtacttatacaccccccagtaatattgtttgcaattcagaggatgtacaccaacctataatattgttcgtaatatccaggaacagagaagatgatattacacccagtatcacagggggtgtacagcttaatgtgatattgttcgtaatatcaagaaaaagaaaaaatggtcttactgccaatatcgcaaggggtgtacaccctcttgtgatattgttcgtaatattaagtgtgggagaggatgatattattttcaacatcacaggggctgtacagccccctgtgatattgctcataatattcagcgaaggcaaggatgatattactcttaatatcacaggggctgtacaccttcctgtgatattgtttgtaatatcaaaaggggaaaaagacgatattactcccaatattgcaaagggtgtacaccaacctatggtattgttcatcatatttagaaggagaaaggacaatattactcccaatatcgcaggaagtgtacacatcccccccgtgatattgtttgtaatacccaggaagggagaggatgacattcatcccaatactttaaacaccctctttgtacacccactgtgataatttttgtaatatccagggggagagaggatgatgttactcctaatatcacagggcgtgtaaccaccctgttatattatttgtaatatcccagggggtggggggaggatgatattactcccagtaaggcagggtgtgtacaccccttttaaatattgtccataatatcaaggggggggagaggatgatattattctcaatatcgcaaacagtgtacatccccccgtgacattgttggtaacatccagggaaaaaaaaaaaagaatattaccctgaatattgtaaacagcctgtgtgtacaccctctgtgatactgctcgaaatatcaagaggaggagaggatgatattactcaatgcac

SEQ ID NO: 476143 - DNA, 1070 bp, Homo sapiens
ttgctagagcagcagtctgagatcaaactgcaaggcggcagcgaggctgggggaggggcgctggccattgctgaggcttgagtaggtaaacagtaggtaaacaaattggccaggaagctctaactgggtggagcccaccacagctcaaggaggcctgcctgcctctgtagactccacctctgggggcagggcatagctgaacagaaggcagcagaaacctctgcagacttaaatgtccctgtctgacagctttgaagtgagtagttgttctcccagcgccgagtttgagatctgagaatggacagactgccccctcaagtggatccctgacccccgagtagcctaagtgggaggcaccctctggtaggggcagactgacactacacatggctgggcacccctctgagacaaagcttccagaggaatgatcaggcagcaacatttgctgttcaccaatatccactgttctgcagcctctgctgctgatacccaggcaaacaggatggagaatgactttgacgagttgagagaagaaggcttcagacgatcaaacttctccgagctaaaggaggaagttcaaacccattgcaaagaagctaaaaaccttgaaaaaagattagacgaatggctaattagaataaccagtgtagagaagtccttaaatgacctgatggagctgaaaaacatggcacaagaactacgcgatgaatacacaagcttcaggacttttgccattggaaagtgtaacaatgggatttgtaatggggttgctgtaatatgcgatgagttcccacctcctgaaaaactggtgactaaagaaaatgacttaatgctttggtcatgtgcttcagttcatatgtaacgaacctgcactttgtgcgcgtgtaccctaaaacttaaagtataataataataaaatttaaaaaaaaagagtgaagacaatattcagtgtcttacaccttctgagtgtttgacattatgttatccttccaactgtgaaatgaattctgggctgtcctcaaatcccagaaggactggtggtaataacatctctcagcatttgcttgtcc

SEQ ID NO: 476144 - DNA, 1630 bp, Homo sapiens
ctccctggcgatatgaacagtaataacacactctccccctcggggtattacgaacgatatcacaaggggctgtacgccccccgcaatatggacagtaatatcaccatctcccgaccggcatattatgtacaatatcaaaagagggtgtacttccattgcgacatgggcagtaatttcaccctctgcttccccgaggtggtgtacaccatgggcgatatggggactaatatcaccctctcccttcaagatattacgaaccacatcacagggtcccccccaggatataatgaaacatatcacaaagggttgtacaacccccgcgatacggggagtaataggagtaatatcaccctctgcccccaagatattaggaggcacatcacaccctccatgatatggggagtaatatcgccctcttttttcctggatattacaaaccatatcacaggggagatccccgctatatggggagtaatatcaccctatgccccccagaatttacgaaccatatcacatggaagtgtacgtcctccacgatatgtaatgtctccctctccacttctggatattacaaaccatatcacaaggatgtacaccccccgtgatatgggatgtaatatcacccacttctcccttcctggatattatgaaccatatcacagggaagtgtacaccctccaggatattgaaagtaacatcaccctcctctcccaccctgggaagaatataacaggaggggtgtacagccccgacgatattgggagtcatgtcattttctccctcatggatatttggaacaataccacaggagtagtgtacaccccctgcgatattgtgattaatatcaacctttcctttttggatattaagaacaatattacaggggtggtgtacatttcctgtgatattgggagtaatatcatcctgtccttctttggatattttgaacaatatcacggggagggccccttcgatatttggagtaatattatcctctttttccctggatattatgaacagtatcacagtgggatgcacaccccatgcgatattgcgaataatatcgtcttctcccaccctggctattacaaacaatatcacgggggttgtacagcccctgtgatattgggaggagtgataacatcctctttcccagtaaatattacaaacaatatcacagaggggtgtacaccctctgcgatattaagagaaacatcctctactcccctggatattataaaaaacatcacagtggggctgtataccccctgtgttattgggtgtaataccatcctttcccctcccctgaatattaggaacaatatcactggggggtgcacaccgcctgcgatattgggagtaatatcatcctctccccctataaatattaggaacaatatcacagcaggggtgtgcacaccctacgatattgggagtaatatcatcctgtctctccctggatattattaactatattacagtgggagtgtacaccccctgagatttttggagtaatattatcccccaattccctgaatattataaagcatatcacaggaggggtgtacaccttctgtgatattgagagtaatataatcttcttgccctctggatattagaaacaatattc

SEQ ID NO: 476145 - DNA, 1330 bp, Homo sapiens
gaatgcttgatggcctgggctctcctcagactgccccggccacactcggcatcgttccgctggtcgatggtatgctggtgtctgtcggtctgctcttgtccccccagtcggtggcctgctggcgtgctggtgtctgtcggtctgctcttgtccccccagtcggtggcctgctggcatgctggtgtctgtcggtctgctcttgtcccactggttggtggcctgctggcgtgctggtgtctgtcagtctgctcttatcccatcagtcggtggcctgctggcgtgctggtgtctgttggtctgctcttgtcccactggttggtggcctgctggcgtgctggtgtctgtcggtctgctcttgtcccaccagtcggtggcctgctggcatgctggtgtctgttggtctgctcttttgccaacgtgctcctcttgacatccagccacttgtgtgtgtgcctgccagggtcttgggggtttttataggcacaggatgggagtgtggtaggggccagggtggtcttgggaaatgcagcatttggtggtgaaggcaggagtgcctgtcctcacctaggtctgtggagatggagccccagccagggacctgccttcctcaacccagcacttcccttcacacttctatatcatttaaagggaccagctctccccttcccagcactcccatatcactgtgaactctccacgtggggctgcattctggacactttggcctcctgtctgttcttccaacccaacacgccaggcagcttctgcccacggccttagtgctcactgctactcctgcctgaagacagcttcccaggccccactaggcccatgctcacctccctcaggcctctgctgaaacttcaccttctcaatgaggctttctctggcagtgcgtgcaggggacacaggaacatccgcctgctgcgtcagtgccaggtcagggcggcagagctgccacttttcgagctgctgagggtggacatctcagccctgcatgtggagggcggagactggggtacacccttggcagctgcagccacggcaggggagcccctgttggttcagtactggcagctccacgccaagcctggccgcgtctggccagggtgctctggctttcccgccgtgcctgatggcctttctgctcacgttgccatttcttcctcccttcctggtccaccatggagcctcagtttctcaagggtggatgcctgccagttccccaaactctacattcccagctgctctctgtcgatacaagtaggctgttcatatggttgagtgtggcgctcactgtaccacgctgtaccgggcactgccgcccctt

SEQ ID NO: 476146 - DNA, 1130 bp, Homo sapiens
ggtgaagccccacaggtccccctgctgtgcacgtccccagccgtggactcaggccctgtggtcctgaggggtcatgggtataggagatcccagcccccacccttcaccccgcctgcggcccgaccccagccccacgttgcaccagacctgcggccaaaccccagccccaccttgcaccccacctgcggccaaaccccagcccccaccctgcaccccacctgcggccagacaccagccccaccctgctccccacctgcggtcaaaccccagcccccaccatgcaccccacctgcggccaaaccccaccccccaccctgcaccccacctgtggccagacaccagccccaccctgctccccacctgcggccaaaccccagcccccaccctgcaccccacctgcggccaaaccccagcccccaccctgcaccccacttgcggccagacaccagccccaccctgctccccacctgcggccaaaccccagcccccaccctgcaccccacctgcggccaaaccccagcccccaccctgcaccccacctgcggccagacaccagccccaccctgctccccacctgcggccaaaccccagcccccaccctgcaccccacctgcggccaaaccccagcccccaccctgcaccccacctgcggccggacaccagcccccaccctgctccccacctgcggcccgaccccagccccaccctgctccccacctgcggccggacaccagcccccaccctgcaccccaacttcagtcatgcttcccagtagacctcaaagccgaaatgtcaggcagcttcctgttaagaaataaagaggaggaggaagaaggaaaggtgtgcagggcgttagtggtgaccaggtgctttcatcccggcctctccacggctttcacgtgttgggtgattccagctgagaaccctctggcctgaaaccaagcatggccctggggcttttaaacccttctcttacgggccttggcaattgtttttgaagtgatcactttaaccttttgttttaatcctctggttattcccctgactggggaatgcaacctgagaagcatcctttggcaaaagagaagttttattagtgaggcaagcagttaattaaaaaaataaaaact

SEQ ID NO: 476147 - DNA, 951 bp, Homo sapiens
gtcatctacctgctgatgacttcatctccagaccaagccaagcccctgaaatacacactgtattccactgtttatctgacatctcaacttggatgcttaattaatccccaggggcatgaacagaaccagccagtagagacccgggagctcattccgattcctggaccacgatcctgcagggacagggccaaggctattcctacccactctgattttcttggtgacattatgataaaggcgaaaggtacattaaaagctttggatctatactggggtcgtaaaatgtcacccatagacagttcctgtctagggattcatttgccagacagatcaataaatgctgtgaaaagttctacaataagtattcccaaccagctgttctgcaaagcacccgtatttccaactcaccaggaagaagacaaaataagcaaatgtatcttggtagatgtttactctttgaatgtcaataagaatttcactctgaaagacagcaggtttccattgtcctcagacaggcagcagacagctgggtcaggagccgtgctaacaagtgaacccaaggtgagggaactttcagatccacactcaatctctccaacaggaagcatcgctttcctggcaacggaaagattaatcatacattgcaccagggagagacgaagcttggtaatagacaaagatgttcctgcgagtcacctcgctgggagtggagctgagaagccctgcactgagctggtgtgagacagggaggtaaagcctgcagggaggaggtggaagggcgaggccaccccatgggcagcagccctcagagtgggccaggcctggaggaggggaagaagctggactgtgtatcctcgatgcccagttgtgctgttccgggactggccccactggccccctgggacccagagagaaagacctttgctctgggcatcacaggcgtgcacagcc

SEQ ID NO: 476148 - DNA, 1834 bp, Homo sapiens
agcacttgtgatgagtaagtccctgtgtggagtcctccaaagcaggtgcctctgccaggcgagccttaggtggacgccggtcagagaaccacaggggtctcagctgtgaagggattgagtggaccggacaggctggccatagtgcttaggcctccattgcaaagttaccagaattctgcaggaatgggttgttgtctcagtgctcgttaaaccagtcaggcagtgggtgaccatcaccagtggacctggctgtgggggccttggcactcgggcctgtgatttatgtgcccagctcacacatgtcagctgcaaccccttcactcgagtgttggggcctggaaagcaaggactgtgtcttgttcttttgaggattctgggacttttctaacctaagattcctcagtcctagtgtgggcatattcatggaggggggcggttatgagtacgaaatgaggtaacagtaggtaaaacacctattaacagcaccaagcgtagcgctttctagaggctcacgaagacgtccatgcccttttcccatatcggagctgctcaggcactttcccaggggctttgccattttgcactgtcctcacctaactcctggacctacagtggcaaacccaatttgaccagttatgatttggccttgcccctcaattgccagccatggggcatagcaccccctaactcacccctcaattgccagccatggggcatagcaccccctagcttgcccctcaattgccagccatggggcatagcaccccctagcttgcccctcaattgccagccatggggcatagcaccccctaactcgcccctcaattgccagccatggggcatagcaccccctagcttgcccctcaattgccagccatggggcatagcaccccctaactcgcccctcaattgccagccatggggcatagcaccccctagcttgcccctcaattgccagccatggggcatagcaccccctagcttgcccctcaattgccagccatggggcatagcaccccctagcttgcccctcaattgccagccatggggcatagcaccccctaactcgcccctcaattgccagccatggggcatagcaccccctagcttgcccctcaattgccagccatggggcatagtgccctggaacccacccctcaattgccagtcatgacagaatatccacattggaattgtggtttgagagaaaaataaaaattttgtcttgttaagctgtttaaattttgaggattatttgttacaggtgccaatattttcctacctaaaagaggattccttattaaaggctgtggcaccaccatccctcaatccctgaaccagaaaacgaaggcaacaactttaatatttctttatcctcatttccagaccaattccaaagcctgattttttttttaaacttttaactttgagatgatttagacttaaagagttgcaaaatactgcagttaccaatatacccttccctcaacttcctccagtattaatatcttatataaccatcatatagtaatcaaaactaagaaattaatatcgataaatactattaattaaatgacagagtttgttggatttcacttgttgagggacctgatgtgaagggggagcacaggaaaggaggagagacaagcccagtaggtatccacacatggaagaggacttcatctgacagtgccacctgtgtctcagggcttctgtggcaaagatcacagactgtatgaggccgaagccacagaaattttttctcatagctctggaggctggaagtccaagatcaaggtgtcagcagggttagtttctgctggggcctctctgc

SEQ ID NO: 476149 - DNA, 4438 bp, Homo sapiens
ctctttgctgcgtaagtccttcctacaatgttctcctagtccttaccacattgtccttttaggaccttactgttgcatcctcctaggtccttgctatgacgtcctcctaggtcctttctatgacatcctcctaggtccttgctatgacgtcctcctaggtccttgctatgacgtcctcccaggtctttgctatgacatcctcttaggtcctttctatgacatcctccttggtcctttctttgacatcctcctaggtccttgctatgacgtcctcctaggtccttgctatgacgtcctcccaggtctttgctatgacatcctcttaggtcctttctatgacatcctccttggtcctttgacatcctcctaggtccttgctatgacgtcctcccaggtctttgctatgacatcctcctaggtcctttctatgatgtcctcctaggtcctttctttgacatcctcctaggtccttgctgtgacatcctcaaggtccttgctatgatgtcctcctaggtccttgctatgacatcctcctaggtcctttctatgatatcctcctaggtcctttctatgacatcctcctaggtccttgctatgacatcctcctaggtccttgctatgacatcctcaaggtccttgctatgatgtcctcctaggtccttgatatgacgtcctcctaggtccttgctatgacgtcctcctaggtccttgctatgacatcctcctaggtccttgctatgatgtcctcctgggcttactgtgatgtccttgtaggcccttactatgttttcttccaaggtctcaataacgggccaaaagcaaacaggaaaacaagcagagaaagagaaacaaagggaacctcatacataaaaagccaggaacctgacgagcaattagctttgcatttaccaaccatctgtcttctcaaagaacatttatgttggggagatttgacacctcccttgatctccactggccaccgtcatccctgcacaaggacggtgaatgcctgccatgtaggcaaaacagagggtctaccatgcacatccgaaaaacagcgggcctaccacgcccatccgaatcctaactcattgccttcgtctcctcttgcaaatggatggctgccgctcagcccctctatgtagaaactctgtagcccagatttaatctgttctggttttctcttgttgtaattccagctcctaccccagcctctggcaatcactaacctgctttctccctcgatagcttcacctttcctggaatttcatgtaaagagaatcatacagtatggagtctcccatgactggcttccctctggggcatgacatggtagagtcacccatgctgctgcatatgttaagagttgagttgtttttatcgctgagtaatatttcattgcatggttatactacattttgtttactcaccagttgatggatatttgggttctttccagtttttggctattatgaatgatgctattacgaacattcacataaaacttttaatgtggacgtatttcttcatttttcttgggtagatgcctagaagtgggattgatgggtttgttggtaagtgtatgtttaacttaataagaaattgccaaaactgtttccattttctacatccagcgataatgtatgtatattatttcatcaacttagctaaaggtttataaatgttattgatctttctaagaaccatttcttggcttcattgatttttaactattgcttgccttttgtccatttcattgatttctacactatcttgatgatctctttccttcttactttgggtttaatttgaccttttcctagcttcttaaaatggcatttcatatcattgactatagactttaagctgtcagcagtaagcatgctactttagctacgtctcacaaattttggtatgttgtgttttcattttcattttgttccagatatgttttccttatgatgtctcctttgacctattgattatgtataagcattgtgtgtgcagtttccacatatttggggatttgccagaatattttttctgttttaatttaaaattttattctgctgtggtcagagaacatactcttcatgatttcagtctctttaaatgtatagagaattgctttatcccaggatgtggtctatcctgttgaatgttccctgtgtgtttgaaaagaatgtatattttactgttgttgagtggaatgctttccagatgtcagttgtttgacagtgttgctcaagtcttctatgatcttgctggtgttctatctacttgatctacgaattatggatggaggagtagtgaaacatctagctataactagttgtctatttcttctttcgattctgtcagttttgcttcctgtatttggagttctattgttaggtgcatatatgcctaaattattatatatttcttctacattggacattttatcattatgaaatgtacctctttgtcttgagtaatattctttagcttaaaactattcgtgtgatattaacatagccaatctactgctctcatatgtacagtttgcatatcttttcacttttactgtctttgtagctttgatttaaaatatgtcttatgtagaaagcatatagttagatctagtctcacaatctctgccttttgattggagtggcaagtaaatttatatttaatgtaattattgatatgcttagattcatgtctgtcattttgctctcttgttcttccttcttttgtattaaatatttaagtggaacatttttatatctctattgatttcttagctatatttctttgtgtgctttaaaaattatttgtagttgttctagggattatgtaagtattttaaacttatcacgatctacttcaagttgttactgactttcttctggtaaaatataggcactttgtactcatatagcttcattttctcttccctttctttttgctgttgttgatacacacacacacacgtacatatatatatatgtatgtataacatatatgtgcatgatgtatatatgtataaaatctatatttatacaattagaattaaaatatatataatattacacatatgtatatacatacacacatatgcacacacacacacattcgtatatgttaaaatccaacaacacagtatatattttttgctttaaacactctttaaaagaaattaagagataaaaagaaaagtatatattcttgtgtatttatgcagattataactcattttctctttatctttggctttcagcagtttgactataatgtgtccaattgtggctttcttattgttcatcttacttggggttggctctgaggctctattcatttttctttgtctttcttctctctcttctttggattgaatattttctactgatctttctttaagttcattgatttttttttttcttctgctacctcatagctgctgctgagcccatctagtgaaatttttatttcagttattttactttccaggtctagaatttctgtttggttctattatatagtttccaatattttgttctctacctattcagtcatgtttagcacattttactttaatcctttggatgtattttcttttgaattgttgagcatatttataatagctttttacaaaaatctttgtctcctaagttcaacttctggcccttcatggactcactttatattgattggtttttgtttttcttccctgagtatgggttatacttttattttctttttgcatgtctcataatttgtgtttgaaaactggacattttaagtaccacactgaaatgactatgaattctggtttgttcctctgagggtgtagacaattagcttgcctggactcaaaatgcaaagtgtctccactgtgtgtgcagccactaatatctttattttgtttttcttttcactttctttttggcctggctccccagtggtctcccagtggctgcataggctagcagtcagccaatgatttgagtagaggtcatgctgttccattcaagccaggaaagcttctgctgtgctatgtggctgtgtgtggactgcaggatgtattcaaaggcatggcaacttcacaagtgtctcatgcatgtgattttgacagacttttccagcatcttccgcgtgtagtttggcagcagtgacatgtgatgagcacatctcggctctttcatggcttgtttccctccacaacctccttcttacatctctagctgctttgccacccaccctgaacattggtgaggacacatgaatttgctgttgggtgtgtgtgtgagctcatgagtgagtgtgggtagtgagcagtgtttgactggaaattgtgggacttggattttaagtaatttctcattttatctgacgactgaaccaggcagtcagaagcttatggtcagaagctacagactccatggcttctgaccat

SEQ ID NO: 476150 - DNA, 1002 bp, Homo sapiens
tgggatgtgggttggaggcctgcaggtagcagccggtctcatgtggaaagacgtgtttttcacagctgcagaccggagccctcgcctccagtgccttcccacagacacttgctactggacgctaatggggaactgaggctgagaaggttcaatgaaatactcaatgatgagtctcacggttctcctgcccgatcgtccccacgctcagggacagatgggaggattggtgctattggaacatagccagggtctggcttttctcaggtttgaagctggcatttgtaaatgtacaaagcaagctcacattgattcttggtatcgatttccaaatatgaaagcagtacttggaattttcgaagcttctaaacagatctgggagcccggggagggctcgtcatctgggagtgtcagcagacaccgcagccatcggcagcaagcatccacctgctccgcgggcgcctttttcaagcgagttcagctcacctctgcttctcttggttttcctttgcttaattgcagtcaactcttactcttggtagtgtgtggacaaagtcatggaatatacaggaaggttgtgttgactttgttttcagtcctcacccctcttcttgggttgaggtgatcgaactctgcccgtacttgctaaaacgctccactctgttttaattctttgtaaatagagctccccctccccgctaccgtggcttattcctgcagttccattcactaccacgttcagcctaatcacatctcctggaaataatatgagaaagttatgctgttttactccatcagatttaataagtttggatggtttccaagtactaggcattaatcacacttaaacctgggccttgatagttcatccacccggagtattcatgtcagagacataaaacaatctgctttaatgctcagagtcctcttgaaaactgagcacttgcctcgtgttaataaaacttgctttctacagtggggctgggagaggacagggcatgggga

SEQ ID NO: 476151 - DNA, 2066 bp, Homo sapiens
tgtaggtagaaagacatagtgaccttccttacccctacgtgcaattaaatcagactccctagggtggagctctggcagtagcctttaaaaaacccgcagaaaagatttggtgattccagtccacagccaagattgcggaaccactggtctatagaacagcatcacctaacccatgaaacccaggcctcagcacggcacttcccatagcgagtggattaccacgccctcttcatgtgacccctaagcacctctccaatctgctcacctctggcctatacctgagtctctgctcttggcgtctgtcatgtatgctggacgattttctcccagctgctttgcctgctcctattcttctagaaatatgtggataatgcctctgactttaacacattccagcttccttatagcgttacctctgatgtccggggcggtgctgacggcagccactgggcctatctggcctgggcctgatttggagggaatgttccttccacggttttctcatgaagaacgatgttcatgggaagtatttcatacacactctgccagactgaagacgtgtccttctattcctagcttggatgatgctgcgggaccaaagctgacttatgatggtgtcatcgggttacatccagagcacctgcctgctcctcacgcagctcctcagacgtctccacctaatcacagaatgacggagcctcacgtttcctctcatggccaccaacgccgtggggcagccaacttaaagaatgtcttcacttcaagatgggatacagcctgaaaacacgagcagcgagtgtaaaatgggtggaagaggtatggctaagcctttcgaggttggcactgggacagcagtggcacctcctcctgacacatctctgaaggtgaaggctgggcttccacggagcatgcggatgcctaacgtggtgtgttttcttactttttccccagccattatgcctctacttgcccaagagagtgtcatttaaaacactgtcatttcctcatctttaaagtgaagggaataatagcgtctaccttaaagagtttttagataaatcacttaaaacatagcaattatgtaacaactgccaacaagtactagttatcatcattggacactgtaaaatgtttagtgtccaaacctataaaatagctcctaaattgaatgatctcatggtctagctgggaaaataatgtgtaattcaaaaataaaaataaaaatgtcaattctgtacagaaattcccaaatgaatgtgtagaatctactatccgcaccaaggaacgtggagagatcacaacttggagcccctgcagaaagtgtttagggaaacaatgggacttgaacgggagcctggaggctttaggtaatgagagaggaagggagagaatattctagaaaggaagaataccaggtgagaaggtttatgatgtatttggaagccacctcctgtgccagtcgggctgaaatactgagtttgtgtggaagaatatggggtgaaccatggagaaaactgatgaaataagatggtgggtcagcatcatcccagaagccaactactgcttggagaagagttaactcagtggctgtctgtacgatgaactgaagtcaagaagaaattagaagcaaggatgaaacaagcgaagtaaacccttctatgtttaaccacaactttgtaaacgcagtgactcatctccattcatgggtgtcagcttggttctgagcatgcagatgaatgtatccaaccagggctgaggaagccgggttgaccctgagctttggccttttagttccgttcctttgcaggcagatacaactaggaaacgaggcccatattttgagaagtaaaaatattctactctgagatctttgcagttttatttccctaattattttggataatcaacattttcattttttttttccaattttcaaatcaactttagatttagccccttaaatatatcttttaggaagtagcatcttgttgccttaggaacagtgtttgaaaaagttctcatttgtgctgtacacttcaatgataaagaaagttcactggcatccc

SEQ ID NO: 476152 - DNA, 763 bp, Homo sapiens
cagacacaggggatcttgcctgctgggacttttgctgtgttggtcagctgtggcatggggtgccatgaggaggtgggaagtgagcctgaaaaggcagttaagccacacggtagtggtgctgtttccaatagcgagtcgtgtagaatggaaagtggaaagtctaacgtatgggtcttgttcttgtccctggcaccggcattcctatgggattccatgggaagacatcacagcacagtgggaaggcgtctgctatcgactggacctgagtcagaaccctgccagcccagctctgggagagaagggtgcatgtgagggccctggtgagcccaggatagtcagagaggccagtgtgagtgggggcagaggaagcccggaagccctgaaagtccagtgtattgcaaaactttctcaaggcactaaaaataccaaagtaccaaatattcagagggcttcatggtccttaatatttccctatttttattatatttttaaagatgtcattgtgaaatatacgtatggcaaagtgcattaagcataaatgcatactttaataaataattataaacaaaatgtgaacccacctctcttaccatacctcctcccctcccctatttatgtcccatttatggtcattgttctttgctttgccttgtagttttaccacctatctatgcatcgctaaatcatagaattaaaaaggtttgttgtgaactttatatgagtggagtcatgtagtctgtattctttggcatcttgtttctat

SEQ ID NO: 476153 - DNA, 911 bp, Homo sapiens
ctgtcctcaccgccctcaccgcccacaggaccacaggagggcagggacaccagctggaggaaggactgccgggcacgaaggagccaggacgtaccggtgtgaaaatgaacctttctcattccaggcttttctggatggcagagaagactaccatgaaagagaaactctcctcgaggtgccgccctccaggaactgcaccccatgaggtcatcacgcacgcacacagtgggttccggtatctcacccctgagctcaatgccaggagagcagtggcctgcagggcccagcgccggctgccatctgaaggtggcctctgggcagaccccatgtcggagctgcccggcagggccactgctgattttgtgacctacagaagtagtgagaggagcagcaaagggcatcccgtggtcgacgatgtggaatgcgatgcccacggggccactggcccagagggtctccaggcagctgttggagctcaggccctgtcagctaagcggtttctctccaccgcaggcgttgctgctctcacgttgccagatgagggtaacttgcagtttctgcagagccaatgttcagaattaaaacacatttactatgacacgcaacgccctgtgtggtggctggatcgcagcaccaatgggtgaaaacatctttaaactaccagtctatatttcagctgtatttacccactggggactggtggattcagagctgtcactcagagctggaaacacacctgtggttctggtagcttgggctccagagcttctgatgttctgggctgagagtggcttgcacaggacctggggtggtcctgccttgagtccgcccacccccttcacatagaagggtggccctcggttagagactgccgctgcgaagcagatcacaaacacacttgatttcaggac

SEQ ID NO: 476154 - DNA, 2338 bp, Homo sapiens
cagatggctgacaggatgatgatggtgatgatgaaggattatttactaaatggcatggcaatgatggcgatggtaaggatgatgacggtggtgatgaaggattatttactaaatggcatggcaatgatggtgatggatgatgatggtgatgatgaaggattatttattaaatggcatggcaatgatggcgatggtaaggatgatgacggtggtgatgaaggattatttactaaatggcatggcaatgatggcgatggtaaggatgatgatggtgatgatgaaggattatttactaaatggcatggcaatgatggcgatggtaaggatgatgacggtggtgatgaaggattatttactaaatggcatggcaatgatggcgatggtaaggatgatgatggtgatgatgaaggattatttactaaatggcatggcaatgatggcgatggtaaggatgatgatggtgatgatgaaggattatttactaaatggcatggcaatgatggtgatggtaaggatgatgacggtggtgatgaaggattatttactaaatggcatggcaatgatggcgatggtaaggatgatgacggtggtgatgaaggattatttactaaatggcatggcaatgatggcgatggtaaggatgatgatggtgatgatgaaggattatttactaaatggcatggcaatgatggcgatggtaaggatgatgacggtgatgatgaagtgattacttactaaatggcatggcaatgatggcgatggtaaggatgatgacggtgatgatgaagtgattacttactaaatggcatggcaatgatggtgatggtaaggatgatgatggtgatgatgaaggattatttattaaatggcatggcaatgatggcgatggtaaggatgatgacggtgatgatgaagtgattgtttactaaatggcatggcaatgatggcgatggtaaggatgatgatggtgatgatgatggtgaagatagtgatgatatggtgatgacgatgatggtgatgatgatgatggtgttgatgataacaatgatggtgataacaatgatgatggtgacggtgatattgacaacaatgatgatgacaatgaggatggtgataacaatgatgatgatatggtgatgacaatgatggtgatgatggtggtgatggtaatggtaatgatgatggtgatgatggtggtaatgataatgacaacatgatggtgatgacaatgatggtgatggtgatgatgacaacaatgatggtcgtgatggtaatgataatgatgatgagatgctgatggtgatggtgatgatagtaatgatgctgatggtgatggtgatgatagtaatgatgatgatggtgacaatggtgatgatttggggtgggggacagaaatgagaaaagatggagttaggggatgatgggctcacctgcccttttggccctccagttctgtacttgcatattgaggggcttggtctacctggtgttgcccaaatgactagaaccatgtaggaagcttataaaagtacacagatccagatcctataccagactgaccaagtcggcatctcccatctggggctttggggtttatggttttagtacagttgactgtaatgtgcagccaggctggggaaacatgaaactaatgatctgagttcaaatcatcactgctaaaatgagcacaagggaatagaaccagttattcgtgctgaataaaataaatgtaacccccaagttgttgcactgctatttgaaataatttatgttattgattttcttcaataaaactgagctgtgtgtggatttgcctgaaggggtctgtgtcccaaccttcaactcatcctctgttttcctggatccccacacaatcgtaggcagcttagcttgtagttttgcggactgtgagctggacatccttcctgtgtttgaaaatgaacctgtcatcagcacaggctcagtaactcagactgtaggaacccacactaaagacgtgtttttaaaatgtgggtgaaaaataattgaaagcacgtttgttacagctttatttataatgttgaaaaactttaaaacaacccatatgaccaagcatagcagggaacagtgcagtcagcctctacagcaggtggccaagaggctctttccatggttccgggaaatgctcgcgtgtagtacccagtgggagtggcaggagacagccccgaggctacagaatgaatttgagtgctttggaaaaagtacgtaattatgctttggaaaacactggaagaaaatgcacctagaatgatattttttttcaccattttctgtatgcttcagtttttatgctgtaaga

SEQ ID NO: 476155 - DNA, 3364 bp, Homo sapiens
cagcaaagcagacaagtctcctcctatgaaactcacattctaggtggggacagacaagacacaatgcacacaatcaccgatgtcaggattggggacggttgctatggaggacagacaagacacacacaatcaccgatgtcaggactggggacggttgctatggaggacagacaagacacaacgcacacaatcaccgatgtcaggattggggatggttgctatggaggacagacaagacacaacgcacacaatcaccgatgtcaggattggggatggttgctatggaggacagacaagacacaacgcacacaatcaccgatgtcaggattggggatggttgctatggaggacagacaagacacaacgcacacaatcactgatgtgaggattggggatggttgctacagaggacagacaagacacaacgcacacaatcactgatgtgaggattggggacagttgttatggaggacagacaagacacaacacacacaatcactgatgtgaggattggggacggttgctacagaggacagacaagacacaacacacacaatcactgatgtgaggattggggacagttgttatggaggacagacaagacacaacacacacaatcactgatgtgaggattggggacggttgctacagaggacagacaagatacaacacacacaatcactgatgtgaggattggggacagttgttatggaggacagacaagacacaacacacacaatcactgatgtgaggattggggacggttgctacagaggacagacaagacacaacgcacacaatcaccaatgtcaggattggggatggttgctatggaggacagacaagacacaacacacacaatcactgatgtcaggattggggatggttgctatagacaaagaagagatgaagaggaaatgttcaaacatacacgaaagcagagaagataacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcacggacgccatcggccacggccacccatcgctctgcagagaagacaacggcatggacgccatcggccatggccacccatcgctctgcagagaagacaacggcatggacgccatcggccatggccacccattactctgcagagaacataacggcacagatgccatcggccacggccacccattgctctgcagagaacataacagcacggatgccatcggccatggccacccattgctctgcagagaacataacagcatggacgccattggccatggccacccatcgctctacaaagaagataacggcatggacgccatcggccacggccacccattgctctgcagagaacataacagcatggacgccatcagccacagccccccatcgctctgcagagaagacaacgacatggacgccatcggccacggccccccatcaatctgcggagaagacaacagccacccatcactcttcagagaagataacggcatggacgccatcagccacagccccccatcactctgcagagaacataatggcacggacgccattggcaatggccccccatcgctctgcagagaacatgagaatccagagcccccactgcctgggatgaatgggctccagaatccagagcccccactgcctgggatgaatgggctccagaatccagagcacccgcctgggacgaacaggctccagaatccagaggccccgcttgggacgaacgggctccagaatccagagccctcgcctgggacgaacgggatccagaatccagagcccctgcctgggacgaacgggctccaggggcccgcaaaaggacgtcggctctgcaccacccctacctattactctatactgagccgcaaacccatgcacgcctcagtccaaatgtcatagcttctctttctcccactaccctgagggccacacacacatgactcggagaaaggccacagcctgtgtgtcacaggatctccctaaatgtccagtggcccctgtccagccgctgtggctgcccacatcatggtgctgggccctgccgtttctccatcatagaaccaccaagaggcaaccgagaaacccaggagcatggcaacatccacagtctccaggatggggccctatctacatgctcctcctagaggggctgtgtaccgtgagcacaggagggtcatccagctacaggatgggactctatctacaagttcctgctagagggtctgtgtgccgagagcacaggagggtcatccagctacaggatgggactctatctacaagttcctgctacagtgcctgtgtgccgtcagcacaggagggtcatccagctgcaggatgggactctatctacatgctcctcctagaggggctgtgtgccgtgagcacaggagggtcatccagctgcaggatgggactctatctacaagttcctgctacagtgcctgtgtgccgtcagcacaggagggtcatccagctgcaggatgggactctatctacatgctcctcctagaggggctgtgtgccgtgagcacaggagggtcatccagctgcaggatgggactctatctacaagttcctgctacagtgcctgtgtgccgtcagcacaggagggtcatccagctgcagaatgggactctatctacaagttcctgctacagggtctgtgtgccaagagcacaggagggtcattcaactgtaggatcggactctatctacatgttcctgctacaggggctgtgtgccatgagcacaggagggtcatccagctacaggatgggactctatctacaagttcctgctagagggtctgtgtgccaagaccacaggagggtcatccagctgcagaatgggactctatctacatgctcctcctacgggggctgtgtgccgagaccacaggagggtcatccagctccaggatgggactctatctacatgttcctgctac

SEQ ID NO: 476156 - DNA, 933 bp, Homo sapiens
tgaagtcgcctcaccgccgaccatttaatcaccctagaaaccacccagagcccgtaaccctcaggcccctcctctgcgggactcctgccttcgtgttcttgggacacagccaggaccccacctgggatctgagcttgcttggggtttcctcatgaactctcttctacttcggactctgtttcctgtgccatggccctgcagcctgtcgacatgaccctatcgtcgaagcccggactgacccgtccagctctgcagccctgcgggccatgctgagctcccagctggaagtgcatcaccgcaccgcagtggaggcaggaggccttggaaacacgtgcacagctgctaactcatacacgcacataagcacagccgctaacgtgtttaactgccaaacttactgtgcgtgcccaaggatgccgccaatccaacatcataaacccttccggcaaacagacactgcccgtgcctctgcgcggaagcctaacccccaggtgctcctcgatgacggcttcgtgccttctccctctgtcttccctgcagcgttgggtgctctcatcaacgaggctcatcatctctgtccccagcattgcctgagccttgcaaagccccttcctgttctgggagcaggtcagtgctatgcctgctgcttggctgcctccgccccacaccctcgtcccagggaagccacagctctgccctgcatcctgcttgcatggccaggccaggacagccgggagacacgcacacagaaaaagcagacactgcaggctccatgctccagagcttccaggatcctggggcaacagatgttcaccactgatggttcggttataattgtggacaggctgcaaaaaagggcacgagagcacctgacagagggcactgacctcacccagcggtcagagaacgaacagcggccgacctgaggacatc

SEQ ID NO: 476157 - DNA, 2922 bp, Homo sapiens
gtggcctgtctgaggacagaaagatctcaaagaagcagcagagggaatgcaagggcagagtgaggaagtgaggggtgctgcggggctggtgttggcactgacagacagcaggcgggagactgcagagtggccaagggagattctgcatgacttcagccgcgctgtgaaatttgtgaagataatcgtgttggtgaagaagctgggctcatggtgcagctcagacctatatgctgagtctgtctacctgctggagactgtcctgtttctcctctatgctgagtctgtctacctggtgcagactgtcctgtttctcctctatgctgagtctgtctacctggtggagactgtcctgtttctcctctatgctgagtctgtctacctggtggatactgtcctgtttctcctctatgctaagtctgtcaacctggtggagactgtcctgtttctcctctgtgctgagtctgtctacctgctggagactgtcctgtttctcctctatgctgagtctgtctacacggtggagaccgtcctgtttctcctctgtgctgagtctgtctacctcgtggagactgtcctgtttcttctctatgctgagcctgtctacacggtggagactgtcctgtttctcctctatgctgagtctgtctacacggtggagaccgtcctgtttctcctctatgctgagcctgtctacctggtggagactgtcctgtttcttctctatgctgagcctgtctacacggtggagactgtcctgtttctcctctatgctgagtctgtctacacggtggagactgtcctgtttctcctctatgctgagtctgtctacacggtggagactgtcctgtttctcctctatgctgagtctgtctacctggtggagactgttctgtttctcctctatgctgagtctgtctacatggtggagaccaccctgtttctcctctgtgctgagtctgtctacctggtggagactgtcctgtttcttctctatgctgagcctgtctacacagtggagactgtcctgtttctcctctatgctgagtctgtctacacggtggagaccgtcctgtttctcctctgtactgagtctgtctacctggtggagactgtcctgtttcttctctatgctgagcctgtctacacggtggagactgtcctgtttctcctctatgctgagtctgtctacacggtggagaccgtcctgtttctcctctatgctgagcctgtctacctggtggagactgtcctgtttcttctctatgctgagcctgtctacacggtggagaccgtcctgtttctcctctatgctgagcctgtctacctggtggagactgtcctgtttctcctctatgctgagtctgtctacctggtggagactgtcctgtttctcctctatgctgagtctgtctacacggtggagactgtcctgtttctcctctatgctgagcctgtctacatggtggagactgtcctgtttctcctctatgctgagcctgtctacacggtggagactgtcctgtttctcctatatgctgagtctgtctacctggtggagactgtcttgtttctcctctgtgctgagcctgtctacatggtggagactgtcctgtttctcctctatgctgagcctgtctacacggtggagactgtcctgtttctcctctgtgctgagtctgtctacatggtggaaaccgtcgtgtttctcctctatgctgagcctgtctacacggtggagactgtcctgtttctcctgtatgctgagcctgtctgcatggtggaaactgtcctgtttctcctctatgctgagtctgtctacctggtggagactgtcctgtttctcctctatgctgagcctgtctacatggtggagactgtcctgtttctcctctgtgctgagtctgtctacctggtggatactgtcctgtttctcctctatgctcagtctgtcaacctggtggagactgtcctgtttctcctctatgctgagtctgtctacacggtggagactgtcctgtttctcctctatgctgagcctgtctacacggtggagactgtcctgtttctcctctgtgctgagtctgtctacacggtggagactgtcctgtttctcctctatgctgagcctgtctacatggtggagattgtcctgtttctcctctgtgctgagtctgtctacacggtggagactgtcctgtttctcctctatgctgagcctgtctacctggtggagactgtcctgtttctcctctatgctgagcctgtctacatggtggagactgtcctgtttctcctctgtgctgagtctgtctacacggtggagaccatattgtttctcctctatgctgagtctgtctacatgatggagactgtcctgtttctcctctatgctgagtctgtctacacggtggagactgtcctgtttctcctgtatgctgagcctgtctgcatggtggaaactgtcctgtttctcctctatgctgagtctgtctacatggtgtagaccatattgtttctcctctatgctgagcctgtctacatggtggagactgtcctgtttctcctatatgctgagtctgtctacatggtggagaccatattgtttctcctctatgctgagtctcctctatgctgagcagatttctcagccatcttcttgaaaacttgtctttataatcttggcttccacgaccctgcaacaagaacgttgtgtttctactagctacacctgctcttttactctaaatgtcaacaccaatagtttgatactcatgatagactgcatgatcttgcttttgaatttgtgtatctgttctctctctttgggtcatgagtttgtaaaagttgggcattactgctttctattttttctctccttgatagacacaagctgtacatcatcataaatgaataaatgagaat

SEQ ID NO: 476158 - DNA, 1299 bp, Homo sapiens
tcgcggagggacaggacggtcgcccactgctccatttcttttctccccaggccgtccctccctggcaggagcagcctcatgcggaccgagccgctgtgcggggcatcccctctggtggtgcccggcgacccctactctctggtgtttctgctcaagggctacgcggagccagagggtgtgggcgatgcctgtgcgcgcacgacggctccgtgaccctggtcctaccccagacccggggcccaggcctccagccaccgagagtccccgcgcgggagtggcggcgcagaggcctgccctggaggaggcggcccgtggccccatcctggtggacaccgggggcccctgggctcgggaggcgctgctgggggcgctggcggggcagggcgtggccccgggagacgtgacgctagtggtggggacccacgggcactcggatcacatcgggaacttggggctgttcccaggcgcggctctgctggtctcgcacgacttctgccttcccggaggccgctacctgccccacgggctgggtgaggggcagcccctgcgcctgggcccggggctcgaggtgtgggccacgccgggccacgggggccagcgcgacgtgagcgtggtggtggccggcacggctctgggcaccgtggtggtggcgggagatgtgtttgagcgagatggggacgaggattcgtggcaggcactgagtgaagaccccgcagcccaggagcggagccggaagagggtcctggtcgttgccgacgtggtcgtacctggtcacgggcccccctttcgagtgttaagggaagcctcgcagcccgagacggagggtggagggaacagccagcaggagccggtggtcggagacgaggagcccgccctgcactaatcagcctcgagagggactgcactcttgtcagggaagccctaacagcgaagagctgctggagacagagtcagagcagtcaagggtgggagcttccagcccttccaggaggccagttttctagtgaagacagagtgcacctgacactgccatcacatcgtcagtatcactgcctgtctctgccaccaaactaagatcaaaggaggggctcagctccctgtgcattctccctgggcctcagtaaaatgggagaaggttcgtgggaggggcctccaaaataaaaatggaaactgcattgaaaatcatagtgccctagtgtaaatgtgaagcattgacaatgataatcgtgcaaacatggtaatctacaactacagcagaggcatactttgggcaattgcgcctttcttataggatggagg

SEQ ID NO: 476159 - DNA, 576 bp, Homo sapiens
tctctctagggaggctcctcatgcaaataaagtcctggcagcctccaggctgggtcctcagatatccccagatagatgtggatactcaagcttcagtggaagatcagaaaagcagagcaggaattggtttcatgcattttccaaattcctataaaatgctcaggttgggtttgatgctggttacttcatctgcagtaactcaaagtgcagataacaacaaattatcccccacggatacacagaaaagaggcaggagagtatcagggaaagaggacgtggctaagagggctgactggggatggcgtcttccctctatcgctcaccagctgtgggcttccgtgtacatcacatcatggttgaagctgtggattacaacaaaccgaaatacaagcaaaaagggcaaagaggaagaaaatgagagtaaattactttaagtttcttccatatgcctaatatcatactatcataacaacatactataacatacttgatgctattgcaaggtagatttggtaaatttaagataagtaagatataataggtgctctcagagcaactgtgcatataaacaaaagc

SEQ ID NO: 476160 - DNA, 599 bp, Homo sapiens
acagtcacgtcctatgggctgctgcaataactggccacacttccgattttctttctgcttcttcatttttcaacccatatgcagcatgagcaagtggagtggcgcactgccgagggagcacagccagcccggcggaccttggcctgggaaaggagcccaggcaagatgtcctggcagaggactgagcatcagtaaaagagagaagcgtgaaggagctggcatgctgggagctccaggtgtttgtgtgattggagaagaaggaggcctcggccagtggaggaggacagagctggaagagcgggcagggtcctccctgaagggcttcctgggctcacctgggctggggctgtgtactgaggagagtggcctccatggggtctcagtggaagaaaatgagaagggcctaacgccagccactgggaatggagagaaggagggctcgagtgatgcctggctgaggacagtgatgcagcatctgcaaaggattggaggcaggtggaagacaaaggcacactcgaccttggtggcttccggggtggggaaagggtgggaagcacaaggaggctttcacaggagcccctgcgacaatgaatgagaaa

SEQ ID NO: 476161 - DNA, 515 bp, Homo sapiens
agtgttgagcttcaaactctgctatgttcagaaggaaaccgagccccattaccacccaatcttgctgctgcacgaccttgaccctcgggctatgtggagaacttggggattgtagccccaaggtgagtgcgagccctcttgggctcctttctacgcgtgtggatcagtggtggcatagaggccgtgatggcagcggaggagctgtcacggaaacggcgaccattctcaaagtccttaatggccaggtcccaacctgggcagcgaggagatccttgtggaggtgtaaggcagatattggaaggggtaggaatggagtactattaactagatggttggaaagtgcctctgcaagaacagaggcactgagggcccaagtcatagagcaagtcctaagtgcaaactacaatgccgagaagttgattagcttcaatagacacaaaaagggagctcagcagcaagctcaaacacggattttcattttatgagtctccctgcttcacttcagaatttcctct

SEQ ID NO: 476162 - DNA, 732 bp, Homo sapiens
ccctttggagccatctgggaacaatgggtccataaactttggtgtggcgaagtgggtacccagcaggagaaggtgcttttgggagggcctgccctgttctcacctctgccctgaatcaatgtatcgattttcaccatttgcctggactgattgcaggtacctgtgtgagggagataaggatggagctggggatgaagacaggcatgtagataagggtggaggtggggatggggatgggataaagatgaggatggaaattgggatgaagattaagatggaaattgagatgagcatggggatagagagagatggggatgaaggtggagatgggaatggggatggggatgaaggtggggatggagatgaagatggagatggagatggagatggacatgaagatggagatgggaatgggaatggagttggaatggggatggagatggagacagagatgcagatggggatggaaatgaagatgaagaaaggaatggagacgagagatgtagatggggatggaaatgaagataagaatggagatgaggttggggatggagttggagatgggaatggggatggagacagaggtgcagatgggaatggagacagggatggagatgataagaatggagacgagattggagatggggatggagctggagaaggggatggggatggagacagatgcagatggggatggagacagggatgaagatgataagaatgaagatgagg

SEQ ID NO: 476163 - DNA, 811 bp, Homo sapiens
ccccagcttcattcccaggctgctggggtgctcccagtgtccttttgatagtggcaggccctaaggatgctctccagcgcatcagagcccttgtgcaggccactctgcctccctgatatcgctgctcccccagtggagctgccctgggcacagctgctggattttcagatgcccaatcctactctcaagtttccgaactcttacttttccccaatgcttcctctgctggctgacctgagccctctcctgctggtatctggcatggaggagatgtttctccagcaaaggaaagatgtcccttatcagacacggctgggctctcccccacctctcagcagcagccttgcggcccctaacaccagggctgccagggaacagcaccagaagaaaggtgagctgtactacgttagcaggaagtgggaccagggcctccaggtcctgtttgtgtttatgtcttgtccttccatggattatgaacgggagatgttctgtctcctttgtgaagggacaatctgagcacctaacacccctataagcaaataaatgcagagatgtcctattgttttgtttttgtgtttttacttaaagacaaatgcaaacaaacaaaaaaaccacagaaacctccaactacaaggccaacaggaagtcagaagagacatcaaaggactgttacaatgagacatcatggaagttacaaaagtgaatgtatttttcagtatctttagtttacaccctaggaaagtctctagtattttgttttagaatatatgtatacatataaatattttatatataacttatatgtatgttt

SEQ ID NO: 476164 - DNA, 1393 bp, Homo sapiens
cggcttcattcttgaagtcaatggtaaaactgagattcaggatgatgaataacacacccaagagcaatagccaagtgtcagagcgtggactcaggccccaggtcatagatgatggtggtaatggtgatgatggtggtgatggtgatgatggtgttgatggtgttgttgatgatggtgatgtgatggtggtgatggtgatggtggtgatggtgatgatggtgatggtgttgatggtaatggtgatgatggtggtggtgatggtgatgatggtgatggtgataatggtggtggtgatggtggtattggtgatggtgatgatggtgatggtgatgatggtgatggtgatgatggtaatggtgatgatggtggttaaaaaggtggtggtgatggttaatggtagtgatggtggtattggtgatggtgatgatggtgatggtgatggtggtgattgtgatagtgttaatggtggtgatgatggtgatagctatgtctttatttaagtactttgtcatgctttgcagatttttttcataaagtaaatcattaaagacatggataaaccttgctatttgcccacaatcaatctcatttctttctctccctctcaataagagccactagtctgaatttagtagttttcattggcatgcatattttaaaatttactatatatgtatatatccctgtataatatatagtatgctgtgcatatttttaaatgctgtaaaatgacatgctttttaaaaaacatcattcatggagtagaacgttggacagacgggtatgctcatattcaactttactactaatagtcaaatcactcttgagattaattgtataatttaaacttctgccaacagttttggatgatccagatctttgtcaacatttgacttgtcggactttaaaattttgatccatctaataaatatggaatgctaccatatttttattttaaccaaggaaacataattgtaataataataagaccaataaaagtggattaataaatttttttcaggcaataatttttcaaacgtacatatatccagtttctttattttctgtcaattatgaggcataattaataaagtttgtatatatttaagatgtacaaaataatgttttggtatacgtacatactgtgaaattattaccgcagtcaagcttattaacaaacatatccagtacctcatatagttacctttttgtaggtatgtggtgagaacatttaagatctacttaatctcttagcaaatttcaagtatacaagacagtattattaactatagtcaccacactgtacattagatctccagaaatttccattaatagtaataccaataattattagtattattgatataattattgtaattattactacaattat

SEQ ID NO: 476165 - DNA, 642 bp, Homo sapiens
ccagggcgggactgggggagccgcagcagctggactctggctcaaggaccagcaacccgaatgtttctgtccatgacccatggaaacctgtgtcctgatactgagatatctaggaagccaaaaccgtcatcatcagaagctggcttagagcaccagcagatccctccagagctgctgccattgtgtgagcctgatcatctggctgtgggtattgttcaaggaccgcagccaacaacacccacagtttttgctggcccggagcctgagaacttgagccagttcccaaacgtatacagagtttctctgttaggatacaacatactgttgtacgtggcacggctgcagttgagtttactccctccttgggacaggcagaatctaaagctacgattgcagggcctgagatggtccttctcaagaagggaacaggaccactgtcctggacaccactccaggtgtagcacaggtgactgcaaagtctgagctagcatcatctctatcaatcaggtttgagcattctttcctctgccagttcatatttactgatgagtccttctgctgaattttttattttagttattgtgctttgtacttgaataatttcctcttggctctttttcatagtttatctttctttattga

SEQ ID NO: 476166 - DNA, 574 bp, Homo sapiens
agcgtgctaaattctcactgtgttcagatcagcagatcagatgagaggggtgggtgaagcaggaggagctgcagggtttcccacgtcttcagcatcacacattgggccctccagcctctgccctaccatcgtcatcatttggtcactaccgggacttgcttgttctggcagcgctgggctctcagcctctgggactctggcccaggaagcctgtctgtccacattgggcccattttactcccacagtcacagaattccaggccccctctctcctgctggtcttcgtgcctgtcctgtggctaaagcctactggttaaatatatcaagagaagagtttctcctcaaaccctcagtcagaaagcattttctcggcaggaatacattagggaaagtattgtctaatacaaacaggagaagcggaatactgcactttatttccaaattctgactaaatccgcagtgtctgtacggcagagataatcctacatcatttttagattttgcagaaaactgtccctcccttattttttaacatcaaagagaggatagaatcagtctggataaccattaacag

SEQ ID NO: 476167 - DNA, 1014 bp, Homo sapiens
ccaaggcactctaggatgataaaatggggcattaccccataaaatctctaagtcattattttccatttggggggtatctggcagaagaaatttctaagcagcaaagaattcaagaggtgacttgggtgctgttaaaggcattcagttttataagggaagcagaacataaaagtttggaaaatgtgcagcctgacaatgtgatagaaaaaaaaatcccattttctaagaagaaatttaagccagctgaagaaatttgcataaataacaaggagctgaattttaatccccaagacaatggagaaaatgtctccagggcatgttacagcagctccttccatcacaggcccagaggcctaggaggaaacaatggtttcatgggctgggcacagggtccctctcctgtgtgcagtctagcgacttggtatcctgcattccagccccctcagccatggctaaaagaggccaagactgctcgctacaatcgtcccacactgaggttctgttaaggtttcttgtcttagtctatttctgtgtctgcttctatttcaatattttctattgctcatcatcaagtttattggtgtttcattttgtttactatgctgtcatttcatccactggcacactctttttcatctttataaataacattgggttcctttttatgctttttatttctctcagtgttgtactttaattttatgaacatgtctgtaatatttataatacctattttaaggtccttgtcatttctgaacctgtgttaactggtttttctcttttaggtcactgtttgctgtttctttacatgctgataactttctacaggattctggacattgtgaatgttacattattatgtgtttggattgtgttttctcccttttggatgggttttgtttcctcatttgtttgttgttatattttgctctgttttgttttgttttcttttaacggacaattgtaaatccagttgagcctcttaagttttatgattcaggaacgtcagctcta

SEQ ID NO: 476168 - DNA, 1107 bp, Homo sapiens
ttaaggtggaagcagccagttcagcggagggcatgttgcgttgtgctgcctgtgaacaccaggcacaagttccttatcggcatctggcatcacaaaagacctctgagctggggaaagatatgtcagactcatacatcttggatgtgaagagtggagagtggttaccttactgtttcccagaccctcagattaacatgctaaccagggagcttgtcctgtgccgtgccctaacgattctggcccagttgtctggtgagcaacctttgaatctggattttatgcagattcatgaagcgaggttgatgcgaagtgagttttctaagaaaacaaaggtagttgatagcaggtccaaaagtccagtatcatttacactgggaaaacagtgcagctgccacccaagcccccatcctttctcactttcacaggatttgcttcacaaacaactgagaaatagaacccaatgcaatatctatagtctagaagtagacaccagggagttcaggccgaagaatcctgaggcatcttttgtatcctgctggacatgcagctaatgctagaatgtgtgaccaattaaagtaggtgaaaatcacctatcaatttattcctaaacgaggtaaacaaaccaacagtgcacatctccaagaaaatttcagactttgaacagcacattgtaactcattagccctcccatctcatcctcgttttggcgaagggtcaggaccagatatctagacagccccaggagtactcataaggctgccccagtgcagccgtaagattccctgttcctacacagttcaggagatgcactaggaagatacatatgcaaaacgccatggattcatgaagatttagacatataagagagtgaaatgtatattcaaatggtgcttcaaatcattgagcaaagatatattattcaataaattgtatttccgtatgttctaggcatttgtggtttttccagagtaatattttctatttaattatataaatgacttttgattcaacttcttggttgctcacggacttttctgatggtaatatgtcagtaagataccaagaatactcaaatttaaggaaaacatattgttgtagttctgtgtc

SEQ ID NO: 476169 - DNA, 797 bp, Homo sapiens
gggctaccgggcaggatgccctggccactggcctccagtgccctgggctcccctccgttttcaagccccctcctaatggagaagatgaggaggctttgggattcggactggcttccctgctcctcagcttgcggatggcctattgtaagaccttacgatcgtcctcgccagatgtctgctgttaaaatgagggcattgattggaaaagaatgggaccctgcaacttggaatggggacctgtggaaggatcatgatgaagctggggacactgagtttgtgaactctgatgaatcttttttgccagaaggaacagcttccccatccccagtagtggcaacatcccctctccgacccatgctgccatcagcctttccacctttgtctgggaagataaaccctgcactgcctgaggcaacagtgatgtccttccctgagacagttgccaggcaaaataatgttgattctcctgaggagccacccccaacacccctgtttgcttctagacctaacactagactaaagtcctggcaggcacctagatatttaacagtgagaaccgcagtcactcaactacaaaatttaaatacaatggaaatattggatcccgaggtggcagggagcaaatggcagcactcaactgtcaaaggtaaggtgggcataactaccgtaatggacagcagaggcaaatcagcaatcagaatagtctgactcatgtagagctgtgacactggctaattaatgatggtgttcctagaagtgaaattgataggaagcctactatattcctatattaattg

SEQ ID NO: 476170 - DNA, 1415 bp, Homo sapiens
ccttctgctgtgctgcctggttcctaacagcactcagtcgatgaggaactgggagagggacctgtgcactaggaaataaattgcttgttgaaactgttccgggtatgcctgcatgccagatacccaatcttgcaagaccgccattaaagttttgcttctgctcttctccgtgcccctgagtccattctttgggtttggacggatgagaaaatactccagattagatccagaggacccagtaggacagggtcttctaaaggtcaactttgtgaccaaaagccgcccagatatcaccaaacagttacaaaagattgagggctggaatgaaaagtcgattgaagagttgctgagggaagcacagaaactctttgtaagaagggaggaagagagacagaaacaaaaggcaaagattgtggtctctattaatctaaaagtagagatctctttgccatcaaataggaaaatcccacaaccgggaggaaacagcagcatcgctggactgtgctgccacatcgtttcactgaagccccaaacttatttggtcaggtcctctaaaggaagaaattcaggcattagaggaacaaaagcaagctcttgtaacagctccggtcctggccctcccacctctagagaaaccgttccatttgttggtgacagtggatcagggtgttgcccttggggtgcttactcaaatctggggatctttgtttccaaacttcttgatcctgtctctagaaggtggcctgaatgtgtacaagtgatagcagctacagctctgcatgcagaagagagccaaaagctaacttttgatggggctctaatatcagcaaccttctggtggtcaactattaagaaaaaggtaaactggatcaattacatctattataatcagaaaagattcatcagttacactcaagatgcccttaagggtgtagccagccaactaaatgccactagccaaatgtcttgggaaaacaaaattgcactgaacattatattagcaaaagatggggcaaatcaaagcggggaagcttactggtcaaagttggattcaaagattgtctgattgtcagttgattgaaagtttatataaagacctggaaccaatagaagggagtggctgggttaaggagtttcattgagctattccttaatgcaagttctgctagtgacaaattatttgctttacttagtttgagaatgtctttattgctcctacatgcctaaaggaaaaacagttttctcagctacacagctttcagttgacagcttttttggtttccacgtttgaaaactgttgtgctacttccttgtggtctccaggctttcagatgaaaattctgctgtcatccatattggtgaactcctataggaaatgtatctctttgctctaactgctttcaagatttatctgc

SEQ ID NO: 476171 - DNA, 627 bp, Homo sapiens
cgctgcctccccatcaccttccaccatgactggaagtttcctgaggcctcaccagaagcagatgccaataccatgcttcctgtacagcctgcagacctgtgggaaatgtgacaggcataccaaacaaggtccccacaccctgggcatagtctcctccacgagcattcctcgctttggcacctccgatgctgaggcagttcagcacagggttctcctcctcccaaccagaatctgcagctgcttcctgacaacttttgctgatgagcagatctcactttgcctgcaccacagtggagcagagtgcagcagaatgaatgccgccaagtccttccccatcaataaccttaaccaacacatggcaggaatgggtgaaccaagatccaagaacctttgcccccaggtgggacatctccgaggcacttgttctacactggtttcaagggttctccagtgggattaaggagacaagtatctcagttttttatgtgattattttgtggaagagagagattaggtaacataaccaaagtcacatgaatattgcatttctggactgggatttggatggaggtctttctaattgcagagctattttgcattaaaactctgatgaagaagtacaaagac

SEQ ID NO: 476172 - DNA, 824 bp, Homo sapiens
ctgccaacacactgtcacctctcaatgctgaatattgtcatgacaatagggctatgggtctcaattcctgggaaagacaaagctctggggcctttaatttgcctgactgccattccagggctccttcacaagctctgttttccacactgcaatgtctataacaatgacacttttttctctctaaatatttcagattcctttctgcatttattatctcagttgctgacattaccagtcatgcagttacaatgtctggaaatatccatgaatactcagtctccctttagagtcctcattcaattaatcagagagtcttatttatctaatctctgcaatgtccctttacttcatcctctcctctgcagatctctgctgctacactgctcagaccctcataatctcctacacatcaaatggtctttctcctttagcaactccacccttccaccctattcctggaaactgctacgacagtgttgattataaaatatagatatgatcatataattttttcccattctgcatgaaactccagctcatggttctctcctgtctgtagaaaaaaaatcccaaataagtcttgatatataactctaaagtaaactcctatagctttctctgcaggactttgtccgtgaccatagcagtcatcatcatactgcagattttagtgagaccccctccacctcacaggacaagtcagtctttttcattgttgggatcccagttcctagcttactgactgactggcatttagcagacaatagatatatttagcagacaataggtactttcaggtgtccctttgtggtagctttcatttt

SEQ ID NO: 476173 - DNA, 874 bp, Homo sapiens
cttggactggctctccttgctcctcagcctgcagatgagcgtcctgaggtttgcaggctctttacagataggttgcttccatttctcatgcagtgtgatccagcagcacacccaacaaggctgtgaaggcagctcagggctcgcagcatctccagtgctccaccacagtcccgcctgcgtcggtaaaactgcttaaggcagcgctaattaatgtctcctgcttatcctgcactcccctcgcagggtatcgggtctcagaatcgacttcctggactttctttggcacgtctgctgctggaaatgaatcagaatacagggagagggctaattgacaggtctatggatgccgaagacactgctctgcctcagaagacatcatccccacgttaccaaaaacatcactgggcctgccctcgtggcacccttggcctcaaaaagcaggtgaacacccatagacacaggctccaggactcccaagggccaggaaggtccccacagcccacactacaggttggcccctgcagccccacaatccagcagacccaggttccgggcctgctccagcagaccagggtaaaaagctgtctagaactggaaagtcctccaaggacccaggttccaggaccacccctgtgttcccaggtcccaggctggcccctgaagactcaggacccaggccagccctcacttcaatgccaacaccaatggacccggtctccagactccaggccagccctaatggctccaggcaccgggttaatgcctgtggtcttaggtaccagaccagccctcatgggcccagattccatgccagcccttgctggaggctgaccccaaattcagggcagtcctcattgctccaaactttagagga

SEQ ID NO: 476174 - DNA, 3619 bp, Homo sapiens
ttattttctgacacttgttattttcatctttttttaatagtagcctgaatttgtggcctaacatatggtctattatggagaacgtccttccactgagatacatttgttccattcttcccattataggtggatgggaaaattcccaggtaggcagagatatctagaaggcgttgtgatcataggagatgacagctctatgcctgtcattgcccctgaagaccttctactgggacaagatgtggaagtggaagacagtgatattgacgatcctcaccttgtagcgaatggtgaagaaatttcagttggaggaaaactaatagaaagaaatggaatggttactagtagctgttctacaaaagaatttgctgccaacagcagtgtacctaaagaaatactaaaagtttttcttcaggaaaaggggtatcatggaaatgcagggataattaacaaccaaggaaaggttacacatggagtaaatctaaatgaatattgactatataaaacaatcataattttatctgtttaatgtttaatcttcagtggcaaaaatcatagaacataaacatttaaaattttctaaatttcaaccctgaaggtggaaaaaacactgacgtatatatatattagattttaccaatttatgcatgctaataagaatgtattctattcactttatgaaatttcatttagctgtacatttatgattgttatacttcattatattaagatgagatcaaaaagctcacccaaaattatgtaatgcaaataaatattttgaacaatactttttggttgaaaaacgagaaagccaaaatatcattgcattttgatatttttattcaatgtattaattatataaagtttttttttttacatcaattaccctcatgcagacacatgtataaagtttttcaatgttgatattaactaaggtttttgagaaattggtaaaagtttcagttttattaaagcatagtgtcagtattattaaattgttgtaaataaatgagagaattgttgaaatgaccataaagtttaaatgtttaagtattacatgttgaaaaaatgacttgttatcaataaaagaacagcacacatttaaacctggttagataaaaaaataaatattcagtagaattaagtggtcatatctgattagtctaaaacttagatttgttttcatttttatatttctgtttactgtgctgtattaatgatgagtaacaggttatttgaatacctataaaagcaaaatttgttgaagatacaaaatatttggttagtgaagaatttaagagattttgaaaaactccagaaggatgtaataaaactagataactaaacaatttgttgtcaaatgaaatgtaatatacacagtggaagatataatacactataagaaatattttaatgtacatccactattttgaaatgattataaccactgaaaaattaaatattaatatacactcgtacagactgtccttaacttatggtggtttgagttatgattttttgactttattacagtgtgaaagcaatacatattcaacagaaaatccatacttcaaagtctgaattttgatcttttcctgggctagcaatatgcaataaatactcagctcccagtcatccacaggatcatgagggtaaacaaccggtagtgatgccagatgattttgcccaactctaggctagtaagtgttctgagtatgtttaaagtagggtaggctaagctatgatggtcagtaggttaggtatattaaatgcattttcaacttacaatattttcaacttacaatggatttatcaggatgtaaccccaacctaagtcagggagtatgtgtacttatttcatcctcaatattttatttagataattatggagtacctattatggtctttagattccatatatctcatatttcaaaattatatggaaggatcaaggaccaggaataaccaagacactccttgaaaaagaagaacacacaagacaagatttgtcctattacatattcacctcgttgtaaagctatattgcattttataggcagtattgaagtagggatcaataaatacaccagtggaagataaaagaaacatattccagaaacagattcatgcatatgtgaaaacctgataaatatcagagctcttgtgtcatatcagcgggaaagacagttaacacagaataaagggaaagcaattgactattcaagtaagaaatgagaaacagaccccatttcaattgataagcaaaaatttatcccatactgacatttgaatatagtcttgattttagataatagtattataatgacatcaatattctggttgttataattatactatggatttataatatgttaacattagggaaaggttgaagaagaaaataagcgaactttctgtgttggttttgtaactgttctgtagctctataattctttgaaaataagaagtgttttttaaaaaggtagtacaagtaatatgtgatcagtaaaaattgaattccatgttgatcatgagttttaatgcgaatagcaaaatttaatattcttttgaaaacaatatataagaatacttttaaccctttgtacttggaaaaaatttcttaaataagacttaataaatacaaaccataaataaaaatatggataaatccaactaccttaaaaacaagattttctgtatatcataatttctatctcattaccacaattgttacaatatttttaagaaacagagtttcaagaggtcaatgacagctcatagaaaatagttacttagatatgaaaatcaaatttaatctcatttctgcctaattctatatttttttcctttgggcgttatagttttctccttctcaaaaaatatattttaaacaataagctaattaacctataattgtaaaagaatgcatggataatataacctgcattcatggcatagttgtatgctcacacctacctaaatttacaagagaaaacagcttttagtttattagaatccattttatctttggttttgacattttgaaatgaggcataaataaggatatccttatataaaaacatgtcatgcatattgcaattacaaatatagattgatacaagtatgctggattggtgacataccatgaaaggtgtggctattgatgttaagattttttgaaattgtaaacaacttttaacaaaagtctgagccaaagtatatgttttatttaacttacatgataattttatttctgaataatcccataaatattaaatcccagcaaaaaacactttatgtttcaaaagagtattaggttttatgctcaatcatccaccaataggaatattaatgggacatttgattttccagtagaaaaaacttaaaaaactttttattgtacagggctgtcctgtgaatttcagtaaatctcactgatgggacccaaccaattatattcagtgcattgcttttctttgtgacaatgcaaaatcattcataggaggggtcttcaaaaagtttgtgaaaaaatgcattttatgaaaaaactaagaagagattctaaaattgttttggacccaaataaactcatactaacttgttataacatgtctaagcagga

SEQ ID NO: 476175 - DNA, 1003 bp, Homo sapiens
gaaaactctagataggtccttataatggaaaaaagacatgtttaaatgctgtgaacagactaggaacctctggatccaggaaaggtgactgagtccacaatgcctctaacagacctgaagataaatcacaagacaacaaaacgtcgctgtctcttatttggtgccctatggctgaaaatgtgcagtgtttctgatggcattgctcagtttagtgcaaattattcccaaccctgcaaccagacacttcagcacagtctacaggctgcttgtgaatgtggagtttttcccgtctgcctgtggaaagagacactattctcagcactgttactactgatccttctgggtggctcctctgtggccccgattgttggtagaaatatggatgggaatggtcattctagtatggtctcaggtggaaatgaggaacaggttattggaaactggagtaaaggtgatccttgttataaagtggcaagcaccttggctaaactgtgtcctggcattttgtggaaggtggactttgacagtgatgaaattggacatttagctgaggagatttctaagaaaaatattgaagaagcatattcggttttccttacattaggagtaagatatgagagaagagagactatccatattgcaaaaaaggagaaaacatgttccaaagagaacactacaggtgtagatgaacaactacttgataagattcatgtttctgtaaaccgcaaatggaatcaaccacttcagcggaagccagaagtagagatgggattatacctgcagagacactgccagtttgaaatgagagtttggactttagactttagggttgatgctggaatgagttaaaacattcagggctgtcaggatgatatttgcacacaaggagaacatgaatttctggaggttggaggtggaatgttatggactgaatgtttgtgtcctcccaaattcttatgctgaagccctaacccccagtgtggctgtctttagagctggggag

SEQ ID NO: 476176 - DNA, 670 bp, Homo sapiens
tctgagaaactagaaactagaagagactttgcacaaacttaacccaccacacaaacccacatgaatagaatctcactcacatgcttgctttccaggcagtatccacagagaaataaactgaacaaccacaatctgaaattttggggaaacttttgtgaaaacatgcaaactccaaattgttaccccgtgttgccaaagaaagtgaggggagcagaatccgcagaagaagctgcagggacgttttggtgtggtgggaagtgcaaggagaagagcgctgcctcaggtacaggaaactgcggtgcccagctggaggcagcggcaccagaaagagtggcacccagctggaggcagccccatgcacagggcggggtttctgagggagacaggaaagatggtggaggaagctctccacagggagccaaaggaagcccatctcaggaagcaccttcttctaagaagcatgcaagaacgtgttctgacagttctctcctctccctgagcttggtaccactcaggaatgttacttgaacatgaaatagtcttgtgttctattgcaaagttacctcctttggggacaacttatttttaggttggtaactactataactgatgtattatttacccgtgatgtagtctgtacccttagtcttttgatactaactcttgtagc

SEQ ID NO: 476177 - DNA, 750 bp, Homo sapiens
ttcaattttccataaatcccacttggtcatgctgtgtaatttttttggatgccaacggatgtctgtaaaactggaaatacgctggctttcacagcagattcaggttgattctttatgtgaccttaacaattataccacaaagtatgatggctgtgacagagagccaaggcgcacatggctttcagcagaggtcaaaaagacacagggcatgaagagaatatgggacgaaagagatttattaatatttgtctctcttaaaggaactaagcaggtggagtcaaaagatagtgttggtgagagaatgtggattcttacagcaaagtgcaactgtgagaaagatggaagatttaattcaggctatttcaaggctcagcaatctagacagaaactgatgatagaaaactataaaaacagtaaaggcataaataattttaacaatactatcaaccacattgacctaattgttatttatagaacactatacacaactactgctaaatacacattattttcaagtgcacatgatatgttcactgagatcaattatacccttgtccataaagtttgcctcagatatacgcactatagctactaaaaaaatgtgttcatattatctgcttgagttcagaagttaaatgtgaaaaggttgtcatacctgcatttttagcaattattagtctaaacgcacttttaagaagtggtctctttactttttttgttgaatcagaataacatcacaaaaaaatgtta

SEQ ID NO: 476178 - DNA, 574 bp, Homo sapiens
ctttctattcaggattatgactctcctttagtgtcaggctcgtatgcctattgttatatcttcatttctttggagtcagtttctggaaatttgtattcctttggtggtgtcatatttccttgaattttgtgtttgttgttgtgctgtgttggtgtctgcacttttaaaggagtcatcacctcttacagtgtttacgtactgggttcagtggaaaaataccttcatctactggtggatacaaggtcaccagctgagttggaaagggcgaggatcacgtaaaaatggaagggaaactggtgcaaaactctcaggaacctgtgattctctgcatccacctgtcttcgtcttcaatatttcggtcggtgtttcactttgtgacctcacatatcctcacctgacggatctaagaagagttgagaaagtttttgatcatttcaatcataaaaatttcatgcgcgtctgtgtgaagagaccaccaaacaggctttgtgtgagcaataaagctgtttatttcacctgggggcaggtgggctgagtccgaaaagaggcagcaaagggagataggggtggggcc

SEQ ID NO: 476179 - DNA, 705 bp, Homo sapiens
ttgaacagaaaatattgccaaagtcagccaattggggctgtagtctatttcctttgggttgagggtgttttctggtatcgtcccttcgtggttcactagaaaaaatggtactggaaaggggtcccaatacagacccaaagagagggttcatccacgacagcgccacgggcccgagggacgaggacctgcctctctggcccacccgggcctcgcgcccggagggcggagccacctggttttttttaaagcatctaaactggcaactggaatgttgttttgtgttcatgcagtaattgattcagtagaaggtagtcttcctccagttcatattgaaccaatacccacggtagcagttaggagaaattatactattaaaactgacatggctgtaaaattgggcacattttacgaatgcttgctcatttatttgcaccagtgtatccacattcctctgattaacggctttggattggctattgttattgacagaaaacctgttatatcttggagtagcctctcattagaatattcttactggggtgctgacttatgcaattggcttagaaaacaaaattcatctttcaacaaagctacaatttcactttggaaactctgtgaactggaaagcattagagaaatgttgaaaaaggtgatgatcatggagataatgacaactcatgaaagagggtcttgaaagggctctgc

SEQ ID NO: 476180 - DNA, 831 bp, Homo sapiens
ttttatatcgatgaggtctttttatatgatctcattgagatcatatgatttcaatgagatctcattgtatatcaatgaggcctttttaaggccttatctccaattgcagccacgtttgtgggaaagtttggaacttcccagagactcattgagtggttttgaccaaaatgctgatagtgatatggacaatgaagtccaggttgaggtggtctcagatgaagatgaggaacttattggcaaatggagccaagatggtgcaagccccaagccttggcagcttccaggtggtgctgggcctgtaggtgcacagaagtcaataattcacatttgggaaccactgtctaggtttcagaggatgcatggaaatgcctggatattcaggcagaagtttgctgcagaggtggagccctcatggagagcctctgctagggcagtgcagaagggaaatgtggggttggagcccccacacagagtccccactgaagcactgcctagtggagctgtgagaagaggaccactgtcctccagaccccaaaatgatagattcaccgacagcctgtaccagaacattgacccctatgcttctgagagtgaggatttcttctttattaatgtttcagatcacatcttcaagtctctttcacatgaagctgtctacaacttttcctgattccaaacaatgtgattctatgtgcaataagattttggttagaacttattaattattatcattacaaataaatgtttggtattatgttttgatataactgttcatggattaaatcaagtacgatttttctgtttttatcttttttttaagttcacaacctg

SEQ ID NO: 476181 - DNA, 1749 bp, Homo sapiens
agcagcagctgctccgttcagtcccagaaagccacttctgcagtgagcatttgaggataggcacaaaatgaaaatggcagatttcctctttggtcaggagctcttccctggtgtgactagaatagctaaagttgaacgagaggatggaaagttaattcctttagaaaatattgatggatcacagatggtttaccaggcactattccacagagtggagatttctggagagaaggtgttcagaaaaggagaacatcaagtgaaaggaaaaggtgtcaatggctgtttctttaagctttgtcacgatgagttgagagcaggcattgctgtagaatgtggttcttactcgggaatcatggcctctgtggaatcttggctgaatccctctggtgttgatgaggggaacaacactttggatacccccttgaagagtctgattcctctgcaaagcctgaatgtgccagtgccagaaacagactccccagactctcctgaagccaggaccttcacctattaccaaattctgaccattgggacctgcaagggaatactctggaggcctctggaaggtttccctgataaaaaatacatgcctctggatgtatatttggctgtcattgatgcctggaactcaaagaacaagcaacaggatcagtctattaaattaaggtcatcacagcagaaacgtgcaaagagcctgagttctcaatatcacaactgagcctttggaacaactctgaaattgcggacttggggtcttcttatggtttgaaataataagtgcctttattgtttaaactactcttagttgggttctctgtcattgaatacctaaagaatcttaactgataaattcaccactctgcgttttgtctgttttatctttaacaatctggcaatcgatctaatttacctcattgttgtttcaatttgtaatacccaaatttatttaaataatatttaaatgtagcatttacttcagtatatacataaattcattccttgttcttgtgtgtttcttttttataataatatatttttatacttaaatctgtaatccaaaaagaatcaagagaaagaggaaagaaagaaagaggaaagaaagaagaaagaaaaagaaagaaaggaatgaaggaaggaaggaaggaaggaagaaaggaaaagaaacagtacaatttccctgttgtctccaaatagcttgccaattaagaaagaaagaaaagaaaagaaaaagtacaatttccctgttgtctccaaatagcttgccaattgccacaacacatgtcataaatataattcatcatttccatacttatttgaatttttttcatatcatattacaagattcctacatatgcttgagtgtatttctgtgtttttcagagttttcactactctgatttatggatatatattttcattaaagtttctacagtatacagatttaattattgtgttttatattacaggattagggatatcaataatctcccacttctatgatgcaccttttactaactgctcatcttcttttgaaagaccttagatggtgttttagtatgtgattgtttatgtacctttttatagttatttatgttcacattgagccagaggagcagggccatccttatctttgtattacacctccaagcacaatgccagacatgcagtagtgtctccaaatctgaccaactggtgcaaaatcaacacctgtagcatatgtactgtattagtctgctttcatgctgctag

SEQ ID NO: 476182 - DNA, 603 bp, Homo sapiens
acctggaaaagctgcaggcactcaatgccagcctgtgaaagtagctgccggaattgtaccctgaagtaccgcagggacagagctgctcaaggccttggcagcccacccattgtgtcagtgctgaaggagggctgttgcgttcaaggctttttatgcacccacttcccatttggtttcagtcataattcaaggtggttcctggaacacctattagttgaactgctagcaatgggtaggagtttatcaagtcaacaatgggcaaaaggatctaccaggaaaaaacaaaacgaccttaccctttcttatgatgcactgaaaatagagctttcccatgtggtcactacagatgaatgcagggaaaagaattcggaaagaatcagtatcaaaacaaataaattacatgcaataacagcttctattcttccttcagcagcacttgtgaggaagcctttggtccgtatcacatgtggaatgataaacaatgtcagctagggagggtcagggtctttttttgtctctctgtgaagctaaatttcattgaaacagcccgatttttcatctcagaaactctatttttagaagtaaaaaggggccacagatgtc

SEQ ID NO: 476183 - DNA, 665 bp, Homo sapiens
tcacttctagcactctcaggacgctgactgtgggctctggtgccaggagagccatgatgtcctgtgttttccttagacaggatgctgaccgttcactcagtagatcatgttcctttcaagttcatgttcggtcaagagcaccccacagcaaagcgacaggaatcagttccaccatgtttggtgctcacaggcgacttcagcacacttgcatacagcattttctctgggacatgtccaaacaccacaaagaggtggctgaaaaacctggggtccggcaccagcaagacagaatggatgacatcactgtcaccatcactctgaccctacaagagctcattgctcccaagtatgtgaaaggaaataagaacactgggctggaggtccacttaccctatgccctgatagtttataagcatcaggctcctaacaaatttaacatccttaaattgtcacagccaaaagggaccaatccagactttgcagaacaaaaagactctcctccttaaagtaaaatgccaatctatgaaccagaaggcagaaactgctcagaaatttttttaaaaagcagttttctagctttaaaactctgaaggtccagagcattatagttaattaactttattaatgagagcatttttagaatattttcacctgttcctattttt

SEQ ID NO: 476184 - DNA, 632 bp, Homo sapiens
tctacaagcatatagtaaaatgtgagggactctggaaggaacatatcatatgaaaagatttgcttttgcttctaccgtgtgcttaagatgccaggaatatgtgatcactttaaatgattttattgaatttttgtataaatttgaaccctatgacccaatgatgtcaggtttagggctacaatttctcaagaaaacatcctatttcttttcttctcacttgactgtaatgcctgtggctttgtcagctgaagtctcctttgtttcagagcagggctgtgtccatgagtgtgttttccccacacctctcctattagcagatcaacattacattgtgaataacagatggagacgtgcaggttttccaccctcccctgaagctcctggccttggcctaagactagatggcagcagcatttcctggctgtccccaagcagcacatggcatttgcttcctatgagagaagagtttcaaaactaggttctttctgtttttatagattgatggcttaaaatatatacttcttgttattttagaggttttgggaaatatatatatgttttaagcccataatctttaatataaaatctataatttatttagctgctgtcactgtgcttatttttaaatttaa

SEQ ID NO: 476185 - DNA, 1022 bp, Homo sapiens
caaaagtttaatctaggagtaggtaactcaacctaagacattgaataattagatatggagggagaagaaaaaggaaacatactgatgaacttgtttttctgtcctggcaaactggattatgggagcacctttgaacaggatggaggggagccatgtttggaggtttatggccatccagccagacataacgcccagacacaacaaagggttggtctgatgaggacatattgccaatattggcaagcagcttttaccactcatatatttagatgttcatggatgctgcacgtagcaccatcaacattaccttccaagacaaataatattgattcatcatccactccttttagggaaagttggaatggatggtctccagagaaggctgattcctcccattcttgtacatgcctgctacttccatcaatgaagtccacttcctgtcttagactaacctgttgagtagttttgatcaatgtaaagtggtaaaagaatcttgctgtgatgagttttaaatgcctcccatactgaatgttctccaacctctgtctccagctccaatctctggatttagagatctctggatagagttcactctatctagctccacattcctaaaaggatgagaaaacctggaggcctctaagcactttatgctgaattggtttgcacccaaaacatcatagtcctgtagaatttcacgagaactatgtgagcatagttctagtttctttgaatggcacatcactccagctgcttaaaccagggcccagaagagtcttaaatgccttctttacccttttactccatgtccatgcagtctacctgctttcagaacccagaggaaaaggatgtcctcatccccaatttacagcaaaagccatgaatttacagatgacagcttcagaattcatgtcaggatatgtgttctaatctgaataaagcattatttccaatatttggataagcctattttgtgaggaatgtgttcagacaggacagaaggaaggggcaagagttgtgtc

SEQ ID NO: 476186 - DNA, 555 bp, Homo sapiens
ctgccagttacccagttccaaagtcacttccacatttcaggattcatctcacaactgatggcgccctccctcagctgtcagcgcgaactttcacggtatgcagagatacccatgggtgtctatggtctttctctcttccctggacatatagagcaaatcagcataaccacctctctgatgtcaggggttgctcagagacccacttcttccagtaggatatgtggacaggcagtatccccagcttcagacaggagcttagatttgcgcttctacagcccaggtttcatctgctccgtggccggcactgtgcaggcagagaattcagcctctacgaagcttctgcatttaacccgttggacaattagtcagtttcagaactacttctactgcttcattaacggtaataataagatgaatacgactgtctgggaaggagggggaagtggaaagaagagagacagagattgaaatagcctcagctttgtagagggaaagtaaacactgatggcatgtcatgctattttcctagctggggaaaaaaaaaaaagcagtttt

SEQ ID NO: 476187 - DNA, 902 bp, Homo sapiens
cagcacagaaaaaccccgaaccactctgagagggattatggttatgaacggcaagtgggcccactctgagtgatctggaagaacgagacctcacacagtcgaattctgctctgggcgttggagccagcagcccgtctgagccgagctggaggagacaaagcctctatgcgcgtacaacactggtggagacttagactggccccatctttggcatctgcaaacagtgctgtgatgaatagcttggtacatgtggcttttttcacttgtggggatgtgtcatttctaacggcagtggacgtgtccactagaattgttatatcttcctcccacactggtcaattttttgagagaagtaagctagcaccaacttctgctacacaggagagccatagaaaactggagattcaaaggcacatcctggagcttattctaagtttgaaaaaggctttcagccatcataagtgcccaggactcccaagttcatgtccagaacctgctctggtcctccaagcttcagactggaccaatctatcaccagaagccttaccgaagactgtagatggaggtctacagcccgggagcagttccatcagaggctccaatgtggtgtttcagctcacagtttatggacgggtggtgaaggttcagacgggtggctcatctgattggacagaatctcagatgcaggctgtgccaaggcaaggctggcaagagtcccagaagttcagttcacttgcccctggacttcctgcccttgccctgtttggggaacaagcccctgaggcctgcatggctggctgtcctctcttccgttcatctcttttgtcctgaacaccagggggccaagtgtggcagaagtgtcatcttcccatgacacgcgccttgtgtccctggggagggag

SEQ ID NO: 476188 - DNA, 1089 bp, Homo sapiens
cagctgcccttgcatctgtgtctgagtctgaaccaggaacactaagattctccttcattcaatcttcttccgtttttctaactctgtagcattctcagcacatgcggctactgagaatctcaccggctccgtttctacctgcaaactgcacttgtggggtctctaactccaggggcaaggttcatccttgcgtgtccatccctacggtgtgtccagtagtttcctggagatggagcttcttgacagaaggaggagatgtcggatggagaatgagaagaggattccggctgcctcccaaagctgccctcctgagcgggctgggagaagagggatgcgtgctgggaggaaagacggtcccccagtccactccaaaaggcatatacgggtcagccccggataacagaccgcagccgagcgcccccagccctgcagctggtggcatgcccccagatcctagctacagatggactgtgtgcctcagtttcagcactattgtgaatttcccccgtgttttcatggatattttcacaggtggttgaaaaattacaggaaaggaaaaagaaagagagaagtgtgaaaaaagaagtgttaatatccattgccttcactcttacacacaggaatagagttgcatgtatataaactaccttggaaaattgttcagttggcaaacatcttttcaacgtcttcagggagacctgagtagaaactagtcatgtttcctttttaaaagttagcaataaatgttccagttattttctctcacctcaccttagacagagtatattcttcaatatcttctatcctgaaaaaatatctacaaaaatatttctgaaagtcaaggaagagacgagaagagggtgtcagccttacgtttatggtgtattaaggactgagtaagccctgagttctttgggcatttatctactggtattcaaatacaatggacagttactctgccagcatgattaaatcacagtattcatagttttcataaatcaagcagataatttcctgcattttaggtctttcagcatcaaacaatgttttccagtaacaacttattaaataaattattcctgtgtgaag

SEQ ID NO: 476189 - DNA, 858 bp, Homo sapiens
caacccaaaactgaaggatctggggctttcttcctgcaagctctgctcagcgaggggcttgtgctcctacaagctctttgctacataagtcaagccaaacttccatttcccgacatgacatggccaaataagagaaggccaggttaccagagattaaaaataggacgttgctgcagagtcctgggaccggctggcaaatgacacaggaactttgggagcgcatggactcaggccaagcggccgtcctcaccctcggccacctcagggcagggacgaagagtaagcccagcctttgatggtggggattagtcccaaaattctggagttcaccactcctcccgctacactggctttatttcaaatctctgttggtccatgtcaacatcagcgatgggagttgaaagaagtaaaacagctcctggaaaaatacatgttggtgtgtttacaacatgggaaaaatatgtcatctcagcattcagtgataaagcaggtataggtcccaacagaagcgagggtcaggacaggcaacgggaaacatgtgctcgctgctgggtcccaggactgagtgactcaggaaagctgctcagacttatcagctctgatccctgggacttcaggcttcaagagatgtggtttgacgggtctgagaccactgcccagtgggcctttccccaaggtgggggatctaaggacccttggattaatcccaggctttgtctcccacaaaagcttccaagaccagtgccaacattcttggtggacacctgttctctaagagctgggcttgagcccaaaatgcatccacacaggccacttaaaagccatcccaagttaacttgggtcagaatttaatcagcc

SEQ ID NO: 476190 - DNA, 1227 bp, Homo sapiens
cagcagccatttcttagggacaagtgttttctgtgccaagaatgaaaacagttcatcaggtgagaagaatcaactacagaggactagatgagacaggcccagtgcatctcattctgaaggctgttgatatggaaaaccattcttggggcacgcttttcactttctcatcagctgaatgtgatgtgaaggacctggctgagggaagaacagatactgagactcctggccaggatgtgcagcaagtgctggaggaacccaaggaaaccaaggtagtgacctggggtgcaggagagcctgcatgtggaggagaagagcctgcaggtggaggaggggagcctgcaggtggaggaggggagcctgcaggtggaggagaagagcctgcaggtggaggaggggagcctgcaggtggagaagaagagcctgcaggtggaggagaggagcctgcaggtggaggagaggagcctgcaggtggaggagaagagcctgcaggtggaggagaggagcctgcaggtggaggagaggagcctgcaggtggaggaggggagcctgcaggtggagaagagggacctgcaggtggaggaggggagcctgcaggtggaggaggggagcctgcaggtggaggaggggagcctgcaggtggaggaggggagcctgcaggtggaggagggggacctgcaggtggaggaggggggcctgcaggtggaggaggggagcctgcaggtggaggaggggagcctgcatgtggaggagggggacctgcatgtggaggaggggggcctccaggtggaggaggggaccctgcatgtggaggaggggggcctgcaggtggaggagggggcctgcaggtggaggaggggggctgcagatggaggagggtggcctgcaggtggaggagggggtcctgcaggtggaggaggggggctgcagatggaggaggggggctgcagatggaggagggtggcctgcaggtggaggaggggggcctgcaggtagagaaggggggcctgcaggtggagaaggggggcctgcaggtggaggagagggacctgcaggtggaggaggggagcctacaggtggaggagaggagcctgcaggtggaggagagagtccagtccgcaggcctgggatgagccaaagttcagttgtaagtctgcggagggctctgttttgtcatatatttctggttttaaaaacacaattgatgctaaacatactcgaaggtatatc

SEQ ID NO: 476191 - DNA, 508 bp, Homo sapiens
acatggtgaaatgctaaactcacttctactaaaactgggaaccagacagggatatttactgtcattaccattatttgatatttttaaaggaggaggcttggaacacagatatatggagaaagaaggccatgagaagatgaagatggaggcagaggttggagtgacggatctgcaaagaccgcctagggttgctggccaatgtcagaatctaaaagaaaggcatgggaacaaactttcctcagagctcccagaaggaaccaaccttaccaaaaccttgattccagacctctggccttcttcactgtgggccctaggtgagatggtcacactgcacttcctgccatttggagctcctctcttccctctgaacccaggactccctcatgaaacccagtgctccttgcttctcgcctgttaaataagtaggacagactctaaaccagggctctgaaatgcaaatgacccgcaaggtgatgggaacgggggtggatcgaagcaacatattacc

SEQ ID NO: 476192 - DNA, 2215 bp, Homo sapiens
cagtgggccgggtgccagtagcggaaccccgagcaacagctcacactgactgtgaaggactcaaagctggttcaaggttaagatggctcaacaagtgacgagccagaaatgtcatctggccactaggacgccgcattatgaaagtgtgatcatggttcaagaacgttgccatgaggaaaatctgtgcacggaattactattattaggatttgccaatttccatggtgtaaatgctcccacatggccaactgcaagccaccaatgtgaggtcactggatgcagagctgggaataaatatgttccaatgacacttgggagcaggtctatgcacagtacggggcacaaacagaggctccagaggcccagagaagaacccttctacagtaaaggacagggaggcactgtgctgaggactagatggggtgggggagggcagaagaacagcaggagcctccagaagctgtccttaacccctggcctgtgttctcaaaaccgatgcttgggtctaagccacctccatctgtttccatgggcttctatcctcttgtctcttagtgccatgtaaaaatgaaatttcttcttatgcccataagttataaagctcttatgtggccatatgaacttcaaagcatttaaatttcttatggatcttatgtgattaaatgtgtggcatcctgaataatgaatatgagggtaacaaaagtggtactgttgagaaagacatttataatggctctaagatacagtatcaaacacttagtctggaccaataagatcttgataatatgtttctttttttaagttttaaccaagggtcaccaatgacagaaaaatttataataaaccacttccaaacaatgaatatcttagatgaacaaagctgaaagaatttcagattcccaattcatctttttacgattcatgctgtttctcagtttattttatgacttcaaacagaggagtgaatggaaataattcggttatttttatctctgtgcctctgaggctgtcctgtactctcaaacacattttgtgcttcaaaaaaatctcaagagttgcaaatattccaaaggtgccaaagtgatacatttctttttcaacttgcagggtaaagatatagtccaatttggtgaatattaacattgtcatttagaataaaatataattgctataagagctaaaaaattttgcatgatcaatgtgctatactcaataaatgcaagaaaatgagaaattagtcatcaaaaagggcaaaaatgaactccataaaaacacaaaatgaagcatagaacaatctaagcaaaaaggaattagtaaaaataatgataaatcaaggatattttcaaaggaaatgaaacaaatcaagaactaaaaacctagacatgcttaaacaggaaagaggaacattacaattagataattggatgagtgtatttggaaaacaccattgtttccattatttattttaactaaaatgtgggacaacagtaaaaatacaaatgttattccgggcgaccaattgtcacaaatgaaacatggtacaagggaatcaaactaccacaacttagctacagcatctgtcaagagcctgaaaaaatattaaggaaaacaatacagaggaaacagcaagaaacaaatggttgccgcgtcgactcacttcagagcgacccacgatggaaaggttacctttggggagcgagaaatgctcaagatgagatcaagctggaaatggacttttctgacactgttcctttcagtatttacacagaaaaaaaattaacccaacacaaggagctttgcccacgtgcctcttctctccgtcttttttaagtacataaaacaaagagtacatctttaaagattcattatgagataaacagatcttcaagggaatatcactgaccacaggtctgtggaaaacaagctgcgggctggccgaagcggcttcctttttgttaaacatttctgaatgcctgacagttttatgtaaatgcaatttgttaaaaaatgattctgcagaaaaaaaaaaaaaaacaggttgtcaactaatggttgatgaggttttgttgtaagttttaatactacacgaccacaaaatcttgaaaattcaaataaatggaaaacaattaaaatatgatcaataataacatacacccgacgtgtgtgtggaagtggatgctcttgaggggtagtttctacagtcatggtgaccgcc

SEQ ID NO: 476193 - DNA, 645 bp, Homo sapiens
ggtgtattccacacatgccggagtttccaaggaggaaacgtgtttgaagtccaaagaacaaggacggcctctgcttgctaatcagatcttgtgagacttattcactaccatgagaacagtatgggggaaaatgcccccatgattcaattatctcccactgggaccctcccacaacccgtgggaattatgggagctacaattcaagacgagatttgggtggggacacagccaaaccaaatcagctgcccagactcttttgccactctcggtggtcatctgatgaagctctcgccagtgaatttgggtcttccaggaaggctgatggcagctgcctctgctgggaaggaagcgtttttcccacaacatattaaatgcggcactggaggatggctggctggtccaggggccggatctggctctgttgctcacaatgattctgtttggcaagcgtttttaaaaagccttgggtcagctatatgcaccagttatgtgcattgaaaacagttatatgcgttacagtcagctctgtgcatcaaagtcagctgtatgcatcagggtcaggtacatgcatcagggtcagctccatgcatcagggtcagctccatgcatcaaggtcagatatatgcatcagggttggctgtgtgc

SEQ ID NO: 476194 - DNA, 1657 bp, Homo sapiens
ttcccttgtggaggtggggtctcaagaagagagagaaccagctaactgtagcttcaggtgaacaaatccctgcaaccgcctcgggggctcacccgcctgggatgttagtgtcaggatgcacggccccaagcaaggattccctcatcggagctctggcacaaggacttggggctgacacccaggacaaaaggcaaatgatcccacagaatcctggggagagcactgtttctgcctgtggcttctgccaaggaggctcattaacaccggtgattcattttgacccgactttcactcaccaaggccatggcttctctaagctcccagaaaacagtcctgccagatggaggaagtggccgctctgcagcccccgcataaatattcacaggtgcaaggctggcactggattgttggactcgggatttaatggagggaatgtgagggagagtgacttaaactcccatttactcagttttctcatctgtaaaatgggagcttttaaaacatatgcaaggttgttaagtgaatcatccaaaatgcttatttgaaaatagtatcatgctatgtatttattctgacaaccaaatactgaatgtcatctgcaatgaagacatctggggactcctatgtattggtgtatctccaactcattcactatgaggcagctcaacacatggaataaaacactagacactagagctaccaaacaagtgacatatggtcttcacaaaacctccgaaagtccatttctctcattttactaacgaggaaactgagaggaaggaatggtaattgaccaaaccgacacattcagagtagggcaaagccaacaccagaactttagtctgttcctgcctaaagccttccattagctgaaagaaccccagtagatgatttagtcgcagttttatgatgaaatacactataatttctttataatgatgataacttatggtcagatataaatcaccttttttcaaaaaataaattataagcaaaaaatagcatgaaacctatataaacaattatatctgcaatggtttctacatgagcaataatctgtaaataaaaatttatttttattgaaattaaaatcaaataaaagtttaaaatccgctatatactattaccatagtttgggattacctggaagtacttctataccacaacctacttccatccttcagagcctaagaaagagaaaaaaatgcttccctatgaaatttaaatttagaatattcacatggaatgaaccaaaacagagagctgtgtaaaaaaatactagcaaatgaataagtagaagagaaagacagagatagaggaagaagaggagttgaagaaggaggagggagaaaggaaagaaggataaaagaaaggaagaaatatgggaaggaagagagggagaggaaggaaaggtcgagtagattgcaaactttttcccaactcttactaattatattaaaatatcaagtactaaaatatagactatattaaaatatctaaaaggttgaagataagcttcaagaacttgcagtccaacagcaagactttctataaccttagattttcttaggaggtatcaaaagcaaatgtatttattcaacttaccatctttaccttgaagtctacatattacaactgttttatttatctctgtggt

SEQ ID NO: 476195 - DNA, 1807 bp, Homo sapiens
accagatagaatgggtccaattctcctgccctcagatcaggaaaataaaaatcctaatgctattaatgaaacagtggccaaaagaagtcatggcatcagcacagggcatgcgtcgggacagggcctcaggcaacgctggcgatggtttccaacctcatgtgccgacatctcccatctgaggctggagcttggaagatgtggagagatcacaaggtttaagtctcttccttttgcagaggccacaagtccacaaacaaggcatcgccagggtcacgctccttccaaagcctgtgcaagaggacgcttcctgcctctaccaccttctacaggtggctggcaatccttggcttgcagctgcttcactgaaatctctgccttggtcatcacatggtgcccctgtgtctacaaatgttgcacaagagcagaactgtcatcatctgtgaacaaatcacattagtgtaaacactgactttcaaaaatcgtgatctaaatctacaaagaggatggggaaagggagagttggagagggtcaggagagctctgccagagctaaatgtttatctttcatttccataaagtcaaaatattatcatttaaaaaaaaataaaaagagttgtataatatttagaatgtggagatcatgctatgtatttattctgacaaccaaatactgaatgtcatctgcaatgaagacatctggggactcctatgtattggtgtatctccaactcattcactatgaggcagctcaacacatggaataaaacactagacactagagctaccaaacaagtgacatatggtcttcacaaaacctccgaaagtccatttctctcattttactaacgaggaaactgagaggaaggaatggtaattgaccaaaccgacacattcagagtagggcaaagccaacaccagaactttagtctgttcctgcctaaagccttccattagctgaaagaaccccagtagatgatttagtcgcagttttatgatgaaatacactataatttctttataatgatgataacttatggtcagatataaatcaccttttttcaaaaaataaattataagcaaaaaatagcatgaaacctatataaacaattatatctgcaatggtttctacatgagcaataatctgtaaataaaaatttatttttattgaaattaaaatcaaataaaagtttaaaatccgctatatactattaccatagtttgggattacctggaagtacttctataccacaacctacttccatccttcagagcctaagaaagagaaaaaaatgcttccctatgaaatttaaatttagaatattcacatggaatgaaccaaaacagagagctgtgtaaaaaaatactagcaaatgaataagtagaagagaaagacagagatagaggaagaagaggagttgaagaaggaggagggagaaaggaaagaaggataaaagaaaggaagaaatatgggaaggaagagagggagaggaaggaaaggtcgagtagattgcaaactttttcccaactcttactaattatattaaaatatcaagtactaaaatatagactatattaaaatatctaaaaggttgaagataagcttcaagaacttgcagtccaacagcaagactttctataaccttagattttcttaggaggtatcaaaagcaaatgtatttattcaacttaccatctttaccttgaagtctacatattacaactgttttatttatctctgtggtcaatcacaaagatatccaaatccttcactccttcttgtatctttccacttttaaaaaatgttttt

SEQ ID NO: 476196 - DNA, 1434 bp, Homo sapiens
caaattcatagaatcagagtggaatgggggtttccaggattggagaagggggaactgggagtatgatgaccctggagggtgtgatgaccccatctagtgtgatgactctggctggcataatgaccccagctggtatggtgactctggctggtgtaatgaccccagctggtgagatgactctggctggtgtaaggagcccagctggtgtgatgactctggctgatgtaatgaccccagcgataactctggctggtgtaatgaccccagatgctggtatgatgattctggcaggcatgatgactctagcaggtgtgatgaccctggagggtgtgatgaccccagctggtgtgatgactctggctggtgtaattatcccagctgttgtgatgactctggcaggtgtgacgaccctggctggtgtgatgactctaacaggtgtgatgactctggctggtgtgatgaccctggcaggtgtgatgaccctggctagtgttatttatgattctggcaagtgtgatgattccggcctgtttgatgactctggctggtgtaattaccccaactggtgtgagaaccctggctggtgtgatgaccctggctggtctgatgaccctggcaggtgtgatgactctggcaggtttgatgactctggctggtgtgatgagcctggcaggtgtgatgaccctggctagtgttatgattctggcaggtgtgatgattctggcctgtttgatcagactctggctggtgtgatgatcctggctggtgtgatggctgtttggccggtatccaactcccctcatgttcagtgcagcgggtgctcccttcacaaatgccactggctgggccaccagtgagcctgtgcacagtcagcctacatccaccccccgcattagtgttgttggttcatgtctcccatttgtttctaaccaaacattaagtgagggctatttgccagcaagaaaatgggttttctttttttctcttgctacttttgcccaccaaaagaggtattgagaactttaaagtgaccagaaagttctcagcaaaggaaaaactgaagagacttcaagctccacacagcaacagttagcattaatgattgggagctggtcattctcaccacctgagaacatgaaacagcttgattagtgactccctttggttgccagctgtggctgacatccttggttacctccaatcttgttttcattatttcagttcctcacaagatatagagctgtgagttcacaattccttacctgaattgtgttttatgctgttcaaaagttagtgaggttcaaaggatactcagcatcaagatgacaaggatgaacacttttataatgatccacttctacttaataaataataaatgtactttttctttgttatgattttcttaataacattttctttgcactagtttactct

SEQ ID NO: 476197 - DNA, 1087 bp, Homo sapiens
gctagccctgcacctgcagccatggcctcgcccgctgcttggaacagcacagaagcgcaaccttcctcctcgtcctgggctggaccacacgtccggggaatacctggtctgatcggaggcagtgcagccccagacgacgagacatcagcttacacctgccgggacatcaaacaagcaaaagacaaatgtgggagaggatggggagaaactgggtcccttgctgcactgttggtggaaatgtcagccattatggaaaacagtgtggagaatgccgagtccctttctgccctgtccaatcatgctctgatacccgaccagacatgcgtgtgcaaccctcactatcaggagaacgtgtctgtgaagctgaggaacgtgaggaagccagctcccgctaagagcatggttgtagcatgctgcttcaacctgaacgtgcttgcaaaccagcagcagacgaggtctagtttagtgcatctggttgggggcctgagggtctgcatgtctaacaagctctccagcaatgccatgactcatggttactggtccaccacccttgttgtggctggcacgtgtgatgactctagcacatgcgatgaccctggagggtgtgatgaccccagctggtatgatgattctggcaggcatgatgactctagcaggtgtgatgaccctggagggtgtgatgaccccagctggtgtgatgactctggctggtgtaattatcccagctgttgtgatgactctggcaggtgtgacgaccctggctggtgtgatgactctaacagtgttatttatgattctggcaagtgtgatgattccggcctgtttgatgactctggctggtgtaattaccccaactggtgtgagaaccctggctggtgtgatgaccctggctggtctgatgaccctggcaggtgtgatgactctggcaggtttgatgactctggctggtgtgatgagcctggcaggtgtgatgaccctggctagtgttatgattctggcagagctggaaatggtgttctgtgcagtgtgggttttcaaaatgtttactaactggattcatttgctccaccctttattatatcgtttc

SEQ ID NO: 476198 - DNA, 4034 bp, Homo sapiens
ccagtgatgagcttgggcagaaagatgaatccagacgccaagtggagaatagactggaggacagaagtgcagggccgcaccaacctcgagaaggaaaaacaagggacccaagagcaagagccatcgccgttctgggttcacagccaccaaggatggacttatagtgataatcaaaatgtccccactgcatcctgcagagccacttgtcattttatgagcacctgtgtagccaatgcctactctgtgcaagggcctgcagatacaaagataagagaaactgaaggagttttccagaaagaaataatcggttcaggtgtgcatcgttcaggtgtgctgacacttcgtctacagagggtcagacacaaagacactggtcaccattatggcatgttttttaaatatgatagaggcttttttaaatctgggaatggtcaagagatattatgaaatagctattcctagacttttattttgtaactacggtcagtgggtaatgtgcgcacctgcttcagaattctaaaagtacaagaaacaaatattttcttacacagatggtaacacactaatcatactgctttgttgcctttttcatataatatttcttggagatcattcgccatcagtacatacagagctgcttcattctttttagcagatgcttaattttctcttctgtggatatatcataatttatttaaccagtttcctattttcctattgatggacttctagtctaatgacactcttttgctaccataaaaaagtgctgcaataaatatctttgcacgtgtgttgttttgcataagtatgagaatgtgtgtgggtaaattcttggaacatgcaattgttgaactctcagttcctagaaaggtatgcatagtttgtaattttgacaaaatgttacctacttgttctctataaagattgaaaaatgtgtattcaccaaagcaattagtgcctgtctctctctacatcattgcaaaactcttgcaataccgaactttttgggcattgcagtttgtaggtaaaaaatgttatcttagatttaatttgactatgtcttactatgagggaggttggacatcttttcctgtggtgaagagccacatgatctttttctcactgtgatagatcatacctttggcccatttcccagtgcatcattggcaactttcttacagatttatagaagctctttatatgttaaagaaattaagctgtttgtgaaataagttgcaataattttttctttttcattttcctttaactccatttgctatacttttgccatgcaccattttctttagttttatgtaattaaactcatcagtccatttttttcatttccctgtcccaataatattttgtaaggattatcctatattttcttccaataattcttataattttattattacacatttagttttttaattaggaacttgtttgatataaaacgggaaatctaatttcttccagatattgggacacaattccttcaacatttccccctgattttactggatatcaacattttcctcctcatttgaaatcccacctttataatgtacaaaatgtatctgggcttatttttgtttcatttatctgtttataatgtggatcacattattttaaatttatggaacattccagctctttattttcctatttcaaaatgtcatggctaaaatttgtgcgtttatttttccacagaaaccttaaaatcagcttatctggctccaaaagaaaatactcatcagtaattttattgaaatctcattaagtttatagattgacctagagagaattagagctttatgataataagtcttcctatctaaaacagagtaaactttaatttgtacaaaactgattttgtgtcttttcgtacagtttaagggatccttcacatagaatattttaatcatgttggaatcatgtattccttaagtgtttgatagaatttccctatgaaataatcagggcctgattctttttctgaaaggtagcttttgatagctttccatatttcacctacaataactcaactcattaaaagtttcctttttatttggggtgaatattagtaaattgttctgttttagggtttcgaaatatttgtacagaaccaaaacgagtaatttgttacaattctttcatttcttccaacctgtaattattacctatttatgcatttgtattctcaatgtttatcttaactttgtcaacagttcatcttttttatttccttttttatatcaagatctagcttttaaatgtattactgctatcagattttgcttttaatgcagtatctgttcttatctttactaatttgtctcctcctttctttattttaatagtttttttacttcgagttggattcatcattgacctcttttcatctccctttgacattaacgcatgtatttaaaactattactattactcaagtctgcaatcttttgttcccaagtttctctgaagaatttcttattcttatttttcagatatccaccagtttcagtttttattttctctttcactcaatagtaccttacaagagatatactttgttattatcattattggttttattactgttttattcttcctttatgagagttagggatttcttgtttttaatttctagtttcagtgtgatcaaagaatactgcatactatttctactctggaaattagtatgatttctttggtgaatttttgtgactattttattgatacttgaaaataaatatatattctgttttaagggtacagtattgacatctcaattagatatgccttattaaatatggggttttctagtctagtggatctgtgatgcattaagaaaaataatcaaagttttcctttactcattaatgtgtctatttctccttgtatttctgtttacatgtatatataaaacatttgtttttgcttttaatattgatgctgtgttacttggtagacagaccttttgtgatatcttcattgctgattgtattctttgctattttaagtgcccatatttgtctaagtgttccatactctctgccttaaagcctgatataaaatgaggacctttggatttacttttgtttgcatttgctaggaatttacttattcttttgttttaaacctttctgattttcctcacctgaattttaacaaatccacagatgatcaaaattctgtcctggagccagcaatttactctggttggaaatgtaagccccaggcagcagctgtttttgaccctcaccctggcatggagtctttctcacaaatggccctcacagctgggagtttcaaacagtctattctttcaaagcagttgttccctaaagcatttgtcctgtctgcccaggattttccagagcccgggaccaacgttactggagtcagcctgttgttccacaccgaagcacaggccagctgcccacccagggctggcagtgaatctgaggccgagcccaaatggtatcaacttacttgcagctgtccttaccagaagcccaataggccctcagcataattcccctacgtgtttaaaaaaaaaaaatctttctatgctgtggtgagaagactcatagactctgctttcttctgcacagctctgacagcagggaggtaaactcgatgtccaaagagatgatgcaaaattgatttctcattaaagtagaaattttaaacttaaacagggaaatatcatccttttacaaaatactgcttatttagggatctggataacttgcatgtatcaagaattctcctacattggtatttccacagtggggacagtggttgaatcgctagaagttacaaatattcctctttcaaaagcaaagaaacagggtgattgattacctcaggtgggaaaagagcaacacaaggctattatgcaagtgtttttggtcaatcagctgtttcaacacaaagggagagagaagttcttgattaggtgagccctgataattaagggtgaccttcactgagggaaatttattcaatttatcaatagttaataa

SEQ ID NO: 476199 - DNA, 597 bp, Homo sapiens
tcaggctgtgatgtccgttggctgtagtgaggaccgagtctctgttcccaactccatcagtgtggtcacacagccggagtacacttatctgctctccttgcagttgggtattgtgatgttaccaagttctggtcgcctgaacacaaggaggtgtaatgtgccccttccaggcctgccccataaaatgtccccacaagtgatccttgaccatcctccctcctctgctggctggaccaggggactttggaaggcatgtgttgaagatggcagaagggaaggaggtgggccagcaggggaggagctgcctgtccactctgcatgcctgatgtcggtttctcccggcaagccaacagcaagcgaaagcgaacgtgtcctggagaaaaaaacggaccctccttggtctgagtcctggctctaccacattagccttgaggtcttcaggaagttactaaccaactacattgggaacagatggttggacatctcccagcaacagccataaatgagaggggaggagagtgggcaccacattctcaggtcttctaatagggtcagcccacaggagatgcccattatcttagtaagaaccacagccct

SEQ ID NO: 476200 - DNA, 457 bp, Homo sapiens
ccatttctacaccactgccaaagatctttggattcaagtacatgacagacatggcgtgcaggggagaaggtttagatagagtagcaaaagttgtttctccggtggaaaaagctgaatccaatcagataatttccaagtcccagcaagtggagagcctggttctggtctctccccaacgggtttcgaggctacactgtctctttagtatctctggggcagaaaaatcattgccagaagcgagattagacaagtgggacagggttcctcctcagacacatcctaacccagggcagggctgtgctcagatatctacctggtggatccgacagcagccacccgccctgcacacggagttccaggagcagctgggcaggttgcaacttctttttcaagaacagtgtgtgcagcctccccgtggttctgctgactccagcactctcattattttttaactttt

SEQ ID NO: 476201 - DNA, 558 bp, Homo sapiens
gggggtcccgggtggctagcagcacctccaggtgaacacctcactcccgtgtgctgagtgcattttcccggctgctgctctctctaccggcagcagtacaggccgcccgcccatccctgaaccagtggatgggacaatgcactgacatttcatctctttaccttttacaccaagagttggagctagtgttgcaatgggctgaacagatcgtcacagagcacccatctgacagctctcggaagatgctcacctggaagctagcaactcgcattcagtgcggttccctgcaagtcaaagaccttgggtaccaacaagagtgggctgggccattctcactctgggaacatccctactggagaggaaatacagatttcttgggactgcagatgaacaaatactcgagggctcgtggccacaaggtccaaatcttctgcatggtttctgagcgggatccatcgtggtgctggttgtgcccatggcccttctcaatgggacagccttgttttgcaccctgcggtgcaattctctctgacattcgatgactggaccaaggatggg

SEQ ID NO: 476202 - DNA, 571 bp, Homo sapiens
gacctgactgacagttctcctgtccttcccacttccgggatgagctgggacatccaggtccccagacctcgtggctccactgagctccatctgacaggggcagcccaggaagagtgtggctgtggcctagagcttagagctgagcaggttgtggagtgccaggcagtccagaggctccaggggttcggcttggacataaccggagctcctccgactccccaggcaagcactctgtcattgtcttccagactgttctcacagatgccccgcaaaagagcacaaaagcagccgccagaggcctggagccccgccaagaggacagggcccccgggacagagggacagaggggggctgtgcccaggtggccctgaggctgcccaggactcactggctcctgctgctccatccacacagcagacagagaagcttccagtcggcaaagggctgggaacgctgcagcgccggcgctcggaatatttggattttctgaatgttaacacactggaagctcctaaggcagccaagaggctatgagctcaaaagctttgtgagagcttttctcggagagctc

SEQ ID NO: 476203 - DNA, 1171 bp, Homo sapiens
tgatactacaaaagaatgacctttttgtggcttaaagcacaagtatcaggtgtgcatttgaaaataaaatctgcttcctcccatgagtttagtagggccacgtccactgcttcctctcgtgagtttagtagggccacgtccactgcttcccatgagtttagcagggccacatccactgcttcccatgagtttagtagggccacatccactgcttcccgtgagtttagtagggccacgtccgctgcttcccgtgagtttagtagggccacgtccgctgcttcccgtgagtttagtagggccacgtcagctgctgcccgtgagtttagtagggccacgtccgctgcttcccgtgagtttagtagggccacgtctgctgcttcccgtgagtttagtagggccacatccgctgcttcctgttggcttatcagggctgcatgtctcacagtcagccagcagtctagggaatgggccagtcatgagctgtgctcctaaatttggaaaaatcaggaccttgtggagacaaaaaggaagtaaacagagctaccatccttcagatgaccacgtctgggtgccatttgcagaagaagagccagtcttttccccattcagttaagcaccaacatattgaactatatctgaaggaaaacggaacgattaagtgtaagcttaagctataaattgtttgctcataaagtcctacgaccaagtatcttaatcagagatgtaagcagggtgcaaggtaccagtctagactaaaaaaactcataaagggacatcccaaagatgagggctccaagttcaaggttatttttaactaagacagttgtaaaaggcgtgatggatttaactccgtcactttcagagcagctaactgagttcagccagcagactgctttgatttgttcattaaatgtattatgtttgcattacttgagttcatttgatgagatattcccactctgtaaaatatccagctaaggatttggaaatctattcaaattttgcatccattaattcattttagaattttcaaagagtaggtactttaggcaagctaagatatatcccaaatattcggggaaacatccaatctacagaaatggtgtaacgtgttttttcatcgtaagcacgattggtgagtttatccatttaattatttttcttgctagaa

SEQ ID NO: 476204 - DNA, 524 bp, Homo sapiens
aggtttctgctccgcctctagatgacccctctgcccgccagagctggcctgcgggtcaccctgcaagatgaccctctgcctgcccgagctggcctgcgggtcaccctgcaagatgtcccctctgcccgccagagctggcctgcggagctggcctgcgggtcaccctgcaagatgaccctctgcccgccagagctggcctgcgggtcaccctgcaagatgacccctctgcccgccagagctggcctgcgggtcaccctgcaagatgaccctctgcctgcccgagctggcctgcgggtcaccctgcaagatgacccctctgcccgcccgagctggcctgcggggcatctgcagcccacggggccagagacccggatgcaactatgggcccgcccccagcaagtcaagtttctggaaaatcctatgaaccatcttgttctttggagagcttaacgacacctaggtcatcaacaacaatcaacaatgaactattgatttcagctgtaatgatcgaatagcagtgcctt

SEQ ID NO: 476205 - DNA, 663 bp, Homo sapiens
ctgagatgagcaagatgggtaggctttgtgcatccggagatggggggatgctccaggtgcagaagccagtgcaagcacaagtgggcaaacataaggcactagactctgggctggagcggtggagaggtggggccagctcaagagccacaactggggacctgtggtggtgcgagcttgggggtgcagagcaggacgttcagaggaggcagggctcaagaaacggcagcaaggctactgggaaaaacaccctcaggagtgaggaagagcagatcattgccattgaagaagcccttggctcctacataaaaaacaatgggaaacaacaatttctttctgcaaacacatggccccaaattgctcaatcatcaagcccttctacaaggaaagcctttgcacccattgctacaatgacctgccactggggcaaattttgtgtaaacatgtaaattttagtggttatcattttattaaaaaaagaagctcttgaatgttttttactactgattcttggcattctgtgtcttttgtgtatgtataatttaaaaatcactttgagcatttatgcacattactatatgacatgataattttcatgcaaaaaatcaaaatcaagttttagattaatttaaagggtatctgtaatatacactcagtttataaatg

SEQ ID NO: 476206 - DNA, 587 bp, Homo sapiens
gacactgtgtgcactcagcccatgcaaacagtaggtgccagccgaagtcgttcaagggcgacagagcggtcacagattacctctaggcttaggacggaggagttgctgccaacttttaaacacctgaaattgataagggagaagctgcctctgccaaaaccaatctggcaactgtgcacagaaaaacaggttaagaaacgagtctttcgcaagaagctgcctctcagtcggtcctggtgtgggtggctccatcacctgtgtgcaggccccttctggtccgcatccttttccctggatgaggagggcctgcaggctgacagtgacaggtgttcctccagtgcccgtcaggaatgcccgggctcccttcttctccagggaagggggtggggggcactcttcgggcccgtgggtatttgttttaatggaagaaatgtgggtaaatacagtcttcaagcacagaatgaaaacagataaaaatactgtaaaatcagaaaccggatttggattttaaagactatagacatcctcagggtagagaggatgagggacagaccagcttctaacccttcattcctacctggtgttga

SEQ ID NO: 476207 - DNA, 601 bp, Homo sapiens
cgggaagtccccgacgtgttctccatcactatcgaataactttgtgttgcttcattagctaccatttacaaaaatggtgcaactgttgtttcctgcaatggacaatgtgatgatcagaaaaatgtgtctatcaccttatgaccacttggaagaatgccaccaactattcacaagagtggcagtcctagaggatcattccagagagtttgccatggacattccctgcgtcaacttctgctgccaggaaaccacagaaacttcgctggttgctaagtcttcgtggcctggcatccgacacaatctccacagcacccggagaccactaggtcccatggaatctaataacttgctccaaaccaggaataaagaagcacatgtcattgcttactcaaggctatcagaaaacctaatagttgtcagatgtgaaatagagttttggattagatttgggctcctgttggaaattgggaattctgtggcttcatgggaaagcaattgccatgcagcacatcacccagagaaaccatcagacaacttagatccagaaaagtattctgcttctcggaatagtgtgtttgcattatgaggaaatatttctatt

SEQ ID NO: 476208 - DNA, 686 bp, Homo sapiens
atactacttggaaacttaaaaccgtgtgttgacagaatttcctccagttgaagagagcagcaggaaatgtggtgcgtctgaactgctcgagtcatgcccacaactcccattcagccggcttacgatggaagaggtgagccccttctcatttcaggcaaattcttccgctatgtcttcccacctcctcagggcccttgtacaatagattatagcctttcttttttgtaccttcagtttcatggagctcatatctttcttcatttaaacatagtcgtgtcttttcgtcttaaaactagcaagtctctgtctaacccaaaacgttaccaacatttggccccactttccttcgtcaaaatcaactttttaaaaagagttgcctgtacttgctctcttcctcaactctcatttatttttttacccattataatctggcttctgttttacctctatatgaaaactgctttacccaagacagcattgttgctcagttcaatggacatttttcagcctttattttactttgcctccaagagaaatttttgactctgctctctttgtttaaacacattcttcttttggtgcccatagaagtaaactcctgtggtttttgacctgcatctgtggctacatctgcttggtctcctttgggagccgtctgtcccttaaatgtaggtgttttagtctgt

SEQ ID NO: 476209 - DNA, 657 bp, Homo sapiens
ttaggaaagcagccttcgcagcagttgatttgagagttttgtatagaagagaggcacctatcatgttgcctctcgatccttctgtttggctgagcaaccctgggggcacgtccagctccgcagaggaggctgcaccagggctggccgttaagggcaccccaattctggtcatcctgatgccagaaggatcccagttctgagactgggacatccctcctggggaaaggagatgttaaaaccctctttccacagactcttaaatgctgcccttcccgcagagacatatgatcgctggtgcaaaatcaccgctgttcttcctcttagggcctctcagcttttggattctgaccattgctgggaatcactgctttcttctttccagactgttcaccccacagagccttacattgcagcaggagctggtggttttgagggagacggactcatgcattttacactcaatagcgatagtattgacatgtcacaaaatagttggctgttctttgagttgtactgttctcacttatcaaaacctcttcatctttttcccacactaaatttaattggtttctttcttagtttgtatttatgggattattgctgttcaagacactactttgcattgatctttattgacttccattgtatttaattgag

SEQ ID NO: 476210 - DNA, 615 bp, Homo sapiens
agtatggtcaatgcacacattatgttgggcatttacaagcgtcagccggcttgtcgagcgatgcacctcacacactgcctctgggcttgtagatcggagagccatttggccacatgtagaaaagcatccttcacagtggccaagatgtgcaagcaacccaattgtccactgatgaatgaaatgtggtatatgcatatagtagaatactatcctggctttaaaaagaaggaaatactaccatttgtgacaacacggacagatctggaagacattatgctaggtgaaatagtcagagaagaagaaatactgagtgattcctcttatatggagcatctaaaaatagtcagatgtacagaagtagacaatagaacgctggttactagcggatggagagggggcatatgcagagttgctgttcaatggattatcaaattacagttacacaagataagttccagagatctcctgtacaacacggtgcctagagttaacgataaggtattgtgcacttaaaattctgttaggagggtagtaatataggagttattaagaaataatttttaggcagctagaaagggtgagagttcttggtggaattttcctataataaaaagc

SEQ ID NO: 476211 - DNA, 554 bp, Homo sapiens
cgcctctctcgttaggtctatctttctttatttctgctttatatctggcccagaacttagcatggctcaggtggtggtgtctggtgacatctttctggtgaacatggaagggacgatgctgaggagatcccccaacccaaaggaaagagactatggcactgattggcggccttcaggtaagtggggtgcatatagccagggctttgactggaatagtttgcattcgtttaaggagtcaaacttgacttgtagagccaataaaagctgtttggaaaactggcctcataccttgcctattatacagtccctgtataaggtttctgacctgtggcattctaagtcacaggatgagataggaggtcagcacaagatacaagtcataaagaccttgctgataaaacaggttgcagtaaagaagctggctaaaacctaccaaaaccaagatggcgatgaaagtgacctctggtcgtcctcactgctacattcccaccagtgccacgacagtttacaaatgccatggcaacatcaggagttaccctatatggtctgaaagg

SEQ ID NO: 476212 - DNA, 551 bp, Homo sapiens
ctggcttgaaattctcgctgccagcacagaagcagtctgagatggacctgggatgctcgagcttggtggcgcttctgctggtgatacccagggaaacagggtctggagtggacctccagcaaactccagcagacgtgcagcagaggggcctgactattagaagaaaaactaacaaacagaaagaaatagcacatccactcagagaccccaaccaaaagtcaccaacatcaaagaccaaagcaagggaacaaaactggacggagaatgagtttgacgcactgacagaagtaggcttcagaaagtgggtaataacaaattcctctgagctaaaggagcatgttctaacccaatgcaaggaagctaagaaccttgaaaaaaggctagatgacttgctaactagaataaccagtttagagaggaacataaatgacctgatggagctgaaaaaccagcatgagaacttcgtcaagcatacacaagtatccatagctggattgatcaaatgaaagaaaggatatcagagattgaagatcaacttaataaaataaagc

SEQ ID NO: 476213 - DNA, 1288 bp, Homo sapiens
tcctggaaagttctgtctttaaactgatactatggctggaccaggagtactgcaagtggcttccactgcaggcaccaggcaattcaatggcacccaaaacctcagagacaccagggattgcagagccccaaagagggtgttacagcatgtcacactccagacatggggagccccgaggtctcggccccagagggctgaagctcttctctccttgctgccacagaatgatgagtggggtggcaggaaatgtgtgtttcggcccgtttctgttacactctttcagtcctgctgcctgactctggcccacggctcctgggctggcctggccctgacaacactaattcctgtcacatggggtggctgccaggcaccagcagaggatcaacatgtagtctgctgggccccggttgtccacgtgaaggggaacagccttcagccccctggcctgtcgctcatgctaatcagcacccaaagtccagagggcagtgagggtatgacatgtcagaactgtccccagcatgcacactggctgggctgccacagtgcctgggcttggtcacaatgttgttctgcatggagtgggcactgggagcagagagaggacagggaatggcaacaggcacttcttagcctgcgaaagcagggagcttcccgccccccacccccacctctgagagcaccaggatgtctggtctgggtccagaaccaggcagaagcagctgcgcccaggagcgcaggcttccaccccaacaatggggctccctctggaatcacctgttcctggctccctgtggctctgcagagagtacaagccccagccatgtctctcccactacagctggcgaccttgcagtggcccctccaggcaggctgctgctgccatcaacagcagttttctcatcagaaacaatgaaacaagactgataccagtagtgaaagaaataaaattgtcagcctataattctattaaaagtgaaatagcactaaaaatatatgtgaaataaagtcattttagacacaaaagcagaaaatattaatcaacaacagatctttactataagaaacataaggtcataaaggatgaccatggaaaagaaaaatgataccagagggaaatacagatatacataaggggctgaagaacacagaaataatgataaccttatagaaaaatatataggatttttattgcttaaattactttaaatgattgctgtttaaacaaaagcactaacaatttagaatatcagtaaggtataaaagacttaaacaaaactttcaattatgt

SEQ ID NO: 476214 - DNA, 1295 bp, Homo sapiens
caccagtaactcaagtggccagtgtccactctgtaaaatggaccaatcagcaggatgtgggcagggcccaataagggaataaaagctggccacagagccagcagcagcaacctgcttgggtccccttccaagctgtggaagctttgttctttggctgtttccaatgaatcttgctgctgctcactctttgggtctgcagcttcactcctgaaatcagctggaccacgaacccaccagaagaaagaaattccagacacatctgaacatctgaaggaacaaactttggacacaccgtctttaagaactgtaacactcaccgcaagggtccgcaacttcgttcttgaagtcagggagaccaagaacccacgggaaggaaccaattccggacacattttggcgacccagaggggacacaacactttggatggttccaggggcttaagcattcttgccaattcctccaaatgggccacctactgggagaatatcccaactgcacaaggctgtaagggtgacaagttctgccttgttccaggcaggtctggagataccatcgaggagtcagagcctcgagttggaaaccttaggaatcttcctagtgctgtggctgagctggtaccaaagccgcaagacaaattccttctcactctttcctccacaaacagaggagtctctccccatggccaccactacctcaggcctgtggctggctattgttgagagccaaattatatacctaatgctaaggtatatagcataaggtgtataagaatgcttgtgatttttgcacattgattctcagcaaactatcacaaggacaaaaaaaccaaacaccgcatgttctcactcataggtgggaattgaacaatgagaacacatggacacaggaaagggaacatcacacaccggggactgttgtggcgtcgggggaggggggagggatagcactgggagatacacctaatgctagatgacaagttagtgggtgcagcacaccaacatggcacatgtatacatatgtaacaaacctgcacattgtgcacatgtaccctaaaacttaaagtataataataataaaattaaaaaaattgagattatagtactattaattctcacaagatattgggggttcagttccagaccgtcacaataaaagtgaatataacaacaaagcatgtaaaacaatgttttagtttgccagtcatataaaagttatgcttacactatactgcagtgtattatgtgtgcgatagcattgtctacacaaatttgcatacctgcagaaatttaacttt

SEQ ID NO: 476215 - DNA, 3876 bp, Homo sapiens
tcctttcaggataaaactaccagggcaggtagagaaagatcatcaggtggaaacagggttagatgtgtctgagctcagattctccttgggtgaggcattctgtggctgctgtgatggatggacatttcagcctggctaagaaccattactggggaagtactatgggcatttggagtgtcatgcaaaaccaagtgaatacttgcatgcattgggaagctgtggagttttacggaagagatgaatatacctgtctcaccaactggctctatctggcaacaacgggcaatcagaagcccatctacggtttggtcaaggagagactctgtcacttgcaaaataattttgaaggagacttaattgctatcattcatttatataatgctgggtactcgaagcatgagaatgcaacagtccatgcctttttcatattcattttcatgaggtacatgaaatatataacacttttggatatttgttaccacactcaaaagttttgcatcttctatattctctactaatgaatttacatttatgcatggtatgcttgattagtatttgcattgtgctttgaatttctaaacatgttgaaataattgattagttatttctcccatagccccatatgagataagactaatgcttagttcttatgtaatgtttccaacatcagcgcttttaataaatatcacctagttagttttgatatcactcttgaaggctattatctccactttattttattaaaaaaaacagaaacaggatgaataaaccacttttctgaactgataaagggaataattatgaggaataggaaaattgggtctcaaatagaataaaaaataagggagaatctataagcactttaaagatcttatgagcttttttgtataatagccctcaatgcaatctaaatagaaaagaaataatttaggaatcatataacatcagctaacttttatgaaaatttaggatagtcacttcaacttactttgctacattttctttacctgtaaaattacaatgcttatgccttactgacctttttcaaaaaattgtaaagaaatatcaattaatgcatgtgaaaaaatcttcaaagaacagtatgattaacagtgtcacagttttagaatgcaaagttctgataagggaaacaaataaagccaaacctatagtttcaaaaggaaaatatcagtgtcacttctggattatgttcagcttaagattctcatgaaactttttaggaggatagaaaatcatgtaagatgatcttgtgctagtttgtctctgctctgaggcagaaaataagatcttcatagacaggtttgagagcttaaattcctacaaaatagttctaaaagtatgaggggctaaatcttgacactaattcacctagtgtggtattattttcctgaaataatcctccctggcaacttgtcatgaaaatctatcagacggacacatttcttcatctattgaattttttccgttgacatctccgttaagtgatattattaattctgttcaaaatgtaattctttttcagttgtactgtctactggggcctgaaatattcatactgactgttcctcacattttaatttattttttgctaactgtagaatatgatttccttgaaagcaaataagctttcttgtgcttattcctggtttcattggtttactaccctacagccacatctctagcaagaaattatttgactttgctgtgtctttggtcagatgaaggcccattcaaaccagtgctgttgatcatatagcaactaggtaataggaagagtattatgctgaattaaaatcttattaataactctgatatgtattatatatttgcctttggaatgccttttttcgtaatatttgaatcattattcatggaatgagagcaagagtataaatagtagatctgttatatcaaatggaataccagataagaatggctagcacactgacagaatcatgacaagtattcgaaaatggttattttcttccttcacttccaaacagaaaatggctacactttttctgacccagtagactactaataactgaaaagtgttcctcagctataaggtggatatgcattgcctaataaagactctaatctgctaataatccatatagagactacatgaaagcttatgcagaaatctaatggaaatttttcttctagcatcattcaaggctggacatgaatttgtctttgtctaccttatacctgcaaataattatattagatcagaagcatttaatttctccttatttgatatgtgatattgttgtcactttgtatttgaaactgaaatggtaagattaaagactgtgtcaaacagctagatacaactacagtatttagccagcatataaccatgaactaacacagtgcctagaatctattggatactcaataaatatatattggagaaataaaatatacaaatgaataaagttgtactatctactgggacctgagataaaatatgaatgatgaagatttttctgtgtttatatccatatatctaaacataatcttcgaaccttcctttagggaagctctcactgcccactacataccaataaatcatagacacttcaatccagctccttatgcccagaattagactgacagtactaagtactttgttcaataatgcctactgcttaataaaatatacaaatcatgccaagtaaatgtgacataatatgtgctaaacagtgctattcattttacccacagtgttaaagacagagtatacaactttagcattttaaaatattatatgttaaagcaaaaccagaagaaaataaatgggatcatttgatggtttgcagcaagctaattttgggagaaaagccctttgtaataaagctaatgtgatcttgggtaaaggaagctatctgcacctgcactgcagagataactgcgaaagaaagcaggcacaatgccagggagcacaaagaagagtgtgaaacccaaactggtggataagggcgttggaagatgaactgtctggttgaatattatagaacaggcaaactttaagttacatatgggaattttcacaggaaagattgggaaaaggcattccaggaagaagaagcaacatatattaagatacaaaataaaagataatatgtggtatataagaaatgtgaggtatgtggtttgagggcagctgaatgataagctagactcatgataggcctgattagtgtggctaagacatttgggttataaacaaagttaaagagaagacattgagaattttgagcaaacaataatgtatcaaatctatgtatacagttgtttctcttggtgtttgtgggggattgattccaggaccttttgggaataccaaaacctaagatgctcaagtaccttatataaaatggaacaatattttcatgctctgtatactttaaataatctctagattacttaataacacttaatgcaatgtgaacattatgtaaataattgttatactgtattgtttttgtgttttttcttatatttttattattttttaaaaaatatttttcatctgcacttggttgaatagaaactgcaaaaactgacaagattagaaatataactctgaacagaaatatagataacaaatttgttcatgagtggagagaggactggtcagactttaggtataaaaaaagcatgtagaatgttaaaaataatgcagtagtagagaagaagatctagtagatgagaaggattacagtgattttaaagaagccattatctggacatgaactggttgaattgaagaggaaatggagtatctttttcgcatggactaaatgaaatgaaggaatatcatagcaaacctgtttactttgttat

SEQ ID NO: 476216 - DNA, 726 bp, Homo sapiens
tggagagggtagagtcatagcttcctgcatgtgctataaatttccctctaaacactgcattagctgtgtcccagagattctggtatattgtgtctttgttctcctcagcttcaaagaacttatttatttatcctttaatttcattatttacccagtagtcattcaggagaaggttgttcagtttccatggagttgtaaggttttgagaggcactggggtcaggggcccacttgaggaggcagtgtgtctcttggcagacccggagcgctattctgggagatcaactgctctcttcagagctgacaggcaggaacgtttaagtctgctgaagctgtgcccacagctgtcctttccccccggtgctctgtcccagagagatgggagttttgtctataagctcctgactggggctgctgccttactttcagagatgccctgctaatagaggaggaatctagagaggcagtctggctacaacacctttgcggagctgcgggtggcctctacccagtccaaacttcctggtggctttgtttacacttgtgccctacttccttccagtaaaaaaataatgaagtcagtgctcatagaaattacttgtgtgcttctcatattatgtatggctttctgtcttagattttagttacaaatcaaactgactaaatttgtcaataagtgtataaactaattgaggacagaaaagacatcttaattctttgcaaataa

SEQ ID NO: 476217 - DNA, 479 bp, Homo sapiens
tgggaacctacgtcttgcatcagcatgacctggataatgaatcagtgcttgccaggtcctaaccttggtcccatcttgttttatggaagtgtggttactcctccgcaaagagataaaagaggagagaaggaaagaagatggcatccctgccttattcccttaaacctgtgcctatggcaaaccagagagagcaaggtgcccccatccattaattcttggagttctgaaatgaactgctgtttaccagggctgtggccagtgtttttcctgacagccggccaagagacagggaacgggctggagatcatctatcatccagattggagggctgaaatagagtgtaaatctctggggacacccataaatgtgcctgtctgttggctgccaagcagacacaacaagagcctgagtgttcaaacagcaaatggggagtgtatgtttcaagcaggaaaggaattcgtgtggcacacaaagtgaga

SEQ ID NO: 476218 - DNA, 843 bp, Homo sapiens
ttttattttctaatatgctaattagtatatgtggactcatgcagagtgtgcaaaatcctactggagctcaagaccagggaaggctgttttgagagtacagacccatgcccaggttgcagactcagtgatgatggtattagtttcagactcagaaatggcccaatccccagtggactcagctacagccccatttggtcttggtcatgctacaagaaccatctgccaaggccccagaccccaggctccagaggcagaccaggaaatgaccagaggagcagaagaatggcagaatggtgcagcagagaaggagagaagaggaatgtctgaactcagagagttcagctggggcaattggagaggagatcagacactggacggccaaattccaggggaagatcgtcttcccactccatcccacttccagctctccatccattctgttgagagccacctccaccacttaataaaaaccctgctttcatccttgaagtccatgtgcaacccgattcttcctggatgcaagacgaggatttgggtaccaagaggacactgagctggttaacacttaagccatctgcagatggcaaagctaaaagagtgcactgtaacgcacacccacttgggctttgtcctgcgaagggtcatgcaactctcatttcaatgctatctacagatgactagggagatgagaaaccagacaaccttagggaagttgggccacagtaaagaagatcattttcttagaatatttggtgtgaatacattctgaatactttctgaaagctttcatttaacatctttattgaatcaaccactgtttattaagtaaaagttagatgccca

SEQ ID NO: 476219 - DNA, 823 bp, Homo sapiens
tttatatcaataattacacatccatagacaccatctggaattgcaaaatgccagcatcgagttgctattttcagttagatattatgccttgtttggctattatgcattctctaggttatggtggcagagattatattactgactgtgtgctgaaacctggagatgtttccaaccttggatttcttaattcttttacaggattcaaacttaaagctgtatcaggttcagctctaacaacctgctcctggcccaagcctaggaatccaaaatacagtgcagtgacagaaaaaaggagtttacatggatgcatctgcctgttcacatactttttggtgttatatgtcgatggcaaagaaaagcatcagacctttctatacaacatccctgaagtgtttctgtgcaagcaattgagctatattaaggaagttgttattgaaaatctctatctttcctggaaaccactaagggcctcttagcttgcagtgggcattttgctaccagttggaggcatctgttagtctccaggtcattattattaagttaatcttcattaccctctttcaaatatcttatcagtaggggactattgaatgtttggaaagtggagacatgtagtcgcctgaacccatgctttagggttaataggctttaggcaatactgccaaatgtatctcagctctttcaaaataaatcgcataacctaaaatgctcaggagtaggagagatttttaagtaaatacagcacttaaaattattgggttactgtggaaccataaaaaaatgcaattgttgtaattatgtgaaaaaaaaacccttgcttgac

SEQ ID NO: 476220 - DNA, 762 bp, Homo sapiens
agaccatcacggatgccaagcttcaggtaactttcacagtggtaggccaatgaagttgtgttcccagccggattatggctgcctctgttgcatcatactgtcgctaggaaagtgtgggaaagctggcagtgacaagcctcaccctgctcccatgcagccagcaaaacctgtctcactcccaccatgcctccccagtagcaccaagtttacatccagacagctggtgagcagggctgagatcatgccccaggctacaagcctccctgctgagaaagcaagcagggctctcaggccctaccccttcctgcctgcctgcacttcctatttgcatgccgcccccctccccatcacctccaaccggccggcccgcaaacccccatgccaattctgccctggaaaatttgtgctgggtcgaaactattacaaagctcagatggaagctttcttttacctgtggtccttccactgataattccactgtcagtcctccccaaggatccctgtgagataaagtcagaaatggtttccctaggcatccctggggaccaggagtgcctacagggctcttcctgctgcttctacctttatattttgctcagctctctaaatttgtttcagtcctacatatggttaaatccttctcccatgatctgaattttcaggttccccagtgaggatatgtgttcagaagtgtgaaaactttccccccttttcacactttgagcacttacagtttttcagctgtcacacagagtttacagc

SEQ ID NO: 476221 - DNA, 579 bp, Homo sapiens
aagatattatgaaccgtatcacaggggggtgtacgcctaccacgatatggggagtaatatcaccctctctcccctgaaatattacgaatcatatacaaggggtttacgcccctcactatatggagagcaatatcaccctctcccacccggaatattacaaaccatatcacaggggatgtacactccatgcgatatgaggaccttctggatattacaaactgtatcacagggggtgtacactcccctcgatgtggggggtaatatcacccacttctcccttcctagctattatgaaccatatcccagggaggtgtacacgccccaggatattgaaaataatatcaccctcttctcccccctgggtgaattacgaactatatcacaggggtttttattcctcctagatataaaaagtaatatcaccttcctctcccatcctggatattacaaatcataccacaagggattgtacaactcccgtgatattgagagcaatatcaccctcctcttgccccctggatattataatccgtatcacaggaggtgtacaccccccatgatataaggagtcatatcaca

SEQ ID NO: 476222 - DNA, 605 bp, Homo sapiens
ttctaacaagcttcagtgtgtgttgttccccgccaagtgtccatgtgttctcatcgttcaactcccacctataacaaatggagtctctctctctctctgtgtcaagctgcctggaactggggatgtggtgatgctggcactcctgcgaccaccaccactaagactgtgctggatctttttagaagccagcacagcactgggtcttgctcaaagtctgctgtaactgctacttgcccatcacctatgttcactcatggccctagggttctacaattagcaggtggtaaaaccagccaggtttgtctccttcccttcagggcagcaagctcccctaggccttgggcagaggagcctctccttgtgggcaccaccaccaccagcccacagggcgtttctgccaggcaatggtctcccctgtggcccggggcaggtccagaaatgttgtccaagagcctaggcctcaatgtggggacctcaagagcctactttttgctctactccactgtagctgagctggtacctaaggtgtaagacaaagtcccctttacttttccctctgctttctcaaaagcgtacaccctcctgtgatatggtttttaatatcc

SEQ ID NO: 476223 - DNA, 450 bp, Homo sapiens
gcttttgcaacattttaacactatgaaaatcatgtcattctttgagctacactatgaagccatcatcattcatactgtgtcagaactcaaggacaaagtccttcccactcttctcttctttttgcacaagcaggggagtctctcctcatggccaccaccaccacaggcccatggggagtacttcgaggatactgtcgatgttcactcaaggcccaagggttcttctgccaggttgtggtgcacactgcccttcccgggactcatgcttcatggcaatgggtttccctctgacccagggctgatccagaaatgctgttcaagagccaaggcatggaatcgcccacttggtgctctactccactgtggccaagctgacatctatggtgcaagacaaagcaccatactcttccctctgcttttctcaagcagaaggagtctcttcccatagct

SEQ ID NO: 476224 - DNA, 3771 bp, Homo sapiens
gctaagctctggaatacaacaccatcccttctctacttattcggtatcacgagaacggcacaggaaaaaccttcccccgtaattcatttacctcccaccaggtcccacccatgacacatagggattattacaatttaaggcccacagcatgctatgtgggtattgctgttggttattcagggcccaaggctcttcagtcagcaggtgaacaattctgccaggactgggtccttctcttcaatgcagctggttccattctggtccaggatgtatctagaaatgccatctgggagatagggcctgcaatgtgggccttgactctgcccggtgcccttttctcagccactcagtcacctcatctgaaatctacagaaacacttagagcaaaatcagctctaaatattagatatacctctcttcttccaaatcttaaccttctcattcttcattgccttattgactttccatgccttcagtatatgaagacaaaatttccaccctgggttggctgtgacctggccatttaaccttagttgagtcacttattctttctctgggtctcgttgttaaaataaagtggtttctttttctaacaatgtaattaccactgtttaatgatttacctctaagttgttggaagttagttctatattctttttttcccacacaaagattttcaagcactggctctcagtgtactgacaaataaatactctgaaacattatatgtatttctagttactggctctatatagatttttatatctgaataacataatcttttacatcaactaagctgccaactgactaaactattggcagcttaaactatattttgaaaaaaaaacatgtactctgagaattattggatagaagaggaaaatagcctctatgttcatcagagtaaatgctgcctgtcctttcttaaaagattctgccacaactctcattacaaataaggctaatagagatgaatcatgatttacttgactataactcaaaatattcaaatggaaagattttaacaaaagtctaagctgctgtattatctggtaaattttaagtcaatagtattttaagggaaatatctgttgattagaataaattataacttggcttatttttccctttggttttgtcaagtgtaagatctgtgtgaaccgccatgaaataaggagtagacaagattagcagcagctgctattaaagggatgaatgagaatgtcagaagaatagctcaatgaattaccagggggagaatgggcaagttctgttcatagatggtaacatgaatagggacattcagaaagaaaacagagcattaatacggctataaggacaattacaataggatgtaaagcaataatagttaaaggattaatagaaatggcatccactagggttaaatttgaacaaaagcagaagttaggtggaaaacaggcagtttcatcagaacagggacacaatgggtgttctgatgccacacctaaccaaaaaattcttcaccttggctttggttttttcctgtgcacctgtgaattttcatccagtaacatcaatatttggtgagacttttaggtataatatgtaacatttatttgttatgtttattatttgtattttatatgcatcagtattatgcataattttatgtaagaatcctagcaagagattaggtcttccataaagcaagtactgcaaggaatcctgagaaaaaatattctggggcatgtgacactcagactaatggcctaaaactcatgtcaccgaagcccaaggtttatcagagcttctctggcatcaaaaggacctcctatcctgcttcaccaatagcaaatgcctttttattattttacattttggagttacatgagttctgctttttaaaatatttgatcattacaaaatgtatccatgcattgaaacatcacatcatatcctataaatatttacaattattaaattgccaattaaattaaaacaaaactttaaaaaataaaaataaaatcaaacataaaaatatttgtaaacaatgactccagagaccatatggtaccaaataaactataattctttcaaaaagttacaaactcttttgaaatattaccttttcaaatatactgcctgcttattactaaggtgttaatatcagagaatatacagaacacaatattttagttttgatactgcaagaatcagaggaaagaaatacaaatttttgtgataaaaaagagaaaaaaaagaagaaaaaaagaaattacaataaagttagaaaaacaagtcagaaatcctctccaagaaagaaatgtttaaacatgtgaacacatttgttcaaaatgcaaaacatgtacatcaaaagttgttctcttacatttcaataaaataggagaattacaagggcttcctattgtcttaaaggtaatttttcattatgggagaataactgtcagcagtattcttatgatgaatttcaatgtatatataaacaataagttcatctaatatgcattaccttgcagatcattcatacagagttaactgactttaagcttttaataatgtcatctggcaaactcagtccaagttatcatttagtggcataatatagctatattttcaagaactttattttgaaggtgaaataaagcaccaagcacaggaaatgcttatttgccaagaacagacataagtcattttatgtccaccacaagcacaccttactatattactcacaagtttcacattcagccaaagtcaagccgttcattcccacatcacctttggaaactttgtagcaaggcttggtataaatttacctttaaattatgaacaggtaatttatcattcctcttaggaaaaagaaaatggtttttggaggtttgattatatgctttgacacatttttaccctttactgagacctcagcaagcacagtaccattcgtgaagaaatatatgttcttgtaatttgtgtagcacagccctcatcaccaggccttaaattatcttacctaacatccatttccagttactaaaaaggaagcataaaaattgaagacaatttatagtacaaagaataaaaaagaaaagaagaaggagacagatggagagaaagaaggaaaagaaggagtcagaaaatagaacctaaactgatcaatgaggtgattaaaattgcctaggtattgtgggcttaattatgcccccctcccaaattcaaatgttgacatcccaactctcagaacctcagaatataacttcatttggagataagatctttaaagaggcaatgaagttaaaatgcagttattagggtggaccctaacccaatatgaccatgttcttgtaagaaggagattagggcacagacacgtggagaaaagaccatgtgaaacagggagaagacaggcatctttgtggcaagaaaggcctcaggagaaaccaaacctgcagacaccttgatctcagacttctagactccagaattgtgagaaaataaatttgttgtgtttaaaccacgcccagtctgtggcactgttacggcaggtcttaccaaactaatagactgggcaatggaaagaaaattgagtaaaaatttaatgtgtgtttaattatgagaaagcttattaaatgaagagtttttattaaatttattggcaatacataattagatgaaatgggaagagcaaataattgagctttccagttatttgctaagtcagttgtttgcgaagtataataaattagactaatatactcatcagaatttttcact

SEQ ID NO: 476225 - DNA, 5515 bp, Homo sapiens
tccacttccttcagaggacctgtgggtcctcttggaattgccggtttgttcttgaaaaaaaaaaaaaaagccatgaagccattgtgtccagagttggttccttctggtgggttcatggtctcgctgacttcaagaatggagctgcagaccttcatggtgagtgttacagctcttaaagatggcatggacctgaagatgtggaaggggacccaaccaggttgccgctgctggctggggtggccagcttttattcccttatttgtccctgcccatgtcctgctgattggtccattttacagagcactgattggtccattttacagtgtgctgattcgtccattttaccaacctctagctagccacagagcactgattggtgcatttttacagagtgctgattggtgcattttacaatcctcttgtaagacagaaaagttctccaagtccccacctgacccagaagtccagctggcttcacctctcaatcccccctctaaacaaacaggacaccccaactgctgttgggaattgggcaatgatcactcaagctacatcctgctggataggggtgaagaaggggccctgcagtggtagtgtcttccagaagggaattctctaggccagccaaaggaagcagaagggaaaaagataggacagaataagtttgcagtttgcatttcaagaactagaggcaacaaaatatcattaaaaataaacaagtaataagagttttagcaaattgataaataaatcaaggaataagagtattagcatatttaagagaaaaagtatatttaaggaaatgcatactgttgattaaaattgaatcatgaagaagaggagtggagaggtagagaacaatagaaaactttctaactataataagaaacacgagaacacatggacacatggaggggaataacacacactgggggctgttttggggtggagggctgggggaggaagagcatcaggaagaatagctaatggatgctgggcttaatacctgggtgatgggttgatctgtgcagcaaaccaccatggcacacatttacccatgtaacaaacctgcacatcttgtacatgtaccctggaacttaaaataaaagttgaagaaaaacaaaatcacaaaaacgaacaataaataaaaaccaaccatgaagaaaaaaaaaactttacaagccatctaaaaagaaaacatcacatatgacaaaattaaaacccatatatgtcatagcattaaatataaatgagtttgacctattaaagaaagaaatgttctgcttagattataatgcaaacaccaactttggatatttacaagagacacatgcaaaataaaatgattttctaagtctgaaaataaaagaagtgtcaactgtaaactaaaaaataatatcaatatcacaagctcaacataaaattacatggatttcgacctcaaattattaaaggagaccaaaagggcactttgtaacgctaaaagttgcaactcataatgaatatattacagttataaatatacaattatgtattgaataagcaaaaattatatgtcagaaatgataggagagacagtagcagtaagattttaatttactcttcattatattacatatgaaattagagaaaaataaacatagaatatgaataatgtaattactaagattactctgatgtatataagttttggtggcagaaaatagggaatacatcattttttttttcaaatacccatagaacagtaacattcaatgaccactgagaaggtgagaagactatagaatatgatcaataagatatctaaaagaaatttattttttactcttcatggaaaaagagttcagtaccaaattatgtttgcatgttggtcagtttgttcgtatggtgggttcattgcttcttcacttctatcagccttcatagaattaaagagataggaccttgctctaaattaggctttggcttaagggaatgtggtcactggtttgatcgtctacccaaactactcaaactttctccaaatcagcaataaggctgttttgttttatcatttgtgtattcactggagtgtagcaaaagtacaaaagtgtgtagcacttttaatttcctttaagaaatttccccttgaatttataacttgactaactttttgacacagggcctagatttcaacctttctcggttttcaacatgtcttcctcactaagcttaatcatttctagcctttgattttaagtgagagacatgcaactcttcatttcgcttgagcacttagaagtcattgtaagatttttgggtggcctaattttaacattgtgtctcagggaatagaaaggctccaagaagaaggagagagataggaaaatgactggacagtcgagcagtcagagcacacacaatatttcttaagtttgccatcttacatgtgcgtagttgtagcacctcaaaacaattgcaatagtaacatcaaaaatcactgatcacagatcactataacagatataataatgaaaaggttttaaatattataagaattactaaaatgtaacacagagacaaagtaaaaacatgcttttggaaaaatgggaccaatagatttggttgatgcagagttgccacaaactttcaatttgtaaagaattttatatctgctaagtgcaataaagtgaagcacaataaaacaaggtatgcatgtaaatattttgcatattgacccatgaggttattactcaggtgaatataaatataaataagtataaaatttatataactttacacatgatttatatacgttattgtatgtctgttgtccttcaataaaacatttttttaattttttttattatactttaagttttagggtataatgtaacaacgtgcagctccatcttctgtaaaaatgaataataataaccttccctacttcagagggctgtacattgtctgacacacccttgtcaagtggtcaataagtgttacctagcattattattactattttagcaaaaatttataatacagtgattgacagatatttgagatacacattccatagacatggactatgtgagactaaggtgagactatactactgccccccaaatatcatattctaggaatgctggtgacactttatgaagctcatcttcctccagatgaagaaaaggtttctatttgaccaatggtgataggcttcccctcaccaccagcatcagcatacaatattgaattttccaaaggttttctcacataggagttactcttggccttgtgaaaatcaagaaaaagcattggtaaaaccagataatttgtccaaagcttcaagtccagatataccttactgaaaatctggagcttttgacccttatgtagttgagaaacctgcactggggtccacactggccacactgttatcattttgacctggaatttgatttaactctggcttaaaattgattccagtatcactagatcttagctatttatgctttctgataaagcgttaagactgtccaccttttatataaataattgtatagctattacttttccccaaaaggttttattgtcaccaagtgttttttacccctgaaattattcaatttgttaaggagactgcctctacgaacaaagaatcatggcagtaaacaccttgtgcttgcatagacgttagtaacttctatgctaaaagtgtgattatccaaggccattatttaatagcatgtatttttctttgttatctcttctaagaaaactttgaataaaataaaatatcaggaaaccagtaagtgattcaacaaatgggagagaaccgatttctagtgggtgttctagagttcatttagattaagaatctcatttctaagaaactgatactaaaaatgataattctggtgtatgacagaatcttgatttatcaaataagatgcttacactcagaaattaccaaggcaggtatatatattaaaacttctagaagtattttcagctctgtacattgaaacaaaattttttttctggttaattatatgataatcagtaaatattatcaactaaaaatttcctgtccttaggagcactaaggtttacatttttttgtaaatcatttagaacaggcatgacaaatatgtggcatgcctgcaagtactctcctgtcttccatccacttcaggcatcactaatcaatcaacttcctgctgagcctagatgtagtctcagaaaacaatttttcagaaagtaccagagagcttcagccattgatgaaaacttacttgctattcctagtctggattgtcataattcaatattaagagtttatgtaacatccagtcagcttctgatcattaaagtatttctctgaacatattaaagaaggaaaaattatattactaatcaggggatctctaagcattttagtttttaaaaaataaagtatgtcaatacttaacagtatttaatgcacacaaaagttatttttaaaatataataattacatatcagaatatataaaagaaaaaactctaaaaatagcacagaaagaaaaacttgtcaataatgctagtaaaaaatagagctaaaatatgttataagaagtgagagtcaaaaacttagggcatctttgtgtaaaatacattatgttaacaaaataagcattttacatttagaaatgtactttttctatatgtaaacattattttcttattaaacatatgaatatttctttttatcatataatggcaaagaaaaatgtaactttattttttaatttataagttatcaattctcaataaactaattttttaaaatattttttacccatacaaaaaacgaattgcaattagaagctatatcattattttaatattctctattatattaagaggcttaaataacttccctaactttaataatcattttacttaaatgtcatcagaattttttgaatgaattgtcctgggtttttgaaatttatagataatctccattaggtagctattacatggaatcctccctcaattaagagtcagaagatctgggttctaaaccaagctctaccataaattacttatatgaacaaggagaggctagtcctctgtaaaatgtatgggttgggctagaaaatctctaagaccctttcaagttctaaaatgccattttattatacttaatttatctatacattttcagtattttaactatcaaggaaaactgacattttattctgtagtgtctgtatggacctagttgttttgggtttttaaaaataagacgtatttttatgtggtgatgtgtaaacaaaaaaatttaattgaaatgatttaatgcttctttaatttgtttaattattgaggatcatagcatagtattgttggactaaaagtcaatggtacacttcaggaacagcatgtgtgagtctgctgaaatcgttagcaaaattatttgcatgtttgttcacatagtgttcattaagtaattaacagggcccatgacccagaaaaagtataaatgctat

SEQ ID NO: 476226 - DNA, 550 bp, Homo sapiens
gggaggcctcaggaaacttataatcatggcagaaggtgaaggggaagcaagaaaaatagtaaatcaaaaacaatatcacatccctggagggattggagcgattactgccaccatcaaggacttaaaagatgcaggggtggtgattctcactacatccccattcaactctcccatttgctctgtgcaaaagacagatagatctcgaagaataacagtggattattgtcagcttaaccgagtggtgactccaattgcagttgctgtcccagatgtggttttattgcttgagcaaattaacacatcccctagtacctggtatgcagccattgacttagcaaatgcctttttctccgttcctgtccataaggcccaccagaagcaatttgccttcagctggtaaggccagcaatatacctttattgtcctacctcaggggtatatcaactttctggctttgtgtcataatcttattcggggagatcttgattacttttcatttctgtaagatatcacactggtccattacattgattacgttatgctgattgga

SEQ ID NO: 476227 - DNA, 727 bp, Homo sapiens
aatttaggtttgactaacgtttcctcatgaatagactcagattatgcattcccttttgaaatatagcaaaagggagggtggggtgggaatggtggaggcaaagcctctccccatccccacctcagttttaggtagggcttttaatttaacccaaggacatctctcaacttggagaataattcagtcctcaacagtgcctcaaatctgctatggttttgcagcgcagcagcaagaatgtaaacgcacataccaggagaaaggggaagaggaaacagaggtgtcggaagcaaagctgagtgacagaacacattcagttggggcagatgtctggctgcgcttcgggaaggtgcgccagtctcctggggagatggtttccacgtgcactcccatggcggcggccgacgccgagcgggcgggcagcgcgacgggcggcgtggaccgacagcgacctggcggcgggagggtatacagtgtggagatggtggacaatgggataattcacgtctcagtcaggtgagatattctattttgtcttaagttacagagatctgaatattcctacatttattttctgagcatataaggactctgccattcatgtgtccacctgtagatgcacaaggatttctgtgttgactccaggaaggtttaagaacatcttgtcaacttgttattttgcttttcaaatcgaatctgaaaatatacttttcattatttgatttcctta

SEQ ID NO: 476228 - DNA, 564 bp, Homo sapiens
ggcctggactgacagacctgcaagcaagcatcgggaaaatggtatgaagtcctctttggggtggggactcttagttttcttgtcagagaagctgcatgttttctgcagaacaccattggctagatatgtgatagcattaaatgttcacctaaatttaacctctgccgttctttcctgtcttcttactcctgctggaggcacgcgcaggaaactcagtgctgctcacccccagcaagttccacagcacctcccctggagaattaccaccaggagacagcccatgacccacccaactttccagcttctaggtgtcccagtgggcaaattcttagcaagttcagcagcaccttcaagtgtggctttctattttccttctaacagtcaggaccctcagctgcaggtctgttggagtttcctggaggtccactccagaccctgttttcctgggtatcaccagtggaggctgcagaacagcaaatattgtagaacggcagatgttgctgcctgatccttggtctggaagcttcgtttcagaggggcacctggctgtatgaggtgtcagtc

SEQ ID NO: 476229 - DNA, 545 bp, Homo sapiens
acgcatttggacttctgagagacctgactgtatttacaaaggccatggataaagacaagtgtagacacatggctgtgggagggaagcagaatacaagatgtgaacactggattattggctgtgcttataatgttaaacgtgagaacttcagtggaggaagtaattgcagatgtggtgaaaaagcaagagaactagaattagaattggagcctgaagatgtgactgaattgctgcaatctcatgatagaactttaatgaatgtgaagttgcttcttatgaatgagcaaagatgttggtcccttgagatggaatctactcctggtgaagttgatgatgtcagcacaacagctctttctgttactcactcactcactcacttctctgcatcatccatcgttgctacctatagcttcttcctcaaggtccttccctttgtttctaacattgtgctcttctgactcttctattttgaataacctcttccatcttttgttctttttgtaattgctctactactcattctgctcccttctgactctaggcaa

SEQ ID NO: 476230 - DNA, 1986 bp, Homo sapiens
aaacgtaaaacagaagaggccattatgatatgtgtttttggcaagaaaggagtaacttcacacatggatatccgctggccagaacgctccggtgaaggggagctggccaaagcactgcgtcggggtggcagcagcaggatctgtgctcagttgcacatgcctgcaccgtggcagagtactggcgagactggggatgcgagcagtcgtcaagggaacatacaaccagccatcacgagatactggagattttccaagaactgtgattttctttccgactacgctatccaattcacgtgcaatgggactcgcagcatattctctagatttcatggtctcctggtagcgcctctaaatgtggctgtgagagtggatttatttgggaacatctgtgatctacaattgtgggactctctgcatgctgggggtgggagatctgtgggtactgaagatgttcaagaagctgcattactacaatacgagatttcatttgtttccatggtctggtgaggtctcataaaaatcagagagaatcagagagagtgaatgattggagactcaggggaaacggtaatgtgaagatagcaacaaaacctggaatgatgcaaccacaagccaaggaacaccaaggaatgccctcagttggcagacgctggaagaggcagtaatggattttccctcaggacttctggagagagtgcagcctgcctacataacatcttgatttcagacttctggtttccagagctcattttcttaagccaggtactggattcaacgccacacatgatctatctcaaggcagtagtgctagactggggggagtttgcttcctggggtacatttgacaatgcctagatacatgtttctttatcacaacagggaatgaggatgctactgacatctagtaggcagaggtcagggatgctggcaaacttcctacaatgcacaggactgcctggaataataaagaaggatacagccctaaattgtcaacaatgcacatcttgagaaaaatgttccaaagtaaaagctgagtgattgttcatcagctaaataaatggtaagtcttgttataagtaggaggaacaatgggacatggtttttctacaatggatgaattgaaaagattatcatatgttgtaacatttttctatttgtagggaatacattcactacattcacatggtccaagattcaaaagatactcaagaagttgtagtccaagtctccctcccaccccatccctgtttcacccaagttccctccctggaggaaactgttagtaatctcttatttagttacctaaaagttctctaggcctctgtaagaaattatatacatgcacagaaacatactatacatattctttgcattgtgcttttgttacaattcattttggagattgttttctatcatgatacaaagcgtttccccattatttctttttaagatagcaaagtatttcattgtaggttgtatgcaagttttctattttatgtaaccattcccctctctatggatatttagattatttcctttttttctgttacagacactgatcaatgaatatctttatctgtgagtttaagtcctacaaacagaattgccaaataagcacatttgtgcttgtaatttttatcagatgttgtccaaattaccctccattctccattaaattgaatatgtttccattcacactggcaatacatatataaaggagtttggataactttataattttaaaagtttttctcattcttttcatcaaaacctgagaataaataagaggtggacacacaatataatattttctgtctaaaatgttctcagcactcaggtatccagaatctattcatgggagatattttttttctaatctgtttttagtgcgctaaaatatataacataaactttaccattttcacaattattgtgtacaattcattggcattaagtacttttataatgttatgcaaatatcattat

SEQ ID NO: 476231 - DNA, 1021 bp, Homo sapiens
tccaacaacaggattgagggtgcctggggcaagcgccagctcatgtcatcaccctcactgagccccgggcctgaagctcataaaggattacagaatattgttaaacatttgaaagctcaaggcttagtaaggaaatgcagcagtccctgcaacaccccaattctaggagtacaaaaaccaaacggtcattggagagtagtgcaagatcttagactcattaatgaggcagtaattcctctatatccagttgtacccaacccctatatcctgctctctcaaataccagaggaagcagaatggttcatagttctggacctcaaggatgccttcttctatattcccctgcactctgagtcccagttcctctttgcttttgaggatcccacagaccacatgtcccaacttacgtggatggtcttgccccaagggtttagggatagccctcatctgtttggtcaggcactggcccaagatctaggccacttctcaattccaggcactctggtccttcaatatgtggatgatttacttctggctaccagttcagaagcctcgtgccagcaggctactctagatcttttgaactttctagctaatcaagggtacaaggtgtctaggtcaaaggcccagctttgcctacagcatgtcaaatatctaggcctaatcttagccagagggaccagggccctcagcaaggaacgaatacagcctatactggcttatcctcaccctaagacattaaaacagttgagggggttccttggaattactggcttttgtggactatggatccccagatacagcgagatagccaggcccctctatacactaatcaaggaaacacagagggcaaatactcatctagtagaatgggaaccagaggcagaaacagccttcaaaaccttaaggcaggccctagtacaagctccaggtttaagccttcccacaggacacaacttctctttatatgtcacagagagagccgggatagctctttgagtccttactcagacttgtggga

SEQ ID NO: 476232 - DNA, 668 bp, Homo sapiens
aaacttattggtcttgtgaccctgcaggcatgctagggagagggagatctggatggataccacggcatctactgcacactccatatgtccattatggacatatttctactccaattcacagcatgtagttgtacagcattttatttggtttttcaatagaagctttgttttaaaaaaatctgatgcagaaatccaatatcgagagcatgtacaagtaaaattgttccttagtaacatgggagcagaagccctattcacagttgttctcctcctgctaaacgaagttctttcagaaaacatgcctgtaccagtcaagaattttactggctgcatagaagttatagaaataaataactggagatctttcattccatccaaggcagtgaaaaactatcacattaacaattgcagggtacatgtgcacaatgtgcaggttacaaccacagttgagtagttgtaacagaaatgcatgacccacaaagcctaaaatatttaccatttggctctttatggaaaaagtttgtcaatatcttgtgtaagaacgtagaacatagacctagttctcaccaatgaagtatgaagagaaataaattattgccacttacgactcgaacatatgatacatgattctttggactttgtcatctattctttctcccctcaccttc

SEQ ID NO: 476233 - DNA, 553 bp, Homo sapiens
acacggaattatgggagtacaattcaagatgagattcgggtggggactcacagacaaaccatatcaaccagtattatcagcagtaaccttattggaaatttggtttagcagaaaaaagaaaataatggcataccagatcaatctcttttgtttttctgtcactttgctggcccagaccaggaaaagttgttccagaccttatgtaaattctgcgctcctgacaaatttatcttcgtgtagttcactgttaattgtaaaaccaacactattagcattaatgccctcttttggactcttggaccttccaccagtggtttgtcaggggctttcgggccttcagccacagacggaaggctgcactgtcggcttccctacttttgaggttttgggactcggactggcttccttgctcctcaccttgcagacggcctattgtaggacttcaccttgtgatagtatgaagtagaaataagagaattcgtgctttaactcgtagtgaatatattgctatgagcagacttaacataaagcaaggactcatataaaatcaatg

SEQ ID NO: 476234 - DNA, 484 bp, Homo sapiens
tcctaactcctatcacaaccagataacagtgggaactgttatgaaaaagactaagagatgaaatgctaaagagactaaaacaagatactgacagtaaggatttccatactttaaaaagtatgcagtatgctccatacctgggctttgggcaccttcactggattccttcctccataagaagaaaaaacattaaagagcagatgctgactcagcaagatggcagaataggaatagctcaggtctgcagctcccagagagacgaacgcagaaggcaggtgatttctgcatttccaactgaggtacccagttcatctccctggtactgtgtgaacaaagccgccaggaagttcagactggtggaggggggggccaccacagtgcctcaaagctgccgtagacagaccgcctctctagatacctcctctctgggcagggcatctctgaaagaaaggcagcagccccactcaggggcttatagataaaa

SEQ ID NO: 476235 - DNA, 802 bp, Homo sapiens
tccaacattaccactttggaggtcccttcgtggtcgccaaaatgttaccgggtggtccttgctcacagaggtcccaagatggcggtgacccgcttccaagatggtggcaagccttgtgttctctgacctggggctcttggcctcacggattccgaggaatggaatcttgggccatgcgtaagatattctgtatcacaaaatgtgagtgtacatctggatggactggacagaactgtagtgaagaaataaatgaatgcgactctgatccatgcatgaatggaggtctttgtcatgaatctaccatccctggacaatttgtatgtctgtgcccacccctttatactggacaattttgccaccaacgctataacctttgtgacctacttcataacccttgcagaaacaactcaacatgcttagctttggtagacgcaaatcagcattgtatttgtagagaagaatttgaaggtaaaaactgtgaaattgatgtgaaagactgcctcttcctttcctgccaggattatggtgactgtgaagatatggtcaacaatttcaggtgtatttgcagacctgggttttctggatctctgtgtgaaattgaaattaatgaatgttcctctgaaccttgcaaaaataatggaacatgtgtggatctgacaaacagcagagatttgtagttccccttgaagaggttcatcaatcacttgagccgttgtaaggcaggcttggtggtgacaaaatcccccagcattttcttggctgtaatggattttatttctccttcacttgtgaatctcagttt

SEQ ID NO: 476236 - DNA, 564 bp, Homo sapiens
aaatatgacttgtaataagtccactgaatggcagttcagcagtatgtgcctgaaatttttcaaccgtatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatctgtcaaataaataatcttgttcatgtcaaaatttccccagggtggtcactgcaatttcacattgtcctttgagaaattatgccaattagagagatatgtatatggcttacaatatgaggggaggaatgtgtggtgtccaggtataaaagactgagaagaacccgtgaaaacttatgtcagcaagcatttgtacaa

SEQ ID NO: 476237 - DNA, 550 bp, Homo sapiens
ccagatataaatggatatgtgcatcatgatactatgttatgttcagcacataatacctcagtttggtcttcccacctctatacagtccagtaacagaccggcctttattaatcaaatcacccaagcagtttctcaggctcttggtattcagtggaactttcatgcaccttactgtcctcaatcttcaggaaacgtagaatggactaatggtcttttaaaaacacgcctcatcaagctcagcctccaacttaaaaaggagaactctgacaaggatagagcccaaaaacttacgctgaacccccttggccactctctaagtccaccaagcagaggtactgagctctgggctggtactggagagtcctctgatgtgattcatcttcaggtctttcagctgtggataccagtaacctgctctggtggagatagtaggggaaaccagtatgggtggacaaattagaacttgccagagatctcagaaaccaggcatggctgacttgcagaatgggaccattaaggagaactagtggagacatctgtgtcagggtat

SEQ ID NO: 476238 - DNA, 2223 bp, Homo sapiens
ttcagacggtcctctttcgacaacagctagtttgcaacctgttgcatggcggcagtgctcgcagggacaacagaagcaattttcactccaccggaaatagttcagacgttgattcaagaccacaagcatcatgacagatttaccaacacttatcaggccttcaaggcactgaaatgtcatggaattggagagtattatcgaggcttggtgcccattcttttccagaatggactcaaatggctaaaatccaaaacactgacaacaccaaatgctagtgaggatgtggagcaacaggaactctcttatattgttggtggaaatgcagaatgtataggcagtgaaactgttttacatgatactaatgtggagcatatatgtcattatacatttgtcaagacccaaagaatgtacaacacaaagaaggatccatcaggtaaactatggacttttgggtgataatgatgtgtcagggttggttaattttttgtaacaaatatccgtactggtgcaagacgtcaaatgggaaagctgtctctgtgggttgtggagcagggaagataggaagggagatgtggaaactctgtactaactttctgttcacttttgatctgaacttaaaactactctaaatgtaaactcaattaaaaaaaataagtatgtttataatttttgtttttattttacatcaaactgctgcattctatctagtgtttcaaacttgcattagatcaacacagaataataactttggtcttcatggacctctttgagtccatggccaggcaatccataaagaaaaattctgtgtgaaaagtgtatttttagatcttcaagaagatgaaaataagaaatgcacagctagaattatttaaattatagagctaaagctttggtttgtatacttacctgaatgagaaagcagtaaatcattttcatatttatctcttatacatctctataattctaagaagagtcaaactaaaatgtatattgaggtcatctaaaattgaattgttatacaaaaggaatatcttagcaccttatttgtaattattttactgttactgatattttgtgattttgcttattttatgcttatttctctggaaataaattattttctttttagcctgacttggttttgtttctacattattaacatttctttggacttttgaagactatgaattattatgaggttaataattttttttaaaaaatgataaatgaagaaatctcattgaggtattatttgtatttttgttatgttatgtcttgttattaaatgtcagatagagcatatacattgatccatagtgttattaatacaaaagcttggatcatcaagagatacatatgaattaataacaccgacaaagagtcaattcagaaaataattaaacacattgtctcctgtcctgtcttttgtgactgaagtgtttattattattttttttcttagttttcagtgatagcttttcagtcaagttcatcccttccttgaaatcaacagttctcatctgattttaagactttatattgacttcacattattatatgtcagtgaagtacctggggaatgtaacactcttccaatgatagtgtcctgtcaatttcttttcacattcttttctttccagggtataatattaggtatagactttattaaagaaaggattttataggtctcaaaatcctagtaaagtcatattttctgtgaatatggtatttcaaacactagtgtcagaacttttattattttcttcttcctcattatctgttcactttctctagtattttgttatcttcattcctttaaaacaaaatggtataacctagaagatacgaaaagctatgattccatgagtggggttcaaaggatgagctaatgtctaaaattgtacatgttattgtgtgtgaatatccggttatgaacagcattttttttggagaaggagcctataacttttattagttttcaaggagtacatggtcaaagacaatttttaaaactctatacatttaaaattatttcagaaatatttaaataatttacctcaaaatttaataatttaatagggtattattttaccatactgtctaaaatgtaatggaaattgaacttctaattttctcccattttacggggtttctttctttctttaagttttggagtacttaaaaatacctcaagccaaataaattaccactagtcatgtatac

SEQ ID NO: 476239 - DNA, 1650 bp, Homo sapiens
aggggcacacggattggtgtaatggacattgaagactcagaagagggtatgagagtgttcagctaaagacagggtccttgtcacacggccacgagaaattaggcttgcagacaatttgaaggaatcggtagacattgcgaaccaggttatgaagtgcaaggctgcagttgcttgggaggctggaaagcctctctccatagaggagatagaggtggcacccccaaaggctcatgaagttcgaatcaagatcattgccactgcggtttgccacaccgacgcctataccctgaggggagctgatcctgagggttgttttccagtgatcttgggacatgaaggtgccggaattgaggaaagtgttggcgagggagttactaagctgaaggcgggtgacactgtcatcccactttacatcccacagtgtggagaatgcaaattttgtctatatcctaaaactaacctttgccagaagataagagtcactcaagggaaaggattaatgccagatggtaccagcagatttacttgcaaaggaaagacaattttgcgttacatgggaaccagcacattttctgaatacacagttgtagctgatatctctgttgctaaaatagatcctttagcacctttggataaactctgccttctaggttgtggcatttcagctggtgatggtgctgctgtgaacactgccaaggtggaacctggctctgtttgtgccgtctttggtctgggaggagttggattggcagttatcaagggctgtaaagtggctggtgcatcccggatcattggtgtggacatcaataaagataaatttgcaagggccaaagagtttggagccactgaatgtattaaccctcagggttttagtaaacccatccaggaagggctcattgagacgactgatggaggagtggactattcctttgaatgtattggtaatgtgaaggtcatgagagcagcacttgaggcttatcacaagggctggggagtcagcgtggtggttggagtagctgcttcaggtgaagaaattgccactcgtccattccagctggtaacagtactgtgtagcagtattcaattacgcgaactatcttaattcatctgttctccagttgaaggcatgaagttgttgccagtttctgtattacaacactgtagtggaacattcttctgcattgggctcactacattagttacttaagatgtgtatcacagaataaacacatttagccttatagacattgccaaatttatcttcaaagtaaatgtgagtttttgtgaattacaattatttcaaaatatcatatctaataattgaaaagaagatttggaacctataaggagtagaatatagcattctgaaagaaaatatcaaatatttattttccttgaaagcttgataatgtctttgtgtttacaaactaaggtaagtttggggagaacagttgactgaggattatatcttactcatttcataatatcaagtacggtgaaaatttgaaatgaacgtgtatatcatttataacattgcagcctttaatgttttaaattagtgtcaaaattacagacaatgaacatgcatattgtctcttctaacaggttatctcttgaaaaggctttctaaagcttaaaatactttggact

SEQ ID NO: 476240 - DNA, 583 bp, Homo sapiens
tgcctctacgtaataaataagatcatggaagttcacatgattaagaaatatggtcttactaatgttgactatgctgtagatattttgaattctctgaatggtcacatatctcttgtttctctgggattggcacctggtatcttatttagttcaattgctgcctggaaccaggggtggggtgacacaagcgtccttgtggctgctaccactgggactgcactgagtcagacccaaagccagcacagtactgtgtgtgcctcacccaaggcctgctgtaaccactacctggctactgctgaaggccccatagctatacaatcagcatgtggtaaagcaagccaacctatttcctttctttcagatgaagtcacttcccaattatcagatcatgcaagttgtctcccaggagagcagtatacctgggcagaaagtaataccaagattttggactttgaacatgatgccatgcttacataagactttcagagttcttagggtcggtgagtatattttgcatgtagcattgatatgattaattgcagcaaactaagagctatcatgtattggttgtaccaatggctgt

SEQ ID NO: 476241 - DNA, 1362 bp, Homo sapiens
ctggcacatcccattacaccatctgaaaacaaaatgacacagtgctcaggaaggagaaaacatttatgtgacctcaactactgccattgcctgcattaccctagccaacaaggaggtgttgaagctggtgctggtacctgccactgggagactagagtacaggtgacatcaccggatcccttgcagacattccctaggaccatcataagtatggcagccccactgggtgaacagacccagagaagcagcaggattacagagcttggagtggataaacctgtagacagccctcctcgaacacttcagggtgacagcctccccacaggaggaatgccctccaggttcaggcttgcagaagaggtagcctcacaacccctcacaacatggaacaccagcattcctgcagctgaaaagaggtgcctgtctgatctgaatagctaaaacactgaaaaactttgcaaatagactttatgaacctaaaaatccataatgtattttgaattctgtagagaaaagcactgggtccatagtagaaatacaagtgttttattttttcaatatttctcaaaatatcccctgggttagtcaatcaaagatttggagtatagtgattggtaaagaaaaaattgagttacttaacaaaatgctgtgccctctccatgatatttattacctctctgatagaatttatttttcttcatttatattcacacagaatagtatacagttttattcagcttatgcattatattattgcatgtccttaagacatgatgatactgtaaatgagtattgctatctggttaaaaactaaattgaaacttatttttatttcctatgtagaaaataatgaaatgtcctcctttctcaaattcccgttgtggtcattatgcttttgaacagtcaataaatgacgtatatactattctgttgactatcatcgtcttcttatgtttcttaaaagactctcaacacagttatattgaaaatgtattcttcgtaagaacaaatttatttttatcaaataaatacaattttaataaatgtattctttaccatttattcaaggccttattagcattcctgtaaataacaacttttctatcttttcataaacatgcattatataaataaataaatgtattctgaataaaaattaatcagaatcctttgtagggttaggaaagcatcgttgcaagtgttaagtttgtttaccatattttctggaaggattcttgttaaactattattttgtattaataaatataatatgaataatcaactctaaaatatttctaatctcattaaaaactttttaaaattatgcttgtagcagagaagcggaggaaatgaggagatgtt

SEQ ID NO: 476242 - DNA, 847 bp, Homo sapiens
ccatgatgacgatggcggtttttgatttcgcgactcctatcgggtggcctgcatctcccgggctgactcccacgttagggcccctgaccgacactgccccgccgcgggacagctggatgttctgggcaattctgccgccaccgccaccaccgcttacgtcctcgcttcccgcagccgggtcaaagccttcctctgaacagagagcagtcactggatcaggcaatcacttgtgtgatttgaagccagaaggtccacctgaggcaaatgcagatcctcttggtgttttgataaacagtgattctgagtctgataaggaggcacaacattctgtgatacccaaggaagtgacaccagccctatgctcactaatgagtagctatggcagtctttcggggtcagagagtgagccagaagaaactcccatcaagactgaagcagacgttttggcagaaaaccaggttcttgatagcagtgcttctaagagtccaagtcaagatgttaaagcaactgttagaaatttttcagaagccaagagtgagaaccgaaagaaaagttttgaaaagacaaaccctaagaggaaaaaagattatcacaactatcaaacgttattcgaaccaagaacacaccatctatatctcttggaaatgcttctagctccggacattcgacatgaaagaaatgtgattttgcagtgtgttcggtacatcatcaaagaagacttttttggactggatactaattctgcgaaaactaaaagggactaaatttttaaaaaattagtctgttatagttgaagattaacttttcttaacattgtgattattgaagttcatgaatcttgctgtca

SEQ ID NO: 476243 - DNA, 583 bp, Homo sapiens
ggcactcaagtgctgagttaacaggaatgctgatgttccatgtagagagcgagtttgacgctacctcttatctgagcctgagcatggagggcactcctcttgaggtgatgcagcacaagtatcggctccaacggagatcagaaggcagttccctagcctttggagaaatgttccagggaggagcacagctgcccctgctgcacaaaataatccacacagagacgggggatggtagcaggcagcagccacacccctccacccctgcccatgaagctgaggtgtccaactcctgcacccatgtttataacacacttcttacttgccccttgattctgctcatcaaggttccttcccattcaatattcgactgcagatcttcattgggagcttatctcaacctgtgcccatcacctgagttagctggcagagttctgtgaggtcccctttttcaattcatataaacatataaatggacttttgccaccttatgtaaagaagagctaaaataaattttcaccaaaaataaagaaccatcaaaagggattgacagttgtccaagtttgagcctattccattctttatc

SEQ ID NO: 476244 - DNA, 654 bp, Homo sapiens
ctccaacagacctgcagctgagggacctgactgttagaaggaaaactaacaaacagaaaggaatagcatcaacatcgataaaaaggacatccacaccaaaacaccatctgtaggtcaccatcatcaaagaccaaaggtagataaaacaataaagatggggagaaagcagagcagaaaagctgaaaattctaaacaccagagcacccattctcctccaaaggattgcagctccttgccagaaatggaacaaagcaggaaggagaataactttgaggtgttgagagaagaagccttcagaaagtcagtaacaacaaacttctcagagctaaaggaggatgttcaaacccatcgcaaggaagctaaaaaccttgaaaaaagattagacaaatggctaactagaataaacagtgtagagaagaccttaaatgacctgatggagctgaaaaccatggcacgagaactacatgatgcatgcacaagcttcagaaatagagagagcaccacaaacatactcttcgagaagagcagccccaagacacataattatcagattcagcaaagttgaaatgaaggaaaaaatgctaagggcagccagagagaaaggttgggttacccacaaagggcagctcatcagactaacagctgatcactcag

SEQ ID NO: 476245 - DNA, 752 bp, Homo sapiens
ccagccagtgaaagcagctgcctaagggagtgggagcccaccttttgcatctcaaggcagtggagctgccaaaggcactcagcagttctctctccttctgccatgtgagaaggatgtgattgcttcccctttgcaccatgattgtaggtttcctgaggccttgcaagccatgcttaactgcgagtcaattaaatctctttccctttataaattacctagttctcgtatttcttcatagcagtgacctgttgaataactttgaccaaaatgctgatagtgataaggacattgaagtccaggctgaggtggtcttagatggagatgaggaacttgggaactggagcaaaggcgatgattgctgtgttttagcaaagagactgactccagaaggtagatccaccaacagcttgcatagtgtacctggaaaagccacagacactgaatgccagctggtgcagggagctgtaccttgcaaagccacagaggtgaaactgcccaaggccgtgggagctcacctcttgcatcagtgttacctggattgcccgtattctactgctgaagataaagaattaagagaattttttcagtgtcttccattggccaaatttatcaggaagccagtgatatggagctctgaagaagacagctttctccaaacccaagtagaacaaagataaaaggcaagggaggggccagagtacataagaacaaggattttagtaaaaattggaggacacagaaaaatagccagc

SEQ ID NO: 476246 - DNA, 839 bp, Homo sapiens
tgggccgaattaattgcagcgggaacgtggccttaagacacagatctctcaggcttttgtttgtggcttaagaatgcctttaagaggttttccgccctgggcgggccaggtgttccttgccctcattcccataaacccacaatcttccagcttgggctcaaagaacattatgccttctgacattgctgttgtctatattagcatgtttttcctgtgtgatgggacattatttctaggaaaaacatttttgccttcttcccaagccatagctataattcactttcatattaaggacaaagctaatagaaaagtaaaattgaatgatatttgcaatagtgatgaaataaatgagattctgttgtcctttatcatgctacttgtgaaggtacagcccaagccttttctcactcatagatgggaattgaacaatgagaacacatggacacaggaaggggaacatcacacaccaaggcctgttgttggggggtgggaagggatagcatttggagatatacctaacgttaaatgggttgacgagttgatgggtgcagcacaccaacatggcacatgtatacatatgtaactaacctgcatgttgtgctcatgtaccctaaaacttaaagtatatatataaaaaaaaagaacatgttctttgtctctagatcccagttcagtagttcaatgtgagtgtggtaggatcagtttatgaagctctataagcaatgatgtgacagtgaatatttagcaattagttcactggagagtgggccaaaagctcagttatgtactatttgctgatttctgtggtgttaatttccttagcatgaccaacttcaagt

SEQ ID NO: 476247 - DNA, 709 bp, Homo sapiens
taaaaagaaccattgtctgaggctccacttgcatgatcatttggagtctgacagcgtctagacaatggggaaaatgtctccaggtcatgtcagaaacttttgcagcagcctctctcatcacagacctggaggtctaagagggaaaaaatggccttgtggacacagcccggggtccttatgctgtgcgcagtctagggacttggtgccctgcatcacagatgctccagcttggctgaaaggggacaatgtagagctcaggctgtggcttcagaaagtgcaagccccatgccttggaagcttccatgtggtgttgagcctgcgggtgcacagaagtaaagaactggcattttggaatctccacctagatttcagatgtatagaaatacctggatgcccaggcagaagtttggcagtgcagaagggaaatatggggttgcagcccccacatagagtctctactggggcaccgcctagtagaactgatggcaggacagaacagtgggtgaagatctgtatgagtctcttggttatagattatttttccactggcttttccagatgctggtaccagtagttatgttcttggtacgtgggtgagttcaatgtctcatatggggttggaatggcagagatctcctgaagctcatctcatcctgtcatggttttcattttatctatttaatttttatatatttaatttttcctcgcg

SEQ ID NO: 476248 - DNA, 564 bp, Homo sapiens
tctgctgtgaatgcaggcctgggtccgttgtctctgctggagacctccactcggtctgagactgaggaggccattggcgggaacaaggggtctgtgccataaaaagggtgaagatgccccagacacaagtgtggctgagactgccttcctggaagccaaatgggctattcagcaggcacaagccctacaggtagttgaccaggggcacccgtttgagctggacttgcatgtgaccacagatggtttcagctggggcctgtggcagcacacagagggcttaagaacaccagtagccttttggtcccaactatggaatggagctaagctgaggataactagtagtggaatagagaagcaggactgggaaggaaaggacatagagggatggtgcaccaagcaaagtctcctggaagcaatgactaatagcgttcttgtaaatctgaagatatgtttgaacattgtgtgtgaaaggcgattatgaaaatgtcaacttaaatttgccagtttttaggagctcaaagatagtctgaagaaggggtactggatttagcaacgtaaagtata

SEQ ID NO: 476249 - DNA, 706 bp, Homo sapiens
aactcagttggtaatgaagaaatcacccgtcttctgcattgatcacactgggagactgttgccccgaatcccacataagcctttacactgccatgctctcatgaactgctcaacactaatgatttctccagggcttggggtgaatcctgatgttactgatttgatagctttcttattttctggtaaagatattaagtggtataaacattccctaccacaagaggtatctcacttggctcttcaacataagaaactgaatgaagtgacaacttccatgaaggcacaaaccagctacatggagttcttacatacgattgcacatgcactcacatgctccctcagaatagataatcgaaatcgattgcatagcacctctgacgctcaattcttccttgaaaggagaaggactctatccttagcttcagtcagttgttcttacctgatgcagtgaactgtagactaggttctgtagtataacaggacttctgaggcttcccattttggaaggagtgggtatggagataggagaaatacatttctcagggggagaaaaagtcatccttttctggggaaacattcaaaaataagcctctaatagcccaatatgtcagaagtagaatatcattttatttaaacaagcacaaaatattgtatctattacattaaatattaactattttccaggccaaacacaaaattatatacc

SEQ ID NO: 476250 - DNA, 1937 bp, Homo sapiens
tgaatagtgttgcaataaacataggagaacagctccagtctacagctcccagcatgagcgctgcggaagacgggtgatttctgcatttccatctgaggtaccaggttcatctcactagggagtgtgagacagtgggcgcaggacagtgggtgcactgcaccatgcatgagccaaagcagggcgaggcattgcctcactccagaagtgcaaggggtcagggatttccctttcctagtcaaagaaaggggtgacagatgggacctggaaaatcgggtcactcccaccccaatactgtgcttttctgacgggcttaaaaacggcacaccaggagattataccccccaactggctcggagggtcctacgcccacagagtctcgctgattgctagcacagcaatctgagatcaaactgcaaggcagcagtgaggctgggggaggggcgcccaccattgcccaggcttgcttaggtaaacaaagcagccaggaagctcgaaatgggtggagcccaccacagctcaaggaggcctgcctgcctctgtaggctccacctctgggggcagggcacagacaaacaaaaatacagcagtaacctctgcagacttaaatgtccctgtctgacagctttgaagagagcagtggatctcccagcacgcagctggagatctgagaacgggcagactgcctcctcaagtgggtccctgacccctgacccccgagcagcctaactgggaggcaccccccagtaggggcagactgacaactcacatggccgggtactcctctgagacaaaacttccagaggaacaatcagacagtagcattcgcggttaatgaaaatctgctgttctacagccaccgctgctgttacccaggcaaacagtgtctggagtggacctctagcaaactccaacaggcctgcagctgagggtcctctctgttagaaggaaaactaacaaacagaaacgacatccacaccaaaaacccatctgtacatcaccatcatcaaagaccaaaagttgataaaaccacaaagatggggaaaaaacagagcagaaaaactggaaactctacaaagcagagtgcctctcctcttccaaaggaacgcagttcctcaccagcaatggaacaaagctggacggagaatgactttgacgagttgagagaagaaggcttcagacaatcaaactactacaagctacaggaggaaattcaaaccaaaggcaaagaagttaaaaactttgaaaaaaatttaggcaaatgtataattagaataaccaatacagagaagtgcttaaaggagctgatggagctgaaaaccaaggctcgagaactacaaatatgggactatgtgaaaagaccaaatctacgtctgattggtgtacctgaaaatgatggggagaatggaaccaagttggaaaacactctgcagtatattatccaggagaacttccccaatctagcaaggaaatacagagaatgccacaaagatactcctcgagaagagtaactccaagacacataattgtcagattcaccaaagttgaaatgaaggaaaaaatgttaagggctgccagagagaaaggtcgggttacccacaaagggaagcccatcagactaacagtggatctctcagcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagatttttgtcaccaccaggcctgccctaaaagagctcctgaaggaagcactaaacatggaaaggaacaaccagtaccagccactgcaaaatcatgccaaattgtaaagaccgtcaaggctaggaagaaactgcgtcaactaacgagcaaaataa

SEQ ID NO: 476251 - DNA, 681 bp, Homo sapiens
cagacagcgtcctgaaatgaagaattagagcaaaagattaagaccacgttattcatgtctgtagcaggccgtggacctgtgctggtccttggcatgttaggaacctggatgcacagcagtagcactggggagcagctgcaaatacagattaacatttgcagagaggcctggctgcaccgagaccataataaatcaattgcttgcagactcatatcaaaactctatcagcgagtggcaggtgacaagctgcatctagtgacaggttttagagtggcaagtgagttgatatacttcaattatgcagctgcatctggttggcaggctttaagtcagaagctgacagttattttagtccacacacgacctgctcattattttcttcactgcttccatgggcacccctttttcacactacacacttgtctcagtcacagttttgcattactgcttaaccacagaagactcctgaactgggaagaaagggatcgtgacccatttgtgaataagccaggtcaaaaggatataaaatttgttccttttgatggctatatttcaaggtcaaatggagaacactaaacgtactttgagaaaatgaagccaacacagaaaagaaagcaaagctgagagaggggaaaaaggaggagaggattgattctgaaaaggctaaattatgtatggatt

SEQ ID NO: 476252 - DNA, 1051 bp, Homo sapiens
cctcctacacatcaggagctagacacagtgggaaaatccagatggaaacttcaattatcaccagctgtttcagcactgcccctgttctcttgtcgtgggccacccctgagacagcaagaccaacccttcctcttcctcctcctcctcagcctcctcaaagtgaagatgaggaggatgaagacattcgagaaaagacccacgggaagataaaagaaggctacgtttccaaatccaccactgacttccatgacagaaagtgcatccactttgttcaagaacttttcttgaaaggacaagaaagcttggatcaaagtgaaataaacatcttcctacagataggaccatttcagaaatgcagtgccaggcatttgaagatttcaataattttaaaagataatgagtctgtggaaaatggaaaattattagctgttaggtataaattaagaaattataatgtcacaaaagatgagttttcagaagtggaatttcctaaaatcatgaaatttattcctcatcagtcctctctctttttcctaccctgtcctatagcaccaagtcaccagaacttagaatgtggaaaaagaagactgtctttggggcagagtcggtcttgttcacctttctcctatatggaacagtggtgattcatgccttcctctgctgtcacactgtcagcatccactaatcatagccccatgatcacaggacttgtgcacataaacagtttccaggaggtacagaacagcccagggacctctcaggcgtaaacactagttattctgtaattcattctactcccttctctatccttttgtcatgtgcttgaaataatagctttccttaaaacgtttgaacatgtcagcggacgtaggcccttttgctgtctttggtacatacatgtttgtttcactatatcccctttcttcaaaatgataatctttggctgttctggtgaagctctgtggatttgcgtcttaaagaatatcaagaggattcagtgatggcgtttcagacacatgctagatcctcttgtccttcgcatttatgtttc

SEQ ID NO: 476253 - DNA, 527 bp, Homo sapiens
tccctgactgacacctctcttatatcctagcggaatacagagcacctattaagtgcttcaaaacacttagggttgccctcctcgtgaaacgtgatgccaacacagcaggacctgactgtgaaaccagttcccatggcagacagccactgtagagcacaggtcgctttcactgggagccactcctggtggcctgtgtttgtgagacccttggattcaattgatcaattgactgtcacctacaggaagcacaggaagcctgcctccagaagtagcaatttcacagacatgagaaaccctttgagagtgaagggcttttggtaccacttcatcatgttcctttcctgcttggtgaccgatggcagggccaccatgcttctgagtgaggctttgagcaatgtgtccaagagatcaggacaccgggcaagtggttctcagtgctggctgcccattccaacctgctgggtttggtttgcaaaattccaagactttggcccctatcaatgaagtgagaactggggaaggggata

SEQ ID NO: 476254 - DNA, 1134 bp, Homo sapiens
atagatttaggagatatacctaatgctaaatgacgacttaatgggtgcagcacaccagcatggcacatgtatacatatgtgaatctcttgaagacaacagatacttggttggtggacgtttatccattctgccattctgcagaatgccccatcttttaagtggggcatttaggcagtttacattcaatgttcatatggagatgacacggaagatgagcgatgggccttttaagatccttcccggagaaaacgtaagtgatgttcattacattttcaccggattccacacatctggctggtgtgaggagcaaagatccattgggagtgaaactcagtctatggaagaacaacttcatgctgtcatcatgaaacatgcgatcctgacaacggagtccatgcctgcagacatcagtctgtgcgtcctcccggccatcccatgctggaagtccaggctgtacacaggctctttgtcatgccaggctacttcacaagtgataactttcatcctcctgagtcttgaaggtgcaaaacgtttctccggcaccgttctgcagggaccaggatggtcagcggtgctgtcacctcccttgcagggctgtgctgcttcctgcgcactgcaggccccgacccctcgggctaatgaagctagtgactttaagttgaacccaatgcccatataccattcaaaaaatcctagggctcttaagcattatgctaaatctactctgcttctgttccgtaaatggaacaacaaagcttggctgacagcacatctgttagcaccatggtttactggatattttaagcccactgttaagacctactgctcagaaaaaaagattactttccatagattactactcattgacagtgtatctagtcatctgagagctctgatggagatgtacaaggatattaatgtgtttttcatcacagccttcattctccagtgcatgaatccaggagaaatttcaacttccaagtcttgttctttaaggaatacatttcctaaggctatagctgccatagacagtgattcctctgatgcatctggggaaagtaaattgaaaccattctggaaggaattcaccattctagatgtcattaagaacattcgtgattcatgagagaagg

SEQ ID NO: 476255 - DNA, 498 bp, Homo sapiens
ttctttaatgatgatgttagaaaaatgcaactgttggatttcaaagtctcagaccatctgcatgctggtacacagacacgacacagacacagtaaacacagtcaactggcagagctacaggcagctataggaaaatgggaatacttttacatgacaaagttacaagtgtgtggctgtgaaattagggaccaagatgactggaagcacaacttgttgaacattttgcaattcaaagttaccttttggtcagccatagacaatccactaaatgaatctggaaagagtttagtactgattaaacttggcgagtccatgattacaggaccatttgtacctgtgttgcatgactcaggcacaagcagatggtctgcaggtaaaaccacaaaccctctggtgatcagtgaaatcacatctttgttgtctttgcctggtgaatgaggtagctatgagattgctgttcttttgtaaatagaatactaaatgaacatgctgtcacgc

SEQ ID NO: 476256 - DNA, 646 bp, Homo sapiens
gacatcaagcaacttaaattttttcctgcctccttctgttaatgtccaaattcaccagttatattttaaactttctgctttatttttgtgtcacaaattttttctattcaaaatatgtgggaggattagggcagtcgcagcaggaatacaaggagaaagattcgagtctaggattcagtcttagacttctagaggaggacttccgggtctgcagaaaagcgctagttttgaaaggcaagctttgtggagagagaatttctttagcatctattgagagctgtcctggtggactagattataataaacagcagggacagagagaagtagccaatgacaggggaggaggaacgtgtgagagaggatggaagatagacggaggggaagcaggcagtaagacatgtcctgaccactcctttacgggctgatggctggggagaggagccatggcaaatcagtggacacaaaagcaaaggggttcgtgtcctgccccactctggatcccctgggaggatggcattgggagatatacctaatgctagatgacgagttagtgggtgcagtgcaccagcatggcacatgtatacatatgtaactaacctgcacaatgtgcacatgtaccctaaaacttaaagtataataaaaaaaa

SEQ ID NO: 476257 - DNA, 582 bp, Homo sapiens
ttgcagaggggcatggtgggagtgagaccagccctgtggtttgcatgggagctgacacgcttagccctgccctcacctgatggtccttccctacccaccttgatagtggaagacaatggacacatagtcttcggagttctagagccccacccagcactgatccctctccacactacttcagctgatgctttttggaaaaccttccctctgacagagcctacccaaatgagaaggaaccagaaaaccaaccctggtaatatgacagaacaaggctcatcaacaccctccaaaaatcacactagtttaccagcaatggatccaaaccaagaagaaatccctgatttacctgaaaaagtattcaagagaactgcagaatggataagaactcaccaaccaactatctgctaccttctggagactcacctaacacataagggcttacataaacttaaaggggtagaaaaagacatttcatgaaaatggacaccaaaactgagcagaagtagctattcttatgtcagaaaaaaaaaactttaaagcaacagtggttagaagaggcaaagagggacattgtataatggt

SEQ ID NO: 476258 - DNA, 979 bp, Homo sapiens
cccccgaatactctgtctatagtgacacactcttgttcgaatgtcatgcccaaaggccaaggttgtggggatgggcctggtgcaggccattgtattctgagcagaccagcaggggcggtgcttgtggacagacatggctacagcccaccagaagataaagctgacaggacttggctatttgtgggagcagaactggtggtgagtgagaggagcataattgaaaaccttctgatggagcttcctttcctgcagagaaaaggccgcactctctgcacggccaccaaggcccttcccatacccagtcacccgcacccagccaagacagtgacttctccatcccctgaactcatcacacgtgagcccacctctgcccaaaatgcccgcacttctccatccagcggtacccccagggtaaactcccacacctctgtggatctgctcttccctcctttgctgccctctgtggccaagaatttatgcacacaatatggctggttgtatggcagccaaggcagggacgtttgcttaggtctcaatgtctcttcagatcatcgttgaatctagcaatgctctttcacttatctatttgaaccgtcaacagtactgtcaatgtgggagggcaggccctgtgtcccctttttagaagggagagaaggtgggtacagagacgttatgtctttctgattttcttcgtctattcgctcgtcccagctgcctgttaaatgccatggtgcttatcattgctgggccagtgcacagggcctgctcccaggaggacaacttgattcaggattttaccctctgactccttgattggcaggccaacagaaccaaaagtggtttgaactgagctaaattatgtcacatctgagtcaatggaggtcccacgactgtaaaacagctcttataaaagggaccttggacagggaggtgatggtagccatttaattcttgatatttatctgcaaataatgaaagc

SEQ ID NO: 476259 - DNA, 653 bp, Homo sapiens
tcccttcgtaagaagctgagataacagaatgaggaaactggtcctaggccagaaaagaggaataggccatggactgaaaatgctaactgtgcactgtgatggctcagttagtgatgaggtcacctgtggctcaaggctcagggaagacccccgacggctttcagctaggtcggtgaccagctgtcagtgggaagagtcccctgtcagtgccaggttgggggagactcggagctctgacctggaggggaaaagacaggaacacacagctggctggtccagtcaaggtgaacatccattccgggaagcatctgagaccagtggaaatataagatcatgccagacatatgatgatgctaagaggaggtactgttgcatgtatgcaaaatgtcaagccctaagctgccaggtttgcatcttgtttgcaaatgatatagagccaaaatgctgagtgtgctattgtaggcctgaacttgctctagctaaaataaacagataaaataagtggtagcctggaatatagggaacgtttaatataactgccaacagaaatattcaatgctataaaactacaatgtgaaggcaaacatatttataatggacattatttggataatttttttgtgtttcttgctctaattttggagactcagagc

SEQ ID NO: 476260 - DNA, 612 bp, Homo sapiens
acccatcaactaaaggattgggtaacttgtgagacgtattcactgtcacaagaacagcatgaggaagacctgccaccatgattccatcacctcccactgggtccctcccacgacacatgggaattatgggagctacagttcaagacgagatttgagtggggacacaaccaagccatattacggggcccaacctagtgaattgaagtgccaggcccattcccatgtgccagacttaccccaggggatcctggcaccaggcccacccctgcagatccaagctccaggaccacctccatggactcatgtttcagggaacccaaaaggaaccaatgccaggcattcacattcatggaccccagcagcaggcctgcccttccagtcagtaaagaatggaaaaggtgactactttttcaaatatacacacatcaaagctacaaaaataatgaagaatcagaaacatgacaccactcaagggataaaagaaacttctagtaatgaaccctaaaaattagaaatctatgaacttcttgacaaaaaactcaaaatgatagaagtatacagtttttgtatgccattaaagttgttaccagctcaaactatacttttataaca

SEQ ID NO: 476261 - DNA, 1618 bp, Homo sapiens
aggagggaggccagaggagcagacgaaactctgcattatgcctcaaggtgctcttattaggaagctatccatcgcctatccacccactccccttagacctcagctggggctcaaacctgaccctgggtatgacatttggtgtagtggtgaacctgacaatagccatggagtaaaatttatagatcttagagaagatgccattaggaacatttttgttacatggaaggaggtcaaaacagcaacattaacaggaatttggaagaagttaattctaaccctcatggatgactttaaggcttcagtagaggaagttactgtaattatgatagaagtagcaagagaactagaactggaaaagaagcctgaagatgtgactgaattgatgaaatttcatgataaatctttaatgaatgaggacttgctttttatggatgagaaagcaaacttcattgttgctttatttccggaaattgccacagccattcccgctttcagcaaccaccaccctgatcagtcagcagctacaagcatcaaggcaagttcttccaccagcaaaaatacattacaactcaatgaagtctcagatgattgttagcatctttgaccaataaaatatttttaattaagaactatgaaatggattttctttggaaactttttccccactattttaactttgaaagagattctagcatcccatcatatttttccccatcaaaactgcctgaattaaaattggcaacctaaaattagttttctaactataattttgactttttgtttaaatagtaattttcatacatttgtaaaatttaaaatcaattatgtgtttaactatgtgagggggaagaaaattaaagtcacattctaaatgtgattagacatctctagtattgcaatctgatgaccctaattctactttttgatggcaacactgaaaacaaaatgcatttaaagcagtgtaaaccactgatttccaaacgggttagagctgtttttctactttaacttacctttcaaaactgaattaaataaaaaaaaatatatctggggggaaatgttttaataaacagctcagaattcagtaactaacggtttcaacttcagttcctttgtgacttaaaaatcaagtatttatttagaaaatgccttcagcaagagtacagtttgggatttatttcatgtcacagattaaattattgcttgcttccttaacttgaaatgcataattaatatttcacagcaagtttagattagtagttacattttctttacttaattttcaaagtcacttaaagccatctgagccctagtatttttatatcacaaacaataaatcaagttaaatgttagagtcagagagctctaatgctacatttaaatccaaagcactggtaacactgcagtttatctagctgtgttatagactgtcaccaatcataacctccaatgtttcataaatttttgataggacagccccaattcaagagttggaaagtactacaacaaattaataataagattataaagaatatgagaatgtgagagctctactgttacttccatgacaaaatgttgtagtttgaggctttatagtagaattttaagaccgtaattt

SEQ ID NO: 476262 - DNA, 1125 bp, Homo sapiens
aaaccacacatcaacttccagtggtgttctggtatggttaagagccttaacggtgttctatagtgagcttcaaagcacccctctgttaatgagtctgattgggcataggtcttcatttctctggctgctctgtgtaaagcaacctaaaggtacccagaatgctgcagtagtaatagaagtgggaggagtaggagatggagaaaattcaggtggacaaaaagcagcaagtgataaagacaagaaactcctggatgtgggagacacttacttgtgggagaagactgttcctcacctcttccactgctgcctgcacacctgcgttgtccagaccttttcacttgatgtgaactggatccctagtcttcaaggtgactgcccagcacctggaagggcccatgggttagttgcttcagatgcacccattcttgtcccttcgttcatatgccatacaaatattagctttttctctttgtgtcaatacataaatggtgtcggggtaatatatttctctgactgattcatttattgaagcaactaaatgtattcgtctttattcagtgctgtgtactgaggactgtgtgtgttgcaaaagctcttgggtttctctttagatcacagttaggatttaattgccacaggatcatttctccccaggttaggtttgatccttctattttagttattttgcgtatgcataacttttcatttccaaactcatgttatttgcaattttacatttgtttacatgcatacatactaataattactctacaaatagactgccacttccaccaaaacagatggtattagtttttgattatcattaaatatctagcatagaacaatgatacttatatgttaaatgaataaaggatatgcatcttaaaacttttctgtagtcatagaatacaattatttgtagaaaaacatgattttaacaatagtcatattttataagtagtccatatcacttagatatgaatattttgctctttaatacattggtaataacctgatatagtttatactgaaactaatgtttactcaaaatgtgtgcatttttctttagagttgcaattatttttgtaacattttattctgttgttggttatcacataagtactt

SEQ ID NO: 476263 - DNA, 1170 bp, Homo sapiens
ctcacactacctgcttaagagtgagacttaatcagaaagtcagagaatatcaacagtcttcccctacaaccatgctaaataaggataagatgttcaaatgcgtccggagtttcttccttctggtgggtttgtagcctcactgacttcaggagtgaagctgcagaccttcaaggtgagtgttacagctcttaaaggtggtgtgtgtggagttgttcattccttcatggtctcgctggcctcaggagtgaagctgcagaccttcgtgctagacagaaaagttctccaagtccccacccaacccagaagcccagctggcttcacctctcaatggcactcaccatgggactttgcagcacctagcctgagcactccagcagcccaaagggaactcattccccgatcaagcccagcaggcaccagccagctgcaccgagtgtggggcccaccgagtgtggggtccaccgagcccacacccacccggatcctgcaccagcccatgagcgccacacacagccccagctcctgcccgcacctctccctccacatctccctacaagcagagggagccggctccagcctcagccagctccagagaggggcccccacagtgcagcagcgggctgaagggctccttgagcgtggccagagtggatgccaaggccaaggaggctccgagagcaagcaagggctgctagcacgttgtcacccctcaatcccccctctatacaggacaccccaactgctctttggaatttggctgatgaccactctagctacttcctgctggatagaggcgaagaaggggccctgcagttgtagtgtcctccagagcggaactctttaggccaggggaactctttagtcctctcaaaaagtggtctggtgcaattaccaagtaaaacacaagacagccccttgtggaaatttagcaagacaaagatgccaaggactcaatagtaaataaaacataaaagcccttgctctcttaaagctttcattctaataaggataaactaaatttaagcaaaatatacataacgagccaagtgctatggtggaaaataaagggtgattgaaggaaagtgggtgacagcttggagatatactgctattttaagtcaggcagtcaggaagagtctttttgatgaggtgacaattgagcagagactt

SEQ ID NO: 476264 - DNA, 1198 bp, Homo sapiens
gaaggggtccagcggattctccggtctcatcgcctctttaccttgcttcttgcctccaagcctgtgatcgggggggctgctgtgaagatctctgatatgctctggagacattttccccattgtcctggtcctggacagctctgcccctgtggctctgcagggtacagccaccgtgcgggctttcactggctggtgttgaatgcctgcagcttttccaggtgcacggtgcaagctgttgatgttctaccattctggagtccagaggacggtggtcctttttccacagctccattaagcagtgccctaaatgattgggtgggccagcagcagctatgctacagccctgctactggggagggcagggttgctttcaatgctagtagcagtaggcaagtggccaaggagagtacacttttgcaccagatggcagctgtgggcaggatagcctgtcctgagggcactcataaatgggtggcaactcactttggccctggtggcagctgccagtcatggcagtggctctgggtggaggatgtcaatgggctccaggaatgtggagatacaagagttgtgggactccaggggtggatggagtctgtttactgctatgaaagagcttctggccatgctgcagagtgtgggaaaataggcaaagcccatggaaaccctgagcagaggagaagcagtggagtcaatgctaagaggtgcctggagctcacacggaaagtactagaaattaggaagctgaacagaggaaactctggccatgaaaaagtcaaagatcgtccatacaggaatcagtcatactggcatcaggcttctcatccccaatactaaaatcttgtggcaaaatagaaataccctcaaaacgctggtgacaaataaaaacagtaacaaataaagggcaaaaacaaaaaaacttagaaaaactaaatacgtgaacagtgtgcatgtaaacaataaagtataatttagagaaaatcaaattaaatgttaataaaataattacattcaaagtttaactcagcaatcactggtcttttttttttcctgctaaatccatagctttatcttttccagaatgtcatatggttggaatgatatagtaggtagcttttttggattggcattggctttgtttttacttagtaatatgcaattaagttttctccatgtctttatatggctagatggctaa

SEQ ID NO: 476265 - DNA, 1434 bp, Homo sapiens
ggcgagggtccgcggcttcattcatgagatcaggggtacatatgcggaatgtgcaggtttgttacatagaagaagaagaagaagaagaagaaggagaaggagaaggagaaggagaaggagaagaagaagaagaagaagaagaagaagaagaagaagaagaagaagaagaagaagaagaagaagaagaagaagaagaagaagaagaagaagaagaagaagaggaagaagaagaagaagaagaagaagaagaagaagaagaagaggaggaggaggaggaggaggaggaggaggagggggagaaggagaaggaaaagaaggagaagaaggagaaggaggagaaggaggagaaggagaagaaggagaagaaggagaaggagaagaggaagaagaggaagaaagaagaagaagaaagaagaagaaggaggagaaggaggagaaggaggagaaggagaagaaggagaagaaggagaaggagaggaagaggaagaggaagaagaggaagaagaggaagaagaagaaagaagaagaagaaagaagaacaaggaggagaaggaggagaaggaggagaacgagaagaaggagaagaaggagaaggagaggaagaggaagaggaagaagaggaagaagaggaagaagaagaaagaagaagaagaagaacaagaagaagaagaagaagaagaaagaagaagaggaagaagaggaagaagaaggaagaagaagaagtagaaagaagtaggagaagaagaagcagaagacgtagaagacgcagaagacagaagaagaagaagaagaagaagaagaagaagacgaagaagaagaagaagaagaagaagaagaagaagaagaagaagaagaggaagaaaaaatcttcctgggtcacagagttggcatatgattggctacagtaggtcatgccagtgttccaaaatgattgcttaaatttacattctctctgaaatgttcattttccagttgttgaacatgctcactagcacatggtattggccaacgtttatagcttttagctaaactgagtaggtacatgtgcacaatgtgcagcaaagtatgtgtattatacacctatgaattggtcccacagttttggaatgtttgattcccttttttaaactatattttattctttactttttaatttgggaagagtatattgatttattttagcttctatagacctttaaactcacagtttaatttcttcgctgtattctgcctactgattagcctaagacagttgttatttatattgcaatgttttctattatttacttttgattcttagcatttccttctctattcttgaaacatgttaattttttctcttataattattaacattttaaccatagttactttaaatttattatctgataactccaaaatatgaatcttatctgaatctggttgtaattctca

SEQ ID NO: 476266 - DNA, 614 bp, Homo sapiens
cgtggcacaggggtttgtggtacatattatttcatcacccaggtgcagtctcagagttgtgcaccttctcccaatcctgcagtcgagccagctgctgatgtctacattggctgctgagatatatatgctgtctgtgtgggcacatgcgtactgtctgtgggggcgtgcactcacaggtgggtgcccagaaagcattcattgctggtgagcatggggcactgactatggggctgcatagggttccagctgtgggtgctggcagtagaagtttgcatgggccagctgttgaggtccacagtttggctgcttggctgatggttcttggtcagcctggctggttgacagggttagcagacaggttgttgaaagccaggcaccaggtgttgttagctcccacaaattcattgcacccaggtgatctagctatgccagtttcctcagtgttcttgagctataatagtccctgcatggcccaggattccatttcttggaatccgtgggccaagaaccccagatcagagaacacgagccttgccaccatcttggaagcggcccatcaccatcttgggagctctgagatcaaggaccccctggtaacactagtgtagtttcta

SEQ ID NO: 476267 - DNA, 767 bp, Homo sapiens
tgcctttctaaagggtctgggaaccacctctttgaaatgtaaacattaaggaagatggtgcctgataacgtggaattcagtccatggggtcagaggagagtgcagccgctgggcggccctactccaggggaagaccaccttctctctccatcccgctactggcctgcccatccatctcaccgacagcttcttccgccactccatgaaaccttgcacccatcctccaagtccatgtgtagagcttggaacagtttggagagctcagaagaagataggaagatatgtgaaagtgtggaacttcctagagacttgttgaatggttttgatgaaaatgctgatagtcatatggacaatgaagtccaggctgaggtggtctcagatggagatgaagaacttcttgggaactggagcaaaggtgactgttgctgtgctttagcaaagagactggtggcattttactcctgttctagagatctgtggaactttcaacttgtgagaaatgatttagggtatctggagaaagaaatttctaagcagcaaagcattcaagaggtgatagattacaaaagtttggaaaatttgcagcctgaccacggaatagaaaataaaaattcattttctgtggagaaattcaagccggttgcagaaatttaaataaataatgaggaaccaaatgttaatcgccaagacaatggagaaaatgtttccagggcatatcagaaacctttactgcagcccttcccatcacaagcctagaggcttaggac

SEQ ID NO: 476268 - DNA, 986 bp, Homo sapiens
ggcaccgccggaaagtggacagctgcagcactacagctcgtttctaggacatccctgaaggacaatggtgaagggaagtcttcccatgatgaaaactgtgaagatgtttgtatcccacgtgagtgcttaccaacgggtcacctcagcagaggagtttaataatcaagtggataggatgacctgctctgtggacaacactcagcctcttttcccagtcatccctgtcatcacccaatggactcagcaacatggacttccactcaccaagagtgacctggctccagccactgctaaaaaagtgcgacagtgggctcatgatcatgaaattcactggtcttacgatgtttcccatcatcctaaagcagctggattgacagaatggtggaatggctttttgaagccacaattacaatgccaactaggtgacaatactttgcaggactcaggcaaagttctccagaaggctgtgtatgctctgaatcagcatccaatatatggtattgtatctcctatagctaggattcacaggtccaggaatcaaggggtggaaggggaagtttcactactcaccaacatccctagtgatccactggcaaaatctttgcttcctgttcctgtgacgttacattcagctggcctagaggtcttagtttcagagggacgaatgctgccagcaggagacacaacaattactccattaaactggaagttaagattgacacctggacactttgggtttctcctacctcgaagtcaacaggctaacaagggagttacagaattggctggagtgactgacctggagcatcaaggtgaaatcagtctagtactccacaatagagtaactggagctcaatgtgagggtaatataatatgcaaatctgagcaaatttgctgaattcatgagttactcatataaggcttctcaagccgtgatgaataaatcaaggattggtccaagaatacaattttctaacaattatttc

SEQ ID NO: 476269 - DNA, 1469 bp, Homo sapiens
aggagtgcgtcccagccccgcgcctgccaggccgtctgtttcgtcccatcccatcctgccgcagcgcgcgccagccatgagctccacgcagttcaacaaggacccctcgtacgggctgtcagccgagatcaagaaccggctcctgtgcaaatatgacccccagaaggaggtagagctccgcagctggatcgagggactcaccagcctctccatcggccccgacttccagaagggcctgaaggacgggattagtttatggacactcatgaacaagctacagccgggctcagtcctcaagatcaaccgttccatgcagaactggcaccaactagaaaacctctccaatttcatcaaggccatggtcagctacggcatgaacaccgtggacctgttcgatgccaacgacctgtttgagagtgggaacatgacgcagctgcaggtgtctcttctcgccctggtgagtaaggccaggactaaggggctgcagagcggggtggacatcggccttaagtactcggagaagcaggagccgaacttcgacgacgccaccatgaaggctggccagtgcaccatcgggctgcagatgggcaccaacaaatgcaccagccagtcgggcatgaccgcgtacagcacaaggaggcatctctacgaccccaagaaccacatcctgccccccatggacaacttaaccatcagcctccagatgggtacaaacaagtgtgccagccagatgggctacacgcagggcgccaagcaaagcggccaggtctttggcctgggccggcagatacatgaccccaagttctgcccagaaggcacagtggccgacagggctccctcgggcgcgcaggctcgggggaggtccctgaatatcccccttactaccaggaggaggctggctactgaggctcccagcacgctctctccccatatcatctccccgtctgagtttctgggtttttctgtgttttcatctttttttttcttaacctgttcagtgctgccaatcaacccagggtctgacaatgcaggaaagagtggaatcattgatgattttgagtttaagcaactgctgtataacgaggtgatttgttgtgtaaagggtggaccataaagagggagttttgctgttaagggaagcagagaaattcggtgataactgaaggtagaagtggggtcaagtaaggatttttttaaaatttgagtaagatcttaataggaatgattactaaagagaataaagggaagatgtacaatcagaggtatcttaagaaggcctagtgaatgggagtcctttaagtgttttatgtgcaaagtgctatagccaatgaggcatttttaaaaaactggaaatctgggggaaagatggtcactcttgatagaaatggggctgagaagggaaatcattttagaaataatggtaaatgtattttggacatattgagttcaggaaaatatttaagcaaaga

SEQ ID NO: 476270 - DNA, 574 bp, Homo sapiens
agttcctcttattatgatgccccggtattttctagctacctctctcttctccccgaatccctgcaaagaaagttctaaggaaggaacttgtggaccccacaactgcattctggagcagaggtttcctagagctgacagttgtgaggacagcttcatgggacataatgatgggtgctgtggtgagccccacccagacggaccggagtcggttcattctcctttaacctcatcatggtcagatcctattcaatggccatcaggactgccattgcctgagcaattggtcttgagaaaagaacttcagctccctggacttcgtttcctcctcaataaaatgccatcactacccagttcagaggctctgacaacagcatccacagcagatacttccccaaagttcctgaaggagaagctctttctttgcaggtgtttcagattctctctctctctgtggtgaagcccaaggttttgcgcaccctcccctctggactcgaagtatatcgctatcttctgctgacactgaacatctcttcaaaaggatcaatgggcaaagtaattgttcagaataaagacc

SEQ ID NO: 476271 - DNA, 674 bp, Homo sapiens
tgatttccttcctgagagagctgacacagggaaacaggatggtatcgtcagcttcacggtttactgcgtctgagcttccagccatgcttctatctctcctctgcacgatggtctgccccggggtcctcatagagagggacaccaggagaggaaagggtaggagcaggaaaggtcctaccttgactggcagcagtgtgacccagcactggtttcctaccagtggaacaagtttaaagctgatatttctctgggagtgtatttgtgggtccatggaggccccgcctggaagaaatacctgcatttcccctgatgcagagaatgcgttttgctctgttcagtgtcatctccactctggggctttgggggaacctactcctgtcagggtcacagcccactccaggcaaggctcttgggcaggcctgctctctctccacctctggcctgtggaaaaagcactcaagcatccttagttccccaaacctccattccttatgtaattgtccagttacagactcttgattttagaattttctagtcatgcatccagcagcagcctcttgtccccacaaaatcccatgggcacaggtccacctctctggggggtgtactcaagcccatttcagttggcttgaggtgaaaggaaaatacctccaaaggggaggagggaaactgcc

SEQ ID NO: 476272 - DNA, 940 bp, Homo sapiens
gaaaaagaagaacaaggaaccggaaggttatgccatatttcagttcgactgtggcaccctcgccataagcatctgctgtgagagctgattgtccacagtgggcctgataaagtgacagtggaatatccataagaatggtccaggaggctgttcaagctaaggaatcagaacctgcagccatttctggggatcatacagtccttgaagggaatatagcactaccagacatatgtcactacccagtgacggacaagtggcagaataaagaaaatgaaggagatgctcagttggaggaggtcaagagatacatctgccctctggatcctggagactgcaatgctaagcgcttcttaaaatgtctaacagtaacaagcaaaagccaattcaaagatagatctttggggcaccctctggtggctgaaaagagtcatgaaatcagtgcccatgtgtatcaaaaggccaggccatcaccaacttttccatacaacattgaaaatgtagccagatcaggaatgtgggaaggactgaaaagaatttggaaccacaagaactggacttgagtcagagctctcatctattagctatgtgaacctgcatttggttggcaggtcagtttccacagagctgacgccgaatctggaatttctcactggagataagaggcagtgtcaaaactagaggagtatatgattccatttatctgatatgcccagaaaaggggcatttctgacggagtaagactattaaagcagccaactagatgcaattccatcaaaatgaccattttgaaatgtaaaaccaatgttttatttattacttttctcagtaacaggtaactcagtgtggtttgagaactagatgagattaagaagtgcactgatgagagaatgtctattttttacactgtttactaacagaaaatgtgaaagtgaggatttat

SEQ ID NO: 476273 - DNA, 1899 bp, Homo sapiens
ggtatctcagagactaaagaaatgaataggttagcacaaattctcttcccttcaagacatgttttatttatttgtctttgctacaggttacagaatcagagtgtgcaccaatcccaaccacgggtattggaggtagagactactccaggatccttgagaaatggtccaggggaagaatcaaacttcagaacttcatcacagcaggaaatcaactatagcacacatatcttctctcctggaggcagccccgagggaagcccagttctagatcccccaccgcatctggagcctaatagatcaacaagtaggaaacattcagctcagcacaaaaataacagagatgacagtttagattggtttgatttcatggcaactcatcagagtgaacctaaaaacactgttgttgtgtctcctcatcccaaaacatctggagaaaatatggcttcgaagatctctaacagcacatctcagggtaaggagaagagtgagccaggccaaaggagcaaagtggacattgggttgcttccatcaccaggagagacaggtgttccatggagggcagacaatgtggaaagtaacaagaaaaaaaggctagcactagattctgaagcagcagtctctgctgataaaccagactcagtactgactcatcatgtccccaggaacctgcagaagctgtgcaaagagagggcccagaagttgtgcagaaatagcaccagggtgcctgcacagtgcacagtcccttcccatcctcagtccactcctgtacatagcccagacagaaggctggactcacccaaaagaaagagaccgaaatcccttgcgcaagtggaagagcctgcaattgaaaatgttaagcctccaggttcccctgtggccaaactggcaaaatttactttcaagcagaagtcaaaactgatccactcctttgaagatcacagccatgtgtcacctggtgcaactaaaatagcagttcatagtcctaaaatttcccagcgtagaacaagaagagacgcagccttgccggtgaagcgtccaggaaagttaacatctaccccaggaaaccagatctccagtcagccacagggtgagacaaaggaggtgtcgcagcagccaccagagaaacacggaccaagagagaaggtgatgtgtgcccctgagaagaggattattcagcctgaattagagcttgggaacgagactgggtgtgctcatcttacttgtgagggagacaaaaaggaagaggtttcaggcagtaataaaagcggcaaggttcatgcctgcacattagccagattggcaaacttctgctttactcccccatcggaatccaaatcaaaatcccctcctcctgaaaggaagaaccgagctgtgggctgccctggggaagggggcatggctttgggctgggactgtctgcagctgaaggcagtctctggagggggcttcagctgtgagctgtcagctgccaacactctcagcagctggaaaaagtgggctcatcaatcttcaactggaaatgtgggcagtgcacctcagcatctactcccgtctgtctcaggccaagactgggtagatagagcatcttccggggtagctggcagcattttggcacatgatgctggaagaggatgtggccggagctgccaggcactgaatccaggcagccctttcctgatgtgtactaagctacagcacctgtgtcgagatgagagtgagccaaagggcactggttggtaggatgaggtggaggagtattttaatttttggaatttgggaagcagacagctttactttgtaaggttggaacagcagcaacatccattacatataaaccaaaaatctttactatttctaaatttcctagattgctattatttggtcctaagttgagtattc

SEQ ID NO: 476274 - DNA, 721 bp, Homo sapiens
tctttttttttttcctagcagctgccactcggctggatattgcctaagattacgagttcccgaagtggggggaagtgtggccatcattactgcggctgcctgctgctaaagatgactgagctcttgtgggtgaagggtggctgtcatcactgcagctccagcccgctattttcccctgtgggcgactggacggatttgacccaggaggaatttcccacagtgcagcatagcggctgtggcagatcctactccagccaggaatttagggacagaccactgatatccttgggactgagcccctggaggcagaggtggccgcagtcaccgcagatcagcagacttagtctccccctgctggctctgaggaatccaggcaggccggaggagtgggattttccaccagtgcaacgcaccgcctctgccaaggtgcagccacagtgcttcattaagcaggtcctggatcctgtacctcctgactgggtgagacccctcccaacaggggttgccagacaccttacacaggagagttcccgctggcatcaggtcggtgcctctccgggacagagatcccagaggaaggagcaggcagccatgtttgctgttctgcagcctccactggtgacatctccaggtgcaggagggtcccaggtgactaagttctgtagtgaatccccagcaaacttcagcagccctatggaagaggggcctgagttttaaaaga

SEQ ID NO: 476275 - DNA, 900 bp, Homo sapiens
caggcctgcatctgaaggtgccagtctggagcctggggttgtgggggccagtctggaaccaggtttcaaagggtaaagaagaggaaaaaggcatacctaaaaacaaggtaaaagcatacgaagccaataagaaatggcaaaccttggcctattcagaaagaaactagtattctggtgggtccaaacatgtcctgctaaagaacttagaatttatgctgatgatggggctgtgggtctaagaccagcagctgacactacagcttatctcaaatacacatgggatctccagcagaggttagaacttgtgtatgtttgcgctgtgcgttctggtgggttcgtggtctcgctggcctcaggagtgaagctgcagacattcccagtggatgttacagctcataaacgcagtgcaggcccaaagagtgagcagcagcaagatttattgcaaagagcaaaagaacagagcttccacagtgtagaagacctgaccaggttgccactgctggctcgggcagcctgcttttattcccttatctggccccacccacatcctgctcattggtccattttacagagagccgattgattggattaatttgaaagccttatcattgagctctgaagtcttttcttctacttaacttcaacttgattctattgctgagactttccagtgcattttgcaattctctaagtgtgtacttgatttccagaagttgtcattgtttttattgatggtatctatttcactggagatttttccattcatatcctgtgtcatttctttgatttctttaagttggacttcacctttctctggtacctccttgattggcttaataattgaccttctaaattctttttctggcaattcagagatttttttcttcgtttggatccatc

SEQ ID NO: 476276 - DNA, 525 bp, Homo sapiens
tctaagtctttttgtagtttctatgcacgacagtctgctggagtttgccgaaggtccactccagacctcgtttgcctgggtatcaccgcagaaactgcaaaacagcaaagactgctgcctcttccttcctctggaagctttgtcccagaggggcacccaccagataccagctgaagctctcctgtatgaggtgagagctcgagtgctgtgcttggagagccgctgctctcttcagagcctgcaggcaggaacgtttaagtctgccgaagctgtgcccacagagataccctgcccagagaggaggaatctagagaggcagtctggctacagtggttctgtggagctgtggtgggctccacccagtctgaacttcctggaggctttgtttatattgttaattgttttaaccagaatacccaattttaggtcagaaaaaatggtcgaacaatagattttaaaacagtgtagctctattttaatcaatagcttattgcaactgcctgactggagacctaggtcatattt

SEQ ID NO: 476277 - DNA, 677 bp, Homo sapiens
tggatgagtgtgcaggtaggtgtatatgaatatactttatgtcagtagttcctgtgtaagacaagatgtgagtgataggcactcattggagatttggtatatggtgctacaaccatttgagatagagaatacagaaaaaggagctggctggggaggaaaatttattattttagtattatatttattggacttgatgtgcttgacttgcgttctcaggttaagatgtgtagtaggcagttgcaggtattggctgggaactcagaagtggcttgtgagaagcagatgcagatctgggagtgaaggcctgacctacagcagcaaaagcccttatggaaagattgctgcgagtgagctgctgaaatgtcactctagcctcactccctgcttcatcgctgtccagttatttcccaaatggctttctttggtggttggtttcagattgaatattcaggcccaatagacaaagtggaaacctaaaatttgtgattgaaatgcattgttggaattttagcctgaagatgtcacagttttcatttttaaaatatgcataacatagaaaggatcatagagaggatgaacattaacaacctgccattccagtttaactcttatcaaaggataatagaggatgacacattaaaactcttctcacttaactgggcagcagcagtgcactg

SEQ ID NO: 476278 - DNA, 513 bp, Homo sapiens
ttaagattctgattattaatctcaactatacgaacctctatgattgggactggacatgcctggccatccttaatatgaggagaagagaacgcggaaccccagttttgccattgatagccatctgtgaccctgggaaggagggcaatgctgatggcagagggaggcttggaaaggacatgggtcttcctctgaagagagtagtggatttcccagcacagtgctcgagctctggtaagagtcagactgcctcctcaagtgggtccctgaccctcgtttatcctgattgggagatatctcccagtaggggccaacagacacctcatacaggagagctctggctggcatccagtgggtgcccctctgggacgaagcttccagaggaaagaacaggcagcaatctttgctgttctgcagcctccactcgtgacaccaaggcaaacagcatctggagtggacctccagcaaactccagcagacctgcagcagagggcactaactcttagaaggaaaact

SEQ ID NO: 476279 - DNA, 484 bp, Homo sapiens
aaaccatccctgcatccctggcatgaaacccactgaatcatggtggattatctttcggatatgctgttggattcgacactggacagcaggaagtagagggcagcaattcttgagagatgagaaacaaactagatatcctacaataatccaacttaatgcctggagagttttcaggccaccttgtggaggaacccaggcaagttctgatagttttccagagtcaaacagatacagctgggagctcaaggataccaagaagaaatgcatcattaggcaatttcatcattttgcaaacatcatagaatgcactaatgcaaacctagatactatagcctactacacaccgaggctacatagcatgttgctcctaggctacaaatctgtacagcatgttactgtaccaaatactgtagacaagtgtaacacaatgggaagtatttgtgtacctaaacataactaaacatagaaaagatcttccctgcct

SEQ ID NO: 476280 - DNA, 1289 bp, Homo sapiens
accatctcctttttatagatgaggaaactgaggtgcagaaatattaggtaatttgcccataatgctagtggttgccttggacaacccattcaaggaagatcacttagtccaacttaatgaaatctatatcttttgtatactgacggaaacactggcagcacatattgaggccatgtttttggatcacaacaatgcaagtttgagtagatgtgataagagtgagaactctgaccaaatcttcacagatggctccagtagagctgctggtgacccaccttgctttcagggactgggaagtccaagatcaaggtgcttgctgatcctgggtctagtgaggggccacttcctggtttacagagggcctgtcttcttgtatcctcataaggcagagagcagagatagaagctcttatcaaccataccaccctaaatgcagccgatttcttctgatctcagaagctaagcagggtctctgggaagtaggtgtggcatggacaatggcaggacaaccctctggttcccatgtggtccatggtggtgttggcagtggctgtgatggactgagcatttgtactcttttgtcttgtgttggtatcagtgtgatagtggccctttgtgctgccttgtcaggtcctagggttctatcgactataatttccagaaaagcagagttttggtatcctgcttactgtgccaaaactgtgacggccaaaggaaaacttccccttcgtcctctgaaggagataagagcagccccagctgacagccagcaagcaaacgagaacctcagtcttacaaccacaaatacagttcaccctcgaataacacagcttgaactggccaatgaggaagaggacatagaagcagtagtgccagaaagcaaattgacattagaaaatccatcagaagggttctgattattcaggactgcttttgacttcttttatgacatggacctttctatgatatgggcactgaaacgaaagcaagctgtagaaggattggtactacatagaaactcagagaaataaggcaaaaaattcagacagaaattaccatgtattccccctactcaacatgatgatgatgaggatgaagacctttatgacagtccattctcacttaattaatagtaaatatattttctcttccttataattttcttaatatcattttcttttctttagcttaccttattttaagaaaactgtatataatacatataatatacaaattccatattaatcagctatctatgttatcagtaaggctttcagtcaagagtagtct

SEQ ID NO: 476281 - DNA, 706 bp, Homo sapiens
aagcagagggtccagacaggaaactgccacagtagtccaggtgggaggagaatataccatgacaaaaagctagttatgactcaaaacaggattaaaagtttgaccaactactggcaaggaagaaacgtggagaggatggacatccttttacagatgggactattggcagccttcccaaggtgtagcctggaagatggtcaatttcagggagaagcttttcatccaacacagcccctgagcagtggatatcagggaataaagccaggttctatgtggatgagcctgagaggagcctcagtgtcctctgcatccccgggaggtgtgggggagcatcagaaagagagggttgtgggcaggggtgctgtgatagaaatctgcatgaatgggaaagacccagagcagggaatactcatgagtagaggccacagtgagacctgcaacctcagcagtgccacgcaattggtagaaatttgttacagcagccttaggaaacaaataagctaagtttttggctatttgaataaagctgttctaatattcatgcagacatttgtgtgggcataaaagtcctttgttgaaacctatatcgcaaatgtattctttaatcccgtaactagactttttattttttattcatgtattttcaagagaaaaatttctaaatcttggtgaggcccaacttatcaatatttattttgtgttttcc

SEQ ID NO: 476282 - DNA, 576 bp, Homo sapiens
accacaggtagcagtagggaaatgggctcccctgtggccccgggcaggtccaaaaatgccatccacgagccaaggtctggagcaccagaagcttgcttgcagaaggggtctctccacatagttgtcacagctggaaatgatgtgctgggccatacctggagacagcacagctctgagcctcacccacagcctgtggactgggtccttcccttcaaggcagcagattcttccctggcccagagtgtgtttagagatgtcatctgggagataggtcctggaatgggagcctcaggactctgcctgctgccttcttctactgtgtctgagctggtatccaagtttcaagacaaagtcctcttcactctcctctctcctcttctcaagcagagggaagcagtctctcctagagttgtgatggtggtagaaggggagttaagtcagggcaggaagtttgaataagacaggatataaaggtgaggggttaggaggaggaggagttggagatggaagggagaagacctccatagtctttttaaattcagaaatagtgtcagatatccttttgtttacctcctg

SEQ ID NO: 476283 - DNA, 1298 bp, Homo sapiens
ttgtgatcgattgagcaagcagcggaggcttgttgaatggctttgacccaaatgctgacagtgacatggataataaagtccaggctgaggtggtctcaaatggagatgaggagtttgttgggagctggacatgtggcattttgcccctgccctagagatctgtggaactatgaacttgggaaacacgatttagggtatctggtagaagaaatttctaagtggcaaagtgttcaagaggaagctgagcctgaaagttcgaaacgtttgcagcccgacaatgcagtagaaaagaaaaacccattttctggggagaaattcaagctggctgcagaaatttgcataagtaacgagaagccaaatgctaatgacccagacaagtcctggtccaggtccagggcccctctgctgtgtgcaacctctggacttggtgctccatgtcccagccattccagcccatggctaaaaggggccaagggcagtgtgaaagggaaatgtggggttggagcccccatacagagttcccactgggcactgcctggtggatatgtgagaagagggccattgtcctccagaccacagaatggtagatccactgacagcttgcaccaggcatctggaaaagctgcagatactcaacaccagtccatgaaagcagccaggagcaggcctgtaccctgcaaagccacagaggcggagctgcccaaggccatgggagccaacctcttgcatcagtatggcctggatatgaaacatggagagtcagccatgcctggccttctccttggtacttatccaaataagttgaaaacctatatctacacaaaacctgcacattgatatttatagcagttttatttataattgctaaaacttggaagccaccaagttgtccttcagtaggtgaacagataaattctgtggtacatcagcaatggaatgtggtacatccagcaatgggatattattcagcactaaaaagaaatgaggtatgaaatcatgaaaagacatggacaagcttaaatgcatattagtaagtgacataaggcaataagaaaaggctacatactgtgtgattccaactgtgtaacattctggaaaaggtaaaactatggagacagtaaaagtagcagtggtcgtaaggattaagataatgtaaagcattttgtaaactgaaaagtaaatgaaataccatccccatagtgttttgggcttaagagtctgaggctggataactctttctgtattttcctgtgcttcataaaattttggggtggaaggttaaatggtatttaagaaat

SEQ ID NO: 476284 - DNA, 708 bp, Homo sapiens
tatcatgacccaagagtcacacagatctgtgggagaaacatggggcggctgctgggcagaggcgctcctcacatcccagatggggcggcggggcagaggcgctccccacatctcagacgatgggcggccgggcagagaccctcctcacttcctagacaggatggcggccggaaagaggcccttttggcattggtttttccttatcttcgtggtcttatctacctatggtctttgatgttggtaaccttcggatggggtttctgtgtgcacatcctttttgttggtattgatgctactccttcctatctgttacttttccttcaaaaagtcaggctcctctgctgcaggagtttcctggaggtccactccagaccctgtttgcctgggtatcaccagcagaggctgcagaacagcaaagattgctgcctgtaccttcctctggaagctttgtccctgaggggcacttgccagatgccagccagagctctcctgtatgaggtgtctctcgacccctgctgggaggtgtttcccagtcaggaggcatggcagcgagaattttaagccagtggatcttagcttgctgggctctttgggggtggggtccactgaactagaccacttggctccctggctttagccctctttccaggggaatttaattgactggctgtggtaagaaaagatgtttatcagtggggtgagggggcc

SEQ ID NO: 476285 - DNA, 1097 bp, Homo sapiens
aaaactggaagcgttccctttgaaaacgggcacaagacagggatgacctctctcaccactcctattcatattcctggcctggaagttctggccagggcaatcaggcaggagaaggaaataaagggtattcaattaggaaaagaggaagtcaaattgtccctgtttgcagatgacatgattgtatatctagaaaaccccattgtctcagtccaaaatctccttaatctgataggcaacttcagcaaagtctcaggatacaaaatcaatgtgcaaaaatcacaagcattcctatacaccaataacagacaaacagacagccaaatcatgagtgaactcccattcacagttgcttcaaagagaataaaatacctaggaatccaacttacaagggatgtgaaggacctcttcaaggagaactacaaaccactgctcaatgaaataaaagaggagacaacaaatggaagaacattccatgctcatgggtaggaagaatcaatattgtaaaaatgtccatactgcccaaggtaatttatagattcaatgccatccccatcaagctaccaatgactttcttcacacaattggaaaaagctactttaaagttcatatggaagtaaaaaagagcccacattgccaagtcaatcctaagccaaaagaacaaagctggaggcatcacgctacctgacttcaaactatactacaaggctacagtaaccaaaacagcatggtactgataaccaaaacagagatataaaccaatggaacagaacagagccctgagaaataatgccacatatctacaactatctgatctttgacaaacctgacaaaaacaagaaatgagagtcttaagatttttcttttgatctattgacagcttttcacaatttagtacaattgaagaaactggttattttaccaaggctttgactggaatggtgggctttcctttgaagattcaaacttgacttattgggccaataaagcccttggaaaaactggcctacatattttgcgtacagggtccctgtacttactacaggtcagtccctatacagggtttctgacctgtgattgaattcccttcagcatttctt

SEQ ID NO: 476286 - DNA, 483 bp, Homo sapiens
acagcatcatagcgcctctccccacctcccaacaggccccggagtgtgatgttcccctccctgtgtccatgtgttttcattgttcagctcccacttatgagaagttcattttgccaagatttaggatgtgcccatgacacagactcaggaggtcctgaagacatgtgcccaagttggttggggcacagcttggttttacacattttagggagacatgagacatcaatcaatacatgtagatgtacattggttcagtctggaaaggagataaagaaaaagattaaaagaatgatacggggaaagcatatggccactggtcatttgcagcagcacaagcaattccagatagttgttcagcaatttggggaggatcatcagttacctctggtgcatgactgtgaagcttttttctcaataacgtgcacaggtgcagtctatgctaaacagattagtcagtgcctggtgactctgacataggccaaa

SEQ ID NO: 476287 - DNA, 696 bp, Homo sapiens
tgcctaaaaccatttggtagtaaacaccatctgtaaacaactcaccatgttgaaacatgacttgagagtaggtgatattgcccagggagagtcagagggaaaagagaaaaggttgcagaacataccacaagaaagccccatacataaggtgtggataaaggaagaaccacaaaatagaagtgaagagcacatcaccagaaaggagataaatttccaggactcctttcatggctgcaaatctgtttatttcaccctgacaatggatgattttggctctacactgtattatatgggtctcctctactactcctccacaccaagatggtgtcaaggtgcagaaagaagcttgggtaccctttcagcattggtgcagcttggtggggagacatctgatgttcctctgttcctggtgctggcatttgagtccctgctggcctctatggaaatgtcactcagcctgcctgaacacagggcatcctgagtcatggctgtttaagactggctttttggaatgccttatttagaatagcaatcaaagcaataaacacttaaattgcattttatagttacacatattcttagaagtactccatgacaaatcattgatatggttaatataatcactgagttactttaatagttacttttaatggttactttaatagttacttaaagtatttaccataattaaactgc

SEQ ID NO: 476288 - DNA, 657 bp, Homo sapiens
cagtgtgcttgagtcaccatgtttacagaatctgaaagacaaagtttgcctgctagcagtcaggcccctctgctgcaagtgtgctgaagtttgctggaggtccactccagcccctgtttgcctgtgtatcaccagcagaagctgcagaacagcaaagattgctgccggtttgttcttctcctctgctgggaggggtctcccagtcaagaggcatgggggtcagggacccacttgaggaggcagtctgtcctttagcagaactcaagcattgtgctgggagatcctctgctgtcttcagagctggcaggcaagaacgttgtagtctgctgaagctgcactcacagctgccccttcccccaggtgctctgtcccagggagatgggagttttatctataagcctctgactggggctgctgcctttctttcagagatgccctgcccagagatgaggaatctagagagttttgtccttgaaacccagggccccggtggtgtagctactggagggaatctcctggtctgcagttgtggagatcatgggaaaagcgtagtatctgggccggaatgcaccattcctcacggcacagttcctcacagcttcccttggctaagggagggagtttcctgaccccttgcacttcccaggtgaggtgaca

SEQ ID NO: 476289 - DNA, 592 bp, Homo sapiens
ctcctggggtgaactgagagttcctcttattatgatgccccggtattttctagctacctctctcttctccccgaatccctgcaaagaaagttctaaggaaggaacttgtggaccccacaactgcattctggagcagaggtttcctagagctgacagttgtgaggacagcttcatgggacataatgatgggtgctgtggtgagccccacccagacggaccggagtcggttcattctcctttaacctcatcatggtcagatcctattcaatggccatcaggactgccattgcctgagcaattggtcttgagaaaagaacttcagctccctggacttcgtttcctcctcaataaaatgccatcactacccagttcagaggctctgacaacagcatccacagcagatacttccccaaagttcctgaaggagaagctctttctttgcaggtgtttcagattctctctctctctgtggtgaagcccaaggttttgcgcaccctcccctctggactcgaagtatatcgctatcttctgctgacactgaacatctcttcaaaaggatcaatgggcaaagtaattgttcagaataaagacc

SEQ ID NO: 476290 - DNA, 801 bp, Homo sapiens
ctgcagtcacaggccaagcacatcacttccttgccagcctcagctcccctccccgcactgtgcaggctgccctctttttttctgaatggattgagccttctcacctatcatctcctctgagcagtgcttccagcctgctcaagccaatgtggagttgctccctccttcctctatgctccagtgcactccaaatctactcgtattggaggataatgattcattgttggctgcctcctcaactgggctacagaacttacagcaaagactgagtctttctcctatttgtgtctcggacgtcagaccggtgcctgccatgtgtgtgcagcaggtagctgaagggaactgctgtgatgattgtagaagaaaccgtgagggaactgctgcgtcaaggctgtggtttggacaattcaagccaaaggccagatgcagaacttggctaggacttcgaggggttcacagctccagtaagagcaggggccctgtgtacaagggaggaccaagagaacaggtctcaaaccaccagcctcaggcttcagttgcagatactggcagagtccccccaggtagccactatacagacttctgaactaatcatccttttgcttttcaatataaatttttcatatatacagatacacacataagtgtgtcctggaagcatggattggggcatctggcaggacagtggttgggggtggtcagctcttctacgctcactgaagctcatctccacattagcctgcctgaatctcttatcatgtcactgtcttcacagcatcttcagtttctcctgtggccccc

SEQ ID NO: 476291 - DNA, 1393 bp, Homo sapiens
gaaaaagaagaacaaggaaccggaaggttatgccatatttcagttcgactgtggcaccctcgccataagcatctgctgtgagagctgattgtccacagtgggcctgataaagtgacagtggaatatccataagaatggtccaggaggctgttcaagctaaggaatcagaaccattctgctcttcccatttggaaaagagctttcaggcaaatgctttgaagttccacctgcattgtaaagtaagacagggatcagcacagtcaaatggagcagaaatgccaaagagaaagaatgcgcaaatgaatcttgattatctgatttgtgtcaagtaccattcaagagacttgcaaggaggggtaaagaacatgtgcaaagatttatcagaccttggagccttcctaggagtaaaagcttggcagggggtatccgacggcccgagtcttgatcacttgccatttggaatggaagcccataataaaaatgctgccttccagagactgcagggaccttacccatgtgaccagaatgctgtgcttcctcattagcctattaattaattgcatagaatttgatgcttggacagtacttgaaggtttgctatttttggaagctctacacatcttcctttcagtgtcatctacccttttcaacagcatccatgtctaacagtaacaagcaaaagccaattcaaagatagatctttggggcaccctctggtggctgaaaagagtcatgaaatcagtgcccatgtgtatcaaaaggccagtaatctttgcgacttattttaaagggccatcaccaacttttccatacaacattgaaaatgtagccagatcaggaatgtgggaaggactgaaaagaatttggaaccacaagaactggacttgagtcagagctctcatctattagctatgtgaacctgcatttggttggcaggtcagtttccacagagctgacgccgaatctggaatttctcactggagataagaggcagtgtcaaaactagaggagtatatgattccatttatctgatatgcccagaaaaggggcatttctgacggagtaagactattaaagcagccaactagatgcaattccatcaaaatgaccattttgaaatgtaaaaccaatgttttatttattacttttctcagtaacaggtaactcagtgtggtttgagaactagatgagattaagaagtgcactgatgagagaatgtctattttttacactgtttactaacagaaaatgtgaaagtgaggatttataaaagtaccagaagaaaactcagatgaatatctctataaactaagggtagagagaaactggtaaggagtaacatctaaaccagaatctctaaaagagacaagagatggatttaatggattttttt

SEQ ID NO: 476292 - DNA, 661 bp, Homo sapiens
cacacgcattaggtatttgtcctaatgctctccctccccttgtaccccaccccccaaaaggccccagcccctcttccacaagtctgctgcagtttgctagaggtccactccagaccctgtttgcctggggtatcaccagtggagggtgcagaacagcaaagattgctgcctgctccttcctctggaagctttgtcccagaggggcaccagcctgatgccagcagagctctcctacatgaagtgtctgctgaaccctgctgggtggtctctctcagtcaggaggcacagggagatgccctgcccagtgaagaggaatctagagaaggtatctggccacagccaattcgccacactgtggtggattccacccagtccaaacctcctggcctccttagcactgtcagaggaaaaccgcctactcaagcctcagtaacgggggacactcctccccctacaagctcgatcatcccaagtcgacttcagaatggtgtgctggcagcaagaatttcaagccagtggttcttggcttgctagactccatgggagaacagagaactctttccaaaacagtaaaaactcatatgctggttgggttttttctcacttgataagattagcattagattgtgccttggaggagggtcattttaaatttgggaag

SEQ ID NO: 476293 - DNA, 643 bp, Homo sapiens
gagttcttggtgatggttccactctgctccagacaggtgctccaatctcattcaacaaaaattattcggtttaatggactcacagttccacgtggctgggaaggcctcacaatcatggtggaaggcgaaaggcatgtcttacctggtggcagccaagagagaatgagagccaagcaaaaggggtttccccttataaaaccatcagatctcatgagacttactcactaccacgagtacagtatgggggaaaccactcccatgattcaattatctctcaccgggtccctcccacaacacatgggaattatgggagctacaattcaagatgagactggggtgtggacacagccaaaccatatcaccctccctcctcctgatgcaaaacctcggtgtggttctccaagacagaaaggtgaggaaagattagagtatatttttagtttctatggcctgcctcgaggagaaaaaggagcaggtgaaaggaaggcaggacaggaaggaggaagaggaaaagaggtggagaactgaaagctgagctctttttcttaagtgaaaaaacatgttttgaaaaaggaagtattcctttttaagtgtgaatacaaccagtcatgaggcagaggtgagagagaactgcatgaactgc

SEQ ID NO: 476294 - DNA, 603 bp, Homo sapiens
ctcgctgacaccttaattttattcctgtgagaccctgaacaaggaacctagctgtgtcatgtctggacttctaacctgcgggaatttcctcatcctaataagcctgggggcgctatgggagactggggcttatttcatccctacagtttcgaccatagaagacagccgcacccaagggggccgtttcagaggcctacccttagggatgcattctctttctcagggatgttccttgctgagaaaaagaattcagcgatatttctcccatttgcttttgaaagaagagaaatatggctctgttctgcccagctcactggcggtaactgaaaccttggaaagcaaaaccacagataaggggggactgagaactatagttgtatggtatgagcttcaaagaagcatgattaggggtgtcagtggctgcagccatactggggcggtgtggacccagagaacagcaaggggactggcagccaactacactcccctctgccagagagacaggaagtaaaaccttcccctcccttctgcagctccacttagcatttaggcaaggaaaaatgtactgatacggagcaggaccccttttgaaatgggggtctt

SEQ ID NO: 476295 - DNA, 607 bp, Homo sapiens
gtcttttctctctgatttaggcttgaccaaagctaacgccagacttctatgctaaaagcaatatgagctacacactgagaatacaaattattgtaattctttcaactagatgttcaaacacagattttttgatgactaaaatctgttttttaggtgcatatattttatttttcagcgtaattttacttcttagttcaaaacagcttgaacacacttactatatggattcccctaatatgttcacctatcatggaagcctgtctatatacagtaattggaaagagagagaaattcatgcatttgccttttttgctaccctttttatttactttttaaatttcaacttaattttagatgccaggtgtatatatgcaggtttattagatgggtgtattgcaaccagatgtacagatgaatctaacattgtagcatgtttaatgcagctgaccagcgcctctcactgtgtgacattacagaaggagtgacataccctattctctctgattgtgctctaggtttaacacagctgttatttcctgctagacagatttcctatttcttaatagcacattgtgcctttctttctagaatttttaccttataatac

SEQ ID NO: 476296 - DNA, 896 bp, Homo sapiens
gcatgactataccatagtgaaatttaggggacacattcaacccatagcagtatgtataccagttgcttttgtgcctactaccaggcagttaggaagatgggcttgtattgtgggagaaggaggacaaacttggaaactatgagggctaccttggaacccacaagtgcaaactggaagcaacattgcctctcattacctccaagcatcaaatgtgatgaaatagataaatcagtggaatacgcagccactacacaagaggagtttatttctttacccattcaatctgggctgtgtggtgtaaggcctgaaagtaacatgcaattaattaagtggtttcttgatatctttgagtctcacatggacccagcaccctaccacgagttccccaatctttgccagatataccttccaccaaataggcaagcctctcatctaaacagttcctttatcagccagaccaggttcactctacctggttctcaacctaatgggcttcaccttccttctaacttacaaaattactcaaacaagccagttacattctcccatgggaaccagaagctttgctggctgatctgggccatggctgctactctttacaacaccttccttggtgtccgtgaggggcccggaccctaagccggactgacaagcagaatatctgtgtcaatattattttgcccaaatataggctaatgtaagtgctctgagcacatttaagctagactaggctaagctataaagttcagtaggttaggtatattaaattcatttttgacttatgatattttccatttacagtgagttgatgaggacataatgataagtcaaggagcatctgcagttggagaaatgttatcctgtatttgaaagaatagaatgtatgcttggaaaat

SEQ ID NO: 476297 - DNA, 3052 bp, Homo sapiens
cttccaacactgtgttgaataggagtggtgggtttttggtgtggatgtcctttctgtttgttagttttccttctaacagacaagaccctcagttgcaggtctgttggagtttgctagaggtccactccagaccctgtttgcctgggtatcaacagcggtggctgcagaagagtggtggctgtagaacagcggatattggtgaactgcaaatgctgctgcctgatcgttcctctggaagttttgtctcagaggagtacctggctgtatctccagctgcctgctgggagaaccactactctcttcaaagctgtcagacagggacatttaagtctgcagaggttactgctgtctttttttgtttgtctgtgccctgccccaagaggtggagcctacagaggcaggaaggcctccttgagctgtggtgggctccacccagtttgagcttcccggctgctttgtttacctaatcaagcctgggcgatgcattattcatataacattgacacaagataatttttaattcatttctacggatttcatcacaccttatctcatgaatgaatcatttttaatgtaccaatttccaaatcgttggctatttttccttcaatgttgtgttacatgaaatgtggtaatgaacatcaccatccatcaattttttgtgctagattatttctttagacatatttttataggtaaaactacagggccaaaaactttaaatgctttgaacttcttgaaacacaatacaaatttaatttatataaaattatatattcatattgtaagggttaatatctgagatgtatcacttcatattttctacaactttgattattacaatttttaaaacttctaaaatacttcactgatcttttcaataatattttgtcaactactagtgacatttcacatgctttctggtgttgctggtgatcttttatctccttacgtaaatccttatgcattttctgccattttcatttgagtttcactcttatgcttttttatttaaaaaaatttatatattagtgaaaataatcttctttcttatctactacaaatatttccaagtctgtgatttatatcaaaatgtatactttatttttggtgcaacaatgtttacatatttaaatatattagttatatttattctgttttcagctcaacaatttcctctgccttgaagcctttttccagcatacctcagcttacaatgatttttcatatgtgattgaattcactataagcattttcccttattcaatggttaattgcagactgcttttaaatgtttcacattttatacatattcacatttgtcattttatttatactttgattttaccactaaatattgaattttatttagtatataaattatttatattttattttattattatgtttcacccctttcacagtgaatagcacacgaccttgcccatgcagttatttagtaggaatttcttacagatttcttaattttttgcatatagtgaataaaggcaagcctacttcccaatattctgagtgtttttttcaataactggaaactaatttgttgtcttattgaacatacagattttcattttaatttgaacagttggctttgtatgtactatgttctcttctacaactttttgtttcttctggagatgcctatgttttttcttttttaaaaaatattttccttctttataaaatgtataagttttctcagtctctcccttgtatttgccattccacagaaaagcctttatttcctagaaaacttttcttttggatttttcttactttcttttccaaagtaaaataagtgtaattttttgttccttttacatggctactgtcctgggactttcctttgacattcacctaggttgaatccattaattatctgattacaaatctaaatcaggggtttccccatataaattattaataaaggttaaataggaagtacactttcaagtacttgtgtgcctgaaaattatctttatcttaatgcttgatggaaagtttgcctgaatatgaaattttaggtttaaattatgctccttataaatttcaaagtaataaaggaacagagaaataaaattatgcagctacttttttgtggggaatttggcagttatgataatggtgcaagacacagatcaatcagttaatgaccatgtagagggcaagtacaaagattcagagaaagaagcagacatttgacagccccatagagctcaagagaccaaaatgataaacttcagggattaggattctgatgagaagactgtaacagagaaatgagtacatcaatctgttaattttattcccaaaacattggctaaattcttaaggattatgaatccttattattgattttctcagcagctccataatgccttcaaacaaatgcatttttatctggattgtctacttctattttgatctggatttttttaaaaacttgttttggcagcagcattgattttttgcaaactactctgtcatacttgaaagtggtaccattgagatcatagacttttttatattggttacagatctactagattctcatgttgtttacagagatttttttacattgattcttggtagttatccaaacatataataataactcataatcatgcctctctcttaacaactgtaatgcatctaatcctttctgttgtccaatttcattggctaagccttttagccttatataaaatagcaatagtgatgataatcattcttgtttttttttttctgacaatagcaggaaagcctctagtgtatccctattaagtaaggtgcaaatttataggggatgaggaatacatacatacacatatgtgtacatgatgatatcatgcttaggaaacacttatcaaattctaatttattgactacttacaacatgaatatgttttgagtcctataacataatccttttgcatcaatgaagttaatgacatgacttctctacatagattaattaagatggtgctatagattgaattgtgttccccttgaatttatatattgaagttct

SEQ ID NO: 476298 - DNA, 1071 bp, Homo sapiens
aagaactaatgagagtttgtctatttctttctcccctcaagccacaagtaggagaaatggacccgaccaaaccccatggcttatggtccaaatattcctggaaatctctttcaggggtttggttttccagatgaaaatgtgccagcattacactatattctaaaacaactcacccttcacaaaaactgctcacgaatagctgcaaattctcaggcgggtttgtttggatatgtacaagctattattgatgtatctaaacttttgaaaagtcaacaaattgagctgaaagttggttacttcctgaagacttgctcacagttagccaaattgagaggtggagagtacagtcctccagattgtcaagtctgtccaggtcttccaatcctgactacaaagagttgggatccagctacaaagttagaggaaagagtttacaaaaggcaattctcacttctggcagaaaatccaagtttggcagtttaccaaaactactctaaccctaaaaagacttgcaggactccgtgaaacatattatactcatggttttgtttattgcagtaaactatcgcaagaacaaaaaaccaaacaccgcatattctcacttataggtgggaatggaacaatgagaacacatggacacaggaaggggaacatgacactctggggactgttgtggggttcggggggggggagggatagcactgggagatatacctaatgctagatgacgagttagtgggtgcagcgcaccagcatgtcacatgtatacatatgtaactaacctgcacattgtgcacatgtaccctaaaacttaaagtataataataataaaaaagacaggattgaatcacaaatccaaattctttcagaaaacttatcatcagttaaattactaataggaacaaaattacataatgtttaaagtggggaaaatgaaactttacttcggagaaacagggctgacaacagcttaactgtgcaatacatctcaatggatcactaagtgtcagacaaccagacattatgtggcccctactgacacagtgtcacttatgaagtagaattctctcc

SEQ ID NO: 476299 - DNA, 1699 bp, Homo sapiens
gccccgtgggctcaaggaaaactcagataaacaaaagtatatgcctattgttcatggtgattttgtggccggaattggttccttccagtgggttcttggtcttgccgacttcaagaatgaagccgcggaccctcgcagtgaatgttcggatgtgtccagagtttcctccttctggtgggttcgtggtcttgctgacttcaggagtgaagccacagaccttcgcaaagtgaaggtgcagaccttcgcggtgagtgttacagctcacaaaggtagtgtgggcctgaagagtgagcagcagcaagatttattgcaaagagtgaaagaacaaagcttccacagtgtggaagtggaccccagtgggttgccgctgctggcttgggtggccagcttttatttgcttatttggccccacccacatcctgctgattggtccattttacagagcactgataggtccatttttacagagtgctgattggtgcatttacaaacctttagctagacacagagtgctgatttgtgcgtttacaatcctttagctagacagaaaagttctccaagtccccacccaacccagaagcccagctggcttcacctctcaatttagttgactgttataatagtgttatcgtacaaatgttgatatatacccaatgtgaaaaaaggcccatagtgtgtgtttgtcttcaagacttaaaataattagtcatataaacactggaaattcaatttgtaacttttaatgaaggcctcataatcaaactttgctactagatgatggctattattttttcctagtgtgaaacacatggaaaagttaataggatacatagggcatcctactggaaagatagaataattactaaagggcctaaatgcttatataaatgtgatggtacttatgtgagtgacttaaaactgaggataaatgtatttgacttgcaaagaaaactcaaataaaaatttagattatcaggctttagagttaagctactccttaggtttgcattgcataaggctttaaaagggacaaacaaataatacttaaatagttaagaacttgaaaatgtaaaccataaagacataacaacaatttgtaaaaataatgtaagagtaaggaaaagttgaagtattgctaatcaagaatctgattcaactattcaccattggcataatataatcaaaggttatttattacccccaaggcaaataaagtactgacttaaaaaaatataattatgttattctgcagtaattctaaaaattgtttagctatgaagtttgctttgctatggacttcctggatatttagacagctgcaacttgcccagagaagggtagaaccagcaatagaaaaaattagaaaatagtattttctaaatactataaaatagtataagatagtattttctaaatactattttatagtaatgcatggaagagattgtaagaataaatacaaattgaaaataagaggcttaatcctccgttttgaaaataggaaagagactctccctcacccctcccttttcttaaaatgttacctttagaaaattcataagttctttttctttctcttagaaatgtatgtaaatcttttttaaaaccaaagaagcctctccacagtccaaaaatgtagtagtgatcactttgaaatatattcatcaagaaagataagcacccttattttccagttcct

SEQ ID NO: 476300 - DNA, 597 bp, Homo sapiens
gtttctgcagagcatgcagccccggctatgcctctcccactgcagctgggatcctctcagcggctgctccagacgcaccaccgctgccatcattttcttatgtttatatgcccattcatctgccaattgacacttaggttattttctatcttagctattgtgaacagcgctgcaacaaatatgggggagtgcagatatctctttgatacactgatttccttcattttagatatatacccagtagtgggattgcaggttcatatacttgactatcttgttgccttggtcagcacgtgggcagaactggcaccagggtccacaagggttgtctgggaacttgagttcattaaggctagtctgggacttgggtccactggggtgggcctggatcctaggtttatgaggacagacctggtgctggggtccactggagggggcctgtcaactgggttcctggtattgaggctggagcctgtgtcgatggggatgggcctggagcctgtttctacagggaaattcaaagaagggccattgtttaattgagaggtatactcaaaggatgctatctgactgaaagtctccatgaggcatcatttt

SEQ ID NO: 476301 - DNA, 611 bp, Homo sapiens
agagatcaacacattctgttttctttgcaacaggatagcccacaggctggaccagctgactagcccaaatgaccgaggtcgtggcctgctccatccctcaggcactctgtcccagggagaaattggaactctgtcaaccccctggaacacaggcagtgaaattgggggaaatttccagcagtaaagaaaacaagagaggatatatttcacttgcaaaaatattaaggaattcctgtgagatacaggacacaagagacctgaatgaaggaaggactcattcaaaactctcatcctgtgagagagtatctttgctggaaaaatggaaacaagtcaccatacttacaaaagataagcactgtggttctaaagaggacctgtttggaaaactctgtctctctgaaataaatggtaaaaaagaagagaagggagaaacacatagaaaatttctatttggtgttttcaaaaatagtcaaagcagcattgcatctgagaaattagggcagcaattataaagagagaataaatttagatcagtaaatatagtatgagtatgattaaatgacaactaatttaaaaatattatgagagacaatagcagaatattgaataat

SEQ ID NO: 476302 - DNA, 823 bp, Homo sapiens
ttctccagcatgtggatggcagattatgggacttcttgtatgtggtggaagtacagccgtgtgctgcttgcaatccatattattgcctctgccacttttccaaacattaataagcattttaatattttataagccaagttctgaattatggaaaataaatctgaacactattaatacccaatgcggcacattaaaaaagggggacagcatgatctattgtgcagaagcccttcttgatctccacactggaggaagcgaggtgggctctatgactgacttttcaagattgctcatgtccatggctgacaagtgggtattggctgttagctatggtccaggggcattcgttcttctccacgtatgtctcttcactggctgcttgggcttccttaaatcaagatatctgaaattcaagagtgagggtctggatagacaggaattggaagctcccagttccttaaactttgggccttaaagctagcatactgtcacttttgccagattattctgtaagaggtcttatagcaccatgaatctttccttcatagcccctttcacagctcatcattacacagatatttgcatgagttttttgtttattttctgtctccccatttgattatgtgaggaggtttggaatcttctttaatttttctcactgctatgtctcaaacatttagtgactaaaatataaagttgatcaataattttttataaataagtgaaatgcattcaacattttgctcatttacttgagagagaagccacatttgcatggtatttaattcatgttaggttctgactttggactgaattgagcagt

SEQ ID NO: 476303 - DNA, 569 bp, Homo sapiens
agcagtctcttcaggactgatgggaaaaccccagggagggctcacagtatgcttgatgtaatctcatttgtctacgtttgcattgtcgcctttgcttttgaaggcttacccaaaaaatctttccctggatcagtgtcctgtagtgtttccccagcgttttctcctagtagtttcatagtttcaggttttacatttaggtctttaagcctttacttttcatatggtgaaagatctagtttcattcttctacatatgaatattcagttttcccagcaccatttattagagagtgtttcttccccactgtatgttcttggaaactttgtcaaaaaggagttggctcccactgactcaaatgttaatctcatttggcaacaccctcacagacccacccagaaacaatattttgcatccttcaatacaatcaagttaacactcaatattaaccatcacaagtccacccttcgtcagttacactgatttcatcttgatagtccaggtcagtcaccccagccaacattgtaactccttagcctgttgacttaaagctgctattgtaagatgaccca

SEQ ID NO: 476304 - DNA, 669 bp, Homo sapiens
tctttggctgtttgtatgttggaatggtattgcctatactgtctttcagggtttttatagttttgggttttacatttaagtctttaatccatcttgagctaatttttgtatatgatataaggaaaaggggtccagtttcaattttctgcttatggctagccagttatctcagcacgtttatcaaacagggagttctttcctcattgcttgtttttgtcaactttgttgatgatcagatagttgatattattgatagacttataattttgaattctgaagctaagattcgttctttattcaactatgaacaatcacatatctttggtctaagcaaagtaacttttttagacttgagggagatcaatgataattcgccacctaagaaaggaagcaattatttttctaaagttagaattctctgatgatagtatatttttaacttttaaccgtatattaatagatgagcttcgtgtttggactttatagtacaaagaagaaacgcctcaatcctgaacccaaatactattacatgaagttaacaatacttaaatgctgatatgaagtcaataaatcttatgtcacatgataaaggaaaaggaaataaaatgaagataatgtcttagtacaagtgtatacaatcacaaacatgtttttaacaaaaggaggagg

SEQ ID NO: 476305 - DNA, 544 bp, Homo sapiens
tcgcctctaggtcctacctttcaatactgccacatccacattggaggatctttcgaagatggtttggctgccttggagatttggagatctgatgccacgatgaggactcacacacggggggctcccagtgtgtttttcatatatttgctttgctttgtgtcagcctacatcaccgacgagaacccagaagttatgattcccttcaccaatgccaactacgacagccatcccatgctgtacttctccagggcagaagtggcggagctgcagctcagggctgccagctcgcacgagcacattgcagcccgcctcacggaggctgtgcacacgatgctgtccagccccagaaacccctcccccatgcggatccaaagcagtccaggccccagaggaatgctccttgcgcaacccactctggagtgcagtggcgtgatcatagctcactgcagccttgatctccctggctcaggtgatcctcccagttcagcctccagacaccaccatgcctgactaatttttctattgttagtacagccaaagtctc

SEQ ID NO: 476306 - DNA, 522 bp, Homo sapiens
ctgagtgcagggccctgtgtgggaatgagatctcgaaaccaaggtggtgaaagtgcatctgatgggcatatctcctgtcccaagccctccatcatcggcaatgctggtgaaaaaagtctctcagaagatgcaaaaaagaagaagaaatcaaataggaaggaggatgatgtcatggcctcaggaactgtcaaacgacacctaaaaacatctggagaatgtgaacgaaaaactaagaaatccctggagttatccaaagaagacctcatccaactactcagtataatggaaggggagttgcaggctcttgggaagtccgtggctcttgcaaactctaatttctgcgtaatgctattacatcatggtgaactctggaaagtatttaagattcatgtggtttttatgtttatagtggtgctagataaggtttcagatcctagatatgcaaaatataaactcacacttctgaaatattaaagaaattagtcagatggctccaaagaaatgcattttgctttccattaa

SEQ ID NO: 476307 - DNA, 646 bp, Homo sapiens
cgccacactgacatccacaatggttgaactagtttacagtcccaccaacagttcaggaccctcagctgcaggtctgttggagtttactggaggtccactccagatcctgtttgcctgggtatcagcagcggtggctgcagaacagcggatattggtgaaccacaaatgctgctgcctgatcctctggaagttttgtctcagaggagtacccagctgtgaaagggaattccctgaccccttgcacttcctgggccaagtgacttttctaccaccacagttggagacaatggagcccaaatctctaaacattatccttcatcagtttcatttctttattgcctctatgacttatagcaggctgattcctaatgacgtccattacatagtcggaaaaaattcctctaaatacctgatcagtgctgtcattgctttcagataaaaaggatgtaaatccatttcaattaacaatccttaaaacaaagatcaaagcaaaccactgatttcagtggtttatgtgttcatcttctccactaaaatgtgagactcagaaacaagaactatttaattttgaaaatatttttacttagaaataaaaagtaaactctagttattgtttttaataaaatgattacttcttaacattctc

SEQ ID NO: 476308 - DNA, 955 bp, Homo sapiens
gagggagagtatgctctggtctttctcttcttttttttttttattatatttaagttctagggtacatgtgcacgacgtgcaggtttgttacatagctggggcagggcattggcaggagtggggcaatggtatttctacccatgcttgtactgatattggtgaaggtggagtactggtgggcacaggaataccagtatcggtgcatgcatttgccctagtggtggtggtgcagcaggatgtctgtgagtcagtgagcagctctccttgcccactcaagtgtccatggcagttgtggaatctcctgctactacaattctgcaggtctgtggcaagagcgggccagtccttacctgttcaactcaccccttctccactagtgtctgggagtcaagaatcaagtcctggttctcagcaaaaccagggttccatgcttccttccacttcacctcagtgtctgcatcctcccccattcactctcaatgccttccctctgaagatttgccgaaaatgtggcagtctacccaaaatcccggtctctcagtgggagatgttcctcctagtttgttgtgagcccttaaatgggacagaaactgtgcactcagggagcttggattttaaggcagtagcttgccgatgctaccagctgaataaagcccttccttctacaactcgatgtctgagaagttttgtctgcagctcgtcctgctacatttcttggttccctgaccgggaagtgagagaacagcagcataagtggctggcagaggcaaggaaagaccagcagagagaaaaagaggccatctataccaattctaagttagtttagactaaacaaggtcttattaatagcaaaggataattgacatctcaaacttacaaggttttcaacaaaagtgaagattgctaaaagttaacagtgtaacatgtattatggtaacttctaatcttgtggcct

SEQ ID NO: 476309 - DNA, 1523 bp, Homo sapiens
cagtgaacagcgactagggaagtaggctctgctctggcccagggaaggttacaaaatggtttccaagaggctaggcctggacttaggaatccgaagagcctgcttgttgccctaccccactgtggctgaacagttacctaaagtacaagacaaaatgtcctttacatttcctactgcttttctcaaacagaaggagtctttcaccataggcatgacagctgggaatgtgctgggtcacacctatagtcagcatgtctcagagcccaaagtccatggtatcctatctgggcatcacttctggttaatcagtgctgaagggctttttagtcaacaggtgataaatcctgcaaggactgggtcctttaaggcaccaggttcctttttggcccatggtatgtctagaaatgtcatccagaaactagggcctagcatgggggcctcacaaatcggcctggtgccttatcctgctgaggctgagctggtatccaagatgccaaaaaatggactaccaaaaaataccatttaaacatttagtgaattgcatttattgaaaatcaagcttgcaatggtgaaaacatcaaaatttaatccaataaaaacacaagagaaattgtatcaattaaatgacaacaactcaaaagtgcatgaaatttaaatttaaatttaaatttatgcacttttcaaattttacaatttctccttgtagcatattggcataagagaggaatctttttaatacagtttctatattcaactggataaatgtatactcatgattttttagcatctaaatttgacaaaagttaaaaggggcgtaaatagaaccaactaacttaactttgttttgttgaaaatatttgttgaataaaggggtaaaattaaaaacaatatctgttaaaatgtttagactaaagtatttaaatatttcaatttaaaaacctttgaaatgagtatactctctatttagtaagaattttctcagaactttccaggtaactaagaacctgcagagaaaaaattttctcaataaaaataatttccagagaagattcaaatataagaaaatgttcacatgttttaaccacagaatttaactttgaacacaatttcacacaattttattaaaaatagcaataaagccatactgtcataaaaactgcattctttggaaaaatacccatgacatgatatgatgaaaaaagactaatgccaattccatgctgttctggttactgcagctttgtagtaatatattgaagtctgattctatgatgcctccatcttcattgttttttgcacgggattgttttggctattcagggtcttttatggtttcacacaaattttaagggttttttgtttatttatgtgaaaaatatcattgttattttgataaggattgcattgaatctgtagattgttttggctagtatggtcatctttaacagtattaattattttgatccatgcatataggagatagaaaacctgaaaattaacatatctatagccaacttactttc

SEQ ID NO: 476310 - DNA, 639 bp, Homo sapiens
ctgtgtgtcatccagccgcctatatgaacctagtattctttcgggagaatattttaaccaagatcttaaaaggtacacataaattaagcttatgtgcaaaacaaagacagaaaaactgtggaaataaatatttaaaggaagaacttgacttcttctgtttgaaaaggagattaaaactatccacacaaagcatccgggagatctggcaaacatgccctggcactttccctacacaaaagacagagtcttacacaattcttccattcactcatgggctcatttctgttggccacccatgctccccgaagacagcttatggaactggattgcatcagcaaggcgtgatggatgagcagggacatcaccagggagggagtactctgcctttggcttggtttagtgtcagatgtgaaggaaagaggagcagtaaatttggaaactatgttggaagaaactaaaatttatttttaatctctcattttgttgaaaactggataatgctggttgggagacaaatacttttggtaaatgtttagacatcctgaaaagtggaggagcatctatttacttaccccttttcagaaaatgcctgtgaagtttaaaataataaatatgattttaaaatcttagtaaaagtaa

SEQ ID NO: 476311 - DNA, 1234 bp, Homo sapiens
ctaatactggaaatgacaccccatcaactttgtcatattttatttaacttgaagatggacagaaaatacaggaaggaagggaagggaaggatgaaaaatttcaaagctggtaaactgcagggtagggcatgtgctggagtgtcagctattcgctcaagatcaagctgccctgaaagagccactgcatcaatcctggcaatgtggatcaggggtgactgttctgtccactttcacataggtctggctaatgcttatggacataacaccctgatcaaggcagttgtaaaaactgggcaaaacagattggagataatggattttttgacagagttagatggtttcatacagatttttcaccaccagaatggtgaaatcagctgtgcatgtagaaactgtcatgtttacagtccactggatgaaaaacagtagcatataccacgtaaattatgagaaaacatctgaacttcatatttgcctaaaggtcggtggttggcacagtcaggaaaaagtttctcaattttttgctagtgttcacagtttgaactgcctctatggaaaataaattcagtccgcttagcctcataaatgcgttactgcttccatgttttctcctaaaatcgccacttccacaagtaaagaggaatttgaaaaacatatatatcagattatatcactccccttcttaaaacttccaatgacttcctatgtcaggtagatccaagtctacactgatgaccagacccaaggccctgtgtgacggggctcccctcttctgccaccatcctccccactgattgttgtgctccagttacactggtcttatttttattcagaccatgtcagcttattctcccatggctttgcctttcgcatcacttctgattagtgttggttccccaaagcattatgtagctggcaccttctagtcacttaaatttcagctcaaatgccatctccccagagatatccctgattgtccaatctaagctagagttctgtgtacttctgttctattttcctattttatgttctttgcagaacttactaccatatgacattcttttttttggtttacttactgattgtctgcctctacccactggattgtaagccccatgagcagcggagccccctctagcctgtttgacttcttcacagtgatatcccagtacctggaacagggttgggctgcagtaggtgtggtttgtcaaagatcagatggttgtagatatgc

SEQ ID NO: 476312 - DNA, 601 bp, Homo sapiens
tgaggagaaccagtagatagtcaggacctggaaaatattttagataaagctgttgtaagttaatacacaatatgcctggagcatttccttcaagggagacagggagccctcacagcttgtgctggactcatcaccttgtttggaagtatctttccctgttgtttcttgatgtgtgctttgtttggcttgagtgtgttcatctcatggctcctggccaacccttagagggttgcatgcagactatctacctgcattggctgtcgggtgagacgagctggctgtgggggaccagtgctcacttattaaagctgatcttgctctgtgtcttctctggcctcagaatctctaatgctaattctctgacaaacctccttttcgaaaagagtacaaagagtcaacagagcctcatagtgctagtcccacacccaacaactttaaagccactctcttagacctgcgaaagccaaagccaagtttgatcaaaggctctttcaaagttcagctccttaccaggcacttgtaaacatgtttaaacgccccgcttaaagtgtgtggtttgcatttggactgttagaatccagagctcttgacttcttccagc

SEQ ID NO: 476313 - DNA, 534 bp, Homo sapiens
aagaaacaaccttcgatagaaggacatttttatctaactggaagaacagaggccaaagacaggtctctggtgtacggtggcacactaatggaggcgaccagatcatggttggtcaggggctggctccggacacgctccagcatcttgaggcctgcagaagaagtgcccagggctggtgaagtagagcccattactggggcccttggcaggcctggactccaccagggacatcgcagggaggatgtcaccccagccaggccttccaacctgaataagggtgtggctgtgcacctcaatgcagtgaaggtatgtgtcaccatgccctgtgagcataagaggcgagaggagggtctatcaagcaccagcccttggggagtggggagaagaggggcaagtccaagcaactggttggtaaaggacttgaaaaaagtgaggaaggacctaggctctgtccttaaaataagtacccaaaacaacccgccccttgaaccaccttaggctgagtttgagaccaccctgggtagcatggcaaaa

SEQ ID NO: 476314 - DNA, 672 bp, Homo sapiens
actgctgggaattaggaatgattaataccattttacagtcttttgccaaccagttgcttggacttggccctattctgtatcaggtcggagcagagcatggacatgggaacgagtgctctcagcaagaagccgtggtggaccctgcctcaaaactttcatgcaccaatggtgtttcacatggaagaggaccaggaggagctcatcttcgcctccctgatggagtccaggcctgccaatgggccccagttatgggccctggttcattagccctgggcacttattttgcaggcctggagatgctggaacgtgtccgaagccagcctctgaccaacgatgacctggtcacctccattagtgtgccaccatacactggagacctgtctttggctcccaggataagtggaaccgtgtgtcttagcgttcctcagccttccccttaccaagtgattggttgttcgggtttccatttgagttcactgtatccgtaattaaggactgatctcccctgggaagtggggatgagaggagaaatcttggcttcacttttgggtcaatatttattttcccatagagaatgtcctctgaagccttaagatatgttctgtatgtggaactactctttattgtactgaaccaataattgaatatcagctatgtcattttcatttaaac

SEQ ID NO: 476315 - DNA, 560 bp, Homo sapiens
gaaagccgcctcgagcgcgctccgcggctgctggtcccagtatggtcgatgatgctggtgccgctgagtcccagcggggcaaacagactccggcccactccctggagcagctgcgtaggttaccacttccgccgccacagattcgcatccggccctggtggtttccggtgcaggaactgagagaccctttggtgttctacctagaggcatggctggcagacgagctctttggcccagaccgagccataattccagaaatggagtggacgagccaggccctgctgacagtggacatagttgactcagggaacctagtcgaaatcaccgttttcgggcggccccgtgtacagaatcgggtgaagagcatgctcctgtgcctggcatggtttcaccgagaacatcgtgcccgagtgttctaaagttcttctaaaattagtcaactattttaataaaatgattagcggttaaaagttgctaataagttattgtaaattcagctttatgtggtaattcccttattgtaagatacatgattattttaaactggagtgataattagc

SEQ ID NO: 476316 - DNA, 556 bp, Homo sapiens
tgatggtcaaaaaaatcatgaaagctatactcgactttcccctgaatttccaggagaagtatgaagtgggtaatgtgaactgtcagacccaaagagagggagttcttccagggatctatgtgactgaagtattaggtgtttcaaagaagaggtgcctgactcatctgaatttccatgaagaaggatatttctcagtatctgcctttatcttcgcgcagtacactggagggagcattcctaaaaaaatcggtccctgttctatggactatgatcccaatctcttagaagaagacgatgaactacactctcagggagatagcctgacggatcattctgtgaaaggaaaatcaactgtttggagaattggagaagctgaagattattcacaggacatatcttacttggaggaactggaggaacaccgattttctgtttggctatagaatgtgtactctgacttcagaaagttcatagtccaatgaggaatattaatgtttaaaaacatcaatgtgatctgatgatggtatttttaaaaattgctcgaagtgcaacatgc

SEQ ID NO: 476317 - DNA, 1316 bp, Homo sapiens
ggccgaataggaacagctccagtctacagctcccagagtgaatgacgcagaagacgggtgatttctgcatttccaactgaggtaccaggttcatctcactggggcttgttggacagtgggtgcaggacaatgggtgcagcccaccgagcgtgagccgaagcagggcaaggcatcgcctcacccaggaaatgcaaggggtcagggaattccctttcctaaccaagggaagctgtgacagacggcacctggaaaatcgggtcactcccaccctaacactgtgcttttccaatggtctcagcaaacggcacaccaggagattatatcctgcgcctggcttggagagtcccatgcccacggagcctcgctcattgctagcacagcagtctgagatagaactgcaaggaggcaccgagactggggcaggggtgcccgccattgctacggcttgagtaggtacacaaagcagcctggaagctcaaactgggtggagaccaccgcagctcaaggaggcctgcctgcctatgtagactccacctctgggggcagggcatagccgaacaaaaggcagcagaaacctctgtagacttaaatgtccctgtctgacagccttgaagagagtactggttctcccagcatggagtttgagatctgagaatggacagactgcctccccaagtgggtccctgacccctgagtagcctaactgggaggcaccccctagtaggggcagactgacacctcacacggccgggtacccctctgagacgaagcatccagaggaatgatcaggcagcaacatttgctgttcagcaatgttcgctgttctgcagcctccgctgctgatacccaggcaaacagggtctggagtggacctctagcaaactccaacagacctgcagctgaggatcctgactataaaaccacaaagatggggaaaaaccagagcagaaaagctgaaaattctaaaaatcagagtgcctctccctctccaaaggaatgcagctccttggcagcaacggaacaaagctggacggagaatgactttgacgagttgagagaagaaggcttcagattattaaacttctccgagctaaaggaggaagttcgaacccatggcaaaggagctaaaaaccatgaaaaaagattagacaaatggctaactggaataaccagtgtagagaagtccttaaatgacctgatggagctgaaaaccatggcacaagaactacgtgatgaatacacaagcttcagtagccaattcgatcaactggaagaaagggtataagtgattgaagatcaaattaatgaaatgaagc

SEQ ID NO: 476318 - DNA, 707 bp, Homo sapiens
actgattttccttgactcaggatgggccatttgcttttcatcacccgtgttctgctggttgtcccccatttgagtaacagacgtgagccaccatgcctggccagtaacagtcatttttgcaaggtgcaaatggaaaacaatagaacagaactgaactctcagtccttccttctcactgttgccgtatcccctcctggcctgctctgcctttgctcccccacttctgatgaaagtccgcgaggctctgcatcagacttttgtttcagttcccactggcctttcgtttgtaagcagacaattagcaaaaacgttaaacaccccatgctgtacattcccagaggaatttgcatatatgtaattttttttaagtatgaatgcaaagatttattagaaggatttttaaaagtcatacaactttttaacacttattttaggtttgtgggtacatgcgaaggtttgttacatagctaaacatacatcacaggagtttgttgtacagattatttcattacccagatattaattcatcacccaggtattaagcccagtatccaatagttaccttttttgctcctctccctcctcccaccctcctccctcaaatagacagcagtgtctgttgttttcttctttgtgtttgccaattaagtgattttcacatacttgaaattatagtagaatatggaccaacatattttatgaggcaa

SEQ ID NO: 476319 - DNA, 855 bp, Homo sapiens
agctccagtgagtttcaaggatgctcaatgcgatggcaggataccatgagggggttgctaaggaacacacaaatgataagcaaaggagccttaatgctcatgtggagaaagttttagtggtgtggatagaagatgaagccagccacaacattcccttaagccaaagcctaatccagagcaaggccctaagtcttcaattacatatacaggctcagagaggtgaggaagctgcagaagaaaattggaagctagcagagtttggtccagaggttttaaggaaagaagctgtctccataacagaaaagtgcaagaaagaagttctactgtgggtaaaatgctatcaaacagcactgcatgctacagagaaacctttagtgaaagagtcaatcaatgaggcaatgagattgccacagccatttcaaccttcagcaaccaccatcctgatcaatcagcagccatcaacatcaagaatggttttaagaagtttggtcaaacttgtcaagcctttgaaatggttctaaaactgtttttatggttgtaaaattatatttagtccaaataaaaccatatttatttaattttggagctgaaataatgagctttcaaaatgcaagccatccagaaatattccatcaagttttcaaaatttatactttgctcttctaattttattgtggttattttctgttcctttcttgcaccctttccatataatgagaatgtgaaaacacaagcaattctctatggaaaacagatccatcatcctgagctggaagtcttcatgaaagcaaaatttaaaaaaataggagttgtgttggtaggatttccccttaggctgtttcttttatctgtatt

SEQ ID NO: 476320 - DNA, 517 bp, Homo sapiens
aggccgaggaggcgcagagagcgagcgagtgctgctggggctgccagcatgctgtcacctctcaaaaggatccaaccgattaatatgcgggcatttgaggggcataatctccagagtcctgagtgcactgaaagggcctccagatgcctgggctatgcccttcggcaattatttaatagttgtgtgtctcagctgaactttcaatatgaggacagcagctctggatctgggagccactatatcaaggcggctactgagaggagcccatttcagctctctgagccccaagactctcctgggcatcatttgaaatctttttggaggcagccacactcccatggcccatgcactctgcaaaccagtgaagatgtgaagatggcaccatgcaaatgccaccaagatttactgcctgtgctctctggaggagtagccaccactgtaccacggcttgctcgaaccaaacctagggcagccgaggactactgctgacaagtagggagcagagctttaaggtggc

SEQ ID NO: 476321 - DNA, 754 bp, Homo sapiens
gagcgcagccctcagaggtttatgcaatttcaaaaaggtaaaatacctagtttggggaacactgctctctccttggagacctgctgggatactaaaatttcaggtgcttcaaaaatgcaggacacagagaggaatttgaaatgcatccagaaggaagcaatttatatttttctgcaacacttttataacagaaaggcaaagatgagaaggaacctctttgcagtaatcatctcagtcattaaaaaccttttatccaaagaagcagggacttattcaagaaatttacagcaatgtaacaactgtgggaatctccttggtcataaaaacctggatgaggaacttggtttttctgctatgacaccagtggacgtctcaacagccgttgaactgtggagttggagtgtggagaggggacctgttttgctggtacagattatagcagccttcttgattgggatgatgttgctgagccaagatcccaaaggcgaggaaaagacctgtacctttttagtgagagtaactgaaaagttgcatgaagaagagcatggatacaagggtgcagaattgggccattaacacaatttgtcacatttgccaaacacagaatgcattctgcagatataacttgatagattctctgctcattcccatattctgtgtttttcatgactctgttctaactggctcaaggaatttcccactgccagtccacgcacctgttcctttagttttaagtaagatgagataaatgaac

SEQ ID NO: 476322 - DNA, 791 bp, Homo sapiens
tcctggataagtccaggtatgatatgtttactacgtttgtgttttctcagagtacttttatttatagtacctcattttacaacagttttgtgagcatcttgaaggacttagaagcaagtcagcctctccagatcttggatctgatgacttcgttacatcttccagtgtcacatggggctcccgtacacaacttcccagcaaacctgggatgcaggagcccttgggctctggtgccaatggatttccagtactctctagggaaaatttatgaacggaattatcctcccctccaatttaccttttatctttggaatgccctcactattgatcaagtcctcaagatcattgtggaggtattcattcagcatgatgttttaagccctggaaaggtgtttgctcaaatgtcaccatcttcgtaagctctgatcagaccactgcatttaagattattacctctccctccacattccctattcccctccttactttatcactctccatagcacttatcttctaacatattcaatttgtttagtatttggtgctcttattagcttcttcagattttttaaacattccttgtcatgtgacaattatggattatttatatattttcctgttaccacaatgtagcataaatatcattttcactgtccacaaacttgagtgcacaaaaaacgtgactttaaaaacataagaaaagttactccatttcatttctaacttaagcccttattccactggcgacaggcactaaaacttagtcaatgagggataacttctccctgggg

SEQ ID NO: 476323 - DNA, 1190 bp, Homo sapiens
agtcatgaaggtgcacacatgcctatgttttggggaatttgtgcatacatgtaacaagaatgttatctgccaactacagcgcagaggagcgctttctcctgctgggtttctccgactggccttccctgcagccggtcctcttcgcccttgtcctcctgtgctacctcctgaccttgacgggcaactcggcgctggtgctgctggcggtgcgcgacccgcgcctgcacacgcccatgtactacttcctctgccacctggccttggtagacgcgggcttcactactagcgtggtgccgccgctgctggccaacctgcgcggaccagcgctctggctgccgcgcagccactgcacggcccagctgtgcgcatcgctggctctgggttcggccgaatgcgtcctcctggcggtgatggctctggaccgcgcggccgcagtgtgccgcccgctgcgctatgcggggctcgtctccccgcgcctatgtcgcacgctggccagcgcctcctggctaagcggcctcaccaactcggttgcgcaaaccgcgctcctggctgagcggccgctgtgcgcgccccgcctgctggaccacttcatctgtgagctgccggcgttgctcaagctggcctgcggaggcgacggagacactaccgagaaccagatgttcgccgcccgcgtggtcatcctgctgctgccgtttgccgtcatcctggcctcctacggtgccgtggcccgagctgtctgttgcatgcggttcagcggaggccggaggagggcggtgggcacgtgtgggtcccacctgacagccgtctgcctgttctacggctcggccatctacacctacctgcagcccgcgcagcgctacaaccaggcacggggcaagttcgtatcgctcttctacaccgtggtcacacctgctctcaacccgctcatctacaccctcaggaataagaaagtgaagggggcagcgaggaggctgctgcggagtctggggagaggccaggctgggcagtgagtagttggggaggggagaaagtattaagccagaacccaaggatggaaataccccttagtgagtcagtttagacttcaggctgttcatttttgtatgataatctgcaagatttgtcctaaggagtccaatgggggatatgttttcctcccgtgaggaaatgtttagttcttgagggaaaaa

SEQ ID NO: 476324 - DNA, 976 bp, Homo sapiens
gaaagtctgatgagttatgcccagtctccttcctcctcccgccggcatgaggtttggggccctgtggatgaaggaagttcatgggaggcaaacgtgcctgggcaagcaacagccgcagagattcagtccccacgggggccaggagtggataaagctagaaagagacaccacagaagagaagatgtttgaacagctgaagccaatcgaacctgtacagaagacgctcccatgggtgggcgaggtagctgccaccctgcaggaagccatgaagagagattgctggagggaggcacgggtgaagaagaagccagtcacctttgaggatgtggcagtgaatttcacccaggaagagtgggactgtctagatgccagccagagggtcctttaccaggatgttatgtcggaaacctttaagaatctaacatctgtggccagaatctttctgcataagccagagctaatcaccaagcttgagcaagaagaggaacagtggagagagtttgtccatctcccaaacacagaaggcctttcagcctgggtccgaaaaaaagaagaagaagaagaagaagaagaagaagaagaagaagaagaagaagaagaagaagaggaagaggaagaagaagaggaagaggaagaggaagaggaagaggaagagggagaggaagaagaagaagaagaagaagaaggagagaacaaaagtcgtatacagctgacccttgaacaatgcatgggttagaggtgctgaccccctcatacatttggaaatccatgaataacttttgactcccctaaaccttaactactaataaactactgttaaccagaagccttactgatcatatatacagttgactgacacatattttgtatgttgtatgtattatatactgtattcttacaataacatgagccagagaaaagaaaatgttattaagaaaattataaggaagagaaaatacactgacagtacaatacc

SEQ ID NO: 476325 - DNA, 2298 bp, Homo sapiens
cctgatttggaaggagaggttcccatgaggggatctatccgagtctgtgaaaggggatgcgaggatgatgtggaagaagcaacaccaaatctgatctgctcacaaggtgcacagaagaagctcctctttggagagagcagcctggggaacacaggtggactctacctagatatcacggagaggggcacatttcaaaaagactcacccccacaccctccaggcaggcccgttcgggccatcttcatggtcaggtcccgctggaggaggaggcacttggagactgtgatcatccaagccatgttcaaggattcctgccagaggacccaaaagcctcctgcaaacaccccaatcccccacagtgagaccactactcacaacctggagtgcagccagcctacccgaagtactttttactccctgaaatccctggcagccaaaagatctgtagagagaggcagtcccccgtagcaacagatcaataaaagatcccctccacagtgaaaaagaacatgtagatgactgtaacagagcctagatgaccaggcaaatcctgacaccgctgcctgcttctcatcctatagaaatcatgcagccctctgataagagtgggagaacaagagtttccttgttggcagatatggtgaaaatgctttgctatgtgtggattttcttttcacagttaaaactttgttttgattcagaaggataaagacactttttttgtgtccctatgagggaaaatttcaaaatccattgaggcctatagtggaaacaccaaatatcccacgattaaaaactacaaagaagctatgtctgaaaatgctttccaatgtgtgattttatctcacagagttaaacatttcttgtgattcagtaggctggaaactctccttttctggaatctaagaggggatattacagagcaaattgaggcctatagtaagaaactgactatcctgtgataaaaactggaaacaaactatcagtgaaatgctttgtgatgtctggatttatctcacaaagctaaatctttgttttaattcagcagtttagaaacactttcactgtaggatctgcaaagggacattttggagcccactgatgcctatagagaaaaatggaatatcccgtgatgaaaacttaatgcaagctatctgtcaaaaggctttgtgaggcatggaattatctcacagagccaactttttgttttgattcagcatgttggaaacatgtttttttgtagaatctaagatgagacattttgaagcacattgaggcctggagtttaaaaccaaatatcctgcgataaaaactagaaacaagctatctgtgaaaatgctttgtgatctgtgaaataatgtcacacagttaaacctttgttttaattcaacaatttggaaacactctttctgtagaatctacaaagggacatttcggagcgcatggaggtctatagtgaaaaacagaatatctcatgataaaaactaggagtaagctatgtgcgaaaatgctttaggatgtgtgggctcatctcaaagagttatacctttctgttgattcatcaggttgaaaacagtctttttgtagtatctaccaataaacttttcaaagcccattgaggcctacagtgaaaaacagaatatcctgcggaaaaaaactagaagtttgctatctgtgaacatgctttgtgatgtgtcgattcatcttacaaatttaaacctttcttttgattccataggttggaaacactctttttgttgaatctaaaaagaaaaaatgtcagagctcattggggcctatagtaaaacaaacaaataaacaaacacaaaaaacaaatattacacgatgaaaactaaaaacaagctatcagtgaaaatgttttgtgatgtgtggattcttctcacagagttaaactttttttatttagcattttggaaacactctttttgtagaatctttggagggacatttcggagccctttgaggcatacagtgaaaaactgaatatcccatgatagaaactagaaataaggtatcagtgaaaatggtttgtgatgtgttgattcatctcctagagttaaatctttgattcaacaggttgaaaacacttttattgtagaatctatgaagagcattttcaaagacctttgaggcccataatgaaaaatcaattatcctgtgataaaaactagaaagaagatatctgtccaaatgctttgcaatgtttggattcatctcacagagttaaaccactgttttaattcagcaatttggaaacactctttttgttgaatctac

SEQ ID NO: 476326 - DNA, 1566 bp, Homo sapiens
agggtcctacgcccacggagcctcgctcattgctagcacatcagtctgagatcaaactgcaaggtgacagtgaggctgggggaggggcgccctccattgttcaggcttgagtaggtaaacaaagtgggaagctcgaactgggaggagcccaccacagctcaaggaggccggcctgactctgtaggctccacctatgggggcagggcacagacaagcaaaagacagcaataacctctgcagacttaaatgtccctgtcccacagatatgaagagagtagtggttctcccagcatgcagcttgatgtctgagaatgggcagactgcctccttaagtgggtccctgactcctgaatagccaaactgggaggcaccccccagtaggggcggactgacacctcacacggctgggtactcctctgagacaaacttccgcaggaatgatcaggcagcagcatttgcagtacaccaatatccgctgttctgcagcctccactgctgatacccaggcaaacagggtctgaagtggacctccagcaaactcgaacagacctgcagctgagggtcctgatgtttagaaggaaaactaacaaacagaaaggacatccacaccaaaaccccatctgtacgtcaccatcatcaaagaccaaaagtagataaaaccacaaagatggggaaaaaacagagcagaaaaactggaaactctaaaaagcagagcaccactcctactccaaaggaatgcagttcctcaccagcaatggaacaaagctggacacagaatgactttgatgagtcgagagaagaaggcttcagaagatcaaactactctgagctacaggaggaaattcaaaccgaaggcaaaaaagttaaaaactttgaaaaacatttagacgaatgtgtaactagaataaccaatacagagacgtgcttaaaggagttgatggagctgaaagccaagacacgagaactatgtgaagaatgcaggactcaggagctgatcaaggcaggccaacattcagattcaggaaatacagagaatgccacaaagaacgccacaaagaatgcctcgagaagagtaactccaagacacataattgacagaatcaccaaagttgaaatgcaggaaaaaatgttcagggcagacagagagaaatgtcgggttaccctcaaagggaagcccatcagactaacagcggatctctcggcagaaactctacaagccagaaaagagtgggggccaatattcaacgttcttaaagaaaagaattttcaactcagaatttcatttccagccaaactaagcttcatacgtgaaggagaaataaaataccttactgacaagaaaatgctgagagattttatcaccaccaggcctgccctaaaagagctcctgaaggaagcactaaacatggaaaggaacaaccggtaccagccgctgcaaaattatgccaaaatgtaaagaccgtcaaggctaggaagaaactgaatcaactaacgagcaaataatcagctaacatcataatgacaggaccaaattcacacataactatattaactttgaatataaat

SEQ ID NO: 476327 - DNA, 520 bp, Homo sapiens
tcatagaagcagagagtagaatgatggctaccagagactgggaaaggaggggcagtaggaaaggaaggaatagggagttgttgatccaagagtacaaagtttcagttgtcccacctttctggactgaaccaatatacctcttatacatattggttgatgtctcacacatccctgaaacgtatacaatcaagctgtaccccaaccaccttgggcccaagtcatcaggacctcctgaggctgtgtcacaggatgcctgcgaggcccctgtctccattcactcacttattcccagggacttagaagtcttctccatgcacagattgtgctcagcacaggaagcacagtggagaactgagcaggctgactggtctgtgttcctggtctgctgggacccagagacaaagaaacggacaatgaccacaagcgtgaaaaggtatgactagggtcattagtctgtggtgttattcacaaggtcattgccttctttctgcgtttgaagcaagacctcacatggtattct

SEQ ID NO: 476328 - DNA, 535 bp, Homo sapiens
tgcctctgtgtccagttcctccacagtctgaatggccatgtttcctttccatggctgtagaatgaggtgcaaacactacagcacagtctgtttcctgctagactctgctcccaaatggtacacaaatggccaaagagcacacgagaagatgctcaacatcattagtcatttgacaaatgcagatcaaaactacaccgagttaaagaaggaagagctttatttggccgggagcttcggcaagacccacgtctccaacaaccgagctccccgagtgagcaattcctgtccctttcaagggctcacaactctaagggggagcttggataaagctgactccgtccctggcttcaaggcttgtgcaggaccccagcgtgggcagtcagggcattctacccccctggctgcagtggctggttcgggactgaatatgagacctaactcaggcaacgaggctcactcttgggcttttccaggaaaagccattccctttcgttagggttggctatctgatatcagcctgtgaaaggaaaataaa

SEQ ID NO: 476329 - DNA, 548 bp, Homo sapiens
aaactagggtttgaaggtattttctcaaagtagctaaggttatcagctggctgagatgaaatgctaatctcatccagaaacaccttctcaggttcacaaacacaaaatcatattacaatgcaacctgttttaaaaggttacatttttacccagataacgcacaatttgatagactatcattttgaaaaccaatgccagtggagagaaaacagttttttcactctatgcctgcttttctcaggttatctaaccttcctatttactgaaattttcaagagtgacatgggcagacgattgttaacagtatacaacaactttcaaattcccatcttcaatggactatcaaaaatcagaaagccaataaaagacgcaatgaagtcttcatctgatgctctgaacagggctttggctttggctttggaggagcgggtttagcatacaaccttgcggatcttctctgtggttcgtccttcaccttggctttatctcctttagcatccccttcagcctttgtcttgggcatggtggcggcgtcgacggcggcggga

SEQ ID NO: 476330 - DNA, 1089 bp, Homo sapiens
agagtgaacattcgtgatttttgtttttttgtggggtattttcggtggaatgagaggaagggaagtgctccaatgtgggaaatataacgccttgggaagacttaaaacaactttgaataagaacctgcttgagaaagatttgccttacaagctaaatgttacatttccactcaacagaaagctcggagaacctgcagaaaccatcttatttatggatgcagaagaactcactgtcacgagaagagcaaattgggaaatctgcccctttgatccagtcatctcccacgaggcccctcctccaacactggggatttcagctcaacatgagatttgggcagggatgaaaatccaaaccctaacaatgggcaaaaccaatttagactgttacaagtcaggatggtggctgttcttgggatgggttcccggaattgctggaactgggtgtgaggggctggtcatgtttcttgatctaggttctggttacatatgtgtgttcagtttgtgaaagtttatcaaattgtgcattactacctatgtagttttctgaatatatattatacttcaataaaatgttttaaaaatatgtatatcatatatcatttcatcttagaaacagaacacgttaataagtgactagtttttggaagaaattattatagcataagttttaaaaaaagatgttggggtggggtttttaactttccataatgctgtaaagtttgcaacactcacacagtcatagaacaaatagaactttgactttggtttcaaaatttatgcagctgcctccatatacttttgacagtttaatcacatatttaacagttacaaagcatgttttagacatcaagaggatacatggagatggtggtagggcttatatacccatggtcgtgtaaaacaggaaaaatgtcagcaaaaataaactattatgctggtctattgagtgactttgtcagctttataaaggaatgaatatatagtgttgaaggataatctttctgaattagtaagttattttttaaaaagcacatctaaatcaataccttattttagaagaaatgtaatgttaggcatactaacatgtat

SEQ ID NO: 476331 - DNA, 746 bp, Homo sapiens
gatcatgtaaatccagaaaacctgtttttaaaaattttcttctcccgcagccccagagtcaaagccggttgccgaccctgtcccgtcccgcagtagcctgcctcctctttcctttcaacatgatagatgtcactgtgtcctttgccaaggacttcctgggagatggagtggccacagccatcttcaagatagcggtagcacccaccgtccaggtcaagctgctgatgcaggtgcagcatgccagcaaacatatcaccgcagataagcaatacaagggcattatagactgcgtggctctcaacttcgccttcaaagataaatacaagcagatcttcctgggtggggtggacaagaggacccagttttggctctactttgcagggaatctgacatcaggctgtgccgctggggccacatccttgtgttttgtgtaccctcttgattttgcccatactcgtctagcagccgatgtgggtaaagctgaagcgaaagggaattccgaggcctcagtgactgcctggttaagatatgtaaatctaatgggattaagggcccgtaccaaggcttcaacgtgtctgtgcaggttattatcatctaccgagctgcctacttcggtatctatgacactagaaatggaatgcttccggatcccaagaacactcacattgtcatcagctggatgatcgcacagactgtcagggctgttgctggattggcttcctatccacttgacacagttcgccccc

SEQ ID NO: 476332 - DNA, 618 bp, Homo sapiens
gagagccagaccgtggggagcatgacggtggggagcatgagggcgaggatgctggaggcgcactgcctcctaccccctcttccacctgctcaccacgtagaggactcaagacacaggggcagcaaagagccactccctggccacggactctctcccctgcctgagcgatggaaacagagcagaactgtccatgcttctggggactctctggggcacgtgtctggcccagggagacctgagctcctcccgctgaggaccgtctccgagtccgtgcagaggaataagcgggactgtctccaaggagtcattctgccagaaaaatgtagtacacaaatacaggataatataacaaatgtaaaatttctcatttctagtgaattaaactttccagtaattttacatctcacctcattcttatgatgctcagtttgcttaattattggcaaacataatggtaaaatgtttgtactgtattagagctttactgttcgattattaagatatttatccagtatcttagagatgctggacttcaattttccttattttatctttttaaaataaaatatcatgcatgcttctgatttgttatagaaatattttgtgttgagtcttttc

SEQ ID NO: 476333 - DNA, 2999 bp, Homo sapiens
cacacccccaccaggggctgcattacaggggaacatgtccaggtttgttatacagataaactatgcaggtttgttgtacagattatttcatcacccaggtactaagcctagtatctattaagctggagagcaatttctctgccaccagcgctgacgatttgccttggcttggaaagcagcaagctcttattgtggctggccaggccaggggacccgtcaccaatggggctgcacagacagacatagaagataaagaagaaagggaaaaggggagaggagagaagaaaagcggggagaaattggggaatgggagaagatgctgggatgggagtaggcagttacggcgttttgtgctctggtgtgctgccccacaagcgagactgggaccacgtgattctgggggagatttgcaaaatacctgcccgactaagcacacaagggtgttagggcaaagatgccatggcagcattgtttataacagtgaaatgtggggaacatatttagtaagaaggcagtagttaaaattatgttgtttcttcccacggaacactatgcaaacattaaaataatgtagtagacctctacttatttctactaaaagatattcatgatgcatatttctaaactaagaaaagcagtttgcaaaactttacaaaacagcatgtctagtagggtcctcttttgtaaaaatatatacgtataactatatgaaagtgtacatagaaaaatctggaataatatacgctaaaatgttaactgatttttttttctgggtagtaggatttgagggaactttttacattcttctttatatattcctttccttattttgtggctttttaaatatagacttaattttttgaagcagctttgggttcatagcaaaattgagccgaaagtacagagaatgcaaacatatctccttcccccatcccccaacaggtgcagcctttccggctatcaccttcccgcaccaagagtgggtcatttgtacaccagtgaacccacatcatcatcacccagagaacagagtttacattagggttcactcttggtgttgtaaatgttaagggttttgacaaatatataataacctgtatccatcattatcatatcatatagagtacttacttgccctaaaaaatcctctgcattctgcttatttatccctctccctaacccctggcaaccacgcatcttttcaccatctccataattctgtcttttccagaatgtcatagagttggaatcacacagtgtgtagcctttttagatcagcttgttttaatgagcaatatgcatttaaggtttattcatgtcttttcatggcttgatagcttacttctttttaatgctactactattccattgtttgaacgtactacagtgtatttatccatttacccactgaaggatatcttggttgtttccaagttttggcaatgatgaataaagctgctgtaaagatctgtgtatagatttttatgtggatgtaagttttcaactcatgtggatggatatcaaggagctcaattgcttgattgtatggtgaagggtaagcttgggtttgtaggaaactgccaaactgttttccaaggtgactgccccattctgcattcccaccagcaatgaatgagagttcctgttgctctacatcctcaccagcatttggtgttatcagtgttttggactttcgccattttaataattgcttgacatttaaagataaacacataatttttttggaatgagaaaatcattagaggtattgtccttttgaaaataaaatccatcttatgtacagcctcaatgaggttatcaggaaaactctaaattcaaagttggtaatcagaactcttcctatggattcccccttccatactgtaagcttaaactcatttgcttgcttttctaaatcagtggttctcaaacttcagtgtgcattggaatcaccaggagagcttgtaaaaatgtagactgctgggctgcacccccagagtttctgattcagtaggtctggggtggggcctgagaacttgcatttctaacaagttcccaggtgaggctgatgctgctggtgtggaaccccacatgtcacaccttgagccatgctgttctagataaggaaaaaggtgcttcaaaaagttagaagtaatgatctcctttctaagttttccaaattttctagaacaaatgctcctttaaaaatatcatatttagaatattgtaaaagaattcctgaatttttatgagatcattttttctgaaaatagataacacatctatatgaatatatataaaatacattgtgggccctcaaatacctgtaaagtgaatttcagacaaagctagttttccatggtgcatcctgccacgtgccaactgatgttcggtgttattgacaatcactatctgcattgtgtgacattcttgtggtctgtctatttgataaattttaagcttaaagccattgttcaaaaagtcacactattgctgacattcaatggtaaagaatctcagtgaacccaaggagtgcacatgcttgtttaaagttttttaaaaagcactttcttctgttcactctgttggccctgtgtacacagccactaagtcattggcacccattccctcccacacctgccctcagagccccttgcatcccctgtgcagtcaattggagggtgctggacttcctggtcaatgcccaggctcttctcagtttcccttgagccccctcatcagtttcttgcactcccttaccctttctaaaggacttccctcgggctgggggagcagcagggagctcagctctttggagcccagcccctgcctcctgaggggctaccctgagctttacaccatagggctcctctgcagggtcagctggagatgctctctgtggggccttcactaggcctcctcctccttcccatcctgcctttgtcactcccttcctcatctgccctgggagtgctggtgtcataatcaataaatcacct

SEQ ID NO: 476334 - DNA, 778 bp, Homo sapiens
tcctggacgccgcgtgctgctgtccgccgccgaccggtgtcctcgcagagataacctggctgaactcaccgcccagcgctatgtcagttctccctcatgacaacccaaaacttgaccggatttgtgttctgcagagaggaaaaaaaaaaggtaaatgaattgcaaagagatgaaaaccagaaatacagtatctctttgaatttgagcacccaggaaaggtgtaaacctaccgccttcctttccaggaaactctcctgcttcccagcaaaggtgaggacggaggcagccatgggaacgatgcacccacagcccagggatgctggcagccctcaccagaggctggaagaggctcctccagagcctgtgctggacttcaggccacggccaccgaacaccagtgcagtagccaggatgggcctgtggctctggctgcagcctccagggacaccagctggagagaaggaagccacgcatggagagcggccaggctcaaaatatcttaaagaaaatggaactcggagtcagtcatctgttctcaacgtggtcatctcaaaaatatgagcacacggaagttttcttccttcttgtcagttttgagtccaatatcaatactgttgtcctgtgaaagattttaagatttaaatgttttttcatgtaatttcctgatgtcttgattgttgcttctattttgttcatcaaaaccaaacagagtggaggttgctctggggctggatggatggccagtcattaaaatcaatgccttattagtctgccttag

SEQ ID NO: 476335 - DNA, 990 bp, Homo sapiens
cagggccggagccaaccagtctacagggctgccctaacaaagcgaaagatttcagaagaggacgaattggatgtacctgacgacatcagcgtccgggttatgtcatctcagtctgtgcttgtgtcctgggtggatcctgttctggaaaaacagaagaaagttgttgcatcaagacagtacaccgtgcgctatcgagagaagggggaattggccaggtgggattataagcagatcgctaacaggcgtgtgctgattgagaacctgattccagacactgtgtatgaatttgcagtccgtatttcacagggtgaaagagatggcaaatggacccctaccacagctcctgaaaacttgaacgtctggccagtcaatggcaaacctacagttgtcgctgcatcttgggatgcgctaccagagactgaggggaaagtgaaagtttcctccttccaaccatctgccaaatcatttcagaatacattctttcatacgccccggctctcaaaccatttggagcaaagtccctcacctatcctggagacactacttctgccctggtggatggtctgcagcctggggaacgctatcttttcaaaatccgggccacaaacaggagaggcctgggacctcactccaaagccttcattgtcgctatgccaacaagtaagcattatgtgtctgtggctgtcttctctctctcttcattcctgctgtttgttttgtgttcctttgaatcatgctcttgggtttggaactgctcagcagatgatttttccaggctaagttgcatattgatttttaaaatatttttgtgtttcctttagaaattagtcttctcaaagattaaaatgttattgattattgataacagttactatttcagtattattaatgtattaattatataattaatctgacatcattatttaactttaggcttgtggtaacagggaaagaacatttttacaaatggtagtgtgacatttttcattg

SEQ ID NO: 476336 - DNA, 1089 bp, Homo sapiens
ctttttttttaaggttaagaatacaaagtgccttggacagcatctgggagagtcattcaataagtggtggcgttcctgaggcagacactaacacgggtctctggcatgcagctgccaggctgcgtttaccacatgcgctgacttctctcccggcagttccatgacgggaattgaaatgctttctattgaaagacacaaacacatggatccatcaaggagagctgggggtgtgtttctgagcttggcatcaaggctgatggagcctccgtccagcaggaagagaccgaatgctccttacgtgacgtacctaaataaagacccatcagccccgtgctctctgactgatgcactggatcacttccaagtggacagcctggatgaaatcatccccaatgacctgaagaagagtgacctgcctccccagcatgctccccgcaacatcaccgtggtggccgtggaaggttgccactcatttgtcattgtggactgggacaaagccaccccaggagatgtggtcacaggatcagatcctgcagtgagcgtgaccataagctcccgctgggccacacatttgtccctttttggagtcagccctgggcttgtgcctctgcctctttctctcctttcacgtctgttgggtgcttccagacaaatctgggtgcttctcagttccttatgtgggaataggaggtgatgaaaaaatgcccaaggatcttgagcctccttggcctctgagatgtttaagttcactctgccaaggacatatttgaagatacatcttgaaatttaagttcttatggaaagagaattgatattttctgtgaataattgcaaattttttttctgggcctctgagctgtgtaagaggaagaagtatggctgtggctgtgtgtgtctctgactgggaggtagcggtcgcattagaggtcagagtttgacattctctgccattattgtgctagtgcagttcgcacaattcaaaatttctagtgcttgtcttggtgttcccactattatatcttacaatgaaaaaatgtgtccaagaatatccaaagagcatcttctcttgtggaatttgtacagcagcgc

SEQ ID NO: 476337 - DNA, 499 bp, Homo sapiens
agagtacttggggtgaaggcgaatgtgcaggagtgggccccatcatgaaacccatgagcctaggagctagacggcactgtgtaggcactgtctgctggagtttgctgtttgcctgggtatcaccagagaaggctacagaacggcaaagattgctgcctattccttcctctggaagcttcatcccagaggggcacctgccagatgccagccagagttcttctatgccctgccttgagaagaggaatctagagaggcagtctggcctcagcgaccttgctgagctgtggtgggctctacccagttcaaacttcctggcgactttgtttacactctgcaattcaaacatgatggtgaattcaaagcagctttgtactctagaagctggtgtagaggttggcagaaggtccctaacagcactggttgctgcctttggactgctgtgtgagagaggggagaagtcctgtcttggttagcctgttatattttaaagtctttgggg

SEQ ID NO: 476338 - DNA, 597 bp, Homo sapiens
ggaggcctcacactaggtgtctgaatgtgaatttacaaaccaaggctccggtctcactgtaccaggtctgagccccagattctcaatgcgttgtgtaccaggtctgagccccagattctcaacgcatctgaacacccacgcattgtgtcagagaatttattctgcacactctgtggctgaaattcctgttcttccagtggaagtgatgtgcaccagctcctggaaggaccgcctcactgccggtgggaggcactccagcgcccccttttcctgctttggaggttgtgagggcactgggccattccagggtcatggtgccttccctcctttaaggtacatacagctgaaagcagctctcaagtgtgcttttaggaaatccaaccttgggcccaccttagaccttttgaattggaatactggaggaagtcaagataggcaagaagtggagtggctgagacgacctaggccaggcctgctggcagaagctgaagcaagctctagggactaaagttagcacctaagaagggtctggaagccagaattaccaggtctagcataaacctgtggacaggggtccagagctttagttggggtttc

SEQ ID NO: 476339 - DNA, 541 bp, Homo sapiens
gcggttgtgctgttacttcgcaatatgcatgggcgttctctggcagctcagcgttgtgtttctgttcctgtcacttctcctaacataaaccctcctcatttccaatttcctggacttctatggatgtttgatcttcctaatggcagaccatttactcccattggaagtacctttctggcctctccaatgaggtgtgctgagcatctgctacctgaaacttccctggcttgtctcagagacaagggagccatgccaccttctacaacagcaaagctgattgctgggagcttcaaaatacatgaagaaaaacaaatagaactgcaagaagaaatagacaaatccaaaattatgctcagagattttagtatccctcctaatagcacagaacaagtggagagaaaaataaggaagactacaaaagacttgaacaacattgtcagccaaattaaccttcttgacagttatagaatgtatcagccccaaacagcaaaatatacattcttttcaaggacacacagaacatacagaccaaggtagacca

SEQ ID NO: 476340 - DNA, 777 bp, Homo sapiens
ctcagaggagctgcttcactggagagatatgtccccattcaaaatgggtcagaacatcaacaacgcatttggtccagaaactgctaacaaatgtacagtgcagcagaggttcaagaagttttgcaaaggagatgagagccttgaagatgaggagtgtagtggctggctaacggaagttgacaacgacccattgagagcagtcatcgaagctgatcctcgtacaactacgcgagaagttgctgaagaactcaacatcaaccattctacagtcattcggcatttgaagcaaattggaaaggtgaaaaagctcttggattttatacaacaaccagcaatgactagctccatagttgaaccaagaagaagctccaaagcacttctcaaagtcaaacttgcactaaaaaaggtcatggtcattgtgtggtggcctgctgccagtctgatccactacagctttctgaatcccattacatctgagaagtatcctctgcaaatcgatgagacgcacggaaaactgcaatgcctgcagcgggcattggtcttctccatgacaatgcccaaccacacgtggcacaaccaacgcttcaaaaaattctctaaggtgaacaacattctcatttgtcctggactggatcctggattgaagggattctgggaacaagagacctttgctgcaaaaactgggaaagtcctggacaaactaggctcacctctcagcccactcattggcttttcattctatgagtaaagcgaagtgcacatccgctgtcttgctgt

SEQ ID NO: 476341 - DNA, 751 bp, Homo sapiens
gaagacagtggaattccaaccctgccagagtaaagagacttcaataacaccccagactggattgggtgggatatgtgtggagagagagcctggtttggcttcaaatcagaaaagttagcaagaaaagtcagtagggcctgcgttcttcaacaggttgtcactgtgggcaacaggaccatggtcctgctggagaccctctgtggccttggggcattgcattacagcaagctgatgagagggggcctgtgcagcaagcacggtggcctcatcctaagcctaagccctggacccatatgttctattgtccttggaagatgccattgctgggaagcaggaggcagttcctcctgtctggctcagactgtggaggctttcctcgcagggtcctgctccctgtgtgcccctcacttggtccaaggcttagaggtcaaatgttccactctcctcctgcgggtacagggctccagcagccctccccgggccactgcattgccaaccttgaatccatacgacatcctgggatccagggccacatttttaccttgaaaggccccaaaaccagagaagatgagtcctcctgagtcctgcattagttgctaaaaatgatgctggatcatacattaagcataaggaagtttttcaaagctatgatttgcatgtgataactactttactttttaaaaattgcttatcagattcttaatttttttttcctgtacctgctttgctggtgctataagtatgttcatgg

SEQ ID NO: 476342 - DNA, 562 bp, Homo sapiens
ggaaccatcttcctgccccttcttgaaattggctcccatgattgctgcagctggcaagtctgaaaccttagggccggccagcagctggaaactcaggagaagacacctccagaaagctcctgtttcaaacaacacagtggaaagaaccctacctctaaggcaagggagcagggctgctggggagctggaggtgttacgggaaagtggtccggatccagaccccaagagagggttcctggatctcgcacaagaaggaattctgggcaagtccatagagcaaagtgaaagcaagtttattaggaaaccttgctgggctgcacgctccatggggctggatcatatccgctgtgaccagtggattcccaacctctgtggcagcacctgtgttcctttaactgctgggctgcctgtgattaaagtggtcagggaggggcagggtggttgtgctggagtcccagatttggtggccctgtccagtgaggagaagtgaggaccagtgcctgcatggagaacagcctggacactttaccattaggtgggtgctctgtgcttggggtctgga

SEQ ID NO: 476343 - DNA, 483 bp, Homo sapiens
atcaagtttggacataggatttcatgaaaaaggttcccccagtgcacgacacttttgcatttacagtaaggtttcagaggagatgtatactgcttattaaaaaatcatattttggtcttttggccggaaccgccatcttccgtgtcaccatggcaaaactgggagtctacgatgttccccagcatgctgttggcattgttgtaaacaaacaagttaagggcaagattcttgccaagagaattaatgtgcgtattgagcacattacgcactctaagagccgagatagcttcctgaaacgcgtgaaggaaaatgatcagaaaaagaaagaagccaaagagaaagaaccaatgggaaggagcctgagctgctggaacctattccctattaattcatggcataataggtgttaaaaagaaaaataaaggacctctgggttgtaaaaaaaaaaaaaaaaactcatattttggtcataggtagaaatgt

SEQ ID NO: 476344 - DNA, 489 bp, Homo sapiens
tttcagagagctcactttcacctggcccgggtagagatataagatgctaatgagacctgagatgtacgaacaagcatgtacagctgctgtgtgtgtgcgcccagaggaccacctagaacatgcttaccagagagaagataacacagacatacaggagaagacacagagaagcccacgggaaggtggaagcaaagattggagttggagaggttggagctgcagcaagtcaaggaatgcccggagccaccagaaactggaagaggaaggattctccctgcagcttcaaagggaaagtggccctgcagacaccttgatttgggcccactggtgcaatgcagttctgacactcactaccctgtgccctgtgttaagggcacagtcctccatggactgccctcacttcagacaccagctgctagttcagaggtcccagggctacccacactcctgaccaactgctacaaatttaacgtttcccaccaattatca

SEQ ID NO: 476345 - DNA, 531 bp, Homo sapiens
aaactttcctaacatccttgagtaggctatatctccaccatgcgctctccttacacagtgcacatctcctgcacagcatacagtgacccgcttaagatccacaactcctatagagagcagctgtgcggtacagctggtttcaatctggatttgtatgactccaaggtccacacctgtgagtacaacacgctggactgtccacggcaatgtggcctctgcccggaagtgaaccttgaggtggctgacccttcttcatcaagcagggagctgtggttcagggcaggagcccagggagcaggggcgatgcagggtgtcactgagctcagacctcctgagtttgtgaagtccaggaagccccaagttggcagcggccacatgggcaattgtctgagcaaggggaagaggtttctgggccactgtcagtacaaacaggggcttcctcaaaggcatcagctgcaggccgaggaacgggagagcgggatgaggcagtgagggtctttggaggagttctgaaagcttgtctggggtccc

SEQ ID NO: 476346 - DNA, 672 bp, Homo sapiens
gagaagatcttatgaacacaaagaagaaagcaacagacattggggtctgcttgcatggggagggtgagggaggagaggagaagaaaagaagagtgagcgatggccctctggcttcaggggagcccatggttagcaggccacttaacaggagaagcccttcctggtttaaaacttcatctgtttcatgttatcctcatttctttccagaccattcttcaccctccttgccttctccctactggcatctcaggcctgacgtcacggctgtgtttcaacaaaccttcatgttctgggctgcatgttctggtctcccacaaacagatggcattccagccactcctcaagaggcctggcagttctgcagaagtgttcgtgggctgcctcaaggaggaaaagccaagaatgagggctcagcccccaacccaggcctcaactaaagcagctctgtcttcatctgatttaatattagcctttagagtaatgtttcgtttaaagaaaaaaatccatgaacgaaacattcaaaaaccactgcttagtccaaaactagaacccttggtctaacacattttcctgtgtcttggggaatatttatgctgaatatttaaaatctggactgtttagaaagttctgattgcacttccaccaaaagcccagtgtcccagtgggtaatac

SEQ ID NO: 476347 - DNA, 738 bp, Homo sapiens
aggccatggccagtacactgtctgacaatttacagagtgtttggtcccttcagccagaatgctgtgcaagactgcctcagaacaagaggctcattgtattccaaaggagatgcagcaggccactctaactctacatcatcagcaaaggccttgtgggtcaggttctccttctgctcagttctaccttcttcccttcatgacaggttttctaaaagttgagagaacggataacaattttatccagaacattttggcaaatatatatgtacagatccctatgaaacttagtgtcttagccaactttcatgttactgtgacaacaaggaacacccacaaccacatgtctgaagactccggagttctgcccctggtgaggggctacaccttcatggagaaacacacagaagaacaacaaaaaggaattgtcagtatcagctgggagaaaccagatacagaattacatgacttatctgaggccatatagccagttcacactgcacccaggactgggacccagatttctgaattctgaggatgatgtttcttccatcatgttaaaatctccacttcaagctttcagggaatatattgctttgtgaaatcaaatgtatgctatccctgatgataattttttgattaccccaaaatatttaatttaccaatgaatttgggggctataatttgaggcaaaaatgatgtggctcttagtgtaaatttattaccatatccaaatctctc

SEQ ID NO: 476348 - DNA, 596 bp, Homo sapiens
ctaagagtgttgaaaaaatggaagtctcatgtgcttctggtggaagaataaattggtacaaccacattggggaacaatttgtagtacgtgtatgtaggagtcaagtcattattgacagcagaatgtcccagacattgttgaaagggggaaatacttcctttgaaaatgaaatgctgcctatctgggttgacctgctggggctagtttcagagactggctgttttctgcaccctttcttacaaaatagtcctagcagtacagatgctctcaacaactgcctcagtactgaagctacacatcagctagatctacatcagataatgagatggaagccaatgactcagcaagccagttggttgtttccaaatatacacacctttgttttccagagtaaagttttacacaaaacgatttcaacacacatggtggcagaatatcaaaacaactccgacagtgacatttggctaaagtgatgagaggtgggattttaatgtgcaagcttgattaaaataataagtttcatcattgctactttgttttgataatttaagtgcaagtgaaaaacagcagaagtttaattaattattttcaaaata

SEQ ID NO: 476349 - DNA, 1047 bp, Homo sapiens
ggtgtacaaatgattttgttacccaggtagtgagcgtagtacccaatagtccaataactaggatccgtttgcagcatggctttaatgggaagccgcttggaccatagacgctataccaatgctccttcaaatagcaggcataaaataagaggaagaacctgtcctcacctgcctccttgtgcaatcatcacaaagacaacttgccctgtaacggaaagtaaagatttaaatttacttggtaccaatggcagtgatactgagcccttaaaggtagtgttctgcagggagcaggaagtatttattgagggaacggatgacggcaaggttgtgaaaggactagattaccgtattaatgtacttggacttcagcgttcattctacagaaatgattgtcgaggaactgccttagatattggcaaggatgtgttcaatctgtactgctttggtgctaataggatggtctcggaattacaaagatacctcaactctcctataaaatgttatcctgtgatgtccctggatatagtcaggggctttaatgtgaagttgaactgaattcaaatcttaactcttccactttctgcacaattttttcagttaatcttattcactaaaatatttcaataagttagtttaccagggaattaaatctactgcttctatgttatactacaaatccatttcccctgattgtgtcactaatgaagagctaattttcagtctgttttcaagtattttcccacatatatttattgtcttctttgcttttctttctgtatatcttaatcatagactatatttatgatattttactgttcatttgtctttttctagcatatttgtattctaacttcaatcattcaataagttcttgggcttactacagagtcatatagatccaaggttcacaaaaagatccaaactgatacatatataatgagaaaagaattaacaactacagtcacaaccacaaagccaaacaagcaaagagaaaaaaaatgagaagcaaagcaaaggtaaatttagtaaataaactgtaatacatcc

SEQ ID NO: 476350 - DNA, 880 bp, Homo sapiens
cacccctggaataatgtatattcgtcagtttcagaatcctaaatggtgtaagaaaatcagtttaattttgccactccactaccttcagatctctatcacttttgacaaaaaggcaacttttaattatattgctgctcttctgtacacagtgagtccgttctcttttgctgcttttaagattttctcttcgcccttgactttcaacagtttaaccataatgtgggttctacacaacgaaaaaaagggttacagaccctacttcctccatgcagcttctactcttgcagaaaagggtagtgaggtgttgagagttaattgggtacacactgggaagaaaggatttctgccagcaggtcccagagggcgcatgttctatttcctggagaccatcagcattggttctttttctagctttttcaaaatggaacatgattttagacctttcttccttgctaataaattcctaaagctataaattttctcctaggtactgttttagttatatttccaaattttaataggtattttcattttcattcagtttgaaatcatttctaattttccctttgatttcttcttggacccatggattatgcagacatgcagtatttatttgatttctggtatttgtggtctttttagatatcttagtgttatacatttctaattcaattccagtggtcaaagggccacactctgtgtgatctcaatcattttaagagtattgaaacttattttatggcccagtaaatggtcaaccttggtgagtatattatgtacatttgaaaacaatatattttctgcccttgctgtttgaagtgttatgtaaacatcagtttacatacaggtcatatttccctatcaatcaagctaccaagac

SEQ ID NO: 476351 - DNA, 1741 bp, Homo sapiens
gagggtccgtggcttcattcttgaagttaattagatcattggaggtgttgtcttcactaagaaaaggtgcaggggggatcatgggaagagacgcattggatgcatctgattcaaaaaagtgcctgagaccaagaggactaaggaaaaaaactgctgacgctggggtgaagaatcttcctagggtgagtgtcacagagacaacgagcagtagaacagagcaccagggagtcagtgagaaggaaataggaacgagtaaggcccttctccctcttctagccttgccgtttctctcccgcgtccctcagctgcaggtctgttggagtttgccagaggtccactctagaccctatttgcctgggtatcaccagcagaggctacagaacagcaaatattgctgcctgatccttcttctggaatcttcatcccagaggggcacccgcctatatgaggtgtcttttggcccctacttggaggtgtctcccagttaggctacacaggggaaaatagaaagccaatatattgagctgaaatatctcaggctttaaatgaagacggtggcccccaactaatgcatctccttctttgtttcccaatgcaagacacagaaatctctcaaggtttcctttaagaatatatttctacacttttcagaataaagtttctgaagtccattctaggggcagtgcacctgaactgaagttgtaattcttggagagtttcagaatgggaatgcagacctgggtgctagctactctctgcatgttaaaaggaatcctactgccatttgttttcctattaaatgacatttcaaatactttattataaacataaatcacatctttcaagaagttatttagattatttctggatagttagccattataaaaattgctacattgagtaagcttgtgcatggcaagttcatatattcacaagcatatctttgctatacattcctataattgtggggtcaattattaggtgaatttgctattttgaggaatattagcaaattgcttttcatagtggttgtaccaatatacacttacatcagcagtgtacaagagtttctgcttcatcaaaccatccccaacataatgtattaccaaactttttgaaatttcacaaaatgagagttgacaaatagtatcatattgattttctctcattatgaatgaggtggagcttctattaaaatgtttaacaagcacttatactttttgtgaataaattgttcatatcctttgtctatttcccattgtcttattgatatttctataagttagagttagttctataataattaaaattacaaaatatatgtttttgagttgcaaatatctcacaaagttctgtttccattagtatattttcatcattaggatttttaataagagcttttaggcatttcaacagtttgaatacattttaattaaaattttacataaacataaggaatttgaaacattacatgtatacagatcaatgaattttcattaagtgagtaaagttaacctttgtaaataccattcagagtaagaaatagtgctccatagatacttccccaaatgacacttccagttactatcagttcctccccaaaggtaaagccaccaacatacatcagttacacctgggtttaatatttacatgtttgtttataatatttattatgtttattatatataaaattatatgatttcaaaaagttatataaagaatctgtattttttgtgtgttt

SEQ ID NO: 476352 - DNA, 730 bp, Homo sapiens
gggtatgcttaagttactgcttaatttgacgcctagttgtccacatagcataactatttaggttgcaaggtgacttgatgacccacagtcaaacggtcagtttccaacaaagcccagtaacaggccaagagctgtctctcaaaaggaaagtagttatctgcagaatatggcagaaccttgctccaaaatcctagagatctccgttgtgattcacctatgggtgcccgccaaaggcgccaaacagcatccctatctgacactgacacctcaagcaccattgaatctgctgggtcatatggcccaagttgcaaagcagctagcacagcagcctggacctattgcagagccttctactgttctggaccccactcaaaactggcagccctttggttcactcaataaatgggccagagtaacacacccaaatgaggaatgtgttgcctcccaaatccaaacaggcctactaggcattgtttctctttcttggttgtatgaggagccaaatgcagcaacttatccttcaccttacaaggagtatacctcaacaggcctcacaccactggatccctagaaattttactgaggtagaaggtccctgaatcttcgtcagatttatttcctaccctctggcacgcaaatgtctcaccaataagtccagtgtgtttactacttcttgcttactggatccaataagcataatatcaccaatgtaacggactagtgtgatatc

SEQ ID NO: 476353 - DNA, 844 bp, Homo sapiens
agctgagggagccggctccggtattggccggcccagaaaggggctcccacagcgcagcggtgggctgaagggctcctcaagtgccgccaaagtgggagcccaggcagaggaggcgccgagagcgagctagggctggaatcaagaaaagtctgtagtcgtaccttcctaacgtcaagtttctggctgtgacccactaaaaaacagtatggcccgcaatggtctgaggagaaatatcttcatagcaaacaagaataattctccagaaattcctacctgcctgactgcagtgttaactcacaagtatttgtatacaaagctgaaatttgttactatattaatactcttgattgttggtattcaggtctaccagatactacaagtagcaaaggcagagcagaaaattctagagaaaaacacgctaataacaggagatgcaaaagagacagaaattattctccaaccccatgtggttgtgattgagtttctcagactattttctactcccctacaagggatcccatccaaccatgtcactgaagtagtgtttgtcaggtttctccactgtaaagttactacctgcccctcttccctttccttacctctctctttggaagatatcactatagacagcccacacttacgggaggagaagtttatgctccactttcttgagggatattctaaaattctcatcgcttttcggccttttggctaagatcaagtgtaaaattctcattagttccttttattaataaaaattaaaagttgagaaaatttgtgttatgccaagagtcactaaaaataattataatgctacttaataaatattaattgagtcttttct

SEQ ID NO: 476354 - DNA, 530 bp, Homo sapiens
aaggattggaggccacctgcagaaactagaaaaagaattaccaatatgaacacacgtttcagaagaagtgaatactctttggaaccatctgttttggctttcttcataacctttgggaatgcattttggagaaagccatcacaaaacttcacagaattgtacctccttcctatggtagctgctttgcacattccagaaatttatgtctttctgggaagtgacatagcacactctgcttgcctgctctttcgcacgagggaaggaaggaggtggtactattggagctcttgttcatcctctgcttttgctcgctggtaccacaagaaaattggaaactctggaaacgtgtgtaagacatatgtcacaattatcccacctgaaggatgtagagatttacaacaacttttgccagttatcagttgacagctgcattagagctgtattcaataggtactaactcacctgcatgtccatcctattggacgtgggtagaatggcaccaggagggtctgcctgattaacataagatt

SEQ ID NO: 476355 - DNA, 1385 bp, Homo sapiens
aaccagcatgtcattctagaattatttctcctccctgcctcagttcctctctttgtaagctttggccaggtctctctacggccatgagtcagccatctgaaggaaagatagagaaggaacgggcaagacctgagagcagctgcctgatttcttctgatgctcggaaagtttgtgcatacagcttttcctgggcccacaggagaggactctgtgtcagcccctttgtccatccagtcctacagggctgcattgcatcctcatccactatcatcattactattattatcatcatcaccattattatcaccaccaccatcatcaccaccacaattgcctccaccaccaccatcatcaccactaccattacctctgccaccgccatcatcaccactaccattacctctgccaccgccatcatcaccactaccattacctctgccaccgccatcatcaccactaccattacctctgccaccgccatcatcaccactaccattacctctgccaccgccatcatcaccactaccattacctctgccaccgccatcatcaccactaccattacctctgccaccgccatcatcaccactaccattacctctgccaccgccatcatcaccactaccattacctctgccaccgccatcatcaccactaccattacctctgccaccgccatcatcaccactaccattacctctgccaccgccatcatcaccactaccattactaccattacctctgccaccaccatcatcaccactaccattacctctgccactgccatcatcatcaccaccaccaccatccctagcatcatcttgaccacccacatcaccaccagcatcacaagcataatttccaacttgttgtagagctactagggactaagctgttacactatagaagtcatctttaatgcttagtataattttgaaagggaggtattactatccccaactcaaaaataaggataatgtatctctttatatttgtaacttgcacaagtcaactagctgatgaatggccgatcctgtattttaatcaaatcagtctgaatccagtgcttatacgagctcattatattaatagtaaacattttagtatggtatgtttctaataatgcttttttcaatagggatttttgcattttaatgtatgattttttaccatgtttggttaaaagtttaaatgccaacatttatgccagtgtgttcaaagaacatctttataacctttataacctcctcattagcatcatttgatctgaagattttctgtaaattatttcaaaggccaactatcaggaggagtttcatcttaccaaataaatgtgaacatatatgaattagagaatataatttgtaaaaaaaaaattaaattat

SEQ ID NO: 476356 - DNA, 727 bp, Homo sapiens
gcattaccacctgagctccacctcctgtcatatggcgcaggggtccccaacccccggaccggtaccatggactggtacttatcagcggcggtgttagattctcatagaagcgggaaccctattgtgaactgcatatgcgagggatctaggttgcaggctccttatgataatctaccgcctaatgatctgtcactgactgccatcatccttagatgggaccatctagttgcaggaaaacaagttgtagggggcaaagcagctctaaaagcccaagggcaaggctccaaagagacacaggtgctgggtgttagaagcaaaagcatgagtggggctctcagaaaacaagttactccagggaatccaggtggagcagatgactgtccactacaatccttactgctctcaaaatttcctccagcttggactttccacctgaacttcagacccatgcatccaactgcctacttgacatctctacttggatatctgtaataggtcaattgtattaaccacagcaatcacgtgcagcacgtgcagtcaaagaaagcctttcactaaagtgtatcctcattatttgcacaatgataatcattaagtcattaaagtgaattgcaggaataaaattattaaaggttggtaatgatttcaatacatcaaattgaagaaatatagtcctttaaactttgattatagttggttttttatagaactgtttggaggatatttt

SEQ ID NO: 476357 - DNA, 955 bp, Homo sapiens
tccccagtttatgtcagggtactggtacaccttgggcttcacagagaacacacacagtgccaaccctctgctccgctgctttacctcagacttggacatcaacaacaggaaggtgaaactgcattttgaggacaagttcacattcacagcccacctggcactgaaggaagatggaattactatcctctgctcagataacaaccgaggaaagaggccctacccaccctatcccataagtgaggagggagaggaacatgattttaccaaactccacaacaaagatggcagacagcatagctttagatgcgcccatagtagacatcaccagcatagctgccacagagaaactcatcagcattccagtctgcctcagtctgggctgcaagcctccaaagccaagatggccaatgctaactcccaggaagcaaggtacagcatcatctgtgctaactcccctttgggtgcaagatggctacagcaggttcaggtgagagaactaagttgtgtgactccaaaagagcagaaaccaggaactggagaatggaggaccaaagatcagagaacaaacgcccaagatgcccagaatgagaaagtttcatgctgactcagaccagctttaaaaaacagggagaaccctgccaccagcttgtcaccaaataaccatccattagccaagtaaagtaacttaaaatagtacattattatctagtgataaactagtaaaaaccaatcatttcctgagcaccttgatgtgtcagtgttgtactgagtaacagagctagctgcatagtacttcattgtacggacataggtgaatgaacattcacctgtgtatgagcattcaggttgtttccagtattttactatcacaaatcatgctgcagtgccttatcttgtacttacatgttttttatattttgaaagtaaatcttcacagatttttagaattgggatc

SEQ ID NO: 476358 - DNA, 618 bp, Homo sapiens
gagggctgccagcacgctgttacctctcaatttgacagctgacacacaaagaagaaggccatgtggcccacagctgggggcggggagtggtgtcccaaatatgcctgcgcatcagagggggacatgcagctcgacaccactctggcctcactccctggagattctaattcagggagtctgagaggggatggaaaggtgaactttaaacaagccaacttaaccactgccaatttgggaactactgatttacaaagtggaacccagaacccagaaaatgaggcctgcatcctgaccaatcctcctcttgaaaatctgtctcttctatcatttgattatgatcaacgaggggtcatgaaaagcaagatttatatccatggaatatgtgtaaagaatctggatttagactcttctgagggatggtacagcactttctctgaatctgttaaagttccatttttgataataagatactcttgcccttctgggaaggaggaaaaaaaatcctgtttcaagaatatcgctcagtactagctagatgcgtttccaaatgtgagaaagtaaaattatcattttaatctgcctcattctcactttttgggatccaaagggtagaataaa

SEQ ID NO: 476359 - DNA, 489 bp, Homo sapiens
tcccgtggcccagtcaaattgacacatacaattcaccgtcacaatggggatctcttcagaagcaggctcagaaagctccccagctgccaaaaagacgctgagaaaaactgagacagaaaaaagcattcaggatataggcattcctcaaaagagctacctgccaaattttggatggcagcaccccaagatgaaaggagcttggatccccaagtcattatttggaggagagcctctgcaaagaactgcctgctgtgcactggactgtgagcctccatgcttacagtgccttcagctgacggaggccagaattactcacctgccattctcaaaacccttcttattaaaagaatatagtgatcacttagttactttagactggtggagcctgtgtgttctgctggagttcatgaatattacaatagcagaaaaacagcacaagttggctctctatatccttccagataatgaagagtttcttaggggctgaat

SEQ ID NO: 476360 - DNA, 602 bp, Homo sapiens
cccacagctcattgacccatgatgtcctctaccctctgcttcaccaaagacacagcaacagagagaaacagaaagaggaagaggaaagcagagggtaaggagaacccatggggcagttacattattacattggattctcatagcaatcaatgctatgcagatctctcagatgagttagaaaagcaggaagaagcagagacctctgtcagcaggcaggaaaggtcagcccctggacaaatattcagggatcagttcctaagtgtgtggggagccccctggaaaccagttgctagcaatggtcctcttactgggaaggggtcccgatccctagatcccaagaaagggctcttggatctcgtgcaagaaagaattcagggactcagatgccagtgggaaatagagacaagtatagattctctaccacccagtgtggtaagagtaatgatggataggaaagcagcacatattacagtgttggcagccatctgtttcttcagttgcagttggtaggtgcataggtttatttttatgattctgcatcataacgtacgtgtatattacatactattttgatataccaagtgttgcataatttaaaaggc

SEQ ID NO: 476361 - DNA, 665 bp, Homo sapiens
ccgcgaggaaaaatgctgcttccagcacgggaaatctaccgatgctgacactgcttcccctgggctccctggttctggggatctgctcagatgacagctgccactctaagacccctgcaggcccaggggcccctcactgctgttgtctctctctcacactctgctgacttcttcctcccattgaggaccttgggaactttgagacttgcagcagtcaccactctctcatttgggagatacaggagtcctagggcagccagtgatcactcaccctggtcttcaccatccttaggacaagcgactctaggatgtctcaatgggcctgtgggagaggagacttctctcacatcctccaaacttcacactgaggaggctgctaggacctttgctttccctctcagatttgccctggcaggacgagaagacccatgtctaagttttcttgatgtttccaactctcatcttcctccctggatcagagacagggctctctatctcactggggatggaaagcatggaaactcttttctccctgttcacatccccttttataagtgttgtcttacaacatcaaggtgcttttaaatttaaaagcaaagcaattggtacggaaacacagaatgtgtgtgacttagccaaggatgcttgatcagtaggtgaagata

SEQ ID NO: 476362 - DNA, 1203 bp, Homo sapiens
gtgatctcaagatccttaatcacatctgcaaagccccctttttcttaccacatcagcctttgatcatcttccattcctccccctgaatatttctcgctgaatgattggtcaggtgacagctttaagacttagctcaaacccattggagcctggctgtccagatgacctggtgtggctggaaaggattttgccctgcatggatgtgacactgtgggatgatgtcaagggctctgggaagcgtggcgccagcatccgcttctacagaggcctcaggaagcttaaaatcatggtggaaggtaaaggggagcagggacttcacgtggctaaagcaagagcaaggagaagagagccagtggtaggaggtgccacactctacaacaaccagatctctcccttcttggcaaaagtgtgggctgccagaccaaaactggactttcataaacatatctgtatcagccaagtgagtggctgcatggattctccagaaaaaccaccttggtcccagtggactgtgccctatgaaactctcttgaccatcctcagagaaagatgcgtgtctcttaaattgatggtaaataatgaaaatccttggcaagatccatctgccaagaaagaaaacaacatggaggagaaacatccacttcttaaaaactgtggcccagaatggctcataccacttccactcacactccgtgggttagaactcagttgcatggccacacctaattgcaaaggagactgggaaagaagaagaagaagaagaagaagaaggaagaagaagaagaagaagaagaagaagaagaagaagaagaagaagaagaagaagaagaagaagaagagaagaagaaggaagaagaagaagaagagaagaagaagaagaagaaggaggaagaagaagaagaagaagaagaagaagaggaagaagaggaagaagaaaagaagaggaagaagaggaagaagaggaggaagaagaagaagaagaagaagaagaaaagaagaagaagaagaggaagaggaagaggaggaagaggaggaagaggaggaagaggaggaagaggaggaagaggaagaggaggaagaggaggaagaggaagaggaagaagaagaagaagaagaagaagaagaagaagaagaagaagaagaagacagtagtctgttgtggcggtgtggagttggaatccctagctgagcttctccatcttc

SEQ ID NO: 476363 - DNA, 718 bp, Homo sapiens
tccaacccacgacccacaggccacatgctgctaaggatggttttgaatgtggccaaacacaaattctgtcctaatggaacagcaagactgtgcccttcccctcctgacagatgtcatccaaacaaacaaagaagttgccttcaaagacctggatgtggccattctcttgggctctgtgccaagagaggaaagatttactgaaaatgtaaaaatcatcaaatggcagggtgcagccttggagaaatatgacaagaagttcgttaaggttattgttatgggaaacccagccaatatcaactgcctgactgcctccaagttggttccatccatcttcaatgagaacttcagttgcttgacttgtttggatcacaaccaaactcaagttcaaattactcttaaacttggtgtgactgctgacaattatccagatgtcaaccaagccaagacgaaattgcaagcaaaggaagttgtttatgaagctctgaaacatgacagctggccccagggagaattcatggctgtgcagcaacatggtgctgctgtcatcgaggctcaaaaaccatccaggacaatgtccactacaagagccatctccaaccacctcagagacatctggcttggaaccccatagggagagtctgtgtccagtggggttatctctaatagtgactcctatggtattcccagtcatcgttctactcattctctgtcgtattca

SEQ ID NO: 476364 - DNA, 697 bp, Homo sapiens
tctgcagccacagctgagagctaccgcctacacatcatgctgcctctctctggattttataaatgggaaagcattactttctaaaaataattctgtcaacaagtatgggagtgttcacccaggcacagcagcatacccctcccgttcctcctctctcccttgatgggttgagcttcagccacactgggcttctccagagctttgaatgctcccagtcctttctaagcagcatcttctgtctccctgcatacaaaaacacagcccctcatccctgcaaggacactgcctactactccagctcagatggccccctgggaagcagccgctggcttcctccatttccatggctagaaatccaaaatgaaggtgttgatgggaccatgctccctctgaagcctccagggaagaatctttgctcatctctaccaccttccggtagttgctggcaaccttgtcattccgtggctggtgctgcagcactccagtttctacctttgttgtcacatggccttcttccttctctgtgtgtggtctatgtgtctccaaatctctcttctcctacggagaccagccactgaattcatggcctgccccaatccagtaggacctcaacttcacttgattacatctgcaaagaccctattacccaagaaagtcacattcacaggacccaaatttgaagctgcttctcagagta

SEQ ID NO: 476365 - DNA, 603 bp, Homo sapiens
atcatcacagaggcataccccaaggttacccacattttcttatgaacatgacattagttggcaagaaccattttgtcccaggtatatctggaagcaagaagggaattcctgtaattctccctcatttagaagcaatcaagggaccattttctctagagctgaaagggacctcaagaaatcgtctaattcagcgctttgcattgcagcaaataagatggtttaatcctcattttacagaagaggatgttgtttctgagtctaatacacaccagaagcacctggagggctcctcaagaacagatggctgggcctccccagagtttctgattcagcaggcctgggtgagaccagagaatctgcaggtacaacaagttccaggcgatgctgatgctgatgctgtgtgtgcaggcactgcactgaaacctccacaaaggcgcttacataagggctatgcagggtgaagattttgtagccaagcatgatttattcagtttgaaaattttcaaaatttgaatggcttatttttctcatagaatttagatgtgtaagcatgattcgacagccaggtggttcatggatttaaaactaaattttacagagctc

SEQ ID NO: 476366 - DNA, 755 bp, Homo sapiens
tccaggtctttagagaaactctttcaaccaattgccaatctgaaaatcttttgaatctacctacgacctggaagcctcacttttaactctacacgatgccattcacagtcaagagaaatgtaaacaaatgtaaagggggcagtattaaatcccaactgcataaaatttactgtgaaaaagcaaagtcattatatgacaaccgaaagcaaaaagatgttgaaggatctaatgctggagaatttaatgccagcaaaggatggtttgataattttagagaaaagtttgtctttgaaaatgtcaagataacaggagaagcattttctgccaacccagagacagcaaagctcagtgaacccaacaagaaatataagaccacaccagggcacattataaacaaattgtttaaaaccagttatgaaaagaaaataataaaggcaacaagaggaataaaaacacattatgtgcagaagcagcaagataaggatgacatcagccttcttgttgaaaataatgcaaggttctgaaattttacaattatattttatttaatgttagttttttcttcattcattttagccatcaatggaacctttcaatctgcaaatgaatgatcttcagttttcgacatttttcttgtataacttatgtgataatatcacccctttaatttttctatttttctattttactagaattttattaatccatttaggccccctaattttcttttctttcatgtttttcatatttttgtg

SEQ ID NO: 476367 - DNA, 615 bp, Homo sapiens
tgtctagagcccttgttacccgctctggaatcctgacagctcctcatttcctctatcccaaaccgtggctggcgcacaggaagacaatatggaggaggtggaaacagttggatttaacgagattcagtgttgggcctgccgtttaccggcattgatgggatacatctcttccctgagtctcagtttcttcatctgtgaaacggcagaaaaacagagtaagaaattgactctagtagaagctcttgtgagacttccttatcagcgagctcaatcatactccccatcccaggtaaatggctacgtaatgtatccagaacaccttcttgctgaaataatctcagtcgggcatttggctctagatccctatttgctgatgaccctcagatggtttcactgtttccagtctttctcccacattttaaaacataaattggatcacgactctgctctgcatagatcaagaccaatagcttctcatcaggataagatctatacaccttaccccagtgaacaaggccctacgtgatgtggccactgcctcgttctccaaactcatgctataccattctccttttgctatggttggaatattttgtcccctccaaattcatgtgt

SEQ ID NO: 476368 - DNA, 1057 bp, Homo sapiens
ttgtcacgagtgagcacagctttggggctggcttctcccgagtgtgccatgaggaaaggggtccagcgattcttccctgagagaaacccctgcactgcgggtgcccattctcgcctcagcctacacctcctctgtcctccaacacagctgatgagcggccggtttatcgagggcaaccagcttttcaaaggaagtgccccacagatggcgctactaagcccggctgtcgggacacacctgagactgtgcatccaggccacgctatccctcccacctccaccccttctcttcctccaaactggcccccacacccatcctctctacaccatggtcagcctgctgtgcgggctccacgtctgggtcaaccctgtgtgggcagagaacaggggcagcttccagctccagaaggaaatcccagctcctctactactcctttccgatccaggacacgagaggagaggactccccttacggatcccatctcctcccctgaagcatctgtgactgtgcaggttggagaaggaggcagggaagggggaagaaaaaaaaactaccgttgagatgacataaaacgctttgtgcaaatgatcgtcctccaggggtattccgtgaagaggacacttgtcatatagccaagcatgcttgcagaaaataaatggacgtggtcagacaaatatttttgtgtgtttcattgatttgaaataaactatcagaaatttctaaacaaatactcgccaaccttttggaaaaaaatatggattgaatctttttttttaagtctagaaagtgacccagtgttgtgggagaaatgtgaaaggcaggcaccatcgctttcacggcacttggggtcatagtctggatgaccaagattcatttgatcctcaggggtcttttatgattggactgcaagtaaagctgccagccaaattttataacacaaaaggtgttccgtgtgctcacagcacccctgcttaccagatgacagaatgtcttgaagattgtgcacgttcctcaaaagacacatttagacagtcatggtcaggcagttgatagactc

SEQ ID NO: 476369 - DNA, 758 bp, Homo sapiens
agtagttgcagatatgggtatatggggttgcagagggacatgtcttggaaccaatccccaacagaccctgaggtttggctgcttccagggagctccacatggaagcaacaatgtgaggtttggtcagaagcagtgggcggctcttccagggaatcggagccctggctgctgctgtgggaccttctgctccacacctgcacgtgtgctggcttccgcttgttaaatgcaggcctgtggacctacctcccccatggagcggtggtctgggtcacggtgagaagcagtgcctctcaacccctcaagccacaaacaaaatcaagagacatggaggtgcgcctgcgtggggtggacaagaagacagcctcgacccacaaaggcaacttacaaagcctgatcataggaggtgcctgcttctcctttgtcttctgccatgattctacctgcagcttgcgaaaggaacaactgcccagctgcctgatagagggctgggggtggagagcaggcaactgttactatgccaagagtcaattataaaccattcacacaactaaaaggcaaagaacttacaaatttaactcatttgatttttcaaaatatgaagttttgcagtcaaatatactcattgtttgaaaattatgtgcatgaatatatttatgcagaacattttaaataaagctgtgtttcttttctccctggatactatctttatgttttatgttttgattgcaagctttatcaattaaacttttcacgagttt

SEQ ID NO: 476370 - DNA, 1374 bp, Homo sapiens
ggtccagctattccgaggacatcgtgggctctcggagaaggcgacgcagctcctcggggagcccaccatccccgcagagcagatgttcctcttgggatggctgttcccgctctcactcccgcggccttggacgtgggcgctctttacccctttagtcgctctgggtcgcgagggcggctcccaagattccgcaactacgccttcgcgtcctcctggtcgacctcgtatagtggatatcgctaccatcgtcactgctatgcagaagaacggcagtcagcggaagactacgagaaggaagagagccatcggcagaggaggctgaaggagagagagaggattggggaattgggagcgcctgaagtgtgggggccgtctccaaagttccctcagctagattctgacgaacataccccagttgaggatgaagaagaggtaacgcatcagaaaagcagcagttcagattccaactcggaagaacataggaaaaagaagaccagtcgttcaagaaacaagaaaaaaagaaagaataagtcgtctaaaagaaagcataggaaatattctgatagtgacagtaactcagagtctgacacaaattctgactctgatgatgataaaaagagagttaaagccaagaagaaaaagaagaaaaagaaacacaaaacaaagaaaaagaagaataagaaaaccaaaaaagaatccagtgactcaagctgtaaagactcagaagaggacttgtcagaagctacctggatggagcagccaaatgtggcagatactatggatttaatagggccagaagcacctataatacatacctctcaagatgaaaaacctttgaagtatggccatgctttgcttcccggtgaaggtgcagctatggctgagtatgtaaaagctggaaagcgaatcccacgaagaggtgaaattgggttgacaagtgaagagatcggttcttttgaatgctcaggttatgtcatgagtggtagcaggcatcgcagaatggaggctgtacgactgcgtaaggagaaccagatctacagtgctgatgagaagagagctcttgcatcctttaaccaagaagagagacgaaagagagaaagtaagattttagccagtttccgagagatggtgcacaaaaagacaaaagagaaagatgacaagtaaggacttacttgttgcacagcaggaattttaacaacaaaaattttatgtgaccaaaagtgttaaaaggctttacagtgctactgtacttaccatattagtaagtccctcaggaaaaagcttcttttgagatatctttagcagcttattttttgttattttaactttaaaaagtaatatgtgcacatggttttaaaaatattcaaccattat

SEQ ID NO: 476371 - DNA, 684 bp, Homo sapiens
agactttcaagtggagatcaggcgactgcaatggggagtgagggtactgaaggggataacagagctgaggagtcgcaacagagaccgcatggcccacatggtctagaagatttactagttggccccttagagagaaagtctgtggccctgccctggaagctcaatggtgccagcactgagctacatccactggcatctttctacttgcccccactgacttcctgtgtgtcggctccattttcatactgtgtgggcaagagggtggcagcatcacacatgagcttctggcccactcagcaggggaaaggggaaggagaaattctctttcccactcagcgcaaagaaccgagattgagtcccattggtctggcttggatgtggtgtctgtctccatggcagagtgctctgatggtccaggagtgggtcactcaccactcctggagctgggaacccacctgtcactccccagtctcatagattgagcaggggtcaaggcagaagtcgatcatgcagggacacatagaccatgttaaaacttgaagttttattctatatttagtgggatcatgtaatcagatttatattttaaaaagatgtctctcctggcaacatagagaatgaactgggggggcgcaagagtggaggtggagaggctaatcaggggtggttctgctggaaaaaaaa

SEQ ID NO: 476372 - DNA, 1366 bp, Homo sapiens
caagatttgcaatttccctgctgcttcttgttttctgcactgtgcctccttcatacaaccttctgacgtctacggccccagatctaaagggatgaggctccatcaaagttcagcatgatactcaacagatttcagtatcttgaagcccaggactttttgggactccgactggctctccttgcccctcagcttgcagcctgcagacaacctactgtgggaccttgtgagcatgtgtctactgttaaagtgagggcattgattggaaaagaatgggatcctgcaacttggaatggggatgtgtgggaggaccccgatgaagctggggacactgagcttgtaaactctgatgaacttttttgccagaaggagcagcttccccatccccaggtaactgtgcactggggaaaaggaaatgatcagacatttcagggactactggacactggctctgagctgactttgattccaggggacccaaaacgtcactgtggtcctccagttaaagtaggggcttatggaggtcagaagacagatggatcttggagaatggcagtggattatcataagcttcaccaagtggtgactccaactgtggctgctgtaccagatgtggtttcattgcttgagcaaattaacacatctcttggtacctggtatgcagccattgatttggcaaatgcctttttctccattcttgtctataaggcccaccagaagcaatttgccttcagctggcaaggacagcaatatgcctttacaatcctacctcaggggtatatcagttatctggctttgtgacgtaatcttatttggagagatctagataacttttcacttccacaagatatcacactggtccattacatggatgacattatgcttattggacccaagcttgctttatttgggtttcataaaaattatgaggatatgtaccagcaggtacatctacaaaaggacattgtaacttgtctgcccttggtgcctgagaattggtagattcttactaatggaatctctctgattagccagaattaatgtaaatggaagattagccaagtatttatcttttctgatctgagaagcttcagttcttattttcccaataaattcccccaataaaactcaatgacttaatggaattaaatacacagaagcaccgatgtggtttaaaggcagcagtccataactgactcaaaagaactgtatgaatttcactcattttatctgaactaggtgttgcattaagatctaaatcataaaaaagttcagaatgctcaaaaagcatttcttgaaacttttctttggattttcaactatttatcactgatgcctaccatatgcctctttgctatcagcctcagtg

SEQ ID NO: 476373 - DNA, 1487 bp, Homo sapiens
ggcggccacccgggctccctcgcgctgacctaagtattcaaagagacatgggctccaaacccaataacgttgtggttcttgtaggctcagagagttcactcaaggacctagggatctatgatcagcatgtggcaaagctggccattactttgtctccttcagagcagcaagttcccccaggccctaggtgggcagaggagcccctttctgtggccaccaccaccactgatccatgtggggttctgccaggccaccaccattgttcacttaaagcccaaggtcgctttagtcagcttgtggtgaatgctgccagacccggtactcacccttcagggccactggctcccgtttggaccaaggcaggtccagaaatgttgatcaacagccttggcctggactcagggaccccaagagcctgcttggtgctctaccctattgtggttgagctgatggagaagccgatgttgctggcgacccacactcaatgcagcttatgccgtggagcagataaggttatattctgtggttctgaggtttaggactccaacatatcatcatttgggggcatcagtttaatctatggtaaccatgtgtctttgaaaaaaatacttaaaaaatttgtcttgcaaagagagaaattaacagcaattaattaaaagaagtgaaatgaggtatttaaaagaaatgatactaagcaattaaacctgttatagctaaaaaaattgtcaatgtttttataaagcaacacatatattaaaaataattgttaaaagtgaagatgatttttataaaaaagaaaaactgtacataaaactgcagacaaaatctgtaaaatactggaaggtgtgctgaaaaatagaaggtataaaggcatccaacattttcatctttcacagttggagatattagctgttacattctttacattaacattatttctcaaatttattattttatatttaaagtgaattacaagtcgaaaaaagaaaataattcttaactttcaaataagaaaaagaatacaaaagtgtaatgaacacattatcagtagagcaacagaaaaagaaaaacaaggtgaggaagaagcatgaaaaagtataaacttaactcaggtaaaactaaacatatcaatatacatacaaatacatattaatgttcatattaatacctatgaatggctaaattcatattaaagctacatattgaaagacaacacaaaatttgactgcacataagagaagcacctaagcaaaatgatagtttaataaaaaaagaagcatgcaataatatactgaaaaaatgcaaagcacaggagagcaagcagaggagttccagtggtagtggagaatttacagtatacataatcagagtctgtcttcaagtaatatgatattgctctagtttatttcttattcatttcctgaatgtctctgatagctctctggtcatttcaagataaatttttcattttgcatttttccagttct

SEQ ID NO: 476374 - DNA, 644 bp, Homo sapiens
ttatgtcccagctctaaggaaaagaagacagtaagaaagagattaagatattttaatagagtgttaaccgatgttcatgactgtgacccttgaaaagtattattaccttagaataaattaccccagcagtggaattgcactgtcacttagaaagccaaaggttcctcacaaaaggaggcaagttgagaagaccagaggctgctgcctcaatccagtgccctgcttgcgaagcaggggtgccactcagagaagtaagccactatcctggtccctacctccagagcagcgacacaacggttttgcccaactagatacgttggtcctaagaggagaaagctcgaaagctccacttaaggaactgactttatttggaacagaaagtaagggaaattcgagcctaagggctttctgggaaacagtggagagtaaccaattaataataaacatgaatttatgtcttatggttctagaagctaagaagtccaagatcaaggggctagcatcttgtgagggccttcttgctgtgtcatcccacagtggaaaggcaagagcctatgcacgcatgagagtgaaggcgctgaacttgcccctttataatgaaccagctcctgcaatgagagcattaatccactcatgaagtggaa

SEQ ID NO: 476375 - DNA, 772 bp, Homo sapiens
gtcccttgacgccatgcagcaattcagcaattcagcatcatatttatcaaggaagcttgcttgcatttggctctgcttccctgggtccacccacgccctgtgtccccagcttgacccgacagcttccatgaagttgtcccttggtgaaacttggtttcacagcttctacctctcaaatgtatccagaatccaaccacttctcactactttccttctcaccacttgtgaaataaaacccctggccctgaatttaaatcctgctccaagccaaatcatcatgcctcccctggattttggcattaactccctaaactgtctcctaaattgccacctttgtccacagtattctcaacagggaagccaggtgatccttacaaaatccttggtcagcagtcctcaaaacttttggtctcaggactccttcatactcctaaaaataactggagaccccaaagagtgtttccttatgtgggttgtaggattgtcttggatatacaggctcttttttggttccatatgaaatttaaagtaatttttcctaattctgtaaagacagtcaatggtagcttgatgggaatagcatgaatttataaattactcaggcagtatggccttttccatgataatgattcttcctatccatgagtgtggaatgtttttccatttgtttgttctcttattttcttgaacagtggtttgtagttctccctgaagaggtgcttcacatccattgtgagttgtattcccaggtattttattctctttgtagcaa

SEQ ID NO: 476376 - DNA, 1005 bp, Homo sapiens
attttccacagctttgtgaatggcagagtggtactgtgaaaatgccacaggctacacacacaactgtccccagggttggaagaagctacgagaggagccagggaaggaaggagctgttgcaagcctggttgctggctcatgtcaacaagggaccaacatttcacagtctcccactgggagcagttttcaaaacagcatcctgactgctaccaaaacagggaagaagctggggcaagtaaaaatgctgattgctgaagagaatcttgagttttcttctccaattcaccattcatttggttggtgtaaacctttcgcgatttttcagagctctaaaagggtgggttatgatcatttcggcttgctttttaatgtttctgctgggagatgggagattggagctgcttattctcccattttgctgatgtcgcttcttggttactcttgatataatattttgtgcttttataggaaagttccttgagattagtagctctctttaaagctacaaattttcctaaaggacttgattttaatgcttgcattttgccttatcgtggcaaacttatgagaaatcacctccagaaatatgtgacaaacccagtgaattaatacaaccttctataataacaatttatcacctctgagccagcttgcttattctttcttgcccatccatatttaattaataccctctcactgccaaattcattttatctctccctagtctctagtttttcttgctctgttggcataattctcttctatctgcaaatttacacaaatatatcagtttaatttagtatacaattattgaatgatatctatatactagggacagcgactgaacctggattacaaagataagtaagatttagtttttgcatcaacatatttaccagttttgacaacaacatatttaccaagcacactttggatttttgtaagctatctatttctttactatttcttgctgaatacatttcatactaactctttcttccattc

SEQ ID NO: 476377 - DNA, 694 bp, Homo sapiens
caccacttcctctggccctagttgagctgctggttcctggcatggcctgccttctgcaggcaccattgatgtgtctccattgtaaggaacttggagggcatttccgagatctttgcagcaccctctcccataacaggcctggaggcctaggagggaacaatggtttcgcaggccgggcccaggtccctgcttctctttgcagccttggaacatggcacactgtgtcccagttgctccagctccatccatggctaaagggggccaaggtccaccaacagcttgcaccatgcacctggaaaagctgcaagcactcaacaccaacccatgaaacagctgtgggtgctgtaccctgtacagccacagaggcagagctgccaaaggccttgggagcctacctcttgcatcaacgtgccctggatgtgagacatggaatcagaggagattatttttgagctttaagatttaatgactgccttctggaagaggtttgtctatgttattaatctttattttaaagaagtttttgttttcttgatttccctattttgactagtttttttattagcacttttcattttctcctattatcaactgttttaagatttgttctgttattttttgaaactttaaaaatttatgtttacttcatagactttttctctttctgatatactatttaatgctgttgcttttc

SEQ ID NO: 476378 - DNA, 1337 bp, Homo sapiens
gtctagttactgaaatactacggcagagttagaagagtgagttagtgaattttcctgctgtttttgctccgaacgccatgaggagcttctatggctgctttgacctgcacttttccagtctgaacgttatccacccttttcatccttctacacatgaaaataagagccaatctctccccttcataatttcacctctgtatgccggcctcaagctcagccccaacaacaccttaaaaggtgttgagacaaacaacaatctagagaataaaacagggggtatggagagatccaagcagatgaaagtaagaatcacggaggcctttaagccattaatagaagtaaccattacacttgtcttcaagaagcaaggatataataagagattggctgtcagcaactcagaagagggacctcacctgatcccgaccatgctgacacccagatcttggacttccagcctccagctgaaggacagtgaggtgcacctgccactgccccagccgactcagggacagcgtccaggctgtgagcaccagggcccgtatgaggggatcagcagggtccctggggcaagcagcctgcgagagagcaagagggctcagaagccaaccacagaggatccctgccttcccttcagctcaaatgtgaagaaagtacatgaaaaccaggaaaggaccatccagaaggatgaaagtagcaggacttgtgctcatgcaagcccgagaatagtgcctttttccagtgaccagattggaaaatgtcagggttcatggcttcaacctccagtcacgttctccccgcacttggaatcagtggtctccttcaacatcagcagctgcgcagccataccctttatgatggactttcagctgccttttatttccaagaccaagcaccaagtgatatgcagaagctgttctctgctgttcccttctgacactgtgttctggttccccagtgtcagctcccagggctggagcccgcgtgatggaaactgatgtgtcattcagtgcacttattttgagtgtgtttatatcaaaggaaacgcgtaagacacagagcttaggcaggactgctcttgctgggccggatgggcgagccagactcaagggcttgctgaacaccgtgcgggaccacctgtggtatttcacaaggagggtattttagatgtcccctcattttgggccaaagcctaggatggaagcacacaggaagacctgtgtggggagcacctttgatttttgcttcacatttaggtatttggaaagaaaggcaaatggattgcagtactcattcccacaccttttctcccttctctttctctctcttgctcccgt

SEQ ID NO: 476379 - DNA, 1870 bp, Homo sapiens
gtagataaggcttgactaaatctgaagcgcttaataaaaacctgctggttttgtggctcaggtgggcatcatggacctaccgatacgtgacgtcaccccggcggccgagctgaacaccccagtgttcagccactctacagatttccacaaggaaagatcagacaatgattttctccttgtgacattgcggaaggacaagagtgaatgttattcgactttccttgtgttgaatctcacagtgctgctccaggttgccttttacttcaccatcttcatccctgagatcaaggacacctttaattcctcatctctcaagaatgttcattggttcacggaattcattgtctccaccagaatctctggtttcttcaatggattctggcaccacagcaacagccagcttgccatctttgtgggcaccagagttccatgtgaggaggaaaatgaattcaactgctatggtctaaatgtttgtgccgccctcaaaattcatatgttgaaacctaatccgcaatgcaacggcattaagaggtagggcctttaggaggtgaaatgtagagcctttttagttaagcaaggatagttcctagtttgtcaaattccataagatgtcattcatttcaaaacagatgctggttgagtaagaagcaaaacttcaccagcataggtatgttttaagaagtataaccttgaaccctctcctctcagtctgtttcttgtacatacatatttatcgtcaattgaaaggttttgagcgggaggtggtgattaaatgagactattagcaaagctcaagtcaggacggcctgatttcacttctacaccctgtaaaatgacggctgttgaaccgtgtggtctttatgccattagcctatgtaaagtatagataaagaaacagcccacgaaatgccatctcctatggacttgcatgatgctcagcctcatcattcagttgtgaaaaacattgcaaagccatcaaaaagaataaagtactgatcaaggaacacctgcatgaaccttgaaagcatcatgttaagttgaaaaagatgcaaaagatgacatattttatgattctaccaatatagaatatgcagagtaggtaaatccatagaagtaaaaaattggtagtcaccaggggctggaggaaggtgggggaggaaaggaataactgcttgtaagacacagggcttccttagagggtgataaaatattttgtaattagatagagttgatggttgcaaaatattgtaagtgtactaaatgcaagtgaattttcactttaaaatggttattttcatgttatgtgaattttactttaatatatttactttaattaaatatataaatgtatattttatatataatacatataatatatgatatgtacataaatatatattatatatttcaaatatatatatttaaaagcatatatatgtatgcatatatatatatatatatatactttctgtgccctaattggtttagggcagcttacagcagctcaagtaacatcatgtgtcttaaaatgctttgtaagtattaaaatactctgaaattcaaagtgtctttttcttgcaggggaaccttgatatttccaaattcacaaatcttattttgaactacttttaaataatccctgcacattctgatttacaacaaattataatgcaaataaaaataactacccaagaacctgtgagaataaatgtgccctgggtggcttgtgcactagtcacttaattagctggttgcctagtatccctcaattagtggtagtacagtagttgaggactgcagaatacctctggttattcccaattaaggtggcaaagaactactcatgattagcattgttgcagatgcagtt

SEQ ID NO: 476380 - DNA, 907 bp, Homo sapiens
acagcaaacatcagaaccagcctcagatatggctgtgatgttgaaagtttcaaactgtgaatttaaaacagctgtgattaatatgcaaagacctttaaagagaaaagcagacaacatgcaagatcaaaaggataacgtaaatagtgatatggatattttaagaaagaagcaagaagaaatgcttgagataaaaagcactgtaacagaaataaagaatgcctttgatgagctaaatagtagactgggaatagctgaggacagaatctcaaagctgaaggatctgtcaatagaaatttacaaaactaaaaagcaaagaggaaaaatagacaaagaagaaaaaagagcagaatatccaagtcctgtggaacaagacaatcacaaaaggtataatatacacataatggaaataccagaaggagaagaaaaagaggaaggactggaagcattccattacattatagcaaagaacatcctgaggctttagagtcaggaagctttaatctatctccaccattaactaccagataaaagtatttatctgtttttaccctcatattcatgatctgtaaaatggagatcattaaacctacttcataggattgtcagccagattgcattaaatttgataacacagtagtgtacatagcacataagtgcttgataaatggtcagtcatttttagcatcacctcagaaatactttacctccttagttaagcatattcctaggtttttatttttcacagctgttttaaaagggattgagttcttgatttgattttcagcttggttgttactgatgaatagcagtgctgctaatttgtgtattttgattttggaattgaagactttaataaattcatttatcagatttaaggattcttttggaggattctttaaggttttct

SEQ ID NO: 476381 - DNA, 678 bp, Homo sapiens
tttctaagccaatgcagaatgccaggacccaatggcttgctgtggcatcttttggggctctacagaagctgaccctaaggctcccagaccatatcaaagaactgaaactctccagatcatcacatccagaccagaagacagaccccacatccctcatgattcttttacccctcccaaattcctctttacctgcatgtagttacatttcttccttgctatataaacccccaattttagttggtcagggaggtggatttgagactgatctcccatctacttggatgcagcaccagattaaagcattcttctccagcaatacttgttgtcttagtgattggctttctgtgagctttgaccctggacagcagttacaagcaagggcggagaaggtggcaacagcctgcagccttctcttgagatgcacattgcaaaagcaaaagggtcacctgcttaagcaggctagatcaacttcgtcagaactgcccactgacagtgtcttgtcagattgcgttttactcccctagacatcggagagtataaagataaattttacctgaatacttgaggtatgattgcatactatcttcccatgtatgtctacattggttgaatctcactgactaaagttctttgaatgtaattaacattagcacaaaactacaccaaacgttaatatac

SEQ ID NO: 476382 - DNA, 1524 bp, Homo sapiens
aggccacctccagacttcaggcataacccttaaagagctagttctctagcaggcaggcttttgacaatgccttacataactgttgtcagatcaggcaggctgcagatatgtgcatatgtgaaaaggagccaactacctcaaaggcatttcagagacctttatggcagcccctcccatcataggcttggaaggctaggagggaagaatggttttatgggaggagcccagagccctactggtctgcacagccttggggaactttgtctcacatcccggctgctccagctccagtcatggctcaaagaggctcagaggatatgtggaaaagattcaatgtcccagaagaagcctgctgcaggaatggagccctcttggaaaacctatcctagggcagtgctgaaggaaaatatgggctggagcctgcacacagagttcctgctggggtaccacctagtggagccaagagaagagagccaccattccccaaatcctggaatggtagaaccactggcagctcgcatcctgcacctggaaaagccataggctctcaataccagcccatgagagtagccacgggtactgacccctacaaagccacaggagaagagctgtccaaggccttggaagccccacttcttacaccagtgtgccctggatatgaggaatgaagtcgaaggagattattttgaagagctaagatttaacgaccaccctactgggtttttgatgaaaagacctttattgatgagtgtgtgtgagggcaaaggctgtctggtgtgtatagtggaactgagtctggtaatgtgcaggaatgctggttccaggatgcatgatggtgcctgatccagatgacataagtgtgaaaaattccttgtccaaggaggaaaaatatgaaaatatcccatgaggggaaagaaaatccttacctcaagtttcctcatttaacttcaggctaaagtctctgcttgtagcaagtgacattgcagtttataccaggattaaatacttgccaactcgatcaagtatctatattgttctacaatgtggaattatatccagatagatataatgctaaaatttttctaaatcttgggtttctcagggcaggttttatataattcatactgagtattcttatgtcagataaaggtaagtatgtagtggcctctgtcagatatcccaacatttttaataaaatgagatttataacaatgagtataaatatatttgcattatgttttaaagattttagaagcataagaacttttatctgtcagagaaactctaaaaaagaaatcatggtgttccaagaaaataacctactttccgttatcagattttttattgttaaacataattggttgtctcatatcctgattttagaaaatatatatttttactaacattaaatgtactctggggaagggttagagtataaatcatcaagatgtaggacacttaaaattatagaattttctattcttatctagaagcatgcctttaactgagttgaatttaaatgtg

SEQ ID NO: 476383 - DNA, 926 bp, Homo sapiens
cagtgttgcaataagaggtgcatgttatcagtttgctccatgatccgtgatattgagctaaatttgagtcgaggaccacctcactctagtccatcctacacacacttaggtgaagggacgctatacttttctgaggtcaattgttggtcagcaaagagggactcagatatttcactgcatcagccaaataattatttctccaccaatgattctgctcatccacctcctctaactcctttattcacagtgtattggagtctctacaatgtactttttatggtgatcctaacagttttctcaaggacagacataatggagaataacccacctctacatggcaggattttgtcctcctttcttgtgatttgtgtcttctcagtgtgtagcagagctaagaaagtcattagagataagcagcaattgaaaaacactgctggtgtaacatttgcattatggatgagatggggtttcccattggccacttggtgtacacctcatgcaaatgaagttgtggtctcacaattaggctgattggttgtggaaagcaaccaatcagaggctgaagtgaagttacaaatttacactcctacgcaaaaagcaaccaatcagaggtactttctgctttctgcaaccaatcagaggaaaaagtaccattaactgttcatctatgttgaaaaatctcacagtaaatgtttataaaaagcactgcccatatctattaaatgagatactttgtcttatttggtaaagaagaaagttgttcttaatgtataatcattttcaataactgtattaatgaaaggaagaaaataatacgtaaccttgaatttttcatgtctttcttattccaaggatttcaagtgcagaatcaaagacatataaccataataaaatgcaaaatcacaagccctcagaatcagaaggga

SEQ ID NO: 476384 - DNA, 648 bp, Homo sapiens
gtagccagtggtttggttggatggtcagggacttggaagaagcatgattggaaaattggtgacaaggaaatccggggaagaggctgtgtatgctctgaatgagcatctaatatatcgtactgtttctcccataaccaggattcaggggtccaggaatcaaggggtggaagtagaagtggcaccactcaccatcatccctagtgatccattggcaaaacttttgcttcctgttcctgtgacattacattctgctgctccagaggtcttagtttcagaaggaggagtgctgccaccaggagacacaacaacaataaaattaaactggaagttaagtttgccacctggacactttgggctcctcctacctctaagtcaacaggttaagaagggagttacagtgtttgctggggtgactgacctcaactatgaagataaaatcagcctactactccacagtggagatgaaataacactggattttcatcccacctgaaatgacacaataagtctggacaaatacatgatacaatgtttttcaagtacttggacattaagcaaagaaggaaagtcatcccccaaaaatgagggggagaaaaaagtggactgaaattttcctagctttctgtcagagaatattctccaggtcac

SEQ ID NO: 476385 - DNA, 655 bp, Homo sapiens
ccgcgagggtccgcggcttcattcttgaagtcaccacggaccctcgcggtcagtgttacaactcttaaaggcagcatggacccaaagagtgagcagcggcaagatttaccgcaaagagcgaaagaacaaagctcccacagcatggaagaggacccaagcacattgctgctgctggctcaggggtccctggcttcaactcttagctgtgaggactgtctgaaatttgaaagggctagccagggttcccgtggagagcacatgtatgttccacttcccacacgttcactcacaggtcatgtaggccctggtcctacctctcctcccactctttgcagccttgctaatcagagaggatctatggagcacccggtcctatctctcttcccactcattggagcctctctaatcagtcagagaggatctacacccctaaataaacttgaggcaggagcctctcaggtctgttttatgctcgaagtcaaaccacaatatgctctaagtcaaaccacaactgagtccttccagggagaccaaggtcgtcacatgtttaagaacactgaataactgtaattgctgaatgtaacatgcatgcctctaggctcatggcattatactaatcttgtgcatttgccttatatcatctctgtgacatttc

SEQ ID NO: 476386 - DNA, 943 bp, Homo sapiens
cttatataccttctaagctatatgtctatctgagacctctggaatactaattgcagcagctccatcggaggagcacagggctctgggctctgcggacgctccttcccctaatgttccgggagagaggtcgtgcatgcacctcaccacagcttgccttcctagggcactgcctgcccttaccctaccgacacacagagacacatagaacggactctcagagaggctgtacaatgcactgccctgtagagaggacaacaggacacagaactgccagacgccttagacatttggccccagccaaacagcttggtgatgttctctggcatgcaaggggagagaggcacagcagtgtgacatgtgacatttcactctcatcagatgttcctcgtaaatggatcacaacagctgcaatgccccaaaaagagataactatcttgggttataaagatctcaacttcccaatcctaagagtaaccagtgacatgtcctccagaagatggtacaaagctttaaagtgtgacccctgctcttttgcaaatgttctaattaaaatgaagggagatttatgaccttaaggtatttaaaatgactcaagtggcatttttcataaggttcgttccagtagatttgtttggtaattttgccttgcatggctctgacggctcattgtggcccctttagtgcattttttcttttattcacatatgttttaaatctgtttgaaattaattttctaaaatttggaataaattttctgaggaaaggtaaaaacagatccttacaatcagctcctggtttgttactcagatgcatctgcctgagcaacattaggatgagaagctgcagtccatgatcagagttttccattttgccttttctccatgtattgctctctggtttgtcctcagcagttaaatatctcagccattggaactgtcacctc

SEQ ID NO: 476387 - DNA, 821 bp, Homo sapiens
acagcggagcgctgctctgcagaagcagtcacagagctcaacattactgctcggagagtaatcgcctacagcactggaaatgttttggaaaatggacagaagagcgtcgctttccctgcagcaggacatcgcagggagcaagcagccccagcgatgtttgcgaggcgctttggcaccatcacgggcgtggcagaatgcctcagggtgagagccctgcatggtctgaaaacaccatttctaacaatttcactacgagtgggcgtccgtcctctcggggccttggctccggggctgttcctaccgcatccttcaggacggcccgcaggagtcgtcctgccgcggagaggctgccctgccctcagttctctccccgtaagagaagtgacagaggcgatggtcctagaggctccccttccccagtgtgggacttagcagagggcgggtccagcgggccttttacggaggcccccacctttttccaacaaggccccttgctgcatcagggctcttcccgagtgacacagccacgtagatgttccctgtccctcaccctgcgattgtgcagaccctcagtgaaggggtccctcccaggggaagctggtcaggtacttgctgaccgccgacgcacggcctctcctgtggtgctgagcagtcagagaaccgcggacgccggttactgctctacaggccgccttgccctgttcgcatctgcaccacacggatgtgttccggtcccacggacatgacgcaacgcagtttataatcctaacttccatatctcttgaaactcttttttatgtgttactaaaagttttttcccc

SEQ ID NO: 476388 - DNA, 1355 bp, Homo sapiens
acagcttttccgtgagctcctgcctggaatttgagctgtgtcctcatgacctggagagttgctgaagactgtctgtttgctggcatgagagttaagaaactccagggaacccagacacaaagggagctcgcgtgcattcacaggctcttttccattggtcctcaactggatgatcacaagaagaataggagcagagctgaggtccagagaaagtcttctgcaaggatcagtcaccattgtaggaaagagaagagggggagaaatgaagaagaagcctcaccttcaaggagcagtcacacaaaaagtaacaaaacctgcaggctatcaagcagtgattgaaggcagcagcagatgtatcatttccagtctgacatgtaaagaatttggagattgtcactcccatcctcacaagaaaagcataaagctgaacaagcagaaaatcatcatctcttacacctgtcagagaactgaggtcacaggacaaacatctgccctcaatattggggatacaggtgaacacagagaaccattcttaccaggaacagaaactcacgagcagaagcagattgatggcacctgtcagaacacttagactgcaattcatgaatttctgcagactcagtgaggaggagcttgagaattataaagtctgtttgagcaatcaagatgtacttcaataggtgaatagatgaacataccgtgggatatccatacaagggagtagtaccagcaatgaaaagaaatcagctactaaactatgaaaagacatggaagaatcttaaatgcatattgctaagcaaaagaagcaaatgtgaaaagatgatataccgtatgattccaaatatatgacattctagaaaaggcaaaactatggagacagtaaaaatgtcagcagttgccaagcatctggagggagggagggagggaggctgagaacatagagtcccaatactgtgtacaaatgttacttggattagttgttgctaataaagtaagtacatttgtttctgttttaagttggcatttttccccatctctgttgattgtgtgtgagagtgtgtgtgtgtgtgtgtgtgtgtaatatgaaacattaatacgtctccaaatgtcaactattcaagaaagactactcagagaagtgaccctccctccatcctgcttacactctttccagtccaccatttttcttcccatcccaaccattcattgtggacatttccaattattaaaaaatgagacatagaaattatattctatgtgtaaaattgtatcctatttatcattgtaaataacgtcctagttcagcttctccagaagtatggcttgagttaagggcattgtccacactagttatt

SEQ ID NO: 476389 - DNA, 806 bp, Homo sapiens
gaaggagcggagatgcccagtacagtcggcgtcctcctcagtgtgtggaaacccgcagtgctctgtgggaggcacagaaaaacaggaggtgctggggaccaagtgtttggctttaaatgctcaaagggagagtcatgtcaaaggaatatgaaaacaggagcatcagaccatctcttcaactgttactcagagatggacctatctaatgggtattcaggccttcagcacagtggatggctcaaccgcaaaatacaccctgcagatgacagtaaattgctgtccttgtttgggttggcactgtccttagacctgggccctgtgctgcagaaggcaaagagccacctttctatggctgtacccttgcccaagggggatgcagcagcaatgccaaggagacatgctgtccccaccattctaggtcacactatgggaatccaagacactgaagtttcctcttccggggctgtgcaatgtggaacaggagaaagcaaggtgaaaaagtatggcatgggttgggtgtgcccacttggtctttcttcgaaactcacagatactgaggaggaagtcatgggccaggccactgtcatcctcaaatgcaccattttcctaactaaaactggttttcctggtttccttcatctttgcacctgcagttcctctgctcttgccctgtatcttcacgtggcatttgattccaatcttttaggtctgctccttagatagaccttccaccccccttccaaatcttcattagtccttcttcttaccataattaatgtttgggaaaaacattttaaaattatatc

SEQ ID NO: 476390 - DNA, 543 bp, Homo sapiens
catctacaagcatcaacaccatccaggaaaacatgacttcaccaaataaactaaataaggcaccagagagcaatcctgaagaaacagagatatgtgatctttcagacagagaaatagctattttgaagaagctcaaagaaatccaagataataccaaaaaggaattcagaattatgtcagataattttccttctaacagtcaggaccctccactgcaagtctgttggagtttgctggaggtccactccagaccctgtttgcctgggtatcaccagcggaggctgcagaacagcaaatgtggctgcctaatccttcctttggaagcttcgtctcagagaggcagctggccttatgaggtgtcagtcgcccccctactgagaggtgcctcccagttaggctactcaggggtcagggacccacttgaggaggcagtctgtccgttctcagatctcaaactccgtgctgggagaaccactactctcttcctgtcagacagggacgtttaagtctgcagaagtttctgctgccttttgttcagctatg

SEQ ID NO: 476391 - DNA, 726 bp, Homo sapiens
actcttaaaaaggtggctggagctaaaggcatagtcaaggttaatgctcctttttctttatcccaaatcagatagcggatgtgcgtgtgcatctgcatgtgtgtactgggtagatgctgcattcgttattctttcaagtgaaagcacccctgtgaatccctggcagactgtgacaccagggacaatgctggaccctggtgctggtcctggttacccccagtctaccttcctccatggtgagccttcccatgggaccctttctttcagtgcccttggcacatccagtccaacccactggaaaggatgtgctttgcaagggaaggacccattcctccctggagcttccaggtctctctgcacacttacccatctgctccttggtgttcagctttgccagggaacactgagaaaggccacccagggacagtcactacttctccttgtgtttacaaagccaggggggcatagtcaatcagtgattcaaatggcttttgaataagtagtattgcatctccctcagtgcctgggcttccaacagagacttttcagcaaagtgttgggaataaataaagcgtattgttaggaagagactcttttaggctatggctatgctaatttatttaaatatatacattagtaccatgtgaatctgaagatttaaagggactatgagagttctatatgtagactaccccttttatttaagatccagctattgctgatgca

SEQ ID NO: 476392 - DNA, 645 bp, Homo sapiens
accaatcagcaggatgtggcaggctgcccagccagcactggcaacccgctggggtccccttccacactgtggaagatttgttatttcgctctttgcaataaatcctgctgctgctcactctttgggtccacactgcctttatgagctcttcactcctgaagccagcgagaccaagaacccaccgggaggaacgaacaactctagacgcgccaccttaagagccctaacactcaccgcgaaggtctgcagcttcactcctgagccgggagaccacgaacccaccagaaggaagaaactccgaacacatccgaaaatcagaaggaataaactccagaggcgccaccttaagtgctgtaacactcaccgcaaggcaaattggatggctcctaggtgccacgcattgcaagcattgaactagactttactaacactaaaacgaaagaaataatgtcccttttctcaaggccctcacaatcttgaatgtcagacccatgatttaataaattttactgctagtaaagcactatcactcctctaccaaagataattctttactcaaaatgaccgaagctaagcatttttatttatttatttatttttcttttttttaattatactttaagttctagggtacatgtgcacaac

SEQ ID NO: 476393 - DNA, 1085 bp, Homo sapiens
cctgagtcaccttctctccttggcttctgtctgggggctgcctgcaccgattcgaagcagttatcgagtgctcgctgtgttccgagtgctgcttcctcccaattagctgcgctgaagacgaggattgtaggaaatgagggagcatctggcaccggagatgctgactcccaggcccacctccaggccatgctggcagaagacgcaaattctgaagagttccagcgctgccattcgctatttcagagggtgctcttcttggtacagatatcacctgattctaacatgaaaatggaacagcaagaggaactggtgaagggcctggagttgcttaaaattaaggcagccgatgggcgtatcatcagatccccttgtgactcaggcgagtcaggctacagagggcagctgcgctctgctgggggctcggctgtggagcaggaagaggcccatgaactctgctctcctcttgcttggcgcactggcctgacctgcactcagcggccacaaccttccattacagcttcctcggggcccagatattgttctcatagcttcaggtatgagacagagtttatccacttcacactgcatgccacaaaagtgttcaacaacgcatctgtagtagcctcacagatcaatgctgtccgtaagcttagtaaaggtatttctggctcaggggcaagatataattttgtgtaagttttgcatattcacttgtataactatgaacatcaactttcagaagaaagtataagaatatgataattgaatgaatgtctcttattgctattgaactcaacatagaataggttatacctgaactatacaagttatagttaacaaaagaattagtgaatatttgctcacctgtaaaatgggcactgtaatagtatttgcctcatgtacttctcgtgaggagtaaatgaagtggttcgtgtaaggcttttagacttgtgccagaactgtaaatattattattattatttaaaattttaattattgtatgtatttttaaaatttgtttcttgacagggaggttatgtaactatcctccaatattctatgggagaatgaggcttaaaacccac

SEQ ID NO: 476394 - DNA, 575 bp, Homo sapiens
ctggtttacacttccctcagcagcagctccagagtcacctgggagcttgtggagaatgctcgttctcaggccccagctcaagaccaacagaatccaaaggcctgaatggagccccgcaagctgctttaaccagccctccaggcgatgcccatgcaggcaaaagtttgagccctgctgcattagaagatgtcaatatacttcaatggcaaaggatgtggacatttatcatggtgatgctataaagcaggagactttgcctctaatcccccatccttttccagatattcgtatcagcccaggtgctggacctgaatccccaggagtaaaaagtggcaatctacattcatgccaggtccccagattattcttctttcatgtaaaaaacgtgacagttccacactgcacggtgctctctcctaggctacgatgggcacggggactccagtgcccagctcccacttcccccaggcctggtctcctccctgcctaagctccaaccccagcaaccttgttcctttacagctgttgctgttggtcaataaaagtgccacacagagattctatatgaagccaac

SEQ ID NO: 476395 - DNA, 627 bp, Homo sapiens
ttgaaggacttgaatggacctttctctaaagaagacatacaaatggtccataagcacatgaaaagatgcccaacatcgctagtcattagggaagtgcaaaccaaattgagaggccacctcacacccatgaggatgactagtatcaaaaatcaggaatttacaagtgtggatgtgaaccgtcaggtaaccagggctgcagtgagagccacagatttcatgggaagtggaagaggagatggaaagaggactcctcccagagcctttgaagttgccatccctgcttcccttccctgccctgtgaatgtagcctatagcccatcttctttccagggtcctgtttcccattcagttattggagactttctgacgcctccagtgtcctctggtgatgtgttggggtcagttgggcatggttgccggcattccatggacacaactcaccagggagcagtcgtgtgttttaggaaataattcactaatcatgggtgaggagtgctttccccaaattttcactccaagtaatgtgaaaaagaaaataaagctggcttgattgatttaatatacccaaatcatctatttatttgggtagaagaacaatagtaatggtacatgtgcacaatgtgcagg

SEQ ID NO: 476396 - DNA, 584 bp, Homo sapiens
gctccgccggggtgataaggagtgaagtgaggagctgggaaaagtatgggagcatgaagcagacggcatgggcaggaaagaaagcggagccggctccaggtctcactgaaaccaggacgacaaggaataacccccagagtctggatccagaagagaaagaagagcagaagcagcaggtagagaataagcagaaaatggagcctggaacagtgctattgcctggggctggctttcgcagggaagccttgaagggcccgttggtgacatgcatacccaattccctgacctcacatgcagcactcgtgtcatctccattccacacgacaacccccaaaggccatgaggccgggcgcatgggaagcgatgtgcacctggccttcctggaggtgcagtggtcacacgcaaagtcctgtggcagacaaggagaggctgtgtacagctttggaggctgtgcagtgcttccaccccatctgtggacacctcctcctcccaatcttgcacctgtatcctgtgctctcggcacactgtgcgcttgtacttccctgcgttctgccggttctctgatgcctctgagcctttgacat

SEQ ID NO: 476397 - DNA, 814 bp, Homo sapiens
tctgcaaatgcatctcctactactttgtcttttactcgacatgctccagctgtatctgaatattttcctgcccttcaaaagggtcatatgtttctccatttcagcaccttcaccacatcctgtccttctcgtttggaacagtctttcttcactctccacccagccaggtcctcttcctcagattgaccttcaaagttttcactggacgtgcagccagggcaaagttcagctccaaggtccgaagtcaaattctaaggtcaaggtccaggcccaatttctatgcctcaggtcagatttgatgtccagatgggagcaaggtccaagatccagcttcaagatccaggttttgatccactttgcagatccaggttcagatgcaagatacagatccaaatacaaggtgtatgtcaaaggtccagggttgatgtttgcacccatggttctggtaccaaggtctaagtccagcacatttgaaggtcaaggtttcttactattgaaaactgtggccacagtaagtccaacatgtgactctccagcaaactgtaagaacacagctctgcccacatgctgtgtgagtgtgcatgagattcccacaaaagagaaaaaaagaaagagagcagttcttgagtgtgagacactaaactcaccaggatgccaagcctccatgctccactcacaagcagtttcaaataactacttacagcttgtagcaattgagtaaagtatatttctggaacaaaatttggagcatatttgtttctgtctacttgatttatccagatttagaaactacttgtgagtactcttaacttac

SEQ ID NO: 476398 - DNA, 972 bp, Homo sapiens
actaccgcagacacatgaacagggaatggaggcccaggggagggacaccgtgaggtggttggtgtcacagcttagggaactggcaggcagcccaggggccaggctcgccccgtcagtctacctctctgtaggaaattcaacctcagatgctttccactttgaagaaatcacaggaaaagtgcacacatcagagtggagaattatttgctggcatgtccacattctagacactcggttgaatgcctctgtccactctttccagccctacttcctatattcatggtccacctacaagcacacatgcaccttcaccctaactgcagaaatatgcatggcttcacaattgcaacacccaaagatgttaatggatttaaatctagggactgaggatgactgcaggttcttcctccatctgtttcagcgaaatttcataatacaagtggagagaatcatgaatccaaaccctatgtcaccctcacctagttgcaattgtcaatgttttgccaatcttctttcatgtatcccaattatttttcttttcaggatactctagcttcataattacttttattggctcctcgacccaatgttatttggtaatttattaaattttctcttattcaagctgtttttattttcactaagatgtttaatgttttaatgtgggcaatgcacatttcatttttttgattcctgcctatttattgttttcttgtgttggctaggttttctaactggtgattgctagttcataagagtggtactattcattttcttctcttggtataatattttatagttttaaaaatatttcatgtgtttcatgaaatttattaaaatagagaaaatgtaaaagaagaaaattctcttaatttcaggtatagtaatcattagcatttcatgatatatcatttcaggccattttcctttatctatttgaaatcacactttgcatacaccattgtgttcagg

SEQ ID NO: 476399 - DNA, 1541 bp, Homo sapiens
aagaggaacagctccagtctacagctcccagcgtgagtgacgcagaagacaggtgatttctgcatttccatctgaggtactgggttcatgtcactagggagtgccagaaagtgggtgcaggacagtgcatgcagcgcaccgtgcgcgagccgaagcagggcgaggcattgcctcactcgggaagtgcaaggggtcagggagttccctttcctagtcaaagaaaggggtgacagacggcacctggaaaattgggtcactcccaccccaatactgcgcttttccaatgggcttaaaaaatggcacaccaggagattatatcctgcacctggctcagagggtcctatgtccacggagtctcactgattgctagcacagcagtctgagatcaaactgcaaggcggcagtgaggctgggggaggggtgcccaccattgcccaggcttgcttaggtaaacaaagcagtggggaagcttgaactgggtggagcccaccacagctcaaggaggcctgcctgcctctgtaggctccacctctgggggcagggcacagacaaacaaaaagacagcagtaacctctgcagacttaaacgtgcctgtctgacagctttgaagagagtagtggttctcccagcatgcagctggagatctgagaatgggcagactgcctcctcaagtgggtccctgacccctgagcagcctaactgggaggcaccccctagtaggggcagactgacacctcacacggtggggtactcctctgagacaaaacttccagaggaacgatcaggcagcagcatttgcagttcacgaaaatctgctgttctacagccacggctgttctgcagccaccgctgctggtacccaggaaaacagggtctggagtggacctctagcaaactccaacagacctgcagctgagggtcctgtctgttagaaggaaaactaacaaacagaaaggacatccacaccaaaaacccatctgtatgtcaccatcatcaaacaccaaaagtagataaaaccacaaagatggggaaaaaacagagcagaaaaactggaaactctaaaaagcagagcacctcccctcctccaaaggaatgcagttcctcaccagcaatggaacaaagctggacggagaatgactttgacgagttgagagaagaaggcttcagacgatcaaactactctgagctacaggaggaaattcaaactaatggcaaagaaagaaaaaagaataaaaagaaacgacaaagtctccaagaaatatgggactatgtgaaaagaccaaatctacgtctgattggtgtacctgaaagtgacggggagaatggaacaaagttggaaaacactctgcaggatattatccaggagaacttccccaatccagcaaggcaggccaacattcagcttcaggaaatacagagaacgcctggagaagagcaactgcaagacacataattgtcagattcaccaaagttgaaatgaaggaaaaaatgttaagagcagccagagagaaaggtcgggttacccacaaagggaagcccat

SEQ ID NO: 476400 - DNA, 693 bp, Homo sapiens
ccacgggtggcaatggtctctgcagtcgtatgtcttgcccctagtctacctcatgcagataaatgcaaagtaagcctcgctctcattgatggactcatgcccctccctagacgccctcaaccatcagatgaaatactcacacagtatcaagccctcattgcagtaatttatccatttcctgtctgtaatcaatttataagcatgcttttttcctataaaatagggatttttatagtactatttttcttagaaacattttgctttagtaactggcaacgttcagtttcttcacctgagtggtggttgcatatttttgttccctttgctgacaaaaagaaaaaagcccaagaagaagttataatgaggtactggaagattttcctgaggagagagtgtcttccagtccatcaggtgctagttcatcaactagcaatgggagaaatcccagagaggattctggaatatgcgaacactgtagaccccaaatacaaagctcaagggagagccctgggctatgctgtttcagaaaagggaagttaagtataagcaaatataaagaaaaaaagcattcctctttcttctgaagtaataatatagattacaaaataataccaaaaacaaaaaacaaaacaggcagaaagcccataactctggtccctagggagagattgactgagataagtaccaaggttc

SEQ ID NO: 476401 - DNA, 916 bp, Homo sapiens
ttttttaatgtttgttgcctagcacatgcggctacccactgaccgccagcaaacctgtgactatgttactttatatgacacagatgattttgtagacgtgattaaggatcctgaaatgagaaaattatcctgggcccagtgtcctcacaaaggtcttttgatagatttattcaattcctctgccagagagacaagatggcccacgaataatggtggcccccagcttggtccagacacccagaagatccccaagtggatcaaaccaccgcccctctctgcaaggcgtcttctgatctcccatacaagaaaaggcagtgacagtctgtgtggtcatccagctgatgacgatgtgagtgtccttgggatccggaagcattccctttgcggtgtcatagataccgaagtaggcagctcggataataccctgcatagacacgttaaagccttggtacaggcccttaatcccatcagatttgtagatcttaaccaggcagtcacagaggcctcggaattccctttcagcttcagctttacccacattagctgctagacagctaaggagtgctttcacttcctcaggtcttagacgccactgagactctgatagaaacatctgagttgtcttccttaaaaaggaaagagagagagagggagaaagagagagagagagagagagagagagagagagagagagaaccaaaagatgagcacagtttcagaacacagatgtcacaaggacaagagcatgaaccagggctgagtattaatacgaataactttctcttttatctgtataaccaaaacatcttttcaccccgtaattatagctacccacttaatttttgcaaacagatgagagtacattgggttaagccagtagtgtattttcaatctttacctcttccatttctatatc

SEQ ID NO: 476402 - DNA, 812 bp, Homo sapiens
cttttcctactctaaaacctaacctcgtggcactacctttaactgccatgtcactgaagatgtttcagtctctcagtgagcttgtgccccgggctatgacttttacaagtgcttctctggttttactgtctctaggagctcttggattcttggcaggaccccttcgggttctcagtgtcctcctattgtatggatatcggttggctgtgcctccttttggaccatggtggtttggacttgcccagggtctactacagtcacttgctcaggtcaaggtggaccacacagacccagagcatgtggcaggcaccctaccctgtgcccagggcttggagctcctgtctggctttgcctctgctcctaccagcaggaatatttcagcaacaactgctcacctcctgctgtgtggcccagttactaacaggccacagaccagtcccagtcagcagccccagggtcagggacccctactatagaatttaaattgggtagaaagtggatttagaattataatatctcccttgtgcatggactcatcattaaaatatctatttactagcagtagcaaagcatcgtgtgctttcttttgatactagatagggtggaggcaattagacaggatgactccctgaaatctttgagtgtcgttatttgaatactaaaataagctggaaaccagtttaagactattatttatgcaattgagctccttcaacctgcttgatgaacagtactaatggggtcctgtgtatggtgttttaatgcatttttaaaaagacatctggaaatttctatttctattccacttcact

SEQ ID NO: 476403 - DNA, 504 bp, Homo sapiens
aacctacgtgattatcagggcagggatgaagcccacttgatcatggtggataagcatttcgatgtgctgctggattcagtttgccagtattttattgaggatttttctgcaggtctgttggattttgctggaggtccactccagacgctgtctgcctgggtatcagcagcagaggctgcagaacagtggatattggtgaacagcagatgttgctgtcagatcgttcctctggaagttttgtctcagaggagtacccagccacaactgtgctgttttggttactatcactttgtagcagaagttgaagacagtgatttcactcagaaagaatgtccccggaccattcctatcattcaccctcactccttaataagcaataaattatctatgagatatagctgtgttcaaaaacttgatgtaccttatgaagaaaaaaatgaccagatgttcctagcagaaggctggggctgtaacaataggcctctgggacagtgggactgacac

SEQ ID NO: 476404 - DNA, 728 bp, Homo sapiens
ccaactaaaaatatggtgaaaaatgataatctggtactctttagaagactattgtagccaagaaataattaatgattcggaggaagatgcaccagttgtttccaaccaccactcgagcacctgcttctgcagccaggatcctgttgaagacagtgtggctatagagggcagcatgcacggttttcctgtcatggttttaacactagccatctaccagggtgctaacaatccttctggaggttctgctgttagatgtctgcttttgcctggtgcacaagctgctgtcatgtatcctcttttacaacatatccacatcatgtactacctcaaagaatggactcagagaagtcagacaaagccactggggaaggaagacttaaggagtcccctggggcacagtgaatttgatatccctgtggagagacaatctcttcctaacaggattcctgggggcagagctgagaagagagttgtgtttagctttcaggagtcccataagaatattaagagattgaggcagaggcaaacaatgaggcaaattataaaaacccaccactcgtaatttgcggtggccccaaggaagggaagaggaaacgaggttattcccgttccattacagaaggcttttaaacattccaaatattctatggtttgtctcttcatgtcagaactaagatatacctttcccatatttatcaacacgttagcaaaatatttacttaatcttg

SEQ ID NO: 476405 - DNA, 2539 bp, Homo sapiens
gaaaccatcagtataattcaagtttcctcctcaaactactcaaagatgtgtgctcctcaaggttctctcttgggtcctgctctcaattcttatacctcaagtcttgctgccatcatctccttcttatgtatggtagaatctccaccagcacagtttcacctgtgcgagcacactgctggcattgagtctcctggaacatacacccccgtgtctttttctgggtgtcaggccctggctgtctgtccctttatactcaccctcacaccaacccaaagtataacaagaacatctggctacagcggtacctcctccaaacctgcagagcaccaatcacttttacatgctcgtcttgagcaaggaacactgaggaccaatgagaggctgcttccgaataagaaggccgcagcagcacactatagctatggccagaaacgacccaaccgtggggtgacactgagccagtgtgagcatgtgcaaaccagccagtgccgggaccaggacatgaggctgattgtggagagtgaatgcatggcccctggcaatgcgagcctactgataacagctctgcagccttctctgtgtggaagtcgatgccctgaaggcctgctgctcacagcaaccacagcttccttggaagcctcccctgtggctccctgtgacatgggcctctgcactgtctgcatgcccacaccatcggttgatgatcctctgtgtatgagacacctgcattcagcagggctgcttctaggttgctcagtgaatttcagaccagtgccagccacatctttaaacccagatctgatgggagctcacccccaccgcttctgtgttgtgtgtgaagctgccctttatctctatcttgcctcttgctgctgggcagtgaagataaaaggtgtggctatgcctcctgcagaagagaagcagggaagaaatactacatacatgtgtggacatcaagagccttgggaaatgggtggcagtctatcatggagacgacttttacacaaaaagtgtggcctgtgccagaaatgtgaggatgaatccttggagtacaatgtgatgctcttccctaaagtcaaaagagaaatgggcaccaagaacgattgaggacaagcagtgtgataaaactctatgaagctctttgaacttagtatactgaaatcagtcttgggcactgttgtatgccagtagaagtttcaattatctattgtcatgtaggaaaatatgatacttctgtatgtttactccgtatcccacaatcttgctatactagcttactagttccagaaatttatttcccttgattcttcggtgttttctatataaacaattgtgtcatctatgaaaaaagacagtttaattccttcttaatatttaccttttatttctttcttttctcttattgcattagctaggacttccagtatgatattgaataaaagtgaatgcatagtgatgttttatgtgttttaagtttgctttcattgccctactttatggatttaattttctcttatttttcattcaatataatgtttttaatattactcatttagttatttgtggccttagttctttctgctgaatgatatcacagtctacgcatttaccacattttatttgttctttcactttaataaaagcacatagctttccaaaaagttttgcctcaacaattagcactatggtaagtaccttgctacatgacaatacatctatgaacaagggtttatgtagggttacacctcacaatatttgtgtgtgtttatgtaaaggcagtaaacacatggaatagatggatacactaaattcagggtatgtttgcatgagataagaaatggagggaaatttaactgatagagtgaacagagaagactacaacttgcctaaaaatgttttaactttaataaaaacatctgaaacaaaatggtacaatgtgatcaagaagaaattcttaaaaataggcacatgaacttttggcatattattctaggtgcatttatataatttttaaagttagattcatttctgctgtcagaattcagaatctattaggagacatagcaaaaaattacatcacaaaatataacagtaagtcctacagtttaaatgtgcccaacatatattgcttatgtgcatgaggaaggtaggcatggaggccctaaaacaaaatacatgactgagaataagcttccaaatattgctgtatttatgtgaattttggattgttgagtactattgtgctaggcatatggggaaaattcaaggcaaaggtaacaagttgtgaaaagtatggaattttggagtttttagcaaacagatggaaaatattttatgtgtgtggagcagaatttttatgacatgatagaaagaggatgaaatcgaaagttcaacccagaaaagtcctgccaggttgtgccagccaacggtaaggctaatagacatatttttactctgtgggccaactaaaggagtgtaatggtgagagaaagataattctcttgtgtcagaaaactcttacaaattctcatctctcaga

SEQ ID NO: 476406 - DNA, 844 bp, Homo sapiens
gacttccatctatgctctctcagggcaagtttcacagccacgaagaagatggaaaatatgaagatctcaaaaagcagataggcctgagtaagtacaacccatttttaataaaggatgataaatttcaaaacaaaggaaaagggtgttcaggcttctatcacctgcaagctgtgggaagaatgaaagagtgtttctcacagccacagcagcagccagagcgccagcacatgcaccagcttcctgaggcccggtccctatcagccaaggaaggatcagagataagatgcctgccagccctggtgaaggaagaactagagagaactcaccagaagcgctcctttagttatgccacttgctgtgatagaggccatggaatgggaggggctgatgattatccaagtagcagtcagcatggatcagagaagacttttaaaagatgtagctcttgctaagccttgaggtgagttcatatggtaactaaaaccatttctgatggtaaaatttgtgcacacattgaaaccaaatcaccaaattattatttgttaaaattagtattcacacaaacacattgtaggttataggaatagataattttccttgattttcttctttagccttagcatttgtcagaaataggagccaataagaaaagtccaggtatgaggatttttgtctttacatgcatagaagtcagcctgcaaaaccattgtgagaataagtgatgtatcattggagttgatttcctaggattgctaaataaaggcattaagaggaaaccaaatttacattattttttataatttgttaaacacatgattatttaatgtctaataatgccatgatc

SEQ ID NO: 476407 - DNA, 525 bp, Homo sapiens
cagcagagcattacccgccaagatggtggtgaagccttttcttaccttctcagaccatgccaaactgttggataggactttaatctgtgtgctaattctgacagcaacgcctgtggcagcaaaggttttggctattacaaataaagctgttatgaccacttatatacagatttttgagagctcgtggagaaaagctattgaaatggaagaaaacagaactaaagaaccaattcaaatggatgctgaacatagagaagtattgccagaatcattacctgtgttgcacaatcaaagagaatttagcatggctgattttctcttagaaaccactctatcagattttggccagtctcattcgactgaagagaaagttatttcagattgcgagtgtgtgcctcagaaacgtgctgaccagtcacatagatgaaccaccaacacaaaatcagtcagatttgttaaataagaaagtaatttgcaagcaagatttggaatgtttagccttcaccaagctttcagaaactagcc

SEQ ID NO: 476408 - DNA, 582 bp, Homo sapiens
tttttcttttcctgaccatcaggattatcatggcaactgctctgtggaaatgggggacagtgggcatcctatttgtgcggacttctccttgcacagttcttgagctccatgggcacgggctgctctggtctgctctctgggcctcagtcaagtgtgaccagtgcagccttacatcccgagccaagcagctgtcttggggatgctgctggttcaatacatgttggcctcaactgtgcaggacctggctgtatcctgggaatatattataaactgagttacataaaggcagagcaaatgctaaagcaaactgtccagaaggaaggacagcaggatgggaatcactcagatgtttataaacaatgggtcctttgctcttgggggaaagcaaaaagatcattgagggtgtgcataggacttggaaatcagaatgtttttctaagcttctatgcacaagaagaaatgcgtatcattaaatttggcatacaatcaagaaagctagaaagcaggagagcattctcagatatttcaaggaaggtggtgtgaagtgtgagatccagggtgaaggatggctctcctctgctc

SEQ ID NO: 476409 - DNA, 1452 bp, Homo sapiens
cagcagtctacgggtggttgaagtatggccgctgggattgggcaacacccagctattgttacaggtacatatactactaagcaaattttaaagcaaaacagtcctccttctctggattccagaaaaatacaagaagcagacacgattgctcttggaagaaactactacattatttctatctgtaaggtcctaaatagcaggcatgtgactaagttgtctatgcattcccagggcattctcaatgtcgtatgcaaagagggtgatcagtgtgtgcttgttgcattcatctatgaattcagtagtctgaacagatgtttcactatgacaaaattatccattttattatggcagagatttctagatatctaccaaatccctattcctttccttctattggcacagctagagtacatataccagacttattatagcatggctgcagcaatgtttccattaagagaaacgtacaacagttctatcaaatttttatatgactctcctaaacaatagttttacatgtttctcagtctcactttctcagtctatttttgtttctaataataaaaactggtattaatatactattaataatttatcttcacacagaatttttaaatatttatttgctgtatcttactttgtccaaatgagttctagataaaccaacttaagtcagatgaacaaacattcaaggttttttgggtttccatatttcacagttttatctataagggaaatgcaaaatatatgcaaatgattagagaaacaatcctgctatgtagattataaataaacacagtgaactactggctcacagacaggatataaaatgggacaaaatgatgtcttttggactagtctttttgaataaattttattgtgcagatgtaagatatacaacatgaagttatgtgaaacattagtaaaatggttactatagtgaaggaaattgacatagtcataatcttgcatatttactcttccttgttttgtggcaagagccactaaaatctactcattttacagtaatcccaaatacagtactgttttatcatccatagttttcatgtactttagatctctagaattactcatcctgcatatctgccacattgaatctatcctctgacctacatctcccaaattccccccactcctgccccttgtaatcatttttattctctttctttatatatttgaacttttgagattccacctatatgtaagattgtgcaatatttttctttctgtgtcaggcttatatttcacttagtataatgtcctccaggttcatccgtgttgtggaaaatggcaggctctccttaaggctgaataatattctattccatatacatttgatggaataagtatccatgttacagtttctttattcattcatccttcaatgaccacttaggttgttttcatatctcagctattaatgcagaatat

SEQ ID NO: 476410 - DNA, 524 bp, Homo sapiens
gcttgacaaagtcacacacctagtttcaaccctggatacttggattgggtttcaactttctctttgattcccatgagtttctttgccatgcagattctgaattttatatctgtcatttcagacatctcagtgtggctaagagccatttctggggaagtagtgtgtttgtttgtagtgaaggggagtggagcaaatttactgctcttgggcactgcttctgtggcctctattgtggctagggcactggcgccaggctgctccgggtctgagacctgtggaggtctccatggatattgcatgttgtctcctcaacaactctgggcgctctatcagtttagaggccctggggaaagaagcagagagtggaatggtggctgccaaggaatgagaggaggggacaatggtgagttgcggtacaatggttgtaaagtttcctttatgaaggatgaatcacttctagagatctgctgtacaacattgcacctacagttaacactactgtagcgtgcacttcaagatgtgtt

SEQ ID NO: 476411 - DNA, 588 bp, Homo sapiens
ttctgtttacatccttctccactgcctccagcatcattcaaggcgttcggggtacatgtgcaagttcaggcagccgagtccttacgctgtcctggtgcctcctcagtgctttctaagagcacaactcgaagacccatcaaactcatcaacatcagggcattccggacaaaaagataaaacctgtgtgctcctggagaatagcccacttcttcccaaagctgacaggaccatagctagaagtaacacccagcatcagccgacgcagagaatgacggacttgaaattgactaatatattttataaaagccattttaggaagataaacacatctgaggccacaggatacattttagaaattctaaatggcttcactctctttgggccaagcagctacttaaatctggctgacctctttccctttgacacccttttatgcatcctctggatacttcttgctcagtgctattgacttcactttcatggataggattctacttcacccttaacttcagactgcactagccaaccccccaacctcttaattctagtgtccattcgcccccttactggggtacgggactctcctgg

SEQ ID NO: 476412 - DNA, 2323 bp, Homo sapiens
gctgcagctccacagattttaatcttcttcctactagcaatggttgctgggcctggctcgaagccgagcgcctgcagatacatccagagatgctccttctcgaaagcggtgaccgaggccgagctcatcctcgcggtaggcacggtggctacaaagaaaaaaagcgcaagccccggggactcggagggccctcaagatccctccctacggtcagcctgaggtcgcggtggtccttccattgccaacgcctgctcctttcacgcccagagccatttcacctcaaagggccttacaacctccgggaaactgagtttctaacggtacatagaagctaccactccactcctgtaaaggttaatccttctgtgcctgatgagcctataatggcctttgctggaggattttccatgcaagacagtgcgattctcctcaggacccatccataccatgctgctttgcttctagacctacaactggactcagtcccaagggaagggaagctgaaaacggtacacgacaggaaggcaatcttcccctgaagtccggccagctccagtcagattcttctctgaagttatgtcatcaagttgtgcctttgaagtcaagccccttctctctgacatccagctgcttctcccctctctgccagctgagtctgaggtttttatagaaataggatgggatggggtggggttactaatatggacattacatttaactgactgactttttaatgccactccaaacttgcatttcagggttgaaccacacttgagcatcatatatcatccctttatgtattgttggacctgtcatattaaattttgtgatgatttttaaatctatgtttgtaacagatattgatcagtagttttcattttttaaatttctttggtttggtatcaagatataaactatcttgcattgttcttctgatcatatgagggataaatttacctaaatattgttcagaccataatattatatccatataaatgccagtagcaagagttgaatcaaccacaactgcctttgtaattatttaaagcatgtgtgcctataagagagttagtacaagaccaataactccataactggtagaattggaagattttaatagtgcttaacattttgtacgtagctttataacagttttctttttctttttttctgagacattcttttcaatataccccatcatggttgaactcaaagtcactccttatttaaaatctacaactgctgacattttgtatccttcgcattccaggaaatatattctgtgtcacgttatttccatgaaaattgtttgaatttgtgctatggtctagaaaatgttaatttttatttcaatatgactaaaggtaatttgatttttctagtgctaattgaaatatttttcccttcctgattgtttactatttctctaggatatacataggtgtaggtttatctccattgtagcttgcttagcaagcattgaattcttgaatatgcagattagtgtcttacaaaagtctagagaactttcagccaaaataccatcacatattgtcccttcccagttcctttcttctatgagaacactcactaaacacatgctacactttctcactgcatcttccatgtctcttaatgattctgtccacattttgcattttttcaaattatctgtaatgcattctgaaatatttattaactctcatcatggccatgtctaatctgatgagttcatttttgagtttttaatttaaaatactatatttttatacaaactactttttgaatttgctacatcaatttttttagtctcctaaaaatatgttcattttttaaaatttttttaaagcaaatgtgctttataatctaacaatgatatttctactaatgaacctttgtggatctgtttgtactctttttctgcttccctttcaaatggtggaatatcatttccttgtgtacttagatgcctttgaatgacaaatatttatttttctttgaaaattatttttgtgcacttttgaggattagttggaagaaaatttgccaaagagaatttgaatttttttgtgagtctactaaaggcaccaccattctgggaccaccttatgttaattcttggcctaaaggtgtttggacgtatgtttggactgcacaattaaacactttttaaattaattgctgtaaatcattaatgattgagtttctttaaatctgtccaatctcaagtcattttcattggcatttgcagggaatgtgaaatgggactaatttacctctgattcttctttatactgaggatataaattttggtcctagcttt

SEQ ID NO: 476413 - DNA, 605 bp, Homo sapiens
gacagtgtaaaacataatgcttgtaaaatatgatggatgggaagctgaaaagaaaaggagaagtccacttgccgttgaagtgcttttgacagccgtgacagcagttgacagcagtgagccggctctggtgcctgaaataacagtaaaatctataactggtgtaatttttctactggctttcttgcgtttgaagcatcctgaaattatgcatccctccagaaggggtaagtggacctgcatggaatccctgatcctgctggaagagaatactcctgatgctcggagtatgaaaacaggaaaaacaaaacaaaacaaaactactcttgaaggtgaaggaggaatatcactgagctcaccaacacagccaggaaaaggaacagaagttttaccaggtttcttaaatgcctacaattattttaaaggaagccgtgtgtccaggaaaaattgagacatatggaataaattactaacccatttctccttgaaatccattagatgcttaatgattttttacatatatttctgaattgaaaagctacttgtgaattatttttataagcatatccttatgtaatgttttgtttttaacagtgaattgaaggttt

SEQ ID NO: 476414 - DNA, 589 bp, Homo sapiens
cacccatcacccaggtattaagccaagcatgtacttgttatttttcctgatgctcttccttcccttgccccctgacaggactcagtgtgtgttgttcactcccctgtgtttttgtgttctcactgttcagctaccacttataagtgagaacatgtggtgtttggttttttactcctgcattagtttggtgaagataatggcttccagctccatccatctcactgcaaaggacatgatctcattccttgttttggctgcatggtattccatggaatatatgtaccacaatttctttatccagttcaccattgatgggcatctaggttcattccgtgtcgttgcaattgtgtatagtgctgcaatgaacatgtttgtcaaagatcagatggttgtagatgcatggtcttatttctgagttatctattctgttccattggcctgtgtgtctgtttttgtaccaggctattttggttactgtaaccttgtattatagtttgaagtcaggttcaagaggtacatgtgaaagttaatgacatgggtagattttgtgttgtagcggttagcttatctcttaagtcaagtcacttaa

SEQ ID NO: 476415 - DNA, 944 bp, Homo sapiens
cagtctcggcaccatgaacagtgccaagaggcagacagactctggggaaaaaaagggaaggtccctggaagagccccatcttcaagccaaggaaggcctgaagcctgggggccaggctgcctgtcctgccgatctgaatgggaatttatggggctctctccaggcccacccatggcttcccatagaccaatcagcacatgctttctctcctatgaaggccagaaataccccaggcttggccagactcaaagagagactacaagatgtaaaggcagagagaagtgagaaagttgcagaagaaaagcttgaaactagcagatgtaggttcacgaggtttaaggaaagaagtcatctgcataacataaaagtgcaaggtgaagcagcaagtgctgatgtggaagctgcagcaagctttccagaagatctagctaagatcaatgatgaaggtgaagacatcattggaagaaaatgggataatgaatttggtgactttaacttgaagccaatgttcatttaccattctgaaaatgctagtgcccttaagaattatggtaaatctagtctgcctgtgctgtatcaatgaaacaacaaaacctggatgacaacacatgtgttcacagcatggtttactagatattttaactccactgttgagaactattgctcagagaaaaaaaataaaaatttatttcaaaatattactgctccttgacaatgcacctggtcagagaacctacagatgagagctcgccttgatttcagcccttgagaccatgaacagggaaagcaagcatgctgtctctgaacttctgattcagagaactgggagctaacaaatgggtgttgttttactgctaagtctgtggtaatttgttatgttgctaaaggaaatcaatgtactctgataacacaagcagacagataaagaaaagttgtatactcat

SEQ ID NO: 476416 - DNA, 502 bp, Homo sapiens
cagactgggcgatagacatgcttcaggccatcaccattagccccagcacttcctggttggtgagatttaaacataaaatcacaaaacacaatatcctgggtttactctttttttggtccctcaatttgtctttcaacagtgacatgataagttacattgtaggtttttccaatgtgacccagataatactgaatgtcaataaatactgctcactttccccaataaatgtcatcatcagaaggctgtttgttactctgtcgttatccagagatgtcttccttgtaggaatcatgctgctctcaagtgcctacatggtgattctcttgtccaggcatcagaggcgctcccagcaccttcacagcactagctttttattaagaacctccccagagaaaagggccaccaaaaccatcttgctgctgttggagtttttaaagatttcacataaatgtgaaatcatgcagtacttgtctttctgtatctgacttatttcacttaacat

SEQ ID NO: 476417 - DNA, 1948 bp, Homo sapiens
gaaaaaacaaatttaattgatttccaaggtttgtcaaggaggacagaaactcagagcaccctgcacttggggatcggcactaggagctgctctctggatggggagatgggagctagcagctcacaatggggtcacaaggtaagttccaaacagctctgtcacagagagcgtcagcagatcgcaaagaaagggagcatgtgaaggagaaagccctgagtgatgtcacagctcatttctgggcaaagggagaagaaattagcaccctgaggcccttccgccttattaacccattgcacttattctcagaggctcctgccaaaaatagagacattattccacctccacctcctcaaattctaagccagaaatatgtgaccctcagctgcaggtctgttgaagtttgctggaggtccactccagaccctgtttgcctgggtatcagcagcagaggcttcagaacagcgaatattgctgaacagcaaatgttgctgcctgattgttcctctggaagcttcatctcagaggggtacccggccatataggtaagttcacttttccctttggtggctcctttttccaccaatctcaacatctgctcttatcctttttctacaggcgacatgacaattgtaggcctggagggagatgagttgacaacatcccttccctataaccacttgttggatctgatctcacatacacagactcactccaaagactgacctgggtgtctgcttctcagcttcattaacagtgggtgctcacaagtctaggtgagtggtgaatcgagatagaattttattagctagttgttagaattagctcctaataatttcagtctgtggttcattgaattctaactatcataagaaggtgtttccagatacaaaataattaatcttatgaagtaacaaatttatagatttgtagaaaaacatttagatttttggagatgttctacttgaatttgtatacatttgacttttctcaatataatagctgaactctcaatataattagctgaactacaactttctgcatttatgtgaagttttaatttgtaaacacagaaatctgaactaataaaattatttagtcatacttcttgcttctttaaactttgaagattgctttatataattctgatattttagaactgtttcaaattaggatgttaaaaacacaagatatgtctaacattttacagtaataagattttagcagatacccagattcttttgtttcatttcattatagtaattgccaatagagatttttttcttgtgatattaaaactatctgaaaatataatgttctgctgtttatataaatttctgttgagctaactactaccttgtataaatggggaggaggtgatactcagtgtgctttgaaatcttttcctaaagtaaattgttttagtatggtattgtttctaagtaaaccaaaactttaaaatactctgtgtattagtttgggtgaggttatttcatgatgagaacaatggtattaaaacaatggtattttcttattataaaacatcctcttggtttagtatttctgcttatacctctgaagactaccaactgcaatgtgttcaataaaacacagtccaaaatgtgacaagtaaatttggtttttaaaaacacaaataatcattgtctgtattcagcaggcatatcgtcatcaagcatgtgtgtttctttaaagtagaaaacagagaggatgaaatcaggataagtaaaacacagaaaggaacaaatgatgataaaataaatttgtggtccatgtgggcatcaaaatattaaggaacatactcagtggacaattgctatatttctgaatatgaatgaatttgtcttaaaataatttgtgttgaaagcccctgtcttccatgcatagtggagagaatgtctgagaagaggaggaccttgactgctcctgaacc

SEQ ID NO: 476418 - DNA, 796 bp, Homo sapiens
cgggagtggggggtggtgcgaatgcctggaggaaggggccgcgtgggctaccggcctacagtcccagcaagcgccgggctgcggggtggtgagcagtcccggagggaggcgcaagccgtgtggacctctctgcttccaaacctatgctggccactgattctgtgccatccctggctaaggggagtgagtccagagagggacttaaggggcaagtcggggctgggcagtgagaagagtgtgacgctgcgaagtgcacctcatctttgcctaaatcgggcgggtctcagcctcaccccacctctcgctgctcagctcggtttccctccagagcatcacgcctcctccagcacaggagccgcctgctttcctaggctgctgtggaactggcctgaggtcccagacgctgtccattgtgctgccgccctccgcgctctccagccagagcgccagttcaccggcttttgggagaactccgccgcctcacctgcccgcggacaaggtcacagctttgcagggggttgacatgggctgtggcttcctggaaatgtcaccctcaccagagccttttacatggatgtgaattttgagacatgaaggaggggctgcaccccatggacctgggttcctggagtctttgacggctttgtgtggtcgacttgttttgatactgaggacacccctgctggctgttaatttcagggcaagggatatgaggccattattttaagtgaaataactcaagaatggaaaataaaatactattatttttcacttataagtgggagttaagctatgc

SEQ ID NO: 476419 - DNA, 873 bp, Homo sapiens
cacagcagggtttgcattcctttgagagtctgatgctgccgctgatctgacaggaggcggagctccagcagtaaagctcaccaccactcacctcctactgtgtggcccggttcctaacaggccacggactggggtggctttctctctctgagcagcggggacatgtgacagcacagggcagcccgcgggggttatggcggggtgaaaaatcttcctgtggctgtggaattcttgataaggtggcgaacgtgttgtgcagcggcatcctgagggctgcccgccctcccaggcgcccagggcgggcaggcaagctgcacgctgtcatcgcctaaggtacatgtgcacaacgtgcagaagcaaactcttgctgtttatttatgacagaacacacatgcaggacttgaaagatgttactaacaatgtccactgcgagaactatggaagcagaaaactggcagctgtgacttacaatggagttgataacaacaagaataaagggcagctgactaacgccctgctgacctgtcctgatgatgactgttcctgcagaggtctgcagaacccccagttacctggccctgagatcatggagtgctccatgaatgaggaccatccgggctacggaaggaggggacatgtgagtgcgccaggaggaggatcacccgcctgggctgggcgagggaggaagcaggcagggctgggtcggtgcccctggcactgggtaagtggccctgggccctctcacgtccaggtggagcacgggcgtcatcatgtacatgctgctggctggctccccacccttctggcaccagaagcagatgctgatgctgaggatgatcatgagcagcatctaccagtttgggtcgcctgagt

SEQ ID NO: 476420 - DNA, 491 bp, Homo sapiens
ggagaagggggccgaggttggtctatgcccagaatgaacaaaggcagcttggaggttagaagcaaaatggaatcagaaagccaatcatcaggagccagaagagaaagcttcctaaagaagccagagaagtcaagactagcgccacctggctggaatttccagagacaaatattaaaccacagcctgaaaatgcagttgcatgtttcagcccggtcttatcctctagaagctgaaaagggcaaggaaatagatgatcacctagggcaggggtcctcaacccccaggctatggcctgttaggaactggaccgagcagcaggaagtgagtggagggcaagcaagcgaagcttcatctgaatttacacatgctccccatcactcacactcctgcctgagctccacctcctgttacaccagctgtggcattaaattctcacaggaatgtgaaccctattgtgaactgggcatgcgagggatctaggttgcctaacc

SEQ ID NO: 476421 - DNA, 843 bp, Homo sapiens
actgcaacctccgcttcctgacagcagctctcatcaccagctttcttacactgtctgccctgtctcggctgcttagtttggttcccacacgcagcagcacaaccagcattcccttgccttcaggttcagcagcttaactctttctgtctcgctgggcatgagcgagccaagctgtgtctatccagccagtaggcagcagctcctggagagagtgggcccttgtggaacactcctcagccccccaacccccagcagctgaaggaggcagagtagctttgactcctaggccttcaaagatacaacccatcctttgtccactgtctagcaatccgcacgcactgtggcccctgctagaggaagaggccctgttattggggagcctttaagactttggccccactgtactgggtgcagctcctatgagcccaccttcctggctgcttcctactgagcagccttcagccctgaggatggacagcaataggagaccttggcatcccactgctcctttgtgcagcctcctccaccagcaaagctccttttcctatgtccctgctcctcactggaatcaagggacacctggtcggccaaggccgcggccacggccatctcagttccaaggggcctgggatgtgtgtgaaatggtgccttcaggagcaagggctggaagacagtcagcccaggagtgcctcgctgcacactgcagagggttctccaagggggacagctggagcaagagccccaacagggcctgtctctgcccaccagcctcggggggtctgagtgctgggaatcccagctggttcctatttggcatctgcaagaaaccatgaatccagctct

SEQ ID NO: 476422 - DNA, 553 bp, Homo sapiens
tccttgcaagggacaaaacagagatgttctgccccaacacagccctgtatcaagctaatttcatgggagatgctcaagataaagatgttctattgctatatcctgagttcctgaggctctcatctgtggaaggtttgaaaacttcatgcaaatcagtagaaatgagtgataagttcaaccactccatctccttggacaaagggcaggagcaccaccctaccaactacagccagccctggtctggggtgatagtagaaacagaggggtcacctcagacagaaatccaaaacgttcagggcaggcccaggatctcgactcaaatatggagactccattgcccctgtcccagggctttcacacttaaaagctttgtcacattcaacacattgaaagattttggtaagggtagttgataaatattggttaagtccattataactttttttctgtccgttacactcacccacaattttccagtcttttcttaagtttaaatttgcagtgccatagctttcatatcttctcagtatcacttttgggaataaatgtttta

SEQ ID NO: 476423 - DNA, 507 bp, Homo sapiens
gttcatcacccccggcactcacggagctgtccccagcagctgcctcacaagattggtcctgatgcagccacagctgctgtacacagagccaggagctccttgcagtttggtgtattctgctgagatttgtggctctgaccctcctctgctcaccccattcctggtagtatctgctcagctgcctggtttggtccagtgtttcctgggagcctgttgtgtgactgcatttcagagggtctttagggattccaccctcactacaccatgtcccaaaggggtccacatcccatctggactccgttttcttcttaatgacaggaaacttgcagaaagagggcttcggaaaccattccagaaccctactctgcccatggacccagaaaaacataagatgaggacaaacaaggaaagtttaggttttcgctggagaaagaggaaaggcagaaacagacaggaccagaaaaccggccagacaagatgatgtgtaagtgccaaaagaaccataag

SEQ ID NO: 476424 - DNA, 670 bp, Homo sapiens
gggccccttgaaggaacgggcataccaattcccagagctcacatgtatcaggaacaactcctggtcctgccagccagagacccaaatataacttctagagatggaaaaactctagttgttatctcaatgtctgaggtaacaactagagaggatgggattaacagttttgacattttagaagaaaacattactttacttgaagaaatagcaggctgcagaattggtttttataactgtgatcctaagtggacgggtgtcacgcaggccatgagaagggaggaccgcagtgtgcatgtagcatggcatttgaagcccttgccccttgggataactctcaaactccccaataattgcacatgcatggcctcagacatccaaggggctcccgttgtcatgaacaccattttgaccggatacattgtcttcgctaacacctctacagctctttgtatgacaaagttatgaatgatttgacctgttacacataacatacataatatgatataaagctgctatcagcatggactcaacagttgtaattactttcatgattgctgaaactcctagtgtctctaacttgcagtttctcacaattgcatcttcccctgtaaattgattatatattcgactatatattttaagctgaaatattttaaagtgaattgtagct

SEQ ID NO: 476425 - DNA, 600 bp, Homo sapiens
caagcttctccatcaccatgagaagccagcccaagatgttcaacaagaaccacaggaaggacaccaggtcctggagctgctgccctcctgggctcctgtgtgattctccccatgcagcaagcaaggtgcctgatgtcctcctgcgtgcaggcgagtctgtagaccaccatgcgggtgaatctgcggctcagtgcaagtcagtgggagcccaggaggtggacatggacgtcagcctggggcaggagaagggaagctgcagtcaaatagccacgggccaagtctggggcagcacaaagagggccttcagctccactgagggcccggagcttctcaaaggcagagatcttggccagaggaggactggcaggggtttggcagcacaggagaaagctggttttatgctgagcggtggcatacagcatggcattgtggaaggagaggttctacacctgcctgtgccaggaacaacaggcatcctgctgcacgagccatccagcactgccggggactgagtggggcatgtatccttcactgcagaaacagttcagcctggttccattttgtcagtaacaaaatgaaacgaaaagatgagctgttttt

SEQ ID NO: 476426 - DNA, 1277 bp, Homo sapiens
gtttccggccgttcagtccccaaccccgtggccccagccgggctacgcacgctgcgggcctcaatttcttcaatcgcaaaatggggacagagcgcgggactcgcggggaccggcggggggtgctgtgggcccgatccggagtggggactggggtcagggtcgtggtctacgggcccggcgtgggggtcgcggcaggggggctgggctgcacccccgggccggcgagggctcgcagtgagggaggggaacacggtgggcgggggcggcccgtggacccaacgccccctccccgggcgctcccaaacctcgccttttatggagaggaactcgggccaagtgggccgggccggccgaggggcggggtgggggccggtgaggggcgggctgggggccggccgggtccgcgctggactcgcacggggcctggcttatctcccggagcgcctcgcggccctgggacgcgggaggcgccgcgagctgcggcccacgtgagccgcgcgggcctgggagctcccgataacaactatccacccagcccgggcagagtcggcccccgcaccccaagctgagactctagccctggccccggaacggggtctgccctctctccctctctcctctcctttcctttcctctccttccctctccttcttccctctctccctcccttcctccttccttcttcccttccttccctccctccttccttccctccctcccttccttccctccctcccttccttccctccctcccttccttccctccctccttccttccctccctcccttccttccctccctcccttccttccctccctccttccttccctccctccttccttccctccctcccttccttccctccctccttccttccctccctccttccttccctccctccttccttccctccctccttccttccctccctcccttccttccctccctcccttccttccctctctccttccttcctttattccttccttcctccctccctccttctttccttcctttattccttccctcctccctcctccctccttcccttccttccttcccttcctccttccttccttcctttcttcctatttgcaaggattccccttagcctggtgcctctgccaaggagctgcagaggcccagggcagagctactgaaggcagccaagtgaccaccccaggctatgtctggaggccaggtgtatgtggggaccaaggctctgctggtcacctcctctgaggagccctccctgactgcttttctttttttttttt

SEQ ID NO: 476427 - DNA, 3512 bp, Homo sapiens
tcacctcgcagcctctgctgaccacacctccctagcgcagaggctgcccgggagcaggaaatgctccaccaggtgacagcctctggtgctgtctgccaactccccagtcctgagcctccaggccgccggcactccccgttccccgttgcgggggacagtcctatagttgcagcagcacagccgactcccgggaatcggggtctgaccgccaggatggaagtggggccagccaccgagaccttcgtgctggaacttcaatgtcttgaggatgggggcccagggcctgacaccctctcaggtggcagcggtgggagcgagagtcaggaggaggaagagcctcaggagaggaacagcagtccacagcggccagcagtctcggccccagtgggggccagtgaaatcgctgaggaaacccggccgggacaacgagagttgcaactgcagcagttagaacagcagcccgagccgcagcaacagccgcaacacgagcagctgcaacagccgcagccacacctagaactgcaacagcagccgcagcaagatgggcaacaacagctatctcaactacaacaggaaaaacaccaatccgtgcaccatcaggaactgaaaccagaactgcagctaatgcaccagcagcaacagttacagccacagcaagtgcaagagcaacagcggttgcagcagcagcaggagcagttacagacgcagcaagcacaagagcaacaggtattgcagcagcaggaacagctacagcagcaagtgcaagagcaacagctgttacagcaacagcaggaacagttacagcagcagcagctgctacaacagcaggaacagttacagcagcaacagtttcaacagcagcaggaacagttacagcagcagcagcagctactattgctgcagcagcagggacagttacagcagcaactgttgcagcagcagcaggcacagttacaacagcagctgctggaacagcagcaggcacagttacagcagcagctactgctgcagcagcaggaacagttacagcagcagcagcaacagcagctgttgcaacagcagcaggaacaattgcagcagcaacaactgcagcctcctcccctggagcccgaggaggaggaagaggtggagctggagctcatgccggtggacctggggtcagagcaggagctggagcagcagcggcaggagttggagcggcagcaggagctggaacggcagcaggagcagcggcagctgcagctcaaactgcaggaggagctgcagcagctggagcaacagctggagcagcagcagcagcagctggagcagcaggaggtgcagctggagctgaccccggtggagctaggcgcccagcagcaggaggtgcagctggagctgacccccgtgcagccggagctgcagctggaactggtgccagccgcagggggcggcggagcggcggtcccgggggctccggccgcggtcgtggtggctcccccgggctacgtggtggtgcaggagctcatggtgctgcccgccgtggcagcgccggccgtggtggccatcccgggcccggcaggcagcgcggcgttgacccctgcacggcagcggcggcggcggcgcgctcgggaccggccgaccatctgcggggagtgcggcaagggcttcagccgcagcacggacctggtgcgccaccaggccacgcacacgggtgagcggccacaccgctgcggcgagtgcggcaagggcttctcgcagcactcgaatctggtgacgcaccaacgcatccacacgggcgagaaaccctacgcctgctcctactgcgccaagcgcttcagcgagagctcggcgctcgtgcagcaccagcgcacgcacaccggggagcgaccctacgcctgcggggactgtggcaagcgcttcagcgtctcctccaacctgctgcgccaccggcgcacgcactcgggcgagcggccctacgtgtgcgaggactgtggcgagcgcttccgacacaaggtgcagatccgccgccacgagcgccagctgcacggcgcgggccgctccaggggcctcggcctgctgcgcgcctcgcggccggcggccctcggtggcccagcccgcgcggagcaggccgctacagccactgcgcccgcagacaaggcgctgtgagggccgtgatcggggctgcctggccgggaggggaccccccacccgcctccacctgaaaagctccttgacccgggttcatgggcgctggaggcgtcctggaatatccctggagtaaaaggcttccaccatcatcatcatcatcatcttccggattccctgagaaaataccaggttcacagatttcaccgccagaaaaatccatccgccaaaagagaagtggaccggggctgaaacagcacacgggacacgtttgtctgccctttgaggggtctgccaaaggttttccctccgggaaaactggacttactacgaacgaggaaaaacccccagtggcgagacgattaatgacactggccgaggactggacacccaccagggaatcaagacgtggtgagacacacgtggaaaatcttcgatcctggtgaaaatgatcgcaaggagaaattcggggaggaagcaaacttgtttgcactatgtagaaactgaccaaggcatcgaatcgtcctcagaggcatttgccttgaaaatactttccaagatgaaaattcatcagggtgggtataattctgatgaaaacgcctgtgttcatcaacacagggtcagagcgctcaccgggtcgatgtgcaaatccaagccaggaagtcctgctccgggtggaaggtaaaaccttccctccagggaaccaggggctccggcgggcatcggaggcagcttcttggcctctgctgctgtgtcccccagtccccccagcccgcattaatgtcctctggaataagagcctgtggctgaagcagagggccttctgggagagctctccaaggtctggaaggagggtcccccagaaggagctccggggtagccccactgtggcccccctggactccaccagcttcatgcttctcagatgctacccaggggccggcccggggagaccagggcagatttctcccgcaccaggctgtggaggtttggagggctgcctgagcagacactgtgccattgctggggctggggaaagaatatctgagacgacgtttgggagcaatgctctttaccacgttcaccaagtcgtctggggcaggggttgtgagctgcagcagttgctggtgccttgtgggaaggtggggcagggaggaggctgcccgccacctctgcccccagtcacttcctgcttgacctgactcttcacatgtggctgcttaattcctgcccctctccccccagctgcttctcctttactaacacacctgctacattttacacatgtgttggtaagtgagaaacagaaacgaaaaataaattaaaatgcagaaatacaatgtccttgtcttggtgttttcacctctggattttgtgtcttccat

SEQ ID NO: 476428 - DNA, 873 bp, Homo sapiens
acaattaaaatgtcagttttcaaaaatgggatataaggacaatgattcatcacaactttttggtgaaatctaacagtgttcttgcccagttgtttcataaaaactggtatttttgctggaaaaggaagagggagtggttggacaaatgtgaggaggagccagagaagaagctcacccccgagcctgaggagacctgggtggtggagatgctgtgtgggctcaagatgaagctgaagcaacagcgagtgtcacctcctgacctagacacgcccccaccaaagatcccatcggagcccaccatcctgggagcatcaccgacatcccttcctccctcggatttgcatccgaccatcgaatacccctccaccctgctatttccaaatgagtacagtcaccccaacactgaagaagctgacgtcagccagaagtctctcctggtggtgcccctgagcagtaacctgatagctgtccccagctacttggccaatgacatggaggaggacagcgagacccccaaacaaaacatcttcttcttcctgtacgggaagaactgctctcagattgccttgttccatacgcttcatttccgggtcttccgttctgtgtgctgcagggcttgcatttccctggaggagttcgaggagatccaggcttatgacccagggcactgggtgtgggcgtgagatcgcgcccacctttcctagagctccagggaccgtggaggcctgagcttgtattaccacaacaataccagcccttcaagcaattctgggtgaccccaaaactcatttgaactcagcagcccaagagtttcattcctctaactttaggggactcagtgcctctggtcagcatgaagtagatacagaagca

SEQ ID NO: 476429 - DNA, 13195 bp, Homo sapiens
tctccggccatgatcccaaaagattggcctttaattataattgatctaaaggattgcttttttaccatccctctggcagagcaggattgcgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattgtattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaaatagaaataagaaaagacacattaaaaacactaaatgattttcaaaaattactaggagatattaattggattcggccaactctaggcattcctacttatgccatgtcaaatttgttctctatcttaagaggagactcagacttaaatagtaaaagaatgttaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtggagtggtcattccttcctcacagtacagttaagacttttacattgtacttggatcaaatagctacattaatcggtcagacaagattacgaataataaaattatgtgggaatgacccagacaaaatagttgtccctttaaccaaggaacaagttagacaagcctttatcaattctggtgcatggaagattggtcttgctaattttgtgggaattattgataatcattacccaaaaacaaagatcttccagttcttaaaattgactacttggattctacctaaaattaccagacgtgaacctttagaaaatgctctaacagtatttactgatggttccagcaatggaaaagcagcttacacaggaccgaaagaacgagtaatcaaaactccatatcaatcggctcaaagagcagagttggttgcagtcattacagtgttacaagattttgaccaacctatcaatattatatcagattctgcatatgtagtacaggctacaagggatgttgagacagctctaattaaatatagcatggatgatcagttaaaccagctattcaatttattacaacaaactgtaagaaaaagaaatttcccattttatattacacatattcgagcacacactaatttaccagggcctttgactaaagcaaatgaacaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcatatgttcacgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcagagatgcaaagaaaagcacctccgcggagacggagacatcgcaatcgagcaccgttgactcacaagatgaacaaaatggtgacgtcagaagaacagatgaagttgccatccaccaagaaggcagagccgccaacttgggcacaactaaagaagctgacgcagttagctacaaaatatctagagaacacaaaggtgacacaaaccccagagagtatgctgcttgcagccttgatgattgtatcaatggtgtctgcaggtgtacccaacagctccgaagagacagcgaccatcgagaacgggccatgatgacgatggcggttttggtgaaggtacgctcgagcgtggtcattgaggacaagtcgacgagagatcccgagtacatctacagtcagccttacgatctaaaagattggaaaagaattggtaaggaactaaaacaagcaggtaggaagggtaatatcattccacttacagtatggaatgattgggccattattaaagcagctttagaaccatttcaaacagaagaagatagcgtttcagtttctgatgcccctggaagctgtataatagattgtaatgaaaacacaaggaaaaaatcccagaaagaaacggaaggtttacattgcgaatatgtagcagagccggtaatggctcagtcaacgcaaaatgttgactataatcaattacaggaggtgatatatcctgaaacgttaaaattagaaggaaaaggtccagaattagttaaagaaaataagacccaaccgccagtagcctatcaatactggcctccggctgaacttcagtatcggccatccccagaaagtcagtatggatatccaggaatgcccccagcaccacagggcagggcgccataccctcagccgcccactaggagacttaatcctacggcaccacctagtagacagggtagtaaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaaagctaaaagatatgaaagagggagtaaaacagtatggacccaactccccttatatgaggacattattagattccattgctcatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaaattagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgccgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaagaaaatgttataattgtggtcaaattggtcacttaaaaaagaattgcccagtcttaaataaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtcccccgccacaagcggcagggactgtaggactaatcttgggacgatcaagtctaaatctaaaaggagttcaaattcatactagtgtggttgattcagactataaaggcgaaattcaattggttattagctcttcaattccttggagtgccagtccaagagacaggattgctcaattattactcctgccatatattaagggtggaaatagtgaaataaaaagaataggagggcttggaagcaccgatccaacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtacggagattttacattgcttagggccagataatcaagaaagtactgttcagccaatgattacttcaattcctcttaatctgtggggtcgagatttattacaacaatggggggcggccactgtagagcctcctaaacccataccattaacttggaaaacagaaaaaccagtgtgggtaaatcagtggccgctaccaaaacaaaaactggaggctttacatttattagcaaatgaacagttagaaaagggtcatattgagccttcgttctcaccttggaattctcctgtgtttgtaattcagaagaaatcaggcaaatggcgtatgttaactgacttaagggctgtaaacgccgtaattcaacccatggggcctctccaacccgggttgccctctccggccatgatcccaaaagattggcctttaattataattgatctaaaggattgcttttttaccatccctctggcagagcaggattgcgaaaaatttgcctttactataccagccataaataataaagaaccagccaccaggtttcagtggaaagtgttacctcagggaatgcttaatagtccaactatttgtcagacttttgaacaagttagacaagcctttatcaattctggtgcatggaagattggtcttgctaattttgtgggaattattgataatcattacccaaaaacaaagatcttccagttcttaaaattgactacttggattctacctaaaattaccagacgtgaacctttagaaaatgctctaacagtatttactgatggttccagcaatggaaaagcagcttacacaggaccgaaagaacgagtaatcaaaactccatatcaatcggctcaaagagcagagttggttgcagtcattacagtgttacaagattttgaccaacctatcaatattatatcagattctgcatatgtagtacaggctacaagggatgttgagacagctctaattaaatatagcatggatgatcagttaaaccagctattcaatttattacaacaaactgtaagaaaaagaaatttcccattttatattacacatattcgagcacacactaatttaccagggcctttgactaaagcaaatgaacaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcatatgttcacgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcagagatgcaaagaaaagcacctccgcggagacggagacatcgcaatcgagcaccgttgactcacaagatgaacaaaatggtgacgtcagaagaacagatgaagttgccatccaccaagaaggcagagccgccaacttgggcacaactaaagaagctgacgcagttagctacaaaatatctagagaacacaaaggtgacacaaaccccagagagtatgctgcttgcagccttgatgattgtatcaatggtgtctgcaggtgtacccaacagctccgaagagacagcgaccatcgagaacgggccatgatgacgatggcggttttggtgaaggtacgctcgagcgtggtcattgaggacaagtcgacgagagatcccgagtacatctacagtcagccttacgaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcgtttcagtttctgatgcccctggaagctgtataatagattgtaatgaaaacacaaggaaaaaatcccagaaagaaacggaaggtttacattgcgaatatgtagcagagccggtaatggctcagtcaacgcaaaatgttgactataatcaattacaggaggtgatatatcctgaaacgttaaaattagaaggaaaaggtccagaattagtggggccatcagagtctaaaccacgaggcacaagtcctcttccagcaggtcaggtgcctgtaacattacaacctcaaaagcaggttaaagaaaataagacccaaccgccagtagcctatcaatactggcctccggctgaacttcagtatcggccatccccagaaagtcagtatggatatccaggaatgcccccagcaccacagggcagggcgccataccctcagccgcccactaggagacttaatcctacggcaccacctagtagacagggtagtaaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaaagctaaaagatatgaaagagggaacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgctgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaagaaaatgttataattgtggtcaaattggtcacttaaaaaagaattgcccagtcttaaataaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgggagcccccacaaaaaacccccacaggggtatatggacccctgcctaaggggactgtaggactaatcttgggacgatcaagtctaaatctaaaaggagttcaaattcatactagtgtggttgattcagactataaaggcgaaattcaattggttattagctcttcaattccttggagtgccagtccaagagacaggattgctcaattattactcctgccatacattaagggtggaaatagtgaaataaaaagaataggagggcttggaagcactgatccaacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtacggagattttacattgcttagggccagataatcaagaaagtactgttcagccaatgattacttcaattcctcttaatctgtggggtcgagatttattacaacaatggggggcggccactgtagagcctcctaaacccataccattaacttggaaaacagaaaaaccagtgtgggtaaatcagtggccgctaccaaaacaaaaactggaggctttacatttattagcaaatgaacagttagaaaagggtcatattgagccttcgttctcaccttggaattctcctgtgtttgtaattcagaagaaatcaggcaaatggcgtatgttaactgacttaagggctgtaaacgccgtaattcaacccatggggcctctccaacccgggttgccctctccggccatgatcccaaaagattggcctttaattataattgatctaaaggattgcttttttaccatccctctggcagagcaggattgcgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattgtattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaaatagaaataagaaaagacacattaaaaacactaaatgattttcaaaaattactaggagatattaattggattcggccaactctaggcattcctacttatgccatgtcaaatttgttctctatcttaagaggagactcagacttaaatagtaaaagaatgttaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtggagtggtcattccttcctcacagtacagttaagacttttacattgtacttggatcaaatagctacattaatcggtcagacaagattacgaataataaaattatgtgggaatgacccagacaaaatagttgtccctttaaccaaggaacaagttagacaagcctttatcaattctggtgcatggaagattggtcttgctaattttgtgggaattattgataatcattacccaaaaacaaagatcttccagttcttaaaattgactacttggattctacctaaaattaccagacgtgaacctttagaaaatgctctaacagtatttactgatggttccagcaatggaaaagcagcttacacaggaccgaaagaacgagtaatcaaaactccatatcaatcggctcaaagagcagagttggttgcagtcattacagtgttacaagattttgaccaacctatcaatattatatcagattctgcatatgtagtacaggctacaagggatgttgagacagctctaattaaatatagcatggatgatcagttaaaccagctattcaatttattacaacaaactgtaagaaaaagaaatttcccattttatattacacatattcgagcacacactaatttaccagggcctttgactaaagcaaatgaacaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcatatgttcacgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcagagatgcaaagaaaagcacctccgcggagacggagacatcgcaatcgagcaccgttgactcacaagatgaacaaaatggtgacgtcagaagaacagatgaagttgccatccaccaagaaggcagagccgccaacttgggcacaactaaagaagctgacgcagttagctacaaaatatctagagaacacaaaggtgacacaaaccccagagagtatgctgcttgcagccttgatgattgtatcaatggtgaggagattagtgtgggcctgagtgaactggttggggaagatgtgccttcagtgttggtgggcaccatccaatcagctgcaagcccagacagagcaaatacagaagtcaaactggtctctctgggagctgggacagactttgctgctgctgccttggacatcagatctgccccagcctcacaggtctgtgggctccaggacttacaccagtggcccccactgggtcctgaggcttttagcgttggactgaagagttacaccatcaactcccctggttctgaggccttcagacttgaactgaaccacaaagctgccatcaccccagggtctccagcttgcagatggtctatcataagacttctcagcccctataaccatgtaagccaacccctccaataaattccctctcatccatccatatccatattctgttggttctgtctccctggagaaccctgattaatacagatttggtattgggaaaagcgaaatatcattcattcttcctgtattccttaagacacaatggaagagacctgtgaaactgtccccttgaaaataaaaggccatattatacatacggggctacttaatggtaaaagataaaagtttaaaggctaattattattggtgcttcaaaagcagaaaatcgcttaattgcaatggccagcacatgcttacaaaatcagtagaccacaaccactctccaaacataagtgcagcaagtgtttccaagattacagaagaaatgaaaatgcaggtgaaaaatgaaatacaagaaatctcccctgccaaattattcgatcatgtacgacttctgccccttcacacagggtcaccaattcgcgatgctaggctattttcacttctaaaatgatctttgaataagttagaagagcctgagaaatctcttcagactttcatg

SEQ ID NO: 476430 - DNA, 1947 bp, Homo sapiens
ttgtaacaaggggagttgtgccaactgttgatgtagagcttgacaaggccttagccgcattactgctccacaatgaagggggcacaggcaagagaatccctggtgcctcctgtaagtggaatcgtatagtatttgtctctcggcgaatggcttatgtcactctgcttaatgagttttatgcgaatggactccatggaggttgggccaggtttgatgcttgtggcatcgacaagtcagtgaaggtcatctctggatcctcaaccaccaggccgtattttcttcgcaaatcttgccagctgtgtcttgttttgccagctggtgttctcactcccgctgctgccattccgctcacggcagaaacacccttgtctcttgccttctgcaactgcaaagcaaaatcgtctatcacagagagaggctccaatgcaggtaatgccatcatcgcccttgtgatttatgacggaggagacctcgctgtcaatcagaggttcttagagagaggagggacagggcagctcgccattgtggatgttgtcagccaactcctgactctctgaacctggagatcagatgtgcagacatccctctctcttctctctctgccctttttctctctccccacctcctctctctctcactcctctcacctctttttctctcccctcctctttctctctcttctctcccttccctcaccttccccctctctcctgtctatccccaatctttctccctctccctctttctctctcccttctcactcccctttctctctccttcctctctcttcctcctctctctctccctcctctccccctctccctcctttctcttcctcctctccctcctcactcttcctcctctctcctcgttttctccctctccctctttctctctctccctcctctctccccttctctctccatcctctttctccctcccctctctcacctctcttttcctcctctctccctcttctctctctcctctctcttcctcctctccctttctctccctcctctccccctttccctctccactctcttcttcctcttttcccctcctctttcccccttctctcttcctccccctttccctctccccctccccctttctctctccccctcctctctccctttcctctctctctcttatcattccctgctctttttcttatttctccctgctctctttctctctcttgtctctctcccctcctgtctcccccctttctctctctcctctcctacctcccccttttctctctcccccttcccattctctctccctgccttctctccctcttctctctctccctctacttctgtctctgaaaccaacctagtagtcccatagacaagtttttttgttttttggataaacatagaagttgacccatctgatcaagttcttaaagcttgaaacttggctttgttttatctgagttcctgttttcttacacatagttacatttcttccctgctaaagaaaggcctttagtgggtcaagaagatggatttgagactgagctcccatctcagctgctgcacccgattaaagccttctccctcagcaacactcattgtctcagtgattggctttctgtgcagtgagcagcagggcctagaccaaacccctggtgttttggtaacatctctccccctctctcttgtctttccctcttctctctctttccctccctctcctctttctctctttctccctttctctccaccttctgcaactctatacagactccctactgggggctcttccccggcagttcccttagcagaggcagatgcatatctcttctgggcagttgttccagattgctactgctacccaacaaatcaaccctaagcttagcagctcacaacgaccatttttgttttgcttatgatttcatgggtaaggaatttgggaagggtttggtggggcggttct

SEQ ID NO: 476431 - DNA, 630 bp, Homo sapiens
cttgtaggtttgattccttctctaccaagtctaggaactgaatatacatgaagcacaatggttatttgtttcctgttggcagcgttccacacagccgatcgcttccgtctcattgagtcattttcttcatttggcttccaggacaccaaagcctctctgttttcctgccgcctccccagctgtgccttctccatcccctttgcttcttcctcctccccttctcctcactttctaactccggaggccataatctcctctctacctacgccccgtcccttggcgacctcatccagacttgtagcttcaagtcccatctacgtgctgatggtgctacaagtatgtctccagcccagtcctctcccagcaatctcagacacagaatccagcttcctccacttcactgatgtcctaactgtccttccagctggcacctgccctttagggctctagacaattccatctcatacactgagtagcctgatctatattcatgatcaaggagagcttgagcgaaggcttaagattttcagtgtcatatttcaaatcggattttcgaagtgtgagtagatatcagctatgtgggcctgaaagttctcattaccataccagtgacagttcagggaaatttac

SEQ ID NO: 476432 - DNA, 455 bp, Homo sapiens
acagctcattgagaacaggccatgatgacaatggcggttttgtattcctgttggactcagatactacaaccactaagtactctggttggactcagacactataaccaatgggtactcctgttggactcagatactacaaccactgaagtactctggctggactcagacactacacccagtgggtactcctgttggacttggacactacaaccagtggatactacaaccactgaagtactctggttggactcagacactacaaccaatgggtacgcctgttggactcagatactacacctgctgagtactctgactggactcagatactacaaccagtgggtactcctgttggactcaaatactacaactgctgagtactctggctggattcagatactacaaccactgagtattcccgttggactctgatactactacatccactgagtattccc

SEQ ID NO: 476433 - DNA, 1374 bp, Homo sapiens
attttggaatcgggccttatcatcaccaaacatgagaaatggaaacggctcagatctgtcatctccccagccttccctagcggagagctccaggagatcccctgggctccggtcaccgagactgggagaagcacacctagctgtgggctggagcctgcacctgctacgcgtgagagcctattctgcacattttgtcccaacttcatgttcagcgctggtgacctgtggatgcgtccagggcaaaatgctgaactgttatccttgtgctccggccgtttccctcctcaaacttcagggagaccttctggtgcaaaacattggcaagaatgtgaggagcaagtgggaccatcggggagggcccaggaccgatgaggatgttgcagccttcggtggtgtggaaacggccctgccctcgccccacgcctttccctctctccacctgcggaaacgcctccatcctggagggcacctcggacaccggctcttgcatgcacgcttgctgacgtgcccggcgtgccgctgctcctcgtgcctgcaccagcacccacagatccagccctccatgctcctcgccatgttactgtgccaggcctcacacaggagagcggatcccctctccgttctggagatccaggtgtctgcagggctgcgcccctctgaaggtgcagggaaggaatctggcccgggtccctctccagcttctggtggtccccccccccttgtggttcgacgatttgctggaaagactcggaactcgctggaagctgtgatagtcccagctatggtttatcacagggaaaagacaccgattaaaatcagcatgcaggggcagagcccacgagggttccacacactgagcgtctgctgtcctctcctgtggagctgcggacagcgttacccctctgacaatgtgcgatcatacgcacaaaacacggtcagccaggaaggctttctgccccgcccccagcaatgcagagacatgcaatgtgaaaacccaatcaacccgtcagcaagtcctggttttacaccccttcttgtcgacctggtggttggggccttctgcaggctgagtggcagagtttcttccttctggtgggttcgtggtctcgctggttcaggagtgaagctgcagacttttgcggtgagtgttaccgctcttaaggcagcgcgtttggagttgttcgtttttcccggtgggctcgtggtctcgctggcttcaggaatgaagctgcagaccttcgtgggcactgattggtgtgtttacaatccttgagctggacacaaagtttctccaggtccccaccagattagctagatacagagtgtggacagaaaggttctccaaggccccacagtagctagttacagagtgtc

SEQ ID NO: 476434 - DNA, 464 bp, Homo sapiens
cagttgccagaatgtcccgcccctctgtctcacgatccattgatccttcccgcatcataaggcatccctggcttcctcctgcctgccatgagctccacttgccctggacacttaacaacagcagcagtggcagccgcaggaaggagcgaacatcttctgagctggatgctgattcattcggaaggcaacagaacatccagatgccagatttagtggtgattgtcctggggaccccatggggctctctggacccaccagctctgcaggccaaacatattggtggcggctggagaatcccacagaaacggacgcattttcgggatgcctcagaaatacgactttttattgtaattaaaatatttgaaattttctttgaaatttatttgaaattcagccccataatagagtggtttgcttaatgactgcagagtattgtcttatctgaggagaagcaggacatttta

SEQ ID NO: 476435 - DNA, 463 bp, Homo sapiens
atatggcctctgggactccggcatcagcatttggttccccatgggtgagaaaacagggagggaggaggacggggagggagcctccagcttgatcactcctgggaggagcctgtggatttctgggcttgggggtcccacagagcccagtgcccatcttcctccagcctctgtgccatctaaaaacctgctcacgaacctgggggagcccccacaggctcgagctctggcagcaaagctcctgggaaggccctccagctctcagagtggcagccgcgtccctgctgtgtgggctcaggcgggaaatgctacctacatcacggtgcacacgctctgcagccacaacacacacatgtccccaatgcaggatccttacttccccgcacttagaccctgtggaaaggagaagccagatttcacaagatgtgggggcctaaccacgggaagcaccagcatgcactgagcg

SEQ ID NO: 476436 - DNA, 1966 bp, Homo sapiens
cacgatagacaggtgtgatttgcagtcacatcaccatgagggcacctccgccctccacagacatgaagtggcaggtccagcccagagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagaaccaccccggcagctatgggggagcccacgagtgcctgacaagaggtcacgtcttcctgggacctcccagaaagccagcggaggggccggggatagtagctgctctgggctcaaggtgagcagtattgccgtccctgaggatggcgtgcaggtgaaggtactgccgatcccaggctgggcatttcttcacgtgcacaccttcgctgtgaggtaccgcaggctccagaggccaccctgggtccaggtccaggtctgctctcaggggaaccggctgcaagccagggcgctggggggttcagagagggatgggctgtgtttgaggagaggggatctcagcagcatgaagggcagggaggcctcggcgttggggcagcagagcctcagccagaagccccagacgcagagctggccttgccatgagctggaccgcactgagctcatcagtccttcagggaagccagcaaccatcacctgctggcgtcaggaccgggccaggcccgcagccagggtgtcctgccccaagcttcgggtggctgtgtttggaagggttctggctgccgtgagccaatgcctgggctttgcctgtgagaggctttctgttctggggggcttccagtgccacagaacctactccccttccaggcccatggaaggccctgaatgggacgccgggaccacccagcacccatcaagatacaatttcccgcttttctctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggtcagtgtcggtgcctacttccgggcagtgaccatcagcccctacttctgcaaagctcgctgcatgtacgaaagcagcaggttgtgcggagcaggcagccttcgagcaggacagtctggtcagcaaagaggctcatctcacagcgccggcctcgggcctgtccctgctgccgctgccgggccgctgctctttcgagtatccaggcaccgtgggggtgtcatagctgtgggtggttcctgtgtgctgagcgctcgctgctgtgtgtttccagcactcactgtgggcctggcccaggtcaagttcccagatgccaaccaagggtaatctttgaaagcaggtctttttaaggctagtggtctcagacctgctctgttaactttcttccacaccagattgtttctactttttggttactgtgaacaatattccctttatctggttgagtttggacatttttaaaccactctcagaactattgctaaagtgaaaattctgcagatccgttcccaggtgctcaggagccttcctgatcggaggtgctcctctgaattatgtcctaagtgtcacacgacgcatgctgtggctatttctgtttttctgtttagaaacaa

SEQ ID NO: 476437 - DNA, 806 bp, Homo sapiens
gcatgtctctgactctgcatatgcccaggggcaggccatctgcctgaacggtgacctcggaccctctgccgttgctggcctctgtggaacctcccacccagctctctctgctgaggtggcactaggcacgtccctgagctgtccagcagcaccaaggggagctcgagccctgcaccgtccactggggctgacagcaagtgatgccttcacaaccattgtttggaggagcccccactttccacaggaccccttcctgcctcccctgcaccggcggagggcatgtggccgggacatcccctcgccctccaaggccatgtctagaccactgttcccctcttgattttctcctgacttcccgaaccatcattcccacctgctgcatcgggcaccctgccattgtccttgaggacagcttcagccccaaggaagaatctcaacccaagattgggtcccggggtcaccggctctgtgattttcctctggacctgccagacaccccctcctcagccctggcagtgcctgcatcagtcacacctccaccttccccgttctgttttagggatgggtctccctccaacccccttaacctcctgtggttccagcttaatggtgggccctctagccagcttcctgacagccctggtgatacagcggtgccattacagggagttctcaatgtccttgagttgtgaggttgtgcagggaaatagaaatcactataaaaagaaactgttcatcagtaaaccgtccacatactcagaggactctccctatcttgccgagggttccccaacccctggagagag

SEQ ID NO: 476438 - DNA, 1425 bp, Homo sapiens
agcagtgcctctcctcagcagattagggttgttacaatgcaggggataaaagcctaaatggcactttgggaggccaagctctgcactgctgaaaagctcttcgctctcccacactcacagcagcacactcacaagtctaaaagggggaaggcccccgagtgtccatccctggaggagcagacacaccagatgcgccatgaaaaggaaggcaattccgacatctgctacaacccggttgaacctcaaaaacctcacgccgagggcaaggatctggacacaggaagacaagcactgcacgactccatttgtaccaagtatcgagaggctgacccacccccagccatgggggccaactggggcccagtcacccgaatacaactggagagcacagaatctgccatggccgccgtccgcagtggcacccaccctttactgacggcaccctggcacccctctctgacagcacccttggtggccccaccatggccctcaatgggctcctctacagccaggtccatccctgagggaaagctgagccgtacctcggtggctctgagtgacccctttgaacatattttcgtgcaaagagaggcagaaataccggacactctaattattccgggcctgaaacaacacccttctaaatctgcaccagcggaaaagagcagaaacatcaggctctatgtgaagtcagggaactctttaaagtcaccagccagcgaggaggctgagcccatctttccctgccagtggcgtggagacctcagccccgacagcaatgtgttcaaggagaaagaacgctgctggacacctgaggggcttggccgcagcgtgcctggctgtccccaccactgtggccctctctggcagtggggttgggggtgcacggagcttaccagcctcgccgacaaagacctccacgggcgcgctggctgggctctcgccgatgatgttataggcgcacccaccaccattaagcaaaagacgtacccatcctatcctgtgttcagggagccccggctggaggagccgagcaaaccacctcagggagagctgcgcgaccagggagatgccaactgtctggtggtcagcaagggccacctttggggtgtgccaacagtgcagacaccagtgctgcaatttcccgtcttcaacattcatcaacatcatgcctggcgctgtactggggtcaagctgtgtgagcataggagcataggagctgctgccgtccgcgcactgggccaagctctagccctggggaaactcaacatctgtctgccccggatccgggctacacaggccctgggctgagtcctccgcacagctccccgccccactcttcagctgggatctccctggggcctgcagcccttccttgggcagttttgtccctctgttatatttgtcatcaatgtacttgtcagt

SEQ ID NO: 476439 - DNA, 891 bp, Homo sapiens
tggacacctgtgaatccctgctgtgttctggatagatgcatcagtcccttatagtttaaaccatgtacatttgggatcatgaaaaacggtgtgtgctgttgtgcaggacctgtcatagcagagggcttgtacccacggaggatcagtccaggctcctggagagaaacaataagcaacagtccccgtgaaccacagcatgtgacatgtgacatcaccacgtgtgcaggcaaatctctcagaagaaacctcaactgtgtctcaggaaactctggtggttgggtgggaggctggagtctccttaaaataaaggtcatgactttgggaaaaaggtggatatgggtgatgacacattgtctacataagaggactgagctgttgggaccaagaagacagaggggaaccaatgggcagaagttgctcaaagaaagatttcagttcagcataagggaaatcctccttatgatgtacaccctgcacgagttgacgtaaggagcaggaaggttgggtccaagaagttttgctggtggcagttgacaggtcgcaggcttgggtgaggtgacaggactcctgcccagcaagttggcacatgccgtgacctaggagggcccctggggcaccttctcctccagtctgcataactctatctggacatcatcaacgggcttttcatacgcgccttggtgctatgaagcttcacacaagaagcgttcggcaccaacattcaggtgattttaatttcatataacaaaaccatgatgctgaatggagcgtatgtattccagcttgcgtccatgccttggcatgttcccaggttgcactagccttcccgctgtgtttcatctggcaattatcacttatatttaaagctttggcccaggaactgtctcctcc

SEQ ID NO: 476440 - DNA, 794 bp, Homo sapiens
tttgcaattcctagagttgagatataaactagttaagacgccggagaaggtgagtctgattggcagattcccaccagtcctgagttctggccagctaagctcgggcagccatggatctgggggctgggagcaggattcagtcgggatgtgctggagcccacttaccccagctagtgagagctgaccctgggcacctcctcccagctccaagttcactgacgtcatattgggagcttgaaatcggctgtgccggatttacttacagcaagaaaaccacacttagtgtgctcaagaggttctctcaatggagcccgggactggcagtgtgggcatcccctgagtacctgccagaaatgcccggtccagaggcaccagctcagaaactctggtatggggcctgggaatgtgtgtcttcacaagtcctccagggcaaaagcgacggcgtttctaccctcatcaggagagactgcctctatgaatctctcgtcgccaaactaagcagttttaatccagatacagagtggagacagatgaacgcatgcaggatgcttctccagagacggcgtgttctcgctgttgtcagccatccagacaggctgaagaaatgctaaagagaagtttgtaaaattcagagcctcatctcagagggaaagatgagttaatgatctgctgcagaaggacttggcaggtattttggagcatttcatttattgagcacctaccgtgtgctggctgctgtgttatatgcatcgtacatattttgttctcacaacaactctggaaaataagcataa

SEQ ID NO: 476441 - DNA, 2226 bp, Homo sapiens
ttggaacaacctggaatggggtagatcatcctaataatacttggctgataaggacttcctgagctaatacatgcaaaccactacaaatgatgccttacactgttaactgctgctgtcatcatcattatcacaactacatcatcaccaccaccattaccagcacggccaccatcatcttcaccaccaccaccaccaccaccatcatcaccaccatgattatcatcatcatcaccatcattatcaccatcatcatcatcttcattatcatcaccatcatcaccacaaccactatcaccagcactaccaccatgatcttcaccatcactatcatcttcatcatcaccccaaccatcatcatcactaccactactaccatcatcttcatcaccaccaccacctttatcatcttcatcattatcaccacctatgatcatcatgaacatcatcatcctcaccaccaccatcattatctccacatcatcatcaccatcatcatcttcattatcatcaccaacatcattgccatcattatctttaccatcatcatcatcaccaccaacacaaatatcatcatcatgaatatcatcatcctcaccaccactatccttatcaccaccatcatcatcaccatcatcatcttcattatcatcatcaccaccaacatcattgccatcattatcttaaccatcatcatcttcaccatcatcatcaccaccaccaccacaatatcaccatcaccaccaccatcactaccactacacccacagaaatttctcatatacaatgacaaatgtggaacatacagaaacatatagggaatggtgggttaaatgctgcgtactcacaattcgacttttacaagccttaacattttgctgtttcctccaaattttttcttgtcttttaaagaaatacaacatcacagtgagcacctgctcataagaaactctcttatttgttgtatatctgaaaatgtctcggttttgtctttactgctgaatgatagtttagctggatatagaatctcaggaaaggcatttgtaaggaaatgtttgtcattgtgcttatcgcatttaataattatatacattgtgtgattatattttgtcttccagcagaatgatttttgtttgttttgttcactgtgtatccctgtccccggagcaatgccaggcacatcatagtcactctgtaaataggtgttgaataaatgaatgtgcaagtcagtgaattcctcactaggctgtctgttctccgagggcaaagtcagcttcttcctgttccgggctgagttccagtgttttttctgatgaagtaggaactagataaacatttgttgtagaaataaatgaattcacccaagatctaaaataaaataataggaatactactcttagaaactagtgccttttgaagaggcaatcttctgatcttctaggtctacattttcttaattttttttcccccactggaattagtaacaagggaactgcaggggcagactgtgggctttcatgagagcaaagccctcttttcaaatatctgttctaaggaggatcagctttccagcttaactgggaggctggctgagtcctcatttctaaacagatggcaacacatcattgctggtggctcctttaaggcagaaaggctgtcaaatcagcaaagatgacttccagatacagcctgcacagagaggcatggcgactgataaaatattcattagtgactgctgtggttgcagggagggcctgtgctgcagggaggcctgtgcacagagccagctgaggtcccagtgtgaggaagtgcattagggttttgcagtaaggcccatttaggaaggaggcaggggcctttgaggcctattgtgcctgagagcactaatgcccttcgatctggccatttataaaagagaaggaaccattaggtctcggaaaagatgcctggcctgcaccatttagaggacacaggggtcacctatgtgtcaacgaagtgaaaaggtcattcataaagccttcagtctgtcagccctagaacccaactcatcatttctgggttgaccaccatgctcctccactgtctggttatgtatgacaactctcaactggacatacggtcacatgtgtatagtcccagcagtcccaactctgggctcgttttgtggacacagatggccctctgtccccctccaatagccccctttagattggataagggaaatcatgt

SEQ ID NO: 476442 - DNA, 1508 bp, Homo sapiens
gccctcaccctcctccttccctggaacacgggcgaccactgcccactttgccgctgcggcaccctgagcgccgtggcccgtgcagaccaccagaggaaggatcccgggagccaggacagggcaaggaggatgaaccagacagaggcagcgctcagggacggaagagccacagtggcaaacacacaggggacgcagacaatcagtggctgctgtaaatatccgtggaacacggtcgatctcaacgaggggccgggctatgagcacggtctccctggagacacttagctatcctcagggcacctcgcaggggctgaggccctgcaattatccaggtgctggtttccatggcaacaaaaatcagaagggcacaagaggccaagccaacccaaatatggcatgcctatttcaagcctctccttgcctcatatctgttgatatcccactggccaaggccctttacctctcccatgggtctctccaaaagagtagctggacttcctacatgactcacagggctccagaaacacaaaaacaaagctatcaggctttcttaaggcttagacttggaactggtagaatattgcgtctgccacattctatttgtcaaaataagttccagcccaatccagatttaagtggaggggttacacaagggaatggatacctggagaagtggaaccatggtgatagtgatggtggtgatgatgaagatggtgatagtgatgctgatagtgatggtggtgatatgatgatggtgatggtggtgatgatagtgatggtggtgatagtgatggtggtgatgttgatggtggtggtgatggtgatagtgatggtgatgatggtgatggtgataatgatggtgatggtgatggtgatggtgataatgatggtggtgataggtgatgatgatagtgatggtggtgatggtggtggtgatgatggtgatggtgatgatgctgatagtgatggtcgtgatgatggtgttggtattggtgatagtgatggtggtgatgatggtgacagtgatggtggtgatgatgatgatggtgttggtgttggtgatagtgatggtggtgatgatgattatgatgatctgatggtgatggtgacagtgatggtgacgatgatggtgatggtgatagtgatggtggcaatgatggtgatggtgatgatgctgatagtgatggtggtgattatggtggtggcgatagtgatggtggtgatgatggtggtggtggtgatgatggtgatagtgatagtgatggtggtaattatagtgatggtgatagcgaaggtggtgatgatgatggtggtggtggtgatgatggtgatggtgatgatgctgatagtgatggtggtgatgatggtgacagtgatggtggtggtgatgatgatgatggtgctggtgttggtgatagtgatggtggtgatgatgattatgatgatcacgatggtgatggtgacagtgatgtgacaatggtgatagtgatggtggtgacaatgatggc

SEQ ID NO: 476443 - DNA, 758 bp, Homo sapiens
ctgcctgaaggtctccgctgtcagctaatgaatagctcgatgcagctgctgggaggttttgcaaagcgcattcagaatagcgagaatcagagcatggtttcttgcccaaaggccaggcatctgcgtggtcagatgggggagcatgagtgcccggagctgtgcggtttagggcagcctgaccttggatacctggttactgggccagtctggcggcccttgttgcttagagcggcagaacctccctgggggggggatgcggacgtgctcttttccagtctttggacaaaaaaaggcaaggggaggaggaaggagaagcgtctgagtttacccatggtattaatagcagcagggctggaactcgggtgctctgggagaggagacgtcctaccccctgtccccgtcagaacatccctgctccaggagcagctggggttccagtgtgaagcgtggctttgaaaccaggccccgctggcccccagctgtgtcgccagggccaagtcacttaacgtctgagcctcagtttccccacctgaaacaccgcagtggcacctgcggctccgtgtgtggcttggaggacgcaggcatgagacctgttggctgctgtcatgactgcagttagcagaggagggggacacactgtgacagggtccaaaggacagcgagaaacctccatctgggggtctcctttttggagcatggatgggttgtttgggcccaagtcacacctggaaccaatgtggtagggcttgtgaactttt

SEQ ID NO: 476444 - DNA, 1060 bp, Homo sapiens
cctctctgcagctcagccctgctccaaggccagcaggcgaggggccacaccacggaccatggaaatctcctcggagtcctcagacacgcctggccccgggcttgaccagcagggtcgtcagggaggcccagcatccatcagggtcgtgccctgggaaggagcccccagtgagcgcatgggctgcgctgggcaggcctgtgaggcacgtgaggggccccaactctgtggccagcacgaggaggctgaacccacggcccagcggcttcagagccgagtgcctgttaatgggggctccagaagcagccccctggcttcaggccccacagctgcctcttcccagaaccctcccggcacgcacttcggtgactcttacaagtacctgttcagcgtcagccttcgcccaggagtgcaggctggggacgagggcagtggccacctctgccggcctagcaatgagcagcagtaccaccaggccctttaatactaaggacatgtgaagtcatgtgtttggagctatttgttactcagcactagctacctgatacccctctctctagggccctggccagcagctgcccaacctcagttagcacaggccagaggctctaaaagttcccaggggtgctaagaaccaggccatggtgacagctggattccgctggctaacagtgccagagggtgccagggacagagcttgtgggagggggttcccaagtcaagtccatggcaggagctactgaagcagaagcacgagtctccactgcctttctttgcctcggtttttccccctgtgaaatgggcccatcaccctgtcctgtctcctggggacccctgctgaaaacctaaaggtctacactcttagggtaagaatgaaacggaattagccctgctccctccacacgaaagacacttggtgctaagagaagcaaaaagaaaaagttcttgagaagttagggctacaggtcttctctagcacagatttgaggtgctagcacagatttgaggtgctgccaagaatgcagagaactccaagcactcaatgcgttgtttgttttgacat

SEQ ID NO: 476445 - DNA, 717 bp, Homo sapiens
gtcttccataaaaccagtccctggtgccaaaaaactgggagccgctgaggtatgttatgatctttcttgctatactcagaaataaaagcatactttatacaacccagttcaagtggacagcttcatttttaaatcatcatgttaccagagaaatccttgcagcctactcagaacattttcttcatgatttagaaaatgattatcccaattttgtagtaaaagcagctgtggacctcgccaagacaatgcagactccactgactgttcctgtgcccgtgctccagttaccctggggccctgatggcctcagccttggctttgccccgatggatgctggggcagttgaagccagagctgccctttgggaacgttacctccacagcatgctggccatggagtatcaacaagtgagcttcacattgtacaattatgtgcacatggctgcccatttcagaaccaccaatctggacatggccagcttctatgtgtcacagctcaactgcagattcccataggataatagtgacacctttgttattaagttactttgtctattagtgcattctcacactgctgaagaacacaccaaagactaggtaaattataaaggaaagaggtttatttgactcacagttcagcatggcttgggaggcctcaagaaccttacgataatgggagaaggtgaaggagaagcaggtatccttttcactaggtgac

SEQ ID NO: 476446 - DNA, 819 bp, Homo sapiens
gtttatttgtgagatccagttacgcgttcccatttcacccaagaccttcagccagagcagggcatcaaagattcactccaaaaagtaataccaagaacatatggaaaatgtggacatgagaaattacaatttaaaaaatgccgtaaaagtgtgggtgaatactcataaatatgtcaaagtctttggtaaattttcaaattccaatagagataaaacaagatatactggaaagaaacatttcaaatgtaacaaatatggcaaatcattttgcatgctttcacacctaaatcaacatcaggtaattcatactagggagaagtcctacaaatgcaaagaatgtggcaaatcctttaactgctcctcaaaccatactacacataaaataattcatactggagagaaaccatatagatgtgaggaatgtggcaaagcctttagctggtccgcaaaccttactagacataagagaattcatactggagagaaaccctacacatgtgaagaatgtggccaagcctttaggcgctcctcagcacttactaaccacaagagaattcatactggagggagaccctacaaatgtgaagaatgtggcaaagcctttagcgtatcctcaaccctcactgaccacaagagaattcatactggagagaaaccctgcagagacttgttgaatgcttttgacccaaatgctaatagtgatgtagatgataaagtccaggctgaggttgtctcagatggagatgtgaaacttatttttaaaatggaagcagaacataaaagtttggaaactttgcacctgaccatgaggtagaatat

SEQ ID NO: 476447 - DNA, 871 bp, Homo sapiens
gggcggtgcaagatgtgctttgttaaacagatgcttgaaaggcagcatgctccagagcataaaacattcccaaaagtgatactgagaagatatgaaagctatggcattcaaaatttaaacttaagaaaagactgggaatgtgtaggtgactgtaagggacagaaaaaaagttataatggacttaaccaatgtttatcaactacccttagcaaaatctttcaatgtgatgaatgtggcaacgcttttaaccagtgctcaatccttactcaacataagagaattcacacaagagagaaaccatacaaatgtgaggaatgtggcaaagcctttaactggttctcaaaccttattcaaaataagagaatttgtactgtagggaaaccctacaaatgtgaagaatttggcaaagcctttaaccagtgctcacaccttattggacataagagaattcatactggagagaaaccttacaaatgtgaagaatgtggcaaagccttcaactagggctcacatctcagtggacacaagagaactcatactgaaggaaaccctacacatgtgaagaatgtggcaaaacttttaactggttctcatacttttctcaacataagagaattcatactggagagaaacccctacaatagtgaagaatgtgcaaaagcttttatgcatggctcaatccttactaaacataagagaattcatactggagagaaatgctacaaatgtaaagaatatgacaaaacctttaatcagagctcacaccttattggacacaagagaattcatactggagagcaaccctacaaatgtggaaaatgtggcaaagcctttaactggttctcaaaccttactaaacataagagaattc

SEQ ID NO: 476448 - DNA, 2826 bp, Homo sapiens
ttaacaaaaatggaaaactgtgatgccacagggctgtcatgctacctacctacctgtcaacctacctacctacctgcctatctatctacctacctatctacctgcctgcctgcctacctacatacctacctgcctacctacatacctacctacctgcctacctgtctacctacctacctgcttatctacttgcctacctacttacatatctacctgcctacctgcctacctacatacctacctacctgcctacctacctacctgcctatctacctgcctacctacttacatatctacctgcctacctacctacctgcctatctacctgcctgcttacctatctaactacctatctacctgcctacctatctacttacctacctacctgcctacctatctacttacctacctacctgcctacctacctatctgcctgcctacctatctacctacctatctatgtacctgcctaactacctatgtacctgcctacctacctatctacctgcctatctagctacctatttacctgcctacctacctatctatgtacctgcctaactacctatgtatctgcctacctacctatctacctgcctatctagctacctatttacctgcctacctacctacttacctacttgcctgtctacctacctacctacatatctacctgcctacctatctacctacttgcctacctacctatctgtctacctatctacttgcctacctacctacctggctgcctacctacttacctatctacctgcctacctaactacctatctacctacctgcctacctacttatctacatacctacctgtctacctacctgcccgtctccctacctacctacttgtgcacctatctacttgcctgcctacctatctacctacccgcctgtgaacctacctacctacctgtctacccacctaccttcctgcctgtctacctacctacccacttacctacttagataagcaggtacctatctacctatcttgagaagacaggaaacagctaactatcttcctacctacttttttcccccaataaccacagtctttctgtgcttatggttttattctgggaacctacacaagaactgaggcaaagccatggggccaggtgcccacactgactggatacagctttgggctgggcattgtgccttgggtcgggattttcatgatgaaatagctgagcattggcctcctgaccaaacatctgccgagtctggggagggcgatttactcctcaggaggctccaagatgaagggcaggtgcctcagcctggtggccccatcttctgtgatccagatgtgcctgccctgaggcttccttcctgcagcccccctccccacccctgccatccggcccctgcatctcctgcaatggacacgtctccatccctggttcatatgccatgtcctcctatcccggtgcctttgcacatgctgttccccatgctccaatgcccttttccaccctgtctgtcaaaatcccacccactcttcaaggcctgcctcacatgctatctgcacagtccccggtagctcccttccctgtcctcaccaggtctggacaccccctactgcagtttgcttcacaccacacctgtgtgtgcctgccccccagcactaggtttaagattcttgagggcagatacctgatggacccttaccttacacccagcaagtgccaatcaatcttcaataggagcgtgagatttattcaaaccttagtgctgcttcttcatagctgtttgaccttggggaagttacttgacctctctgggcttcagtttcctaaatatacatatgtacgtatatatatatatttgtaatatatattacatataaatatacatatgtatgtatatatatttgtaatatatattacaatatgcaatatattatatacatatatacataaatatatttatatacaaaaatgtatgtacataaatatatatattatgtatataaatatatactacatagtacatatatttgtatgtggaaatacatatatgtatatattacatatatttgtataaggaaaatgaatatatatttaggaaataatatgtatagaattctatatgtataaatacatatagaaattatatataatttaatgcattgtatgtatttttatatatttatgtatatgtttatatatgtatttttatatatatttctatacatagtgcatacaatttagtgcatacaatgcacattttataaatataatttatatatgttacatagatatgtatatatatttatatataatttcatgcctacaatgtgctgggccctgtgctgaatgctttatgcacattgtcttgttcatataattcctccttgtaagattgggacaatcacaggaccattgtactcggattttgggagaatgatcatccaataatcctcagacgctccccatagccttgggcaatttcctgtccagctggaggataagaccctcacaagaagaggtggttactcaacggtcctcaatacaagggtaactgccaaatggtgatcttctaatgctgtcattccttctgcaattatttgctgactttctacagtaagaaagagctttatgaaatgaaagaaaatctaaataagtgaaaacacttatttagaacattcttgttcatgaatcagaaaacttaatattgttaagacagcaatactctccagattgatctataaattcaatgcattccctatcagaatcccagctgatgtatgtgtgtatgtgtggttttattttgtttttgttttgttttgtttttgcagaaattaac

SEQ ID NO: 476449 - DNA, 576 bp, Homo sapiens
tccctggcagggctctcataatgcctggcagctcctgctcacccctcactgagccagaaatgggccaatggtgggagaaagtctgtgctgtgatttcagctgggttccccaaactcgcccccgtgcttgcacacggccagcagaggtgtgttgtcctagaaatccctttgccgttcgaggatttcttggatgctgcggccaattttcattcctgccacgaagcttctccgcagaccctgccaggaacatctctttttcatttatttcgggcacaggagaagcagcaagaggaagaaccctgcagacgtctccgtggaagaaatttagaacaaagaactgtcagagttcagtgctcagttcccccttatctgaggtctacctgccagcagcaggtccatttggcaggagcccaggtttctgaaaaactcaaggacatctttggttcccatcaggaactaaacatcttgtgatttccttggctattgctttaagctactattacctttttggttatcaagttgctcatttactgctcaggactagctaggtgcctgaactttcccttgaaggaactca

SEQ ID NO: 476450 - DNA, 606 bp, Homo sapiens
gacttagttcctgctgaaagagaatgaagacagagggcagaaacacaagtgcccaagggcattttgcttggataacaagagagacagcaaattcatttaagaaaatgttcataaacaaatttctctatgctgaccttttatcccctctaacagtaaaaagggttgttgttctgttgagtgaaaggattcgagtgagaatgggatccttaagtattcgatttgtctttcttgttttctatgttgttgatgtatttggtgcagcttgtgactggagcctgcgaaaagtaccatgtttctataaggaaatacggtcagaactaggctccacagctcgaactctgcaacctctggagaagtccgaacgtggggaggcaattgatcctggggagctacgaacccaaagtttcacagtaggaagggggaaaaaagaaaagaaaacatttttcctaatgtaacaatgcgaatgctagaaaatgacaagactgatcggttttaaaccattctgaagactgactgagcgtggaagttgctcaacaaaaaaaggaacgggtatattggtaagtagtctttgctttgtgtctaattatagtgactgtccttttgcac

SEQ ID NO: 476451 - DNA, 634 bp, Homo sapiens
tgggggtcagcggcttcattcttgaagtcagctctccaagctccactccagtcacctatcacaatgatcgctattccctataggtcaagcagcaaggaattgaatgccagggactgggtgcttacaaagtgtcagaagggttggaggaagggtctaagctgggcctctaatgacaactcctggagcaccaggaagggtgctaccagaaagactgaattcagaacccactgctgtagcaataaccccaggatcagaagctgctgccattactgctgctataattgcctcccaacgaaaggagctgggggaaaacgaaaaacaaaaaaacactggaatgtgattggggagaaaacacaaaaatttatatttccataccctgtcactatcaataaaagcaaaaaggtgtgtgaaaatggcctctcacttctgttttctacatgggatacaaagccatttactctgcactgcaaaatcctagttgcaaagaagtcttggtgtacatgaaggcaactagaagtgaggacagaaactgaaaataccctctctaaaatgtactactttctctacatctcacagttgttgggttattaacttatttgcttattttgggggaggggaataagcatctgtaatc

SEQ ID NO: 476452 - DNA, 734 bp, Homo sapiens
tcaggaagatagaagaccagaagacaacatggggcatctagaaaaaggaagagttagagacattaatgaggaacagccttcttactcttcacttgtcttcaaaatcaacacttacattgtaaagattttcttgcacattaaggcaaaaagctggcagaacccctgcaatgccttcctgactggtagggtgagagccaatatggtgggaaaagccaaatggaagcctttagagctgcctctacctagaaaaatagtgaatcaaaaacaatattgcatccctgcagggattgcagagattagtgccaccatcaaggacttgaaagatgcaggagtggtgatttccaccacatccccatttaactctcccatttggccggtgcagaagacagatggatcttggagaatgacagtgggttatcgtaagcttaaccaagtggtgactccaattgcagctgctgtaccagatgtggcttcattgcttgagcaaattaacacatctcctgatacctggtatgcagccactgacttggcaaatgcctttttctccattcttgtccattaggcccatcagaagcaatttgccttcagctggcaagaccagcaatattttttactgtcctatctcaggggtatatcaactctctggctttgtgtcgtaatcttattcggagagatcttgatcacttttcgcttccacaagatatcacaatggtccattacacagatgacattac

SEQ ID NO: 476453 - DNA, 641 bp, Homo sapiens
tgtccggtccctgccttaactgatgacattaccttgtgaaattccttctcctggctcatcctggctcaaaagctcccccactgagcacctcctgttagatgatattgttgtcctatatgaagactttgcacactgtcaaagcactaagctggaactgtcttcccagaaatcccttatatgtatgttttcaggtaacagttggaaacaagacatttttgcaagttttggaaggcacgaatgtggcaataatgaagccattatttattgtctgaaggttggtgtagggcaggtgcttttgcagctcacgctcatgatcccagagagtctagctgcccttgttgtgtggcaacagccgccacatctccagcgcacactgggctggcttcttcagcgtctccaaatcctggccagattgaagagattaaatgggtagatagccaatcaaaaagaatcaaactctgtaaaataaatgaatggatttattctgagccaaatataagtgaccaaggcccaaggcacatctcaagaggtcccaagaacatatgccaaaggtgaatgggttacagcttgattttacacattttagggggacaaaagttacaggcaaaaccaataatcaatacatgtaccctatacattgg

SEQ ID NO: 476454 - DNA, 1973 bp, Homo sapiens
ggaaaccatcgtctcagcaaactaacaccggaacagaaaaccacacactgcattttctcactcaaacgtgggagttgagcaatgagaacacatgggcacagggatgggaacatcacacattggggcctctctgaggaagatgttgaagatgtaccagcttcaaagaaagctaaaggtcccatcagtttcttccagtgtgtctacttggatgggtacaatggctatggatttcagtttcctttcactcctgcagaccgccctggagagagctctggtcaagcaaattctccaggacagaagcaacaaggacagcaattaagaatatgcaacccagagaatttctgtgaaaacattttgctctttggcctgaacaaccgtgctgtggtggagagcccaccggatgaggagtccacaaacccaaggtcagactttaactctaggagtaactctggtcatttatcttctctgtccttcaatacttcatctccaaatgaaaataaaagtgctacagcagcaaaaggactttcatctttggcaaggaatattatggaaatgtaccttgtaaagtgatactattgctaagatctttcaaatttccttccagttttgttattaaatgatccaaatgcaacctgcattttagacctagtgttgccaagtggaattagccaaagcggcgaataaaaatcagagctacacgaaccaaatacaaaaatgggaacattacactgacaaaaacaattttgcacttaaaaaatttagttttgtgtcattttcacagagttgctataaatcagtgacagcagaatatccttcaacccactgaatcagaacacatggaccataattttggactcttgattcttggctactatacttgatttttgattccttgaaatggattcttttttccaactagctttagtaattgttttcagcaagaggattagtttgataaaattactgcatcatgcttttttactttccatgacgatacgattgaataacatgataatggtgaagggccatttactatattttagggaattagttcattaaagctgtatatttatgccatatttaagatgtccacggctttctaaatttttttcaatttctttgacgttttctagtctgttttattcaataattttcaatggtgtgttctttattttcacctttaagacagcaattccttgatgtgtagtatttttctattgacctcaagttgtacatttttctttaataatctttcaaacagggaacctcaatcaaatggtgttttcagtagagggagtatgaggacaatagggatgttataaataagtactgccatgcattttattttattttgtttttggttattttagccattctaataggtctgtagtgatatcttattgtggttttgatctgaatttctttaataattaatgatgttgaacatcttttcatatgcttatttgttatttatatatcttctttagtgaaatgtctattcaaatatgttgcacatttttaaatgtttttattttcttattgattcttaaacattctgtacacattatgtattcaagtactttaccaggtaagtgctttgcaaatatattctccttgtctgtggcttgtcatttatcttcttgatggtgcttttcaaagagcatatattttgatgtagtccaatttatcaataatttttatagattgtgattttgtggtcttatctaaaacactcttgcctgactcaagaccataagattattccatcatattgttctctagaagttttacagttttgagttttacatttaggtttgtgatctattttgaattaattcttcatatggtgcaaggtatgggtcagagttcatattctttttgcaaataaacaccaattcttctacaccattggttgaaatactaaattttccacatagaattggttggtataacattttccaaaatcagttggt

SEQ ID NO: 476455 - DNA, 721 bp, Homo sapiens
acttccttttttccttccccacagctgcaagctcccattgatggggggtaggggcaagaattactcagtgaagatgcatggaaatgccttgatgcctaggcaaaagtttgctgcaggggcagagccctcatggagaacctctgctagggcagtgcagaaaggaaatgtggggtcagagcccccacagagaatccctactggggcactgcctactggagctgtgagaagagggccacagtcttccagatcccataatggtagatccactggcagcttgcactgcatgcctggaaaagccacagacactcaacagcagccaatgaaagcagccaggattgaggctataccctgcaaagccacagggacagagcttcccaagaccatgggaacccatcttttgcatcagtgtgaactggatgtgagacctagagtcaaaggagatcattttggagttttaaaatttgacatccctgctggattttgcacttgcatgggccctagactggcttaaatttcagtacacaatcaatgatggaaataaatttataaagacttcataaagaaaacagtttatttatttttttaaaggcaatctgaaaggtatgtataccttcctgcctccaaaaatagtattctttattatgatcataatagaggctctgatttttctccatcataaatctagtgactcaatcgttgatggcctgaaatattgctttat

SEQ ID NO: 476456 - DNA, 1707 bp, Homo sapiens
ggaatctggcagtgggtggaccatgtgcaagctgagttgcaaggcagggaatgcagacacctgtgagagtcctcacttgccctgcaaatacctctttgtccaagggcattccatagcaaatatcgaacactatgacaggccaagaaagaccataaaagaaagcaatttttcccaacctgttgtgcagctttgctatgaggatgtgaatggatcttgtattgaaactccctattctcctgggtcccgggtaattctgtacacggcgtttagctttgggtctttgctggctgtatttggaaatctcttagtaatgacttctgttcttcattttaagcagctgcactctccaaccaattttctcattgcctctctggcctgtgctgacttcttggtaggtgtgactgtgatgcttttcagcatggtcaggacggtggagagctgctggtattttggagccaaattttgtactcttcacagttgctgtgatgtggcattttgttactcttctgtcctccacttgtgcttcatctgcatcgacaggtacattgtggttactgatcccctggtctatgctaccaagttcaccgtgtctgtgtcgggaatttgcatcagcgtgtcctggattctgcctctcacgtacagcggtgctgtgttctacacaggtgtcaatgatgatgggctggaggaattagtaagtgctctcaactgcgtaggtggctgtcaaattattgtttctgctagtatatattgtcaaaatcatccaacttttttgatttgcgttgtacctcctgatgggtcacactatgtacctctcctatttggaccggagactgactcatcgggagcacaaaggccagtcaccaggaattgcaaacaaatgcgtagtcagagagagagggctcactgcccatttgtcatgtggatgcagacacattgcagatgtgttcccagagcactgaaaatcaggaacaatcctgtattttttgtgataatcaacaaggacaaaacttctccatatgtaaataacagcgttatgagcagcaattcatccctgctggtggctgtgcagctgtgctacgcgaacgtgaatgggtcctgtgtgaaaatccccttctcgccgggatcccgggtgattctgtacatagtgtttggctttggggctgtgctggctgtgtttggaaacctcctggtgatgatttcaatcctccatttcaagcagctgcactctccgaccaattttctcgttgcctctctggcctgcgctgatttcttggtgggtgtgactgtgatgcccttcagcatggtcaggacggtggagagctgctggtattttgggaggagtttttgtactttccacacctgctgtgatgtggcattttgttactcttctctctttcacttgtgcttcatctccatcgacagcaaggaatttgcaagattagaagccatgtggaatatacatcaatgagaagcattcaggtattcatccatgttttttccatttaccaaacatgaaacctgtgcctatattgtatggaaatcagtgctagatgccttagacacaggcataacatcccatttttgtctttaataagctgtgactctggcaagaagcaatgttggtcactgaaaattttaaaaagggcgaacactagctcaaccaggagggaaaggatgggaagcgattttcaggcatgagcaaagaaa

SEQ ID NO: 476457 - DNA, 622 bp, Homo sapiens
ctaattcatgtatgtaggatatttactccaggcttcatgccatccccatgttggctgcatgccccaaaatatatttggtaaaaataaaagtgcttggactgggcagaggtggggtttgtgtgagttgggtttcctgaagtgtgaaatggagggggtactgctgcaaaggcgcaaaaaattgcaccagacaaagttaaagacaaggaagactttactgcagacaattgctacaggggagaaaggccagaactcaactcatctgagctcaacttcactgaaacaaagggctgaaaagtttttgaaagttaagggagaggaggttgtagaccacttgtgtttgctaatgggccccaccaaaagggaaagtgaactttcttatatcttcatgacaggaggaaatagaggaaaaaatgagaagtggtgctagaaggtatacttccatagaaggaagatagtatgccatattgaaaaggcaaataaagtgaaagatcatgtactagattctcactcaataaatgtttatttatggactactatggattttgcattgaattgaatgttctaatagcaaatacaaaagaaataaaataatacttcccataatctcatctgtggttggtga

SEQ ID NO: 476458 - DNA, 654 bp, Homo sapiens
ctggaaaattccctggcttataaaattggagaggagaaattagttctttaattagcgatgtctgctatgggtgttggtgccaatggtctcagcaaacttgcaagcaatgtgcgccgtgtgacaatccagtacaggggcatacacagccagcgtgattcaccctggaggatgcaggataatcaccggagcagtgaagcctgctgcttccacagtgatgttgccacgacgaacagctttgccagacacattcttgacattaaagcccacattgtctccaggaggagcccactcaaagcttcatggtgcattttaacggacattacttcagttgtgatgttgactggagcagagtgtttacgctactggtttgagaacaccagtgtccacttggcccacagggatagtgccaatatcccaaattttgtagacatcctggaggggcagacgcaagggcttgtcaattggatgagttggtgtttcaatgatggaagtattttatagattgcgaatgctcttgctcctggaacatatattatttctcacatattaagatgcaccctctcttaccccatattcaagaatcaattcaaaatacattaaagatgtaaacattagaactgaaactacgaaagtattaaaaaaaacatatggaga

SEQ ID NO: 476459 - DNA, 850 bp, Homo sapiens
gaggtttgagcaacagcagccaccaaacagacaagccacacctccatctcacaccctgcaaggagggggtcagggaactctcttgtttcagagagcatcagctgcagtagtatagagaggatcaggcagtgggtgaggctatagagctcccaagagattatgtcctttgtctttggctaccagggtaggcagagaaaaaccatcagctgtctccaggggcctgcagcagcactccgcttccttcaaaggatctgtgaattctctcagctttcctggtatgttcttgtggtagttcttggagcaaaagttcatgatgtgagtctccacacgctgctctgtcaatccaagtgggagctgcaagttaagaagtggggcattgctataaagatacctgaaaatgtggaagtgactttggaactgggtaatgggcagaggttcaaaagtttggagggatcagaagaagacaggaagatgagggaaagcttggaacttcctagagacttgttgaatggttttgaccaaaatactgatagtgatgtgaatagtgaagtcctggctgaagtgatctcagatgaagatggggaacttattggaaactggagaaaaggtcactcttgctatgctttagcaaagagatggtggcattttgcccctgccctagagatctgtggaactttgaacttgagagagatgatttagggtatctggtggaagaaatttctaagcagtaaagtattcaagatatgacctagtggtttctaaaagagtacagtcatatgtgttcacatagagatggcctgaaagtggaacttatgtttaaaagggaagcagagcatgaaagtttggaaaa

SEQ ID NO: 476460 - DNA, 805 bp, Homo sapiens
ccagcagtgggaggaggaaaaaattcatatgttccgctgactctttttgacacaccatgctagctacaatgtgcaattgtcctgtctgggaaatggaaaggccagcttcactcctgaagccagcaagaccacgaacccaccacaaggaagaaactcctaagacgtccgaacatcagaaggaacaaactctggacacaccatatttaagaattgtaacactcaccgcgagggtccgcggcttccttcttgaagtcagtgagaccaagaacccaccaattccagacacagcaggacaagctggcaggaaccggaaaagccatcctctaggtctatacgtgaaaatgcaatttgagcaaagacacgtgaggagtttcctgggcctagggaagctgcagtgtggggagggggtggatgggctggtgtgtggcctaggggcagccttgctggagctctccaccagtcagatactatctgccagcacagaagctatggcgtggcctccagggcacccaagactgccctgcaagcaggtctggccaggctgggaccccagaaaggccagcagaccaaggggtgctcaggtcgaatcagccctgtctgatggacaagaccaccctgcagagatcaggatggacagttcccctagggctaaagtctcctatgggagcaagtcaggcctggggagatggctctccctggctgtgctccactgcaggtgctcccacatcaaatcgtcctggctccacatcagcttgcttgccctcccacgacttctctaaggagctcttcttgccaacttgagtgt

SEQ ID NO: 476461 - DNA, 653 bp, Homo sapiens
ccggccatttacacttcttttgtggtggaatgtcatcacttaaggtggggcagggcatattcacttcttttgtgattcttcagttacttcaggccatctgggtgtatacgtgcaagtcacagcggatgcaatggcttggcttgggctcagaggcctgacactaaccttccttttggcttcagaaaagttgataagctacaaaatgttcctccctgacactgtaaaggaagaaacaaataactcagacacaatttggaagatggtcacctatccatctcagatggatgtttggtatgactgtacctttggttttcattcatctggacattttttactgagcaactccgatgtgccagacattatgctagaaataacagatggttttggagacatgactgatatggtttggatggttttttcccctccaaatctcatgttgaaatgtgatattcgatgccagagttgggcctgcattacagctgtggttaactgtcaacaaccctcggactcagtttcatgtctgcagagaagcaccatcgcccatgatcctacccatcctccacacacaaagccacaaaggaaagcagccagagttctgtacgtatgttttatttgaacatccacatttcttagcttagagacaattatattcc

SEQ ID NO: 476462 - DNA, 1137 bp, Homo sapiens
atcatcacagcaggaaggaaaagtaggatccccagcaactagagtttctctttgccagactagactaaagaaggagcactaatttattctgataaaacaggtctatgcagctaccaggacaatggaatctacgttgactttagcaacggaacaacctgttaagaagaacactcttaagaaatataaaatagcttgcattacagggtctctctcctttgggatctcacctcaccacaacctctgtttcccaggctcaagtgatcctcctgcctcagcctcctgagtagcttggaccacaggcacatgccacaaggctcagctaagtttttgttcttcttgctttgctggtgatcatgtcacttggattaggcctggggcttggactcaggaaactggaaaagcaaggaatggaccagacttattgtaacaagatggaatacatgactgattattttcccagaataaacttcttctacatgtacgaagggcctgccccccgcatccgagctcataatatacctcatgacttttttagttataccattaaaaacatttgtgatttgtgggaggtcaaaatatcatcattaataggagtttggaagaagttgattccaaccctcctggataactttgaagggttcatgacttcagcagaggaagtaactacagtcgtggtaaaaatagaaagagaactagaatcagaaatggagcctgaagctgtgactgagttgctgcaatctcatgagaaaactggaacagatgaagagctgcttcttacggatgacaaccaccattttgatcagtcagcagccatcaacattgaagcaaggccctctacgatcaaaaaagatgacaactcactgaacgctcagaggatcattggcattttaagcaattaagtaatttaaaattcaggtatgtagtttttagacatagtgctgttgcacacttaaaagattacagtatagtgtaaacatatttatgtgcactgggaaaccaattcatatgacttgctttattgtggtggtctggaagtgagttcaaaatatctccaaggtatgcctgtggagtaaaatctctgaggatggagtgcaaaggactgacgataaacgctgagcaaagagtggttaatataat

SEQ ID NO: 476463 - DNA, 1005 bp, Homo sapiens
agtgtgtcatagagctgaaatgaacagtaacaggaaaagaatatgcccccttttgaaatatacatttaagaatgcttagaacacttactctgagtcagacactgtatgcactgctcagagtacagcccccaaggaactacctgtgtgaatttctaaatgtggggagaggcagtgctgctctgatccaaggcagcgaaggtgaagccctgtctactgtcccttcctgggaggcaactgagggttgtgtagtttgtgaatccttaggcttcttggggccatggtttgacagcacaattataaactttgctcttttgcgctgttatgaattgaattgtgtcttacaaaacttatataaaggctctattagatttgggctagactacgtcacagatgatgtgttttacttcatattgcatctcattaataggcccacaatatctggttgtccaccagtgggatgctgagagagaccactgagagtggggataacatcttgaaccctccattgcaagaagaaactaatctctgtgtggttatcatggcctcatataggtgtctagttccctacccatcattcatctaatagtgtcaacaccagttcatggcctgactggttgatttaattgttgccaaatgattatttcctaattctgtcacttcacatgtgttgattggggacattccttattaactggagctttctgtttaccctgtgatacagtccctgcttaaaagaaggatgaattgtttattctttcccattactcacaaattttgagaataaagaattagtttaataattattttaattagtgatatgtgatatcctttttttctgacttccccttttgttaatgtcattataaactctgatttttaataaatttaatgaatttcaaaaaactacaatcagggcaggggtggttgttcaaatggtcacaaatgtaatcagaagacactttaagctggcttctgagtccctttgataggactccattaatcttt

SEQ ID NO: 476464 - DNA, 800 bp, Homo sapiens
agcagttatttacttagtgtttaatcattttcttattcaaccaaaatgttccaatggagtcaggaaatctactacattctagggatacagtttttgagcaaaaataatactgactctgattcatggaatttacagcctagtgataagatagatattaatcaaacaactgcccctgaaaggagggacaacctagactctcaatctagaaaagtggatgctccaaatgcctggagatatgtccagggtgagccaaatacctggaaatatgtcccccagagaggaaaggagtacctgctgcagagtggagtaactgctgctacaacaggatcttggcgagggagtggggagtgggtgtgggggtgggaagaggcagctcaggctcctatttcaggcaagcagaattggtgggttcttggtctcgctgactttaagaatgcagtcgcagaccctcgcgtaatgaagctgcagacctttgcggtgagtgttacagttcataaaggcggcgcatccggtgtcgttcgttcctcctggttggttcgtggtctcgctgacttcaggagtgaagctgcagaccttcgtgctattgcaataattttgaagttcactgtgctttgcaaacccgatattacttccattctgtgatattattatggaaattaaagagcagaagtcagatctggaaagcaaagatatgggaaattatttaacatatcaaaaggaacccacgtctactctaattttcctcttggttatgccaacaatctttctcattttggaatgtcttttataagctttgtaaa

SEQ ID NO: 476465 - DNA, 686 bp, Homo sapiens
cagcagtccctggagtaccatccatcctcccgctgaccttccagatgactgcaggtgcatgagcacgcccagcagggatcagctgagcaaaatcacctcgccgaatcatagtagatgggacttaacaggacgatacagcaggggcattctgcactgacagttagatctccagtggacccacaactcccaatggacaaagtcagagcaggatgtggggaagatggcagcaaggagaataaaaataaaagaatgcaagaagaaaagaaaggagagtttcagaaagggaggaggaagaaaagtgtgaaagagagtgatgaaggtgaagaaggaaggaaaggcaggaggaggacatcatggataagactagcagcctattttttagatgcctttgagctcatctgtatcagtttcctatggctgttgttgcaaattaccacaaacatggtggctattatataccctgagatgatgaatacccctgtgacttcttcatgcagtaccctctcactgagacctgtatcacctgacttgtaacctggttaacttttcatcctcctttatagttaaccagcaaataacttctaggaagaattccctgaatttccaaactgctttgaatatcactttccattttcatatttctctgtatcgacctctattattgctttacctgttgcattatcatt

SEQ ID NO: 476466 - DNA, 519 bp, Homo sapiens
agccaggaaaaggactttcacaaggataatggtctccagctgcatccatgttgctgcaaaggactgggtcgtttacaccttagcacaaacttggcatctgagattaagatcaattgacgtcaaacttacttgcccaaggatctgggcaaacagggcccaccagagacttgtatccaaatgtagcaggaaagagcacctctgggaaaaggaaaatgaaggtggctggttaaaaagagagcatcagtttgtaaacagctgtctgattgctgcgtctgcttgtgaaaaggagagtgagagagctctctggggtccttttataagggcactaatcccactcataagggctccaccctctgacctaatcacctcccaaagtctccacctcctaataccatcacattggggggtaggatatcagcacataaattttggagggactcaaacactcagccctaaacactccccatctattttcccctctcttttcttcttttcataaccaaatttctcaagacggtg

SEQ ID NO: 476467 - DNA, 640 bp, Homo sapiens
aggaggttattgcaataatagtttcaaagaacatcttgatgtctgcctcaggaccctcagctgcaggtctattggagttcgctgaaggtccactccagaccctgtttgcctgggtatcagcagtggaggctgcagaacagcaaatattgcagaacgacaaatgttgctgcctgatcgttcatctggaagcttcgtctcagaggggcacccggctgtatgaggtgtcagtcggcccctaccaggaagtgcctactagtgaggcgatgcctcaccctgctttggctcacactccatgggctgcatccactgtccggcacccacagtccggcaagccccatgcctctgaaccactggtcactacacttcaatgggtggtgtcagccaaattgtttcagtgtggtgacagcgggatccatccctgtttgcatgtgccagcagcagtggtagcagcagctgcagcaggatgctagcaggtgttatgccctgggaattttcctccgaataccggatctatcaaattgtaggaaattgaaggtacctcactcattttcaattaggttcactctttcaacaaatgtttactgaagaagccctttatgagttgcagtgcttggaactaaaatacaatggtacagaaagc

SEQ ID NO: 476468 - DNA, 714 bp, Homo sapiens
cgattattgaatatagtggcacaagacagcacatatgctatgcgggaaactctcttactggggctcctctttgtcccttgcaaaacatccaactttgggtctgccacaccagaccgccccccccaaacaaatcctccaccttaccccactggtgctggcaagcactctaaggatggctcagaggagaggaaggccatcaatttggatctaagccttttggtgtcagctcagcaagagagagatgcaatcagtaacattcagtgtccacgtgatcagatgagccagttgttcaggagcagcactactattcccggtatggttcctgaatatgctttgggctattggtctcctccacccccacacccatgtcatgcccaggacaggaaggagctctctctgtctgatgatgggcactctcatcctcaagctctcttggagctacccctctcattttcccaaaagttgacaggataacacttagaaaattttcagagtgcctcagtttccttcttacatacagagaaggggagggtgaaggagatttagttttttacgatacgaatacaaagaagaaaaataggataacatccagattcttaggattttgcagcaaagcgattggcttgagaggcaggcattgtggaaagagaaaggcatattgaagtgcctttggatcctcgtgtagtgcatccgcaaccaaacctgcagacttat

SEQ ID NO: 476469 - DNA, 797 bp, Homo sapiens
ccagtaccatgctgttttgtttcagaaggaatggtaccagttcctccttgtacctctggtagaattccgctgtgaatccatctggtcctggactccttttggttgagtctccttgggtgggacttgctatggctgctgtggggaatggcagtgtggttctcaggccagtggagttatgttcccagtgggtgatggctgcctttgctgccagtaaaagaaaaccagctgactgcaggtttctccacagttgtatttactaccagaggataatggagccgtttctacaaagtgtgcatcaagaattctgtcttttgaaaaatgagaaaagggataaaaagtcccagtttcttgttactatagcaatagctacacacactaatgtgaattacctggatgcattctgcagcgaggaccattttattggtcaggtgggaggcaaacctagatggttggtcatcctcattactacatcccaaagcagggccccacagaaaccaggactagactgcctgtctagtgggagctggagccacacaggagattcagcagctgccagtgaagctgtcttagacaaaaggggtgacatctttcccctccccgctctctcatttcctatctgtgcctcctgttggccaaaccagctgcctgtcagctgatattttagttatccatggagaaaacagcactaggcatagattctggactcgaggggccttgtgtctaccacacaataaatgtagatctttggaaccctgagttgatacagagctggctgttaaagtggtgttaacagtatc

SEQ ID NO: 476470 - DNA, 1841 bp, Homo sapiens
agcagttcctccacaggtctggatcgtatctcctccagtacataaagatgtttctgctgagcaactgtggaaagggtatcagccaattatcccatgggtccacttccagggtctcacatgagatctgcaacattgatcagcaggtgaatttcaaacctcagcttcaatgggagactcagaaagtagacagaagacaggcagctacaggagctgggacaccaccatctcctgcccttggacatcagacctccaggttctccagccttcagactctggagtttgcagcaggaacagctcacgagggagcctggtttttgcaaggtctgggaaagaggtctgtccgtaaggcaattgacaagagttctaagaaagatagaatgagaaagactggtacagagcatgaaagatgtaagccagactctttttgtaacctcattgtggaggtggcatcctatcacttcattgcattctatttgctacaagtgagtcactaggtccagcccacactcacctaatttaaaaatcagacaggccaaatgactttatgtaaggtcacataactcaatctccaaatgtctaatccagtgattatgccaacacattcactggttcttatgaaaattattcccatatataactcttccattccaagttttcattgacactctaaaccatatttgcatttgacttcttttatatatatgtatctctgaaatatatatatttacatgatatttttctgacatactataagatggtggctgtaactgcttccctcctgtattttctattgactttcatgtaagcacataggttacacaacatgccaatataagccaaaaatattgctgtgaaaatcaaggacaagaacaccatattattctcaatgctcattagcttgaaagcaaaagcacaatatagtatatagtttgaggagggaacttgtagtttgtccatgtattaagattcaaataagtcataatacaatggaaatattaattcatatttagtgagtatgtgataactaatactttttaaagtactggtattcagaaagcactgcttattcctagaagcagctggagggcatttttcaaaattgcatgtagctatacctgtagaaaactcaaaagaagtccaatgccaggtcaaagttttgttcataggacacttagtttattttatctattatgtttttcacaattcccctattgacggaattttactcctgagagattcagtgactttcccagagccagatatttatctgtgaagaatttccacctatcattttgttaattattgaaattaaattcaattcaatatcctttttggttacttcttatggctaaatcccacctgatcccttaaagtcatgaattgagctctctcatcaataagaggaattatgcatgagcaagtatgactaatacctaaataacactttctgattgcatctaagagtaaattaaagagaaagtctaactgtaagaacgtatgcctttgattttgtgggtaaaatggcaacctgtaatctctatgtttttaagtgatgaatcataacccaacataggtgtctatttgaaatttataatgggtttttataaatactgtcttgcttaaaggtgtctattttggaggtccctttatttcagggcctcttaagggctatattgttagtttcaaatgttgcttttattgaacagatgataaagatataacaatcagggctttaggcagaacaaaagaaacatgaaaagagtgttttttgtaccttcaaatttccatttttttctttaaccaaaaccattaataacacctctccagtgtacatattttac

SEQ ID NO: 476471 - DNA, 933 bp, Homo sapiens
agcagttcctccacaggtctggatcgtatctcctccagtacataaagatgtttctgctgagcaactgtggaaagggtatcagccaattatcccatgggtccacttccagggtctcacatgagatctgcaacattgatcagcaggtgaatttcaaacctcagcttcaatgggagactcagaaagtagacagaagacaggcagctacagggcaaagctgccaactggaggatagactgaaagtttatgtgaagctcagttacaccccagatcccctctccaggaacctggccctcttctacctctatggaacagatttacctttggagagatttacagctgaaaatggacagtggggtggcattggtgaaaggcaacacagaaagaagctacaacccaaaagaaaagccccacagatgctgagagctggtgatcctcaggaaaagactccacctctggctgaggaggactctaagggtaagggacaggaagggcctgaggaggaaagagcaccgtgaatgccaatgtcagtaaatttggtcactttacataatcctatatttctctaaggctttgatcattttttaaaattctgttttcttgatttttgtctgactgggtgaattcaaaagaccagcgttcaagctctgaaatgctttcttctgctttgcctagcctattgttaaagattccaactgtatttttaaatcctttagggaatgtttctattccagaagttctatttggttttttcttaatatagctgtcttgtcttttatatcttgaatcatttttctggcttcttcttattggatttcaactttctcttggatctcattgagtttccttgcaatttatattttgaattctttttctgtcatttcaaacttttcaatttgattaggatccattgctagaaagagaatgcaatccttc

SEQ ID NO: 476472 - DNA, 731 bp, Homo sapiens
cctgtgtgctgacactttcttaaacagtgagtgtctgaggagttttgtctgcagctggccctgctacatttcttggttccctgaccgggaagcaaggtgattggcgaatggtcgaggcagctccttaggtgacttaagcctgccctgtggaacatccctgcaggggactccaaccagcccaagccatgcggatcctgagagcactcccgggtaggcatttgcccacacttgtaccacccttagaatttccggtaaaccagagccagcctgaagatcacgttctcgtcaaaaggtggaaagaagaaaaactcgagccagcctcagaaggaccctaccttgtgctgctaaccaccaagaatgctgttcatacagcaaaaaaggatagactcatcatgcccgactcaagaaagcgccaccccctccagagtctgggcccaacctccaaaccatccttaaacagcagtagactgagagctgtacgtggatgggagcagcttcaccaacccctgcaaagtggctctgaagaagataacaagccctgcttcagtcacacctggaagctgactggtccatgcacggccgaagcatgaggaaactcatcacgggactcattttccttaaaaactggacttgtacagtaaggacttcaactgaccttcctcagactgagggctgttcctagtgtatacatcatgtcactgaggagaccacagcaaaactctcctcatctc

SEQ ID NO: 476473 - DNA, 642 bp, Homo sapiens
gacagcctgcgcactgagagaatggggtggagccacggaagttcacacggtttgcagcgaggaggaactggcccttcttattctgaggaagaagtaagtggggccgctcttcttgcacttaatgatcggatggttcagcaactggtaaagaaaattgggcaccaggctgttctgatggatttaattaaaaaatacaagcagaacactcaaggactgaagtccccagaaaaccccaaaaaggcagccctggtcatgcaaacagaagcagctcgagaggcaacagccttggattcaggcctgcaaggccccagcagccctatgagtgcagagaagagcagcccctttgatgaggagctcctgcaaatgggctttggctctgggctctcctctccgctctttttccctctcttcaaccttggacctcacctctagccccacagcctcagtgcctcaagatctcccagtgttagggcccactgactcttgtttggggtggcaaccaagaaggtggaaggctatgtccagtagctactcttgccaagataaagaaggtaattcccaggttactggcataattaactcagaagcagaatttctgattcacttgtagtttggtaaagtttgttccctatttggaaggga

SEQ ID NO: 476474 - DNA, 2408 bp, Homo sapiens
aaaaggagtcaaacgctttagtttagagagtttatattgtaaattttcatgatactcagtatggatgcaacgagaacacgggaaaaccttgatgcaggatgcggccccctccctgtgagtggatttctattggagacttgtgaagaagatgaactgttacacagagaaacaaaaacagcatacagcctgaggccaattacaccatcgagcataaacctgggagttaacaggaaccatggggaggacttgagagtgtcaccaatcagggagctgggcatggagttgaatataactgacttgctttctcaggccagactttccacttctctttaccatacacacccctcctctgaggacctctgttttacagaaatgcttcaagatcttggtcctacttgtttaaaattttcattgaaagctctgctcttgtctgtaactggtctgggcacattggttttggcacccacagagtggaaagttttctcaaattcaatttttcagtcagaattgtgatttgatctgagttgatctgaatagcccagtctgcaacgctatttacaagtttgattccccaccctctacccctaccaatgattaaccacttgcctaaaaacatttgttgaaaaacatatgtcacatttatgttttacccaataaatatattggtctgtttctgacctatttttctgttccattcatttctcattattcactgtgattaacggttagacaccaccacaagaaggctgactatcctcatttcctttgttggcctctgtaactaatagccttgattttcaaatggtggcctagaacatgctcatgcattgctcatcagaatgtaaaatagtacaagctttatagcaaaacattcagttacatctaaaaaaaactatgcatttatcctttaatgtagaaatacaacttctaggaatttatcttgaagttacaccataaaaaatcaaaattcatacataaatattatttattatagcatctatagttgcaaaatatagaaacaaactaaatgcctaggaaattggttgaataaacattatatgtttacacaacagagcattgtgaagctgtaaaaaagagtgaagaaggtgcatatgaacctataaagatttctaggaaacctagttaaatgaaaaatgtaaagtgcaaaagagtttgtataatatactgccatttgtgtaagaaacaagactacacgtatgtatctgctgaattttgcaaagagaaacacagaaagaataaaccataaacttataaaattggtttcctttagaggttggtgggaacagggcaaaccatttagtatttcaaatattcggaatgtaaaattaaatataaaaagacaagaagtgaatcattaacataagtaaaccaaatgtgaattattaaaacaataaaataatcacacagaaataatacgagtaaatttgaacacagtactctgtatactttcaagaggatatagtctaaggaaaaacaactgtaaaggattcttgaatttactcaataactaattgttgctgctagtggtaatagtatggtaaatctaaaactatattgttggtatttataggatagagaaaatgagtaaatatcttaattttattggaaaccagggttcttactataggagaacagaggtataaaatatgacattgggaaaggagaggaacacatagtcccaagatatttttcctcagattacttattaattgcatagggggaaataataactttatatggagaacctgactgacaccactttaattaagggatcaaagtcaacatcaccaatattaggacaaactgacatcatgtgcttataatacaaggcactgaaaagaacacaagatcatttctgtaatatttctgccaaaaatgcatggcctgcatctaataataaggaaacatcagatatactgaaattgaagaatagcgtacaaaacaactgcctgtatccttcagaaataccaatgtcatgaaatgcaaagaaactgagaaagttttccagattaaaggaaacaaaagagccatgataagtaaatgcaaattcataacctatcatagatcctagaaaagggggaaattgggacaatttaagtattgattgtatattacatattgaaatgtattattatttaattttctctactttataaatgaactgtactgtgatcatagaagttcttaggttatgcacactgaatatttgggggtaaaagggcaataatgtctgcatcttattcttaagtggttctaaaaataatatatgtatgtatatattcacattatgtctacatatacatatatacatgtatgaagagagtgtatatgctaaagaaagtatgagacaatgttcacaattggtgaatcagaggtttctaaaatgt

SEQ ID NO: 476475 - DNA, 927 bp, Homo sapiens
gagtgggcggaatgagttcagcaggccagagcaaaactcagtcaaaggtgcacccaccggccatagaggtttcaggctggcagagtgacaccgcgaagatcccagaattgtgtataatatccatcctgctcttctctttttccttattaattccacctcttggtattttgctctgtgatctgacatcttttccctatggaatttctgcactactaatttgcttctcaacagtaaatgtagccttaggcttccccagaagccatggttacccaaggcaaggttccgagtctatcaacttaaccactcagctaccttatcacaacagcaaaattgacattctggaagtggtaacattatgggtaattggtccctacgttgatactgatgtcaccaagaatgaagaccaaggtagtggtagaaaggaagaaggggagttttttctaggaatggcaatggcaagaatggataaagacttacaagggatggttgttattctcctgcatcccaagaccaaatgttctgtaggatgcaggagaataacaatcatcacttgtaaggatcataggggtagcaaagccctcaagggagagtctggctacagtgagaggaaaaaggtttagagaagaattcaaagacatagagtatttaactgagacaggcaatgagtgtcaaaatgcaaaatgggtagctggcctgggagggtggaagactgtgcaaaattagagactcatatgcagataagaatcccagagataatgaaggataatctagaaagtctgtgtgtatttcaaactttttcattcttattatgtctgttatgatgatctgtgatcagtcatctttgatgttactattgtaattgttttcaggaaccatgaaccacccctgtataagacaatgaacttgataaatgttatgcatgttttg

SEQ ID NO: 476476 - DNA, 612 bp, Homo sapiens
tcctacggcttggaccacatccaatttaccttgcattgccaccctgcccagcagtaggtgcctgtccccggaagcgcagtcatgatgtcataaacctgacatgttaaaacccttttactctttacctgtgattgttcatcagacccctcagctgcagatctgttggggtttgctggaggtccactccagaccctgtttgcctaggtatcaccagtggaggctgcagaacagcaaatattgctgcctgatccttcctctggaagcttcgtcccagaggggcacctgcctgtttgaggtgtctgtcggcccctactgggaggtgtttcccagtcaggctacacgggggtcagggactcatttgaggaggcagtctgtctgttctcggagctcgaatgccatgctgagagaacaactgctctcttcagagctgtcagacgggacgtttaaatctgcagaagctgactgctgccttttgttctactatgccctaccccaagaggtagaatctatagaggcagtaggccttgctgagctgtggtgtgctccacccagttcgtgcttccaggcctctttgtttacactgtgagctactcaagcctcagcaatgcagac

SEQ ID NO: 476477 - DNA, 525 bp, Homo sapiens
gctgcagcctgcctcttcacagtagcttctccagatgggctgctgttgctatcatgtgcccccaccccatgggaaagaggaggttaggattgcatcatacctggtggaagtttttgtatctttaagaattggctacccaactgttgcatcagtaccccattctatcatcaacgggtacaaacgagtcctggccttgtctgtggagacggattacaccttcccactcgctgaaaaggtcaaggccttcttggctgatccatctgcctttgtggctgctgcccctgtggctgctgccaccacagctgctcctgctgctgctgcagccccagctaaggttgaagccaaggaagagtcggaggaatcacacatttataatagtccttcctccattactatttcttcattgagcaaggttcggatatttggacacctgaatagatttctcagtagagtattactgtcattgaagtgttaaaaaattccttctgctcttcattaattttcaaagcacacttataaaagcat

SEQ ID NO: 476478 - DNA, 705 bp, Homo sapiens
gctcactgaggcctccccagaagcagctgctgccgtgcttccttttcagcctgcagcgtcgaggaaaaaatggttttgtgggcctggtccaggaccccctgctgtgtacagcctggagacttggtgccttgtgtcctagctgctccagttgtggctaaaaggggccaaggtacagcttaggctatggcttcagaggatacaagccacaagccttggtggctttcacatgatgttggtcctggggatgcacagaagatgagaatcaaggagtgcctaccacagtgcttcattggggcaatagaagtgggatccttgcctgcatctacataccagcaggagccatggcatggtgaggtacatgtgcattggcaggggtgggccatgggtgagggtgggaggccagcatccatgcacatgctcacactggcaacagcggtgcagcaaggtgcccacatattggtggggtggcatgcccatgggggcttggcagaattatccatacaagcacatttgtgtcagtggcagtggagcaatgtagtgtgtgcatgcatgctggtggagaagacgaggcaaagtccacctgcgtgttccagcaaaacagtgtatggggcaggcgttggtgagcgtgcatctgcaaagtgcacgctgcgttgcatctgcacgagcgtgcatctgccaagtgcacaaaggcgttggtgagcgtgc

SEQ ID NO: 476479 - DNA, 622 bp, Homo sapiens
aagttgcagtgagcccagatcatgccactgcactgcagcccaggtaacagtgcgagactccgtctcaaaaaaaaaaaaaaaaaaaaatttatagtatccttaacaggtgtggggtgttatctcattgatcagtgtggaatgtggataaagaaatctcagaatgacctggggagatctgttagcaggctcttgggtattgcagtgaaattattttctagcacagcaagacatggttccactctgaggcgaattttaagatgccgatgttattctatttggttttgcaagctcagggcacacatatacgagtgtgtggagtgtgttgaaaaatgtcttccatgtcccttgcatctgtatcaccctggatggagtatcgaagctgtccctaaagaggtcacaattaagcagaaacctgaaagaaatgattgagcatatcagacacttacctggatcactgaaaaaacaaattacttatattctaaactttttcactgagtttgcttctggggaaattcaaactcagatacaagtcaatctcatctgcatactgtatttagtgtttatccatttctatttggtgtcacaacatattttggctatcgcttctgaatgtttttatttg

SEQ ID NO: 476480 - DNA, 530 bp, Homo sapiens
cggctgcagccctgcccaggacagtggggatcctgcctgctccatggaacaggaggccagggtttacagccatggtttgggcagtgtcatcaccccaactcggaaggaacagggctcccacttgtccgcagctccctttggcttcactgataatgcagccctagccattggagctgtgagaagaggtctaccatcctccagaccacagaatggtagatccactgacatcttgcactgtgtacatgaaaaaaccacaggcattaaatgccagcttgtgaaagcagccacaggggctgtaccctgcaccaccatagtggcagagctgcccaaggctgtgggggcctaccctttgcatcagcattccctgggtgtgacacatggagtcaaaggagattttgaagttaagatagactcagcccctaccttgcttgaagacaatgctcagacttcaaatgggctccttaaagaaaacttctgcccttctcaagttcagggcaaggccataccatcttcaacagataactagagag

SEQ ID NO: 476481 - DNA, 587 bp, Homo sapiens
ccagcaggtcagtccaggggtcctcgctgcttatgctgctgttctcccctctccttccccttttcgatggcttcagcagtatggtaatggaccttgaagacagtcatccaggacaggagattaacactgagaaggctgccaggaggaagtcaatttcctggccctcaatgattaaacgtacccgaggctcattgcactcaccggcgcagcagcagaaacaacccctgcccaagagcccacaatggtccctgaaccctgctgatcagaatagttgtgctcaccaacgcagcagcagaaacactagttttcctcccagaccacagggaggaccgaggaagatgtgtccggagtttcgtccttctggtgggtttgtggtcttgctgacttcaggagtgaagctgcagaccttcacagtgagtgttacagctcttaaaggaggtgcatccggagttgttcattccttctgtgggttcatggtttcgctggcctcaggagtgaagccgcagacctttgcatgggttcctggtcttgctggcttcaggagtgaagctgcagaccttcgcggtgagtgttacagcttataaagg

SEQ ID NO: 476482 - DNA, 1603 bp, Homo sapiens
aaaccatatcaacagggtaactatgcgttggggaaagggcaatgatcagacatgtcagggactactggacacaggctctgagcatatgatgattccaggggacctaaaacatcactgtggtcctctggttaaagtaggagcttatggatttcagataggcttatgtgaagatacagctagtgtattatatggtcaaatgcttagtccctcacctccctttgtgaagtttgggtatgattttatgtgggatctcatgttactgaaaaatacactgaaatccttggatagtgatgctggtgaaagtccagcaggcaatagaaataaaaacaagtcagaattatctgtgattttagaaaatatgatttgtatcctgcatatggcattgtatggctctagaaaactatgtgcctgtcatggttttactattggcatctacataaactctatgtagcatcagtttctaccacagatggatttaatgctctaaggtttgctaggttgcatggcccaagtgataggatactacaccatggacctactgcagagtctttttctgctctgggctctagtcaaagctgacagccatttatgccagctggcataaaactagaactatgtcctagcatggaatatattgtctacaaaaaccgaggaggtctaaccggcattatgttttctgatgagatgagtcaaatgtcatcatttatttggggaaaggaggagaggggtggtatagcatatcccagaccaatggacatctgataatgttattggatctttgtaaagctcataaggtttaactcctatcttctgaagtccatgtgtcttaccaaggcattcaatgtaatagccccttcttgaccaactagccctaatagaatgacctcatcaatcttgcagaccatgtggtgctttgaaagaagtacagttgatccaaatttagactatatgattagatggcaaaggttgttaagtgctatatctggggtgagtgctcccatagcaatacactcttctttatagtctacttctgtgtattcagcactctcagaatctagtccctcactccctgccaagtcttcagagaattgtagcattgataagataggcctcctctgtttgacagttcctggccagcagagtccatgagccagtgtaataaaatggttgttttatccaactaaattttgttgtgattagttacacaggagtagttactacaacataatttggcaactgaaatatatggctttatctttgggaccaaatgctggtgggatgctagaagttatgaggtgactgagagcctggacgaaactgttgctgagggcttatagtgaagagagtgattaaaagctggaggaaaggaaactcttgctatgttatgggaagattagccaaactcttatctgcgttaatgtagaaaatagaaaatgtaatagtaaacacatggattcggttaaggaggtttccaagcaaaatgctaggaatgccacctggttattttagctttatatgataaggtacagatagaatgacccaagctgaaaaagaactgttccattttgaaacaaatttcagagaagatataaattactattcc

SEQ ID NO: 476483 - DNA, 555 bp, Homo sapiens
ttataaattctatgggtttggacaaatttataacgacatgtatctactactacaaaacagacaaatccataatattggttggagatgccatcatcctggtctcaataactgaaagaacaagtagacagaaagtaagtaagcatatagatgatttgaacaatgctattgtgtcccatctgggtcgccaaaatgtgtccaaaattggttccttccggtgggttcttggtctcgctgacttcaagaatgaagccgcagacccttgcaagttgtttgttcctcctggtgggttcgtggtctcgctgacttcaggagtgaagccgcagaccttcacagtgagtgttacagttcataaaggactgtatgttgaattgtgttcagccaagttttggacagttgagaatatatatcctgccacatctcactgctcaactaatttctcttctttggctgccactgcttataacttcctatgccaacgagtttcagaattgctcagtctctatggataagaaaagcaccaacaaaatatacattacatttacgatttcatttctt

SEQ ID NO: 476484 - DNA, 4499 bp, Homo sapiens
ttttttctgcctcttcagtgcttctttcagcgatatgaagttaaaaccagctcacctgattgatcatttgcatgtatatgtgtgtgcatgtgtgttgtttgttaccacaataccaggggtttggtctaggtcctgctgcttgctgcacagaaagccaatcactgagaagacaaatattgccaagggagaaggctttaatcgggtgccgcagcaaggagatgggaaaatgggtctccaagttctggaaggtttcagtagagttttcatctatacttggaatctgaaaacagaggacatctgtgacataatatccactgatgaagtctggagaatagacaatgtaccagagcatctctatgccctgtatgtgggtagcagaataaattttaatgttcagtatgtaggcaaatgggccaagggcacctcttccgagtttcagtatgcttcggatgaggattacacccagctggggcatagacttcatcagggaagattaaaggacttatagaggctctgcagctgttattgagggacaacaaaacacctaccttcagccattgaagctgattgctcaaagaggaaaggacagattcttgcagatgtagcttaagcaggtgaagactagggagcagaagcccctaccagagctttgaacctaggagcataaatatcctagtcctcatagtcctcaatgagaagttttatagcttgaaccatagacctttttactaattttaacaataatttatcaaggtgaaattcatataccgcaaaattaaacatgaacaattcagtggcatttaaagtatggtatctagttccaaaaccatcatttccatcactggaaattaaaaccattacccatcaatcagtttctctccattccttcctgcactcagcccctggaaaccaccaatctgtgttctgtctctatggattcatcagttctggatatttcatatacatgaaatcataaaatgtgtaactttttgtgtcatgcttttttcacttaaccaattttggaggttcattcatgttacagtttgtaccatatatatcagtacttcattacatttcatggctgaataatattccattgtataggtatatcgaaattagatgatcaattcttccattggtggacatttgggctgttctaccttctgagtattgtgaaaaatgctgctatgaaaatgggtgtacatgtacttgtgttagtacctgttttcaattattttgtggatatacactagagagaaattgaggaatcatgtcatcataactctatgtttaactttttgaagaaccacaaaactcttttccacagtggctgaattattttgcatttctactagatctttcttattaagcagctatttctaaagaccttgagaatattatgtttaatttatttttctattcagaactgatgcatactaattgcacatatttatggagtacaatgtgatgttttaatgcaggtatacatattataatgatcaaattactatatccatcacactgaaaaccaaatagataaagttgatgatcataattatctcaaatatgactcatagaatatggacgtaagttgaacatttttaacactgacacaagtatctgtcaatctgtatctcttcatctgtcatctattaatttgtcatctatgtatctatcactcatcatccatttattgatctgtctacaagcactatttattagaggtgaaataataagaaatttgctttactacataaaacaaaataaacattaataaaaacctgtatcacaacataatactactgagaaaattcctagaacttgactaaaaggtatattaagaggctgataaatttttgtcaaatcctctgacgacaactggtagaaaatgctctttgaatctgaaaacaatcattgattcttgaaaaaccccaatttcatagaaacactccatataatttttctaagcattttaagaaatttagatttatgctgcatctataaaaatatctttgtttagttcagacaggagattttttaaaagtaccaaccagtagttacttaaaaaataattttagtaaactactttatattcatagtctcacttacactgtgaaacttcaatgaaacagtgacgagcatattttttgtagagtatacacaagctgataacaaaatttctttcttccttactcataatcttatgtcctgttcattttttcctttaacttaggtggcagtaaaaaatgttttccaaatatggctatttactgaaataatagggtaattagtttgattaaactgatgaccaactcaggcaaacaaattctgtcaacacaatctgtttattaacttagggaatattcataaattaatgcaaattgtgtccaaatgcaataatttatgtagatagatccctggccaaccatggaaagctaaacaacttttcggaatatgcttagaaaccaattaaaagataaatttgacaaagaggaaagaaagtcaatcatggataagaatccgattcgtgtacattaatttcttttacgaaagatgtgcaacttgatttgaatctgaaaacatgactgacaaggaaaacagatgtgggaagcaaaataatagcccaccaaagttgtccaatcctaatcctcccacctgaatcctgctaaatgttatgtcgtggcaaagagactttgctgacgtgattagggtaatgaccttaactaacctggagtatctggtggacccaatctgatcactatgagtcctttagaagtggaagatggggcaggagaagacagtcatattgatgccaggtgagatgaacttgactcatcattgctgaccttaaagggggatgtaggtcaaggaatatgggaagcttctagaacctggaaaaggcaaggacacagagtgtcccctggaaactccagaaggaagtggaacgttgctgacaccttagttttagcccagtgaaacctatgtcaaactcctgatctagagacttgtagaataataaggcactaactttgtagtaacttgttccagtagcaacagaaaactaatacttcaaataaaacagcagtgagtcaagagtgcaaattctaagttatgccttctttgtggcattatattcattatgtaactactttatttccattataacactctaataaaagtaacagcattcgcacatccaaggtttacccctgtaaaaaaattaacaaaataaacaaactagggaaacctattaatgtaaataaagaaaataaaaacaatcataaatataatacattgcgcaaaattgctttcatgattaatttgctaaagttgaaaacatcaatgaaatggatgattttctaaataaatatgtgattttatatactacacagagaagtcagtgaatcaataactgacaataacattgagaaacttataaaaatgtttattaatttttacggaattattttattttctcacagaaatgaattaattggcattttataaactgttcaggtcataagagataagaagctacataaatcataatatgaaaaaatagatatgaatcctataaataattagcatggaaatagaagcatgagttaacaatgatcagtatactaattttcaaaaagaagtataaagacaatcaatataagcagactacttaaacaatttataatataagtaagttaaataaatacatttcattctcatacagtgtgaccaacttgattggatatgctagaacacaaattggtattcaaaaatgttataaggaaaattaacaaaagatgttttattttcaaagtaaatacactttaaacaaaatacattataatgaatgatggaatatcaatatgtattaaaattatcaacttgaggaagatgtctgttattatcactatttgtaagattccttttgaaagttatgtttcatgaatttagaataaaacagaaataagagagctacagtggaagaagactaaaaggccattattttatacaatgtgtatatgcactaaaataccaaggaaataaattgaaaaactttggacacaaagaataattcagtacaatgcctgataataggaggtctataaataggttttctgaggcagaaaatagattgctaatattgccaaacagaaaaacactcagaagtcttatctataggaaaagggatgtatctttcttacaatacaacagaaaaaaattatatagaaagcaatatcatgatgtttttttttcttcacatacaggatttttgtttgtcactattaaacatctgaattttaaacagattcttggactggcagttcatatccataagcttttcaagaactactaccttcaagttttcccagttcaaactttgaattttctagtgaagacatcattgagagtataaataaattggcaaatctttttatgaccttttaatgagtttttcaaagctgcgtgggatccatttattaactgcttctttcaggaaa

SEQ ID NO: 476485 - DNA, 580 bp, Homo sapiens
aggacatctgcctaagagaatcttggtggagataattttaactcaattatggttattcttcattctccgttttacttcattgctttcaaaatgaggaatttcggttgtgtttacgtttttcagtttatgggtcatactttatttctttggctatctcataaattttgttggaaagtggacattttagatgatatagcaactttcttgggtgctctgaaggataaatgctacattttcttcaatatgtatcttgaaataggctccatgatcaattctcaacatcatgaaaagattgtttcaaacacctacactacagaaaaattcatcttttataaattgaaaatggaaacatttccatggcaaaagaaccttgaactgaaggtatctaatttggaatttgcttatagaatctggctgtcacaggagtataaaagattagctcctacaagccacaagtttctcgttatgattgcaacaaattgactgcagactgactgcagacatgctagacttcagattttatgatctttaacacaatatttactttttacaaaatatattgtgggcactgtattagctc

SEQ ID NO: 476486 - DNA, 634 bp, Homo sapiens
tataatgcttcagttaggcaagatgaataagctccacagatctgctgtacaatgttgcgtgtacagtcaacaagacactgatatagctgtcatagatagtgattacattgatgaatctgggcaaagtaaattgaaaaccttctggaaaggattcactattctcaatgctgttaagaacactcatggttcaggggaagatgtcaaaatatcaacatcaacaggaatttggaagaaatggattccatacctgaaggatgactttgaggggcttaacacttcagtggaggaagtaattgcagatgtggtagaaatagcaaaggaaccagaattagaaacggagcctgaagactcatcatctcagtcattgactttctatgcggcaaacggcaggacctataccaaaccccaggaccctgaagtgcaaaagtagtgattctggcaattcaaatatgtcaaaaagaagccatcaagtacttcatttaaatgaaaaggtaaaagttctcaataaggaaaaaaatcatatgctgatgttgctaaaattagcagtaagaacaaatcttctatccatgaaattttacacaggatactgttttagtcattctatagcattactagttattgcttctaatatcct

SEQ ID NO: 476487 - DNA, 628 bp, Homo sapiens
atcttggataatgacagtggattatcataagctcaaccaagtggtgactccaattgcagctgctgtaccagacgtggtttccttgcttgagcaaattaatacatctcctggtacctggtatgcagccattgacttggcaaatgcctttttctccattcctgtccataaggcccagcagaagccatttgccttctgctgccaaggccagcaatatacctttactgtcctacctcagggatatatcaactctccaggtgaatcagagcagaggcctctaggattttggagcaaggacctgccatcttctgcagataactactctccttttgagagacagctcttggcctgttactggactttggtgaaaacggaaagtttgactatgggtcatcagatgacagaggaagagaaaaatagggcctgattcacagatggttctgcaagatatgcaggtaccacccgaaagtggagagctgaggcactacagcccctttctaggacatccctgaaggacagcagtgaagggaaatcttcccagtgggcagaactttgagcagtgcacctggttgtgtactttgcatgtaaggagaaatggtcagatgtgtgattatatactgtttcatgggcc

SEQ ID NO: 476488 - DNA, 552 bp, Homo sapiens
tgattgtgaggtctccccagctatgtggaactgtcttaacaaggaggattttcaagagggtggagacaaatgcttccattctgtaggctctgcaatgtggtgttcctcaaatgacagcaagcaagccagcatttcttgccaaattggaatgacacttagagttgggcagactagaattgcagtgcacagatacaagaatgttgcctgctttggagccaagactgccttccggataaagggcccacagagagctgagagctgtgtaatacctcaaagactgaagaaaagagttagacagccatctttccttagaggattttgctgcagacagcttgaactaccagaaggttatatactgaccatgggtagagtaaggaagaaatacatccttcggaaaggacaatgaagatctttacagcagggtgagtaaacaggccagtataagttacagaccacagtgtatagcacattgcaagacctcaagaaattaacatgatacagtatgtgaataatgcaaagaaaaccaacaaatcaaaatattccttttgaaat

SEQ ID NO: 476489 - DNA, 667 bp, Homo sapiens
cctgaaaagattgtagggctgtgttagagcatccaaagaagagtccccatccccatgactgagctccaaaacttgctggaaagagcatggcttggcacctaaatggccaagaaatcaccgtagtatcacactggaaagacttgctggaaatcaccctttggaccctaccacatcttccttctgtggtgccaagaagagttgttcttaaggaattaccttgctggaggcattctgctgcaaaaccactcaaagaagttgcaggggaaagctgtttgccattgggtgctgctgtccactgtgtactgaattctaccaacaaccacctgggtttagaagagggccctgaaagctcaagaatggaacattgcccagccaacagcaagactgtagccttgtggaacccagaaaaaatagctaggctaagctggactcaaactactgagacaatatatttcttgtctccaagagacaataaatatatcagtttaagctgttgtttgttgtaatttattatacaacattgatcttcaatcgctgatagcttttcctctgcttgatcgattcggctattgaaacttgtgtatgcttcacgaagttcttgtgctgtgtttttcagctccattccatttatgttcttctctacactggttattctagttagcaattc

SEQ ID NO: 476490 - DNA, 2442 bp, Homo sapiens
tgcttttttttttacaagtatgcaataattataccatagaattctgctgacactgaaacagaattccaaaatgatctcctttgactcgctgtctcatatccaggtcacactgaagcaagaggtgggctctcatgaccttgggaagctccacccctgtggctttgcagtgtactgcccccatggactggtgatgagtgtctgcagcttttccagtgtactacccccacggactggtgatgagtgtgcacggagcaagctgtcagtgaatctatcattctggagtctggaggacagtgaccctcttttcacagcttcactaggtagtgccccagtggggactctgtatgggtgctctgaccccacattttccttccacactaccctagcagaggttctccatgacggcttcacccctgtggaaaacttcttcctggacatccaggcatttccatacatccctggaaacctagacagaggttcccaaaccacaattgttgacttctgtgcacccacaggctcaacaccacatggatgccaccaagtcttggcgtctgtgccatctgaagccatggactgaggtgtactttggccccttttagccagactggagcagctggaacgcagggcactaagtccctaggctgcacacagcaggaaaaaatctgaaatctgctgaaagctttgaatgtgatctgttttttatcttttgctattgttagtattttctttgtctaaattttcacaatttgattataatgtgtcttagtgaacttctcttttggttgaattttactgccagtttctgagcttctatatctgaatgttatcatctttacctagatctggagatttttcagccattattttcttaaatatgccttctaggcctttatatctctcttctccttctgaaactcctattatatggtggatagtttttgcttgatggtgtcccataatttatgtaggtcttatttattctttttcattcttttttctttttatttctctgattggataatttcaaatgtcctgtctttgagatcattactctttcttctgctggatcaagtctgctatttaaactacctattggatttttctcagttgttatattctttatctctaggatttttattttttaatttttacatttctttgttaaacttctaattttgttgatgcattgctttccaaattttatttatgtttctatttaaattttcttagagctttctgaatttctttataggttgattatttggaattattttttggtcattttatagatctccatttcttccaggtctattactggagcttgtccatgaaatcagttgtaatgatccttctttcgtttgtgaaatggtaattcatgtcttttccctacatttttgtgtgttgatatttatgtcccccaaagctctggctttgtggcgatcagggctaggaaaggactggttacccctgacgtagaagtttcatggaggctgttgtgcttccaaataaacaagcccagccacagctttcccaggctcacctggggaagatgattccactgcattagatcttgggggtggaggaccctttacagtatggcgaagatgagcagacatacctttgccttaagtacatctgcttgaataatgctctaacaacacttaagctgatttatctcctagcatctctgaataatttgctaagctgttcctggttactgccaagaacagttttcctcatctatgaattgtagtgcacaatcccccatgtagcctcttgatgttgcctgaatataccaaaggaagtttgtaacatatgctgaaagttcaataagtgacatccatgtttcctggttggaatgtaacagtttttcaaaatgcattaaatgaaaaaatgaaacaccagaactaaagtgggaagaggtcattgtcagccaggggaattaaataaataggtcaaacctgcagttcctgcaataccagcttgcattttactgtttcatgatgatttctctaactaaatgcttctccagcaagtttcctctatacttacatactatcagcactagtctgattttcacttatgtttatgtttgcttagaagtatacattagttatgctctagaatatcaatttgatagcaggagcttcatcatatttaatttcccttgagctttatagatgctaaataaatattgtgaaaaagttacaacatatacttgaatattacaaaatgttttacattacttaaaatcgctttcataaaagggggagaggaaccttcagcacaatattgaataaaagtagtgagagtatgtctccatgtttggttctaatttttaactgaatgtttctaatcaatcataaagtatgctgcttactctggatacttttagtagatatactgtattatgataagaaagttctcatgtattcttaattt

SEQ ID NO: 476491 - DNA, 572 bp, Homo sapiens
ggagcccacctcttacatcagcattggcttggcacggcggctgcgctgagctccagcccagctttcggaaaacagaagcaatgctgttcaaaggattaatcagtggcccatacacaggaggcctggggccactcatgtacaaagccctaaaagttggtacagaaaacctgtgccttccatccttgctgtcttgcaattccgtgaaggcggcggatgatcgtttggagataaaatggtctaaagtaatggcagaggtatttaaaagcttaacagatggtaatatctgtggctacccaatgggcatccctgggttggatgagggcctgggagtctggaaagttgggagatcagcaaaagctatgaacctcagtagagcatctgcacatgaggtcattctgggggtgttcaatgagtgcttggctaaaacaaaaatgggatttcaaaatgttcaaaaagaagattgctcatatggttatatactctaggatagaaaaaaacattagcaggaaataaaaatgacattttctcactttcaattatgaataaggccaagatgtaaaaaatgggaagga

SEQ ID NO: 476492 - DNA, 572 bp, Homo sapiens
ctcccccttcgtctttagccatgattataagctccttgaggtcctcactggaagcaaatgctggcatcacacttcttgtactgtctgcagaactggaagaggctgagagagagactgcagtgattgctattgctcttctgggcctagccacccagtggggctaccaggctctggtgctgaggagtatctgcaaagagtcctgtgatgtgattcgtcttcaggtcttccagccatggataccagcacctactctggtggaggtggcaggggagtgtaatacaatgtacaccaaagcaacccttggtgtcatagatcagacagaaattgtgtcccttgtcaatgctgatgacatccataaatctagcagggaaaatgatgagggggagacactctctaagcttgtgaggactggtggattgatgaagagcaaacacactggtcaatgtatccagcatctagtactttggagctgccacccatttcagatgcttcttgggaccaggagccatggctgcgctcggcacggaaacagccaaacattaactcaaaatggataaaagatttaaatgtaa

SEQ ID NO: 476493 - DNA, 1064 bp, Homo sapiens
tgccttgcttccccttcgctttctgccattattcagaaggagtctctcaccatatccagcatagttgggaatgtgctggatctcccctgaagccagcacatctgagagttccacccaagaccaaagacatagttcctgggtgttactgctggttattcaaagcccaagggctcttcagttagcagatgatgagtgcttccaggactgggttcttctcttcaaggcaacaggtttccttctggcccaggcagatgctgaatccgtcaccaagccctgtaccacaaaggaaatcttctctttatccctcactatgtcctgtttttctggtgaaaacctagaaataagacatctctgtaacataaaagtacaagatgaaacagtaagtgctgatatagaagctaaagtacaagatgaaacagtaagtgctgatatagaagctaaaatacaagatgaaacagtaagtgctgacatagaagctaaagcaaattatcctgaaaatctagccaagataagtgatgaagtttgttacactaaacaacacattttcaatgtagatgaaatagattcacattggaagaagatgccatctgggactttcatagctagagaggagaagataatgcctgactttaaggacagactgactcttctgttgaggctaatacagctggtgattttaaattgaatccaagcctcatttacagttgtcttttcactctatggactgtttcctttgctgtgcagaaacttcttagtttgatgtagtctcatttatctatatttgcttttgttgtctgtgctgatggtgttgaataagacattaaatgtccaatgtccaatataagaccaatgtcctgttttcgtcagaagctttaaatgattatttcaaaataatttttaccagttatgtttgttttctgtagagaggtttccagagcttctgataccttcattccagaagctttctggaatacctttaaaaataataaaagataacaaaatctatattgtaaaataattgctgaaaaattgccaaatttgaagagaaatttggacatccataa

SEQ ID NO: 476494 - DNA, 3028 bp, Homo sapiens
tgcaacaaaccaccatggcacacgtatacgtatgtaacaaacctacatatcaatgccagctgcaggcattgcagttttggtgcatctcattgatttgctgatcgtatttctcagatgtgatggtttcaccaggattcagaaagctgtagtggatcagactggcagtagaccatcaaagagtgaccatggcctttttgtgatgcaagtttggctttgggaagtgctttggagcttcttctcagtcgaaccattgagctgggaagtgggctcccctgtggcccagggcaggtccagaaatgccatccaagattcatgtcctggaattgcaaaccccaagagcccacttggtgctctattcacctgccatcaacatagtacttgggtattgctgctggttattcagggcctaagggctcttcagttagcaagtgatgaatcctaccaggactgggttcttttcttccataaagcagattcccttctggtgcaggtcatgtctaaaaatgttgtttggaagcaacggctcggaaagaagacctcatgactgactggtgccctatcctgttgtggctgagctgatatgcaagatgcaagatgcagtgctccccactcttccttctcctctccacaagtggaaggaaggggttgtttttggagccacaagctgtgtagcttggggttatgggagagtctggtgttaaaatgtaaaaacagccgtctatttgtacaagcacacagtcataagtaatgtgagtctgtaacatagaataacaaattatttaaatttaacatatgaatatttgagatattttatgtttttatactttctaacgattttagagatttaagtagccaaattaggcaaataaaagttactctgcagggtggttgtgaagctggaggtttcctcaacctgcagaaaatactgagtatagtgactgacaaacggtaaataatatttatgaatgatcataactgaacttctggccataatgagattcattagctgaagaaaggtgctttcaatgggaaaggatatatttttatattttctaaaatctttacctattttctaatttctccttaagtgtaaggatgacagcttctatatactgagcaacgaccatgtctaacattttgttgttattgctttacattcatgatgttgtggcagatttcttataatacaattccccacaccagagaatctagatacttaacaaaaaaaagcaacatgtataattgagaaacaattggtcattaattcttaggcttggttttaggggaaacagagttaatgcactttaataagtcttcctgtggtacatatgtgttgtaagagagctctagagacttaaagcctacaggaggtgtctagtgtgaattaaactacatttgttaacatcatttttctgacttatttataatgattaaatatactcgattattttgcccataacccaagaattaattgacctgggcatttaaaaaatatatatatatatatttgtttcaattaaacaaaacagataagttaaattgtttttatgtcctgtgaacactccacctttgttcattatagtaaatgggggaagtacaagtcatttgattgctctttaacctttcattatatcgacaatctgttattgtctagcatcaattccatccttctcagaaggtggcttggcatttttgtggtattttcaatctagggaaataaatctgcatctccatctggattgaccagatgaggctcccttcagagccaattaacactttaccaatggggtcacctcagcatggtaggaggtgctttgcacctccagggcgaccataaactgtctccacaatgcctccagatgctccaggtctggaaaccaatcaatcttttacataagtgtgttggaattcttccctaactacttttttattattattgttatacttggaggaatgtttgcatttaaattcaggtttataggtgaagaataaatcatgtcagttgagaagtttataattattttgtagattagaaaggccccaatacatagacctctgctctaaccttctagttcttgttttgttttaataagttattttctaataattatattagtgccatgaattatatgtgaaaaaggaagtcatttgattaccaaaactttatacacctcattctataaggtagaacaatgtttccaacttttctggacttgccttctgtggatatgttctctcttcttgtatggtgtttatgagaagagaaatatttccatggaagtttcagcaactgaatatggctcctactgcatacttttcctgaaagtctgtgattactttttagtattcaaaagttattttgttttgaagtagccatcacaatgcaatcttcagcacattgtggtaacacaagtgtttctgttgcttttttcagctcttatgggaactgccatgtcccacagaatcaacacatgtgcgttctgagaatgttatatcactgattacaaaaattgccagtactcctaggaaatttactgtctttgttttcagaaattttcctgatttttttgttatgaggtttttttaaaaatgaggctggtttgggctgagtttcgtttaaggctttggataccaatgatataatgtggggaggagcttcctttttgttgttatatattacactactaaagttatcctgtttatagaaaatctgtattttgtttggtgtatgttgagagaacagcaggaaaaagtgttcccaaaatgaatggattttggcaggcacatgacctgaatatcattactagagaaggaaaaacttactctgatattacactgctttttatgagagtactgttcttcctagtcatctttttgtatgtgtcaaagtagccttgtctgagacattgaatggaaactttgggtcataaaaagcagaaattcctttctccacttgttagatatgtttatgaagtaaaattatttggtgggctgctagttttcattacatgtaacatataacttactc

SEQ ID NO: 476495 - DNA, 2676 bp, Homo sapiens
tgcaacaaaccaccatggcacacgtatacgtatgtaacaaacctacatgttctgcatcaatgccagctgcaggcattgcagttttggtgcatctcattgatttgctgatcgtatttctcagatgtgatggtttcaccaggattcagaaagctgtagtggatcagactggcagtagaccatcaaagagtgaccatggcctttttgtgatgcaagtttggctttgggaagtgctttggagcttcttctcaggaagtgggctcccctgtggcccagggcaggtccagaaatgccatccaagattcatgtcctggaattgcaaaccccaagagcccacttggtgctctattcacctgtggttgtgctggtacctgaggagggcattggctgagtttggtctggttttgttttctgctataacaggggagttcaatgccttaaaattgctgtgttctccgtctccccagtgcacaaaaacactctgcaccaagccactgatgctgagagggatggagaagaagtggtggcggagactcaagactgtttttcctacttcttcagtgcctctttcagcaatatgaagttaaaaccaagtgcttgaaatagtcaaggtaaggaaaatttccttgccagccttccttgagcatactgaagcagcagtaacagaaatgattgtaccagccctttcactgtgtaaattcaagctgtagttcagagaacatcaaaggggtcaaagggatagtaggggtttttgtgtcccaacttgtccctattctttttgtggtagctgatcccatctgtctccaagagctgattgtagcttatgctttgtgagtattgttcacaagtcacctaagtaaagattaaacttgtggctcctttcccatgtgttcagtctggtgttaaaatgtaaaaacagccgtctatttgtacaagcacacagtcataagtaatgtgagtctgtaacatagaataacaaattatttaaatttaacatatgaatatttgagatattttatgtttttatactttctaacgattttagagatttaagtagccaaattaggcaaataaaagttactctgcagggtggttgtgaagctggaggtttcctcaacctgcagaaaatactgagtatagtgactgacaaacggtaaataatatttatgaatgatcataactgaacttctggccataatgagattcattagctgaagaaaggtgctttcaatgggaaaggatatatttttatattttctaaaatctttacctattttctaatttctccttaagtgtaaggatgacagcttctatatactgagcaacgaccatgtctaacattttgttgttattgctttacattcatgatgttgtggcagatttcttataatacaattccccacaccagagaatctagatacttaacaaaaaaaagcaacatgtataattgagaaacaattggtcattaattcttaggcttggttttaggggaaacagagttaatgcactttaataagtcttcctgtggtacatatgtgttgtaagagagctctagagacttaaagcctacaggaggtgtctagtgtgaattaaactacatttgttaacatcatttttctgacttatttataatgattaaatatactcgattattttgcccataacccaagaattaattgacctgggcatttaaaaaatatatatatatatatttgtttcaattaaacaaaacagataagttaaattgtttttatgtcctgtgaacactccacctttgttcattatagtaaatgggggaagtacaagtcatttgattgctctttaacctttcattatatcgacaatctgttattgtctagcatcaattccatccttctcagaaggtggcttggcatttttgtggtattttcaatctagggaaataaatctgcatctccatctggattgaccagatgaggctcccttcagagccaattaacactttaccaatggggtcacctcagcatggtaggaggtgctttgcacctccagggcgaccataaactgtctccacaatgcctccagatgctccaggtctggaaaccaatcaatcttttacataagtgtgttggaattcttccctaactacttttttattattattgttatacttggaggaatgtttgcatttaaattcaggtttataggtgaagaataaatcatgtcagttgagaagtttataattattttgtagaattgaaaaggactctttgttaacatgaaagctatttcattttgtcaagccaagaagaaacaaaagatattcaatctcttcttagtttaatacatatttttgagagctgtttcaaatggaggagggaagagaagcatgtatattttttgtttttacaattatgtctgtaagccatctagcattaattttgtgtatggcattaggtgtgaatcaagtttctatttattctttatctagttttcaatatctagtggtctaccaccactcatttaaaatatttttcttttcctatggaattatatcagagactttgttaagaaaaacatttgtttgcatatgtatgcttctttttcaattctattctgttcccttgatctatttatttattatctatctttatgccatgttgtatggatcactataactttatagtaagtattgaaatc

SEQ ID NO: 476496 - DNA, 654 bp, Homo sapiens
taccatactaactgaagattttaaaaatagaggaaccaggtttatcatgaactctctggatggcctgatagtggtgtcactagggggagacaagtttcagggaaaagaaacatctggatttaaagccatgcagatgtttcagctctgtgctgtaattattcccattatgcccccaactttcagtaaagtgcccatgccagggagaatcagaccagaaaggaaacagcagctttgtcaagaagagatgagaagcagtgaacaggcaattgagttgagagcagaaattttaatgggcaagggcaccgggatttatgcagcaccaggaatggggctcgggtcacttttcttggatattgaaccgttacaccagaaggctggagaattggaggctaccttggttgtaatcggcttagggctgtttctaggtgtagaatcagcaagaggtcttatttatggtacagctgtctgtgtaaaacctgacacccaaggacactttaaagctctctatgtgattatctgacatcaaagcattgtaaccccataggaacactgaaagttgaggaattgcattgaaaaattagaatccgtatgcagcaatacgaaggtttttactttattagaagtaaattgactagtgaggaattcagaatcgtc

SEQ ID NO: 476497 - DNA, 1026 bp, Homo sapiens
taatgctctcattttctttagctatgaggtgcccacctggcagcagctacagcccctgcagcagcccctgcccagacacctgcagcagcataaacaacccgagggactgccccaaagcactgccctgtgctgagagctgtgaatgtcagaaaggccacatcttgagtggaacctcctgcgtgccccttggccagtgtggctgcactgacccagagggctcctaccactcggtcggggagcgctggtacacagagaacacctgcaccaggctctgcacctgctccgtccacaacaacatcacctgcttccagagcacctgcaaacccaaccagatatgctgggccctggatgggctgctctgtgtgggagtgtgtcagctcccaggggagtcccactacgtgagctttgatggtagtaaccattctatcccggacgcctgcactcttgtcctggtgaaagtgtgccaccccgccatggccttgcccttcttcaagatcagtgccaagcatgagaaggaggaaggtggaactgaggctttccgccttcatgaggtctacattgacatctacgatgcccaggtcaccctgcagaagggccaccgtgtgctaatcaacagcaaacaggtcaccctccccgccatctcccagatccctggggtcagtgtcaagtccagcagcatctacagcattgttaacatcaagatcggggtgcaagtcaagtttgacgggaatcatctcttagagattgaaatccccacaacctactatggaaaggtgaggaaaacatctggctcttctcgctggggaggcagccccagggagattgcaccgaaaaaccactctcccccgccaggtctgcggcatgtgtgggaacttcagtgatgaggaagaggacgaactaatgatgcccagcgatgaagtagcaaatagtgacagtgaatttgtgaacagttggaaagataaggacattgacccaaggtagtggtcccctaagaccctctaggttttctttctttttctttctttg

SEQ ID NO: 476498 - DNA, 2044 bp, Homo sapiens
cgccctggaggatgttccagccactgagtggagacagacacgctgcggctgcaggctcttctggaagaggcagtcgtggtctgctcctgtgtggatccggcctcccctactggactttggggctggtgtctcgggtgacagccaagaatgaggagcagggacaggaaggcgtgtcctgcctgagcaaagtctacgtgaccctgcccgagagcaccgtcaccctgcttaagggcagacgcactctggttgggggtcagcaagttactctcccagccataccctctaaaggcgtcttcctgggtgcaagcgggcggtttgtggagctgcagacggagttcggtttgcgggtgagatgggatggtgaccagcagctgtatgttactgtgtccagcacatactctggcaaactctgtggtttgtgtgggaactatgacggcaacagtgacaatgaccacctgaagttggacggcagcccagcaggagacaaggaggagctggggaacagctggcagacggaccaggacgaggaccaggagtgtcagaagtaccaggtggtgaattccccgtcttgtgattcatctctgcagagcagcatgtcggggccagggttctgtggacggctggtcgacactcatggcccatttgagacatgcctgctgcacgtgaaggccgcttccttcttcgacagctgcatgcttgatatgtgcggattccaggggctgcagcacctgctgtgcacacacatgtccaccatgaccaccacctgccaggacgcaggccacgctgtgaagccctggagggaaccccacttctgcccaatggcctgcccgcccaacagcaagtactccctgtgtgcgaagccatgccctgacacctgccattcaggattctccggcatgttctgctcagaccggtgcgtggaggcctgtgaatgcaatccgggcttcgtcctcagtggcctcgagtgcatacctcgctcccagtgtgggtgcctccaccctgcaggcagctacttcaaggtaggggagcggtggtacaagccaggctgcaaagagttgtgcgtctgtgaaagcaacaacagaattcgctgccagccctggaggtgtagggcccaggagttctgtggccaacaggatggtatctatggctgccatgcccaaggtgccgccacctgcacagcctcgggtgacccccactacctgaccttcgatggcgccttgcaccacttcatgggcacctgcacctatgtcctgacccggccttgctggtccaggtcccaagacagctattttgttgtgagcgccaccaacgagaaccgcggggggatcctggaggtctcctacatcaaagccgtccacgtgacagtctttgacctcagcatctcactgctcagaggctgtaaggtcatgctgaatggccatcgggtggccctacctgtgtggcttgcacaaggccgggtgaccataaggctcagcagcaacctcgtcctcctctacacgaactttgggctccaagttcgctacgacgggagccacttggtggaagtgacagtcccctcctcctatggcggccagctctgtgggctgtgtgggaactacaacaacaacagcttggatgacaacctgcgccccgacagaaagcttgcaggcgattccatgcagctgggggccgcctggaagttacctgaatcctctgaacctggctgtttccttgtgggtggcaagccctccagctgccaggagaacagcatggcagacgcctggaacaagaactgtgcgatcttaataaaccctcagggtaagacatgtccctgctggccctttttcctccctgaaggacaggaggctggggagggagtctagtcagggagggagaaacaacaagaccagaaacagatggaaaagcatgaggaaggcaaatgggaacacagggccagccagcagtcaccttcttgggacctatgactgatgggtctgtatttgtgtctcaggcagtagataaatccgggatttctttttttttttcctattaaaaatgttttaat

SEQ ID NO: 476499 - DNA, 1295 bp, Homo sapiens
ctgcataccaagagccaggggccatgttgaactgtgccggcacagctgttgtggatgagtttgtggcaaacaaccattatcagccacaactcatctcagaactggctcagatctggaaagcagcagcaggattgcaatttcccattgtaacagccggccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggacagctgaactccgggactggccagtgttgagaggcggagacttgggcaattgctggacgctgccctgggcattgcacttgtctcggtctgacagtgccggcccaacactgcggatgctggggggaggggggattccactcctgttttgcacgtctgagaatggtggatgtggtggagaaagaagatgtgaatgaagccatcaggctaatggagatgtcaaaggactctcttctaggagacaaggggcagacagctaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtcatcttct

SEQ ID NO: 476500 - DNA, 962 bp, Homo sapiens
acattgccagtgccccacagatcctcgggcatctcaagaaggcctggtggagggagtggaatgatcccagcgcaggcctcgcctccctggcccgtttgccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggtgagtggtttagtgaaggacaaagctgtgtcactttgtcttctgtggccatgtgtctgaggttggcctcaattctaacactggccaccattgttctctgttgatgtc

SEQ ID NO: 476501 - DNA, 859 bp, Homo sapiens
agggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcgcttgccctggccctgagacgcctcctcctgggggccctatgaattgctccccacatcccacccccacctgactggcttccctcctcccacaggaagccctgcaaagcattgccac

SEQ ID NO: 476502 - DNA, 534 bp, Homo sapiens
aaccagcccagcaggccagagcaaaactcaggcaaagtatgctaaagaattgagtgatggttggcagctcccaggcagcttcaggatgggggctggccatcaaaaacactaaggcaaaattagaagagcacgtgaaaggaaatgaagtgtgtgcagaaaaagaggacattgggatggccaaggttaagaagatgccaggaggagaaaacggaatgctgaaaggaagagtggaagaagtcaagaacaagtgcagttacttgtgtgtgatgttgcttaaacaccacctaagaggtggggaaaacataggacagttcctggaactcaaaactagcttgagagatggcagctcagttagagcaactgtcgagaagaacccagaaaacttgagaggtcaagttagatcagggaaacgccctccttattcatcttctgccattgtatttaatatcccctgtaaatcggccattttctttctaaaatctaattgggcaataacattcttctaaacaagatcttttaatagctccccaaggt

SEQ ID NO: 476503 - DNA, 737 bp, Homo sapiens
tgcttcaaagcaacccacgcatgctgatgttgggcagccatccccaggtcatcgtgtcatcctccacccctcagtacccttctgtggagcagcccaccccccaagccctttatgtcactgctcaccaggcttacccaaactatgccacacagcttcatgcccaccagctgcagccggctatcacacctactgggaaccagcctgcagcccccagtcctgtccagcatcaggcgggggtggctccacacctgggcagtggacagccacagcagaatctgtaccacccaggggccctgacaggcatgctgccctctctgccaccgggaccttctgcccagtcccctcagagcggtttcccccagccagccactgtgtatgccatccaccacaagcagctgccccacggcttcaccaacatggcccatgttccccaggcccatgtccaaactggaatcacagcagccccactcgccccaggtgatgctgctgcacccaccccagatgtcatccatattgtcaaaaaatgacaggatttccctgttctcgtcttcatttttaattacaaaaagcgcatactttacttacaatgaatataaacaataaagaaaataattatgccgaggccatttctgcatctgtaggagtcatgatttccctttgcctgtatgtcttttcttcttggtacactcgaaattatttttaaggattagctgtcggccagcaaggcatactaaacc

SEQ ID NO: 476504 - DNA, 1038 bp, Homo sapiens
tgccagttccgagagggcagctgcccaactttattcctctctgttctccccatctgcagtgggctccacccagtttgagcttccctgccactttgtttacctactcaagcctcagcaatggcagatacccctcccccagcctcactgccgccttgcagttcaatctcagactgctgtgctagcagtgagcgaggctctgtgggtgtaggaccctccaagtcaggaaagttcctggttggtgcgtttaacaaagctcttgtaagacagaaacgttcccccagtccccactggacccaggaattccagctggcttcacctctcatgagtactgacttatttgtgtcatttttcactgaatcctgggttctccagagaattgcagccttgccagggactcaccagccacagcatactcaaaggtcaagtgctcacccactgtgcaaagtaactcccggtactcccaaaagccagagagatcagggaactcagtgcaaatggcagcagagctttagacttgacaggaccctgtctatgactcttgggggtctgtgaggaagacagaaggccccccaaaatgagtgtgtggtacctttttctgtgtttttcaagaacataggtctcagggtcactagacatcccgtctagatctcttcatttgatatcgaaggaagcaaaagggagagaagagtagaagtaaatgagaaccagtttgggaaggttttaaacttccaaaaacatcaatgaagttttacatttttctcagcaaaaatcatgccaacaagaaaggaagtgaacagagagatgtaacatatacattttaaaaaagggttttaattgactgaaaaaattcccaggggagaaataggatccaaaagagaaaaagcagaaaggttattaaaaatacagcctgaatatcagcttttaattttgactataaagctcttttaaaatttgttttaaatatccaagcagcaagtgttctatcctacaagcagtcagccttttgccagagccgagagtgtgatggctgcagtaggg

SEQ ID NO: 476505 - DNA, 1099 bp, Homo sapiens
cacagacagtgggggatcgttgcactttgcatgcttggagaggacaccagaaaagatacaaatgtctgtaactgttgtaaaaaatgcaaagttctatatagtacaagtaaatcatgctccctactatggacacaagaagggcaagagagtgctagctcctccaggaaaaacaggaaaaactgtgaatgagcatgacctctggacaattattttgtcacaagctccttttcccaggctgaagaaggccttccccagtaccaggttagcctccatgggtccaggctttaggctggcccctgtggatacaggctccaggcctgtccctgtagacccaatgagcaggcccatgcaagtggaccccagtgccaggttggtctcatggacccagggtccacccactccagcagacccaagctgcaggcctgtccaagtgaaccaaggctctgggtcctaccctgcaaacccaagtgccaagcccgcctacctgctgacccagacacccaacttgcccaggcctggccacataccatgccagatggcctgcccagaatctcttcaggcccctcttccacagggcagctgtggtttactgggtgaccactccagacccaatttacttgagttcctcccatacctggagaggggcaccaagctgatgccagctggaacactcttgtatgaggtgtctagcgacccccattgggaggtctcacccagtcaggaggcacaggatcagggaccgtctggctgcccattggctgagcaggctgtgtctagcctgctgctgctagctgcaactcgagcagattgcacagctctctgtttgggacccaaggctctggtggcataggcttacaaggggatcttctgatccatgggatttacagatccatggaaaaagtgtggtttcccagcctttgtgcaccaatgtattttgtttctgcatgtggtctaaatcacataatatagtgttttgaattttgatttaaccaacttattttcttttaaagggttttcaaaaatttcaaaagctttcatgtttacgtattatttccagtgttcttcatgcttaattatacatcaaaattttcctctggaa

SEQ ID NO: 476506 - DNA, 841 bp, Homo sapiens
tggcttgcagtgggcacaggagctggaatgggaatggagtggaaagataatcttcccccggagttccaccacccccggccaaactcttctctaaagtcccgccatcaggtcatttatctgacatccagctgctgcttctcttctttccttctctgccgctcctctctgctctcctgccagtggtgcttggggtttttatgggtacagggtaggaagtggggtaggccagggtggttttggaaaaggcaacattcagaaatagacctggaaaaaatgcagcgagtgatgaattttaatccaatctgccaatacaaatctgggactttccatttttataagaaacgcagcagtgagatgaaaataatccttaaaacatcactgaaaggccctgtaattataacctgctccctggaaattaaaggaaaactaaaagaagtatccagaaaaccccaaacttggctgtacttatcacagacattgtggagctttccagaggctaacaggtgatatcagtgctctaaccgctaaaagaaccaggtgcttgtgtacttttgtgtttaaaaaatttctctgttttaatatggtcagtgtcaataactgtgatccacataagcctttgagatcctctctggatctcacacatgacaattacggatggtttttatgggacacaagctcagtgttccaaagaaataacttacaggtggacttttagaaatgccattcataaacagtggatctgttgtttgcgtacaaaataagatgttaaattaaaactattctcttgccaaatttcagcagaggcccctaaaaccaataagtgccaagaaacctgagattc

SEQ ID NO: 476507 - DNA, 474 bp, Homo sapiens
acatcaaagaccaaacgtagataaatccatgaagatggggagaaaccagtgcaaaaaggctgaaaattccaaaaaccagaatacctcttctactccaaaggatcacaactcctcgccagaaagggaacaaaactggatggagaatgagtttgatgaattgacagaagtaagcttcagaaggtgggtaataacaaactcctctgagctaaaggagcatgttctaacccaatgcaaggaagctaagaaccttgaaaaaagagaaaaaagaatgaaaaggaatcaacaaagcctccaagaaatatgggactatatgaaaagaccaaatctacatttgattggtgtacctgaaagtgacatggagaatggaaccaagttggaaaccactcttcagtatattatccaggagaacttccccaaactagcaagacaggccaacattcaaattcaggaaatacagagaacaccatgaagata

SEQ ID NO: 476508 - DNA, 1412 bp, Homo sapiens
ctgggctgcattcccagacagagatggctagttttgccctaaaacatgcacttccctttatgtaatgtacagttgtttctgggtggcgtctaaccaggtgatgcatttgctggttctcatcttgtatccagacgactggatgcctcctccacgtcttcttctcttgcctgccaactgggagaaaaccgaagaagactccaggatcctgggagatacaggtggaggccacagatggaaaaaaaaccaagtcctggattcactgtatggaaaaaatatgaccacgggaacttcaagtcatgcccagggctgcctcagccaagaaacaaggcaatgctatgactccagggccaatagcaagtctgcagggattggagttttcaacgaaagcttctgtaacggtacattaaaattaaattttgctgaggcatatcctaaatgttccccgctggttgttacagagtgcaatactggcttcaataggcaccatcatagcagaagaaggtgggtcatttacaagccacatttccagtttccagtggattgggcatggaagtttaattgcattcactaagcttgtgctgaatgtggacagcaaattttcagtatacagtgcaatactattaactacagtcttgatgttatatatcggctctccagacttattcattctgtataactgtaactttgtacactttgacttccatctccccatctccccactcccccacccctggtaaccactgttctattctctatttctacatattcaagtgttgtttttgtttgtttgtttgttttggatttcacatatatggcttggatttgtgtccctgaccgaatctcatgtcaagttataatccccaatgttggaggaggggcctggtgggaggtgattggatcacagggagcagatttcccacttgctgttcccgtgatgtttgttaaaaagtcttgtcctacggctctcaccaaggtcactctcggaccatttgagccgtttccccaattccaggcagagtccgaaatttccctttgaaccaatgttgggtcccagtgagcctcttccttgacttcccccatctctccccaggggctgtttttcaccactcgccgtctgtggaagacacagaaggcgaaacatggggctttggggctcaatgttttgacctgtgggaagagggggacagaactgagtctctgtgtgtttctttcccttccacgcctctccttccctcaggacgtcttatttattttcgtgactgcatcgcaaactccctgttattgctgaagttgaaaagagggagctgagagtccagggagaccacagtgactggagttcataaggcagaatactggagaggagagagctgcaagaactctgaagatttgcagagatgccccctcaagcacct

SEQ ID NO: 476509 - DNA, 816 bp, Homo sapiens
accccactctgtttttctgctgtccatatgctgacacttgatcctcctcctggctctctcctgcccagtcctcccagttccatccaatatttagctactttcccagctccacatggtagatttggttctctgaactcagtggagctttttcccatcacagaagcagctctgaaaacaaccagccttcaaactccctgtacctgtttatggccttcatgccggctcaccccaggcatggccctgttcactctgccctcttggccttctaaccagtcacccatgggagaaatcagagacagcaaacagctactgcccggcatgatcagatggcatccagaccagtgcccctcgcagctggtgcaagtccacaattgcttgttactggcccacaaagaaaagagcagaaactgatggcaagcatgtcaaactgtgatggcattgccaccatagccgagtgcagaaacaccagacttgtgttgttgtgcaaggtattgacaatttcaggtggtagttcactatgtacagagaaacctttaggccaaacttaaaatatgtaaggatgcagctttaggctaaacttgacttaatgtctgtaaaccaaaaacaatattctaagcaccccctggctgactgaacagaccccttcttggccaaggggactgcagataaacctgaaaaactgaatccccagccatgatggggaaattggacacaactcattacaccccctccctttggagtttaggtacaactgtccagcattaacattaaaatagagatcataagactgacaaaattgactctttgtggcaataa

SEQ ID NO: 476510 - DNA, 834 bp, Homo sapiens
atgggggtgaattgtgcagaaatgcatgggctgttcaagttgacggggtgggagtgtttctgtttttctctccagctgtgctgccaagagccaggtgtgatgaataaacctggactgtcagcaatgcaggaagaaaaggccttcagttactggggcaatcggataactctgtgcacagaccaaggtaagaaaggccatgggagccggcaaagtatttccttggtggtcaggaccaaggcaagaaaagcttcaggggcagtgaagtattctttggttgggatataccaaggcaagaaaagccaccggggcgcctccactggtgatacctgggaaaacagggtctggagtggacctccagcaaactccagcagacctgcagaagaggggcctgttagaaggaaaactaacaaaacagaaaagaatagtagcaacatcaacaaaaaggacgtctactccgagaccccatctgaaggtcaccaacatcaaaggccaaaggtagataaatccacgaagatggggagaaaccagcgcaaaaaggctgaaaactccaaaaaccagaacgcctcttctcctccaaaggatcacaactccttgtcagcaagggaacaaaactggatggagaatgagtttgacgaattgacagaagtaggcttccgaaggtgggtaataacaaactcctctgagctaaaggagcatgttctaacccaatccaaggaagctaagaaccttgagaaaagcacgagaacttcttgaagcatacacaagtatcagtagacgaattgatcaagtggaagaaaagataccagagattgaagatcaactcaatgaaataaa

SEQ ID NO: 476511 - DNA, 702 bp, Homo sapiens
acagctggacagagatgaggccggacaatgggcagacctcctggctgactcctggggctgcagccactatgtgtgcagaaggtggtcaggacagggacccagcatcacggtcctcggagatccccaccctggcaggtgcttcagtgtcctgggagattcgttccacccccacccaaatctcctctgccctttatccgcccccagcctttgctcacacttggcctcttcggcagcgccatccctgggtttatgtgaactctcttttttccttccagaaccgctttctcgggggcagagcagagcatggcttcccaaatcccacagacctgatctggaactcagcttcaccgccaaccgcctgtgtgaccttgaggaagctatgtaacctctctggggctcagctgactcaccccaaaatgagagaggtggctgtgacgttaaaggagagtcttgtgctggaaggtgacagccgggagagccagcccctgtcatcctccagcccttctgcttccctcactagcttccaccttgcaccacggggggcttcgtgtgcccacctgagggtgcccacctggagcgtctaagctcagttcacaccctccaaactcagcaaccccttgattgaaagacaaagagcagcctggaatctccttcctccacatgattgctgtggtgtttttttatgtttaatttttagagacc

SEQ ID NO: 476512 - DNA, 566 bp, Homo sapiens
gaaggcatggggaacctcccgtgaggcttcggcccctgcatgggtgctgtggctttgccttccttttggggaatggatggaaggcccgtgttgccgtccacagagtcattggtccttggagcagggtgtcggccaggcctaggatttgcgtcctcagcacagggtcatcaaagccttgacgaggccctccggcggcttgccagtttccgagaggaaacatttttggaagccctctacatgtcagacaccattttagattctggaagcacaatgatggaccaaagtcagatagggcttatggaccgaacaggaaactggcagcaatctaagaattgtgcaagtaaatgcaaggagagaaaagacaaaaacactagagggtcaacctacgaggagacatccattgaaaatgagtttcagaagagaagagagcaaatggagatgcagtcaaaagggaaataaaaaataaaaatttggagttgcccccaccccctgactctttgtcccccattcctggttctctggccagaaagacaaggcatttcctccaaccacttcacagctccagg

SEQ ID NO: 476513 - DNA, 1189 bp, Homo sapiens
ccagttctggaacccccatgtcctggctgtgaaaaaggtgcagccgctcccagggttgccagaaaaacagagtgatggtggaagccggtgccaggcagggtccctccaccagccacgctgtcccgggaggggccccacccttctgcgatcagcagaggatccctgggagagtcgccgcccctccagctccaagcccctgggcgaccccctcatgatttatgcgggggccactgtccgaaggcccccggctgatggctcctgagcggaaaaatgaaatgccaagacccaggcatcttgctgggctaattactctcaatgagacccagctggctgtgggagccggcggcgccggggcaggcccggatccctgtacccagctccctggggctacaaaggcctgtcccaaccctgcctcctacccccatcctggtatctcccagccagagaccattgagggcagaggtgaggtgttactggtgttattgatcaccctctctgagcactggtacagaggaggcctagctgcagggagcagctggcaagcagatgcctgtggcctgcagtaccttggcgctggcttggttctgcggggcacaaacaggtctgacaagttcctcagcagcagagacagggctcgggtctgaattctacccctcaacccacagcctccaatccttggctccagggacctgctcccccaacctcagccacccgattccagggtcacaccttagacctgctcttctcttccttaaacactcggttcttgtttcttacttttctttcctttccctccctccttccctccctcccttccctccctccctctctctctctttctttctttctttctctctctttttctctctctcttgctttttttctttttctttctttctctgtcttccttcctccctcccttcctccctcccttccttccctcctttcttttcttttcttctctttctctttctttctctcttcctcccttcctccctccctcccttcctccctccctcccttcctccctccctcccttcctccctccctgccttcctccctccctcccttcctccctccctgccttcctccctccctcccttcctccctccctgcctcccttcctccattcctccctccctccattcctcccttctcccttcttttcttctttcctcctttcctttcc

SEQ ID NO: 476514 - DNA, 826 bp, Homo sapiens
cctggcttgggtaacccagaaagctctgccctccaggcaccaggacagtgtcacccataatgaatgccccagagcacctaggggaagccagccagcagcacatccaagcagcaagcctccctccctgggtgtcgctgccgcccacccggctgcacagggaaagcttgcgacgcacaccttgtaccaatgtggcactggcctttagcaggcaaccttgcctgagccctgcagaggtgcatccttgcctgcactggctggttcccaatggagctgcggctgccaccaacccccagaccccaggcctcctgctggcatctccaaggcatcccctgcagacacagctccaacctccgcaggcatcgggccagggctccctgcaggacggccatcaccccagcgggcaccaacctccttcctcttcagagctgccccaggtctccagggactggatccaaggctcttgcgtcttagagaggactggagacgccctgtccttcatccccacctcctgcctcagcgcagccctggatcctcagatccttccccaggataagagatggtgccatcacccccttggggccccgctgacccatgaactctccgtggctcccggaggcgccatcaccctcatcttaggggagggcgcctcgcggggccgagagtcaatggaacaggaaacaaagccccaaaatgtacaccaaaacatagtggaatttagcatatgataaagagggccttacatcagtgaggtaagcatgggctttttaataaatggtgttggtaaaaccaggaaaccacctggaaacaaataaaactgaatctgttc

SEQ ID NO: 476515 - DNA, 709 bp, Homo sapiens
taagcccaataagagtttcttgctgctgtttttaatggagatggtggtagtggcagtggtagtggggtgtgggggtggtggtggtggtggtggtgatggtggtggtggtgatggtggtggtgctggtggtggtggtggtggtggtggtgatggtggtggtgatgatggtggtggtggtgatggtggtgatggtggtggtggtgatgatgatggtagtgatgggggtggtggtggtggtagtgatggtggtggtggtgatggtggtggtggtggtggtggtgatggtggtgatggtggtggtggtgatgatgatggtagtgatgggggtggtggtggtggtggtagtgatggtggtggtggtgatggtggtggtgatggtggtggtggtggtggtggtgatgatggtggtggtggtagcggtgatggtggtggtggtgatgatgatggtagtgatggtaatggttatgatggtggtgatggtggtggtggtgctgatcctagaaatgatggtggtggttgtggtggtgatggtgatgattgtagtgttggtggtggtaatggtgggatgctagaagtgatggtatctgcccgtggcaagtgacgattactctttctcagttgaaaagactgtcaaacattttaaattacaattgtcagtagtgagacggtgtttcatcatgtgaaatgatctaaagctgtgaagcataaa

SEQ ID NO: 476516 - DNA, 1914 bp, Homo sapiens
tgtccctgctgcctctgaaacgagctatgcttccaacatcctggattttacatggtacctccttatctacaccttcttctggatggagagatacagcatagaaaaaaacaaggtgatgcgatggcgaggaagctcagtgtattggaagtccttctgatcatcttctgcttaattgtggtgaccatagatatcctcttgctgcttcttgtgttggaggaaacttcagatacttcatttactccagagtgcccagagattccccagtcggaaaggatagactgcacacctgaccaggaggtgaccgaggatatctgcagatggcaatataagtgctgctggtcgcctgtggcagatgccaatgtccctaggtgcttcttcccctggaactggggctatgaagccagcaatggccatacaaatacaagcacaggatttactgcccagttgaaaaggttgccatcaccatctctgtttggaaatgatgtcgccaccacccttttcacagctgaatatcagacatccaatcggtttcattttaagatcactgactttaataacatacgctatgaagtttcccatgaaaatattaacctggttgatgggattgctgatgcctccaatttgagctattacgtggaggttactgataaacctttcagcatcaaaataatgaggacaagcaacagaagagtcttgttggacacgagcatcgggcccctccagtttgcccagcagtacctgcaactgtctttccgactgcccagtgccaatgtgtatgggctgggagagcatgtgcaccagcagtaccgccacaatatgacctggaagacttggcccatcttcacccgggacgctacccccaccgagggcatgattaatctgtatggagctcatacattcttcttgtgccttgaagatgccaggggctcctcttttggagtatttctgatgaacagtaatgccatggaggttacccttcagccagctcctgcgatcacttatcgcacgattggaggcattcttgacttttacgtattcctaggaaacactccagaacaagtggttcaggaatacttggagcttgttggacggccattcttccctccctattggagtcttgggttccagcttagtcgcagggactatggtggcatcaataaattgaaagaagttgtaagccgaaatcgtttagctgagataccatatgatgtccagtactctgacatagactacatggatggaaagaaggatttcactgttgatgaagtcgcttactctggtctcccagattttgtcaaggagttacatgacaatggacagaaatatcttattattatgaatcctggcatctccaaaaactctaactacgagccctataataatggaagcctaaagagagtgtggatcttggggagcaatggctttgctgttggggagggatatccgggaccgacagtctttcccgattataccaatccagtatgcactgagtggtggacagatcaggtcgctaaatttcatgatcatctggagtttgatggagtgtggattgtaagttattattcctgactcaaatttcctttggaaacagataacgccaaattttcagatgagttttgaccttgatgtcaaataaatgtcaataaaaaatagtttgctttatgtagtagtattcaaaattattttacttaaggctgagtctatatccagtgaattaggctcctaagagccttaggttcttatcctgcatctttcatcaactggttatttcattttgataaagtttttgctttctccattaactggttgtcagcttaaaaatactgttttattaaaacagtattataattgctactatttgtagcattgattcataaaaatttaaattaatcattagagaataatttaatgagg

SEQ ID NO: 476517 - DNA, 537 bp, Homo sapiens
tccttttttcaaattgaagttttgactctgctgccagtgtgaatgtgtgcatggacactggctacccacacctccccttcactttgccatggccaccagtgtgatcatgcacacagagggcagcaggccctgccacaggtgcaaatgcaagcacagacctcggcaaccctgtccccacctatgactcactgctggcatgagcatgtgcaggaatgtcacagccccgcttctgccagtatccccctgccccagccaacatgcatgcatcctgctgtgctgtgccacggctgccagcacaacccgtcggatatagtgccttcaaagattgaagaaacatcagcccacacagtgagaaagaaccagtgcaagacgtctggcaactcaaaaagccagagtgtcttcttacctgcaaataactgcactagttcctcagtaatggtttttcgctaggctgaaatggctgaaatgtcagaaatagaattcagaatatgattaggaatgaagaacatcaatatccaggaggaagttgaaacccaa

SEQ ID NO: 476518 - DNA, 646 bp, Homo sapiens
acaggtaccagacccctgccatgcatttccacatggcttgtcctgctgacctagagctagaagtcaactcatctgacccctggttgctggctctccatttgacaatggagaggacatggaccctgagggcctctcccacacagactgggcctcacctctccacagaggaattcagctcaggactcatcaaagctggtgaggacccagctaaggttgtttgctgctgctgtgagctcttgagtagtaattggggtgtggtgagggagaaaacaaatgcctcaagggggcagccacagcccctaactctaggcctgacagagaaggcagggagctcggcagccatctggaagcaagaggcttatcttggcccaggaccagagctgagccaagagaagaggagaggtcggagcctgggaggcactgaccttgaggagcagtaacaccagagagagagagagataacagcattagaaaactaatacaaatgcatactggatgctggcatcatattctataatgatgattccatggcaagggagataagaagcttgctctcatacatcataatgcttaatgagggggagacagatgtaacaagaacaatcatcgtgaatgtcaaaggaaaagggaggtagagaagcatgtc

SEQ ID NO: 476519 - DNA, 733 bp, Homo sapiens
gcaataggtaaactggaaagtgttgaggagatgccggtggaggaacaaccctcttcctgggctctgcctgaattttgtccctttcctcctacagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagccaagacacagccttgcagagtcaccgctttcctgtgcagaaaccttcggggcctgccaggaagccgtgggggccacggagggctcgggtgaacatttcctccaagagccccgaagaagcttcagaacatcatagcacctgctaattcatccatgtggcaactttacatcctatgacatatttagagtgtgggtttccttttgcctgaatatgtcaaatgtagatatttaaagaaatttggattggaaatacactaaatcagaagtagcaagtgaaggatagcggttctgtaatggaatctttctcagattctgttttccctagtctcatgtttcttttttaaacccagt

SEQ ID NO: 476520 - DNA, 1686 bp, Homo sapiens
acctggaaaaggactgtacccgaagaattgggtgacactttcttagctccactcagggagtgaccctgaggagggtgctgccagccagaggggctcaggtcctgagtcctgttcccctatcaccgatgcacagacccagaagacccctccatcctgtagcacctgccatgagcatcgggctcctgtgctgtgtggccttttctctcctgtgggcaagtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggatgatgagcgggtggatgaaccaataacaggaacactccaggaaccaaacccaggagtgtgtttggcaactcagagtgcagcagacaattctttgccccgtgcatttgggataagactggagacagctggaaaagctatggactggacgttctgcactctcaatgcaggactctctgaaatcccacagattaatgtcaggaaagacaatgagctcaccttttggtgctttgtgttggcggagctgttgacacatcctagagaacatgcccagcagacagaggagcggctgtgggatgaggagataaactcagagatgcagcatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagctcagccacagcactactgctccagtgtcagcttggttccctaggaaatggggtttctagaacctgaatgctgacaaataagagttgtatatgtgtataccatgcaacctgcgtttaaaaatgtatgtacatagtgcaatgactaaatctagctagttaacatatgcagtacctcaatccttatcctttccagtggtgagaatacttaaaatgtactctgttagcattttcccagaatacaaaccactgttgctaactctagtcatttgttgtataatagatctttgtaacatcttcgtcttatctgagtgagattttgtatctgttgaccaacatcttcccaacagtccatctctactccagcctttgctaattactgctctagtctttgaatttgaagtaatttccctgaggtctttagctcaacaagatgggggaattttctctataatgatgcttacgttatttttgctttgtttttgtttcgttattttatgtcttgcaatatagtgtttattgtaaatataaataagtatattgtaataaaaatccttcacctctctttgggtaaagctacagttcacatattctaaatttcatgctgtgaccaacgctgacataattatggatca

SEQ ID NO: 476521 - DNA, 832 bp, Homo sapiens
ctgcagccagaagactcggccctgtatctctgtgccagcagccaagacacagccttgcagaatgctgagtgacccagaccctggtcatgctcttgtgctgaaaggaaaccagcacatggggaggtgggtcctgggcggggccccttgtgtggatttcaaggcccatcccctttccactggagcagtagcatcagctttgtccttctctgcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttactccacagtgctgcacggctgtctcctctctgcacagaaaggcaagggaaggtgctgccctcctccgcagcacagattcagcgatgcccttggtcctagcaccgaaaactttggagccccaatgggcccgggcggtgcgagccttcatctgtgccaggtgcctctgcagtcggtctcggccaggcctggatcggtcccaggacctcagatgtcttccttgttgccctccggtctttcctctgaggtgtccttttgggctagtgccaggggtttcccagctctgactttcctagtcattcacctgagtctgaggcctcctaggtgaaat

SEQ ID NO: 476522 - DNA, 1021 bp, Homo sapiens
gtaatctacagacacaagatcatgggcagcgttgggctgccactatcatccacacagagagggcagtcagcagcgtgaggtggttctgcctgctgcggtctcaccccaggcacagaaagcaagagccctgggtggagctgaagacccagaagacccctccatcctgtagcacctgccatgagcatcgggctcctgtgctgtgtggccttttctctcctgtgggcaagtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaagccacagcgctgcatggccatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagctcagccacagcactactgctccagtgtcagcttggttccctaggaaatggggtttctagaacctgaatgctgacaaataagagttgtatatgtgtataccatgcaacctgcgtttaaaaatgtatgtacatagtgcaatgactaaatctagctagttaacatatgcagtacctcaatccttatcctttcc

SEQ ID NO: 476523 - DNA, 1145 bp, Homo sapiens
cctgtcaaagttttcaattgctagaaaatacgcagcaaggccttgtagcaactggcatcaccccgaggccactctatgatggtcatcaccacgtagccagttgccctgtgggagggccctggagctggaagaagggagcttaggaacttcagaatgcttactacagagacaccagccccaagctaggagatcctgccatgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcagcgtagcacagccctgcatgagcatcagccttctgtgcaataacattcctgccccactcaggaagtgacgattttttaaagtttttagtaacaatatttaacatgagatctaccctttttatagacttataagcacacaatacagttttatactctgtagtcataacgttgtacagcagatctctagatcttattcatcttgcatgattgaaattttatacccattggcagcaactccccatttaccccattccccagaccctgaccgctaccattctagtctttgcttccatgagttggactattttagataactcatgtaaatgacattatgcagatttttgtctttttgtgattggcttatctcatttagcctaatgtcctaccaagtatagtggtgacagttttacttctatcttccacagttcactcgaatagctccttgaccaactgtaacccagaatcataaagataaaggcattcttagaaatataacttcttgtcctggctaagttaacttaacacaacccggtacgggatggattctcccaggttgaggcatctggtcacatacgagtttcaacctatcatggtctccaggatccattttt

SEQ ID NO: 476524 - DNA, 1112 bp, Homo sapiens
tcctgctcccctttcatcaatgcacagatacagaagacccctccgtcatgcagcatctgccatgagcatcggcctcctgtgctgtgcagccttgtctctcctgtgggcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagttactccacagcgctacaaggccgtctcctctctgcacataaaggcagggaggttctgccctcctcccccacccaagactcagggatgccctgggcagagatctctgcgccaggaaccttggaacccacagtggccccaagtggcctggacaggctttcccagctcctacttttctactcattatcctgagtccgaggcccccaggataaaacaggatttgcatttcagatccatctagactcccgtctctccctggtgaccctgttgcttcctctctctaatgtttcccccagcccccaccctcatgttttctctcctgtggcccacctttcccatctgggcagtcaccctccaaggcgttgctgggtctctcctccccccacctcctcgcccctctctactgcagccatgaggggagcccctgttctgtgcctccttccttcccatcacagagacttcaaaggccatttcctctgcccttgcatggagccttcctttctgcagtagccagctcctacctgtccttcatatctcagcatgatcaacccctcttgtgggaagcgctccctcccctcccatctgaaatcaactttcctctcataagctgtcacagattcatgtgtctgttagtaacctttagcacagcttggctttctcagatacttgtctggttatttttgtactccacccaatttttaagcccatgagagct

SEQ ID NO: 476525 - DNA, 1756 bp, Homo sapiens
gagtctctaacttggtggcaaggtgagagacccagaagacccctccgtcctgcagcccctgccatgagcctcgggctcctgtgctgtgcggccttttctctcctgtgggcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagcttagccacagcatggcacagtcgcctccttcctgttcacaaacctcatccttctctctctttgcagctcccagagatcattaacagaggcctctctttgctcctcacttttcctgggaaagaggtagatttggacctcggttgtcctttgggtggaaagagaccacagattcattcctgaaacacagtgactgcaaatgtaagtggtgaaaacaatcacgtcccactgcactctaggagggctcggagccagctcactgctccaaacaaggagtgggtgtcttagccttggccttcagagcagacatgcatcttctataggtcttggaggctgctgtgttgcccacatacatgaggttgtcataggcaggaaacatgcctcttcttcatatgttggggcatctggaaggtctgaggctacatccccgagaagatctttcttctgaagcctcttctatccctgtcaccttggaagttttctgccacaaaatatcaaacctctcttcctgtttgaagtaaaggtctttgcaaatttgtggtccttacttgataaatacaatcatggtaacaataacacttcatttcttctgcctactttaagccaagagtatcctttattttatttccatttgccattgctgctgtcctgatagacagaagcatgcatcaccaccgctgccacttcaccttgattcactcaggaaatctgattttcagactctgagtgttttgattgttgtccaactcatttgatttgaaataattctcccaaggcctttaactcaaaaagtgttttatttataatattgaatctattcctttttattatattttttcataatatatagtgttatatagcacttgttagaaatagaagtacaatgattatattgcaatagaatcttccatctgtctgtgggtgatgctgcagtttgtatctatgaaatggaatgcactggtcagagctgatgtgattatgcattatgggtttcggggagtcctcagcgacagaccacttctccaagtctgggactcagtgtcccagatgcaaccctgatagaggtgccctgaatctttcatagctaggaggggcatcatagtccttccaaattcactga

SEQ ID NO: 476526 - DNA, 1937 bp, Homo sapiens
tcctgttcccctttcatcaatgcacagacccagaagacccctacgtcctgcagcccctgccatgagcatcgggctcctgtgctgtgtggccttttctctcctgtgggcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagttattccacagcgctgcaagcctgtctcctctctgcacataaaggcacagaggctctgccctcctcccacccaagactcaaggatgccctgggcagagttctctgcaccaggaaccttggaacccagagtggccccaagtggccaggacagtttgcatcaataaaacagggccactacaagtttgagagtgtaacagatttatgatcagaattagactttatgcatatgtgggaggagctgaggaagacaaggtcttgaggagagaagtcagaagaatcatgttttggctctttggtgctcagatcagtggatgtgcattgtacaagttgatcatttcctgtacaagcccattgctgctcttaattatatccatccttattttgtgcattaggtactgctccctacaccactgcttattgccgtgtaataagtctcattttgtgtatttcagttttactttttattattacacatttgacttcatcttctgcttatctatacttttggggtaacattgttatttttggaggacatttttgtttatctttagtgattcagattaaataatctctttatacttcaacgtctgtcttttatttctatttaaaaccaaatattattttcttttattcctctcattctgttcctctttctttagttgatagttttaagggagaaaaatttagactataactggagctacgtgataagagttattcagaatgaggctgggatattaacattgttaactcaaagcaacagtcagcattagaactagtgttgggatgagggtttagggaagctgctcataaaacctgcagaatggtacttctggaatattctctcagctcactctgcagacacttcccagcattccttgggccattgcagaagcaacaatgatgaaacatcacttactggccataagatggcactgtggtccactgggatctaaagggctctggggagtctgggagagcagcctaggagggaaagggttaagaaaaattagggcttagatccagtattatgcagatgttgcagcagttttcagttttgccagactacctacagctatgcgagaggtgggaagtccctctaaactttaatgagatctacagttgaataattttggctggacagctttggtgtcagggacaggtgcagaggagcaactgcctcagagaaagctaggggcaggatgtgccctgagcccagtgcatctgcgctgcacctcatcttccctgcaggtcttgccaggcaacagctttaacctgctcaagtgatctgggattctataagtttgtaagtcgtactgataacatcatcttggctgagattccattgggcaccaagcacgtgtactctggaggacaaaaaatattgataacagttctaaaacactcaagtaaacaaactactgaaggaaaatgttaatagatgcaccaaactgtactgttagacttgaaaataatcaactaatagaattatcaaaaagagactacaaataaatctttactaagtatttgtgggcatc

SEQ ID NO: 476527 - DNA, 710 bp, Homo sapiens
tgcctcttcttcatatgttggggcatctggaaggtctgaggctacatccccgagaagatctttcttctgaagcctcttctatccctgtcaccttggaagttttctgccacaaaatatcaaacctctcttcctgtttgaagctgagagatcagaaggatcacatcctcagtattctcctctcctggactgagtgtggccactctccatctcagtccctggaagttgtccagagttccctgagaatccctgctctggggcagaatcaccaaggctcatcctcaccagctccccacaggctccagcagggctttcctgccaggtgtgcaggagcaaatccttggagaggaaaatggtccagttcagctgtcacgggagacaggagaaagcaaagtcatctaatccacagtcccctggctgatttgcttccttatgatactattttgcatcagcgtgtcctcatctcccgctgctcctctgcctcttccagtgtcatctcttccctgtttgctgctcagatcagtggatgtgcattgtacaaggtgatcatttcctatagcagtccctttgctactcttagttatatccatccttattttctgcattaggtataaacttaagagtggaaatactgacttacagtgtagatgtgtgtgctatgcttgcgtgtcctcacaaaagctcatgttgaaatttgtcattgtaatggtatt

SEQ ID NO: 476528 - DNA, 643 bp, Homo sapiens
tgcctctatatctgctggtcactgactctcactgtccaaccacgataacctgccaatttgacactgatctggtaaagcccccatcctggcctgaccctgccatgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagcttagccacagcatggcacagttgcctccttcctgttcacaaacctcatccttctctctccttgcagctcctagagaccctaaacagaggcctctctttgctcctcacttttcatgggaaagaattacatctggacttcagctgttctttgggtagaaagagaccacagattcattcctgaaacacagtgactgaaaatgt

SEQ ID NO: 476529 - DNA, 1176 bp, Homo sapiens
tcctccacttctccgtggtgatcaggctttcagagatcagacaccacgggtagtatggtctgtgtaccctacagcactgtagatacaagcatcatggtgttggcaatggggagcagccatggaaatgaggagagccagaaggaatcaaaccctgctgcttggttcagtcgacagaaggacctggtggaaggatgttggctgggtctaagagaagatgatgagctcagaaaacagacaaagagaaatcccaggcgaaagcttctgaaaccctggaggaatcacaagtcaaatttctcccagaagatggtggcagtgactcaccttcagaggagacctgtgaactgggaaatgagcagcaacagcaccaccacagacacacactcgccaggcacagggagaggacagatcctggcctcttgtagcaccagagctctgaacgccctctacctgctcagtctcccatgggatctaggctcttctcctgggcgctggacatgccttggtttctcaaaaccagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcttagccacagcatggcacagtcgcctccttcctgctcacaaaccctcaggcacttacttctccttccagctctcagaagccctgaacaaaggagctgccctgctctttcctcagcaaggagaatgaatgcatttggaactgcaggtgttcttctgatactaggaggtcagaaaataacctctgaaatacaggaacagggaatactgggtagtaataattttgacttatggatttctgggattccttatatatagttcaaatttccataattaggatataacagagcttagtctcatggatagtgactaagtaaatattcttttatagaactatgaagtttcagcacatttatattaaactactgtt

SEQ ID NO: 476530 - DNA, 1567 bp, Homo sapiens
gagagtgagctatcataaacaggcagccaccttgttctctgcatgaggagcatggaggtccagatgcttccaggagggatctggggcaaagctctaactaagcaacacattattttgattttgtgtgtctgggatataaggatggccgagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtttggtcacagcgctgcagaatcacctgctccctgtgcagaaaccctggtgcttcctcttctcctccagtacccagcagctctcagcagcctttcttgctcctcccctagcacaggaagtacataggtttcgtgttccacatgtcctaggcaaggcaagaacaggtcataaggacacatcacgttaggaaacttttggtaggaagtcagtgggtgtgatggttcctgggattccacacatacttctcacaagggtgcctgagtccaagtttgagggcgagtgtcacagactggagctttcaagtgattgagtgagcttaaaactgtgcagccattgcacatggatgcttatctcctttgctgctttccgttatggcttctttgccatttcttttctcttctaccttaaaactttcaacatctttgatgacttccaacatcaatattggcttcccagttttttcacttgctcacttcaaatgatcatttccttcaccttgtgtcagatattcatttccactttctttttctagattccaatgacaaattatttgaattacccccaaatagtttcctcaagcatcccattgtctcatgcgggcttctcttttcatctctggtactacttctgcagcaattcttcaacccatcaggaccactaattgacttctcctgcaaatattgcaccatatatcatctcctcatgtactatattccttatctgacttagactatgtgttccaaggtgattgtgaaattttgcctatgtcttcagctcttttctttttctgtttcttacctggaaaataaaatggggcctactctgtgcccctttcaatgacacagagaacataaaatgtcccttacccttgtcaagcagtattataacgatacagtgtgtcttgaggtctgtaagtccctctatgcatataaaattatatacttttcttctattaaaataatttgttaccttttaatgagttcatcagtttcatctttcaattatagttatacttttgacaattatagaagtactaaaaaaagttatgcacccagaatgtatgattctatcacttttatgtgtgtgcgcacttcacttcatacgtacaaaaaagttaaaagaatgcc

SEQ ID NO: 476531 - DNA, 623 bp, Homo sapiens
ttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtatagacacagtgaagcacggatgtcgcctctctgtgcataaatgtgcccaggataagaaatttttagaaaaatatgagtccctgtccagaatacacaagccttggctccacgaattttcttcgaattatttcctggattctgtgtttagctttggatttcttcttctacatagcctatgggagtttgactcacacagagtcccacagaaaccaaaatactaaaacatagagatggaaaagacagttctccctgaaaaggatctaaagaacattaaaacatggtatcatgagaactacaaccagtcattgaaactaatgttttctgacggtagtaagtaaaacactggaaatgagatggctctaagctacttcactttgaacgttcagaccatattcacagatgcct

SEQ ID NO: 476532 - DNA, 873 bp, Homo sapiens
ttctgccagtagttagaagacaatatcggctgctgaattaatcacagcggacaacctaccacccaacagacctggacccttgtcaaccctttgcaacacagaacaggggtttagacaataagggtgaacgtgaaagcgtggagatgacacctggcccctgaccaaggtggaactgactggaacaagatgggagccaattctgcagtgaacacgctgctgcttttcctgctctctccttcctccacaggctccacggacaccaaggtcacccagagacctagacttctggtcaaagcaagtgaacagaaagcaaagatggattgtgttcctataaaagcacatagttatgtttactggtatcgtaagaagctggaagaagagctcaagtttttggtttactttcagaatgaagaacttattcagaaagcagaaataatcaatgagcgatttttagcccaatgctccaaaaactcatcctgtaccttggagatccagtccacggagtcaggggacacagcactgtatttctgtgccagcagcaaagccacagccaccttcatcaggtctatagttctacaacacagagtgtcagtagtagggaacgttgttcatgtgagtgcagggaatacttgggattctgtagtttctgctcaactttgctgtggacttaaaattgctccaaaaatacaattcactaatttaaaaatggatccaagtattcagatggagaattaccatattggaggcacgaaatgggaacatactgttgaatctgttgcaatataggaagagtgtttaatgacataaactttttcattatttactcctttatctaggaaataggacactatttaacactgactacaatgagga

SEQ ID NO: 476533 - DNA, 637 bp, Homo sapiens
gggtccttgactgcaactcccttcaaagactgcaatgcattggctgtgcaccaagtctggggtgggcagaacagcctctccacaccctgtaaaccagccaggcagagattggaacagtttggaggactcagaagaagacaggaaaatgtgggaaagcttggaacttcctagagacttgttgaatgcctttgacaaaaatgctgatagtgatatgaacaataaggtccaggctgaggtggtttcagatggagatgaggaaattgttgggaactggagcaaaggtgactcttgttatgttttagaaaagagacagatggcattttctccccaccctagagatttatggaactttgaacttgagagagatgatttagcgtatctggcagaagaaatttctaagcagcaaagtgttcaaaaggtgactcgggtgctattaaaagcattccattttaaaaaggaaacagaacataaaagtttataaaattcgtagcctgacaatgcagtggaaaaaaaaccattttctgaggagaaattcaagacagctgtagaaatttgcacaagaagcctaatgttaatccccaaaaccatgggaaaatgtctccaggccgtgtcagagaccttcatggcagcccctccc

SEQ ID NO: 476534 - DNA, 678 bp, Homo sapiens
tgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtgggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctca

SEQ ID NO: 476535 - DNA, 1067 bp, Homo sapiens
tggtgaccctcacctcacagacacctcctctcccgatcctcgggagataaaaagacgggtcctccaccaccagtcaggcacactctaccaccatgaatccactcccgatccttgcctctgtgggagctgctgttggtgtctcctttgatgatgatgacaagattgttgggggctacaactgtgaggagaattctgtcccctaccaggtgtccctgaattctggctaccacttctgtgttggctccctcaacagggaatactgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcgccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggact

SEQ ID NO: 476536 - DNA, 530 bp, Homo sapiens
tagggtgatggaatgtaggccgccccttctatccaggaacaatgtgcgtgcccagcctccaccaggagcatgtccactaaggtgggtgagccctgaaaggtgtgttagtgacatctcccagagggagaacaaggcgaggctgcatgagggtctgtatgagagccagagcaagctggtgcgtgcatgcttgctggtcacaggccctgcaggcgccatgtgccgcgctagacagccgaggctggcagccgctgctgagagacatgagcagttggctgtcagagtgggagctggttccctggcggctgtgccacatgtaggaaatgacctgtcgaggagccagggctgggcgggtgtattctggagggagaaggatacattccaagactcccctagtgcaggggttcccaacccccaggcgacggactggtactggtctgtggcctgttaggaatcaagccacacagcaggccccggtgtgtgatgttcccctccctgtgtccatatgttctcattgttccactcccacttac

SEQ ID NO: 476537 - DNA, 674 bp, Homo sapiens
gtctgcgagtctgaatttccgtggctgtgggaagaaccctgcctttagcttgaactaaggaaaagtcctgcaacgcttttgatgcccaatgtgatactcaagaaccatggctcagtgcagggtccccgctggctggcacaatggactcaagctaggctatgagaggagaagggagatgtatgctctgctctcgcagctgtggaatgctgcagaggtgtgcatagaatccctaaccttgataaaagggccgtctgcattggttatacatcaaattgggaccaaagatcagactagcagaggccgcagtcacaaggcaattcctgcaggcaggcctagtcacctaactgcggggacctatgcaaagaggcaaatgtggtggggcctcctgttcagagggaagggagcaagtgctgtgaagcccttgccctgcacatctcttccatctgactatccctgagtctcatcctttataataaactagtaataggaagtaaactgttttcctgagtcctgtgagctagaatagctgacaagttagtaaacttgaggaggcagtcatggaacccctgatttgcagcccatcagtcagaagtcagaagggagtcctggatttgggatgggcattgatgtgggggcagtcgtgtggggctgagccctgaagttgtggggtctgc

SEQ ID NO: 476538 - DNA, 3242 bp, Homo sapiens
tgggtttgaagacactgtcccagggtgttagagactggaatgagagagtgggttaatgggcagaatcgtcccccagcccaatggctccctccccagagctccacccttcaggaggagcttgcagtgcagcccaggaaagaaaggggagagtgagggggcatggtcatccctcccggccaggtcctgaagggacacagcattctgctcattgacgactggatacagggctccctgacggcccctgggtgcaaggacaggccgaatgtagcctgcctctgtgcccaggaagaggaggcgggcttggtgggcttcgccaaggcagaaatgcggagagactgggacacaggggagcagaggagcagcaatagtggcgagagtggagggtggtgccaacaggaggctgtgattccaggagaggggctggacagggtcaaatgtggaagcaaagggtgcacatcatgggtgaagcttggagcatctccatatgggggacgccagggggccttttgtaaggactggcttgtgtgcgtggctttaggtgggccttgcaatgtgggaaatgcttagccatgctaaatattgccagtattcaggagttgattctgtaattggcagctgttgttagccctcagatgtgtgtcacccacagtgtgttctgctcccccagctgcagctgaccaaacacacctggaagctctcatgcatcaatcagcctccttggtgcatttctctagtatccaactcatttacctgttgagaaattatatccctaaaaatcagcactcttggttgtttgaatctttgttaaaaaaaagtgtgcttttgtgaatatggaatccaaaattaatacagatgcttgtcgacttaccctggggttacgtctagataaattcattttcactgaaaatattgcaaattgaaagtatatttttggacttacaatattttcaacttacgatgggtttacctgaaccccattctaagttaagaggcgtacagaatgtttatgtttttgtaccatcctgaagtaaaaaaatcttaagtccaaccgtcctaaactggggaccatctattatgtaatcgtaaagctggtggatcccagtaaagggctcccagcgatgcgatgggttactactgccacctgctggtagaacatttctttgtcgatgcaaaaataattctggagttagtggtaacattctgcgtcttgaggggagcttggattgcgcatgcaaatacatttgtcagcttacagatacaattcttcctagaaaccaagatgccaccaacaatgaagacggcgcctatttggggattgacttgttggttaatatatgagaatttccttgaggtgaggtctccagtcatgtagtttctggctccctttggatcagctttagataggaacaaaacaaatgtacaataaaaagaatcagagcagtagttgcatcttggtaaacattgtactggacctgcttaactctgaaagctaaaaaataatgagcttaagtaatgaaaagtaaaagaaaattattccaaatgatatgtactaataatctttaaataatgaattacttaaattattcattatctgttttctgtaacctgctgtgaacagcatagccccattccaggtggtaattgtccatatagttcatgatgcctgggagtccatctcaaaaaaactgaaaaattaaaacataaataaatatttttacctgtcaattaaaaataaataaatatatgtcaattaaaataagcatttatctgtcaattaaaataaaaaaatattttcaccaacctgatgctaaaaagaaaaaaataagtcaataaataaataaaacttttctagataagctgcacaccagcactcttagaaacatctttgatacatgtgtcctaacagaatgtattacaatagctaagagtagttaatatcccttccctgaattcacacattctgaattacttgcacaacttaccaagttagacacgtgtttaagatatgtgttttaagtctactagatggagtttgagtgatgaacacttctatttactgaaataaaactgttgtaaatcaagcatataactcatacccttagaaacagtcctggtaagtgtgtcttaaaagaatgtattaaatgaacttaagaatggtgaacgcttctaatcaatgaaaaaaattattttgagtcatgcaggcaaggacttgtgttagaaacttattttgtacatgtgtcataccacagtagtattaagtgcctcaaacacatctttaagctgaaattacacagttcttaatcatgtgcacaaccagcactcctagaagaaagtttacatgtgtcataatggaatgtaatagattgagttttgagtgttgagcgcttcttttcagtgaccctgttgttctgaatcactacacagctagaaacttagaaacatcttttgtatacttatcttaaaagagtattagatagacataaaagtgaacacttccataaaataaaaatattctcaattgaatacaactaacactcttagagatatattttatacatttgtcataagagcatattacgatataaaaatggtaaatattcccattcactgaagcaacgctgttctcaatcatacatgcaacactcctagtaaagtcctttacatatgagtgttactaagtgttttatgtggagttaagagtgattaacacattcattgaaataacactttcagaatcacatgtgcaactagaactcacgagagtacttttcatatatgtgatttaacatatataataaattttaagatttaagagtggtgaatacattgaaatcaaagtgtgctgaatcacttgtgcaactcgcattcttagaaatatggtttgtggatatgccttaacagagcacatttatacagaattgatgagcatttcattccctgaaataacagtgtcctgaatcagtcatgcaactagcagtcttagaaatgtattttgcacatgtgcctagcagagtatattagatgacataaaagtggagagaccttccattcacacaaaataacattgtcctgaataatatataaaatagaattcttagaaacatctcatgtcttcacagagtgtattaaatacagttgagtgatgaaaacatctatccattgaattaacattgttcttaatcatttacacaagtagtactcttacaaatagcttttacacgtgaatcttaatagagtgtgtt

SEQ ID NO: 476539 - DNA, 2103 bp, Homo sapiens
ctgcccagctttcccccagcacagcagcaggggtttgtgtgcagaacatcctgcccatgctgccccagcagcttcagttggcacctgccccagtccagcctctgggacccatgcagcggctcccagcagccctgcacccaccaccagcatccgtttcacctgcagtggaagatccgtgaggtgcccagaagatcatgcagtcatcagtcccacagagcagcccgcgaggctgaggctcctcccactggactgccccccaactggcaccactgctgcccctgcccctactctcagcctcatgtgactctcgggcagaggcagtggtagggcagcttcagagtctgagccaggctgtgtgtacccccttgtgggagaaggcttgggccaggctgagccaggttccctgactgtgtgcagctgttctgcccccacagaagctgctccttggtatccgagctcaggagtgtctgggctgcaactgacaggagttcagaggacaccccaggggtagtggcagtgcccgtctctgatatgctccactcccacgatccgttgtacactcctgctagcccctggcttgtgggcttggcctctgagctggacttctttcggtccttgttgcaagtgggccaccttcacctggaaggccaggtcgtggtacttctgcatctcattgggccccagggtgtaccaccgctcgctcaggatctggctgatggtccagttatcctggtaggggtgaccctggtgcgccctgccagggcctggtgccgcttgctgaagatcgtgaccgccactcatgggccaccagatgtggtccttgtcccatttgttggggctgcgtccatccttctcagaagatgagtcctgttccttgcacagggcactgagggactgggcctgacatcatctgaatcgtagaggcaactgggtgtcaggagacatgacggagaggaaagcatcatcgtggtcattctctgtctcactgtccagcagggactcccctgagggcccagggctcctcctccatggtgagaggtgggcttttaccaggttccaccacccccaaagtgtgtggggttccgggccctgggctttcagggcaggtggctgcagggggccgcccagggtcagcactccctgtcccacctggtggacactcgtgagcaacagctgccgacttggcaggttctttgctctggttggaggccactgagtgactggcaggttgctgggcctcacgcggctgcagggaggggtcaggaaggggacagagtaccaggagaacacagccacagagcaaggttccacattcctccacacaaacatgctgacaccaccagaggccttgctggacgcagacatcaggggcctgggcagagcccccacagagagcttctatgagggcagtgtggaggagaaatgtggggttggagcccccacacagaatccccaccagggcattgtctttggagctgtgggaagagggccactgccctctagaccccagaatgtattggaagccagcatgtctggggagctgcatgtagcactgcttatctcggtggaaggtgcttgtcctggtgtctgcattctgcagaacagctggtctgctgctttccagccggagtttgcagaccaggaactattcagtggtgctcaggccctgggcctgtctgcagtgcaggacccccagggacatgggccgcctaagccaatgcaggcaggacttgtcagcaaggactctttttcccacaagagccatgaaaagcctctgcctgtggagttggacccctgccgtctgctgccagcttcaggctcgctgcaatttgtggagcctgattttatctgctcctccaacctccaactcccaactcccctcctagccactaagttaccttcccacccgctcatcatctcgccagactttccatcatcacaacctctcaggttaacaaagctctctggcctcatgcctgacttcctgctccactcactgcatagctgtgctcctggagggaaagatagcccaccacacacaactgataaagggcagggctgagatttcaaatcagggcctctagccccaattctcacattctc

SEQ ID NO: 476540 - DNA, 1191 bp, Homo sapiens
tgcatctgccagaaccaccctccatgaaagagctgcccatgcctgctgcttccagcgcccacctccccttctctctggggccttctgcaggcaggctccctgccacaatcacccgtgtcctgcaagtgggcaaagcaaatgctggtttaagtgacagacatgtatatcaactgttcctgatatatggtaactgctcaatcaatgtcatcaacacctccaccaccatcaccatcaacactaccatcatcaccatcaccaccaccaccattaccacaaccactaccaccaccaccaccatcaccaccaacactgtcatcactatcatcaccatcaccaccacgaccaccattagtatcaccatcaacactaccatcaccacaaccatcatcgccacaaccactactgccaccatcatcatcaccaccatcactaccatcaccaccaccaccatcaccaccattaccatcaccatcaccatcagcaataccatcactaccaccaccatcaccacaaccactgccaccaccaccaccatcatcaccaccaccatcactaccatcaccactattaccaccaccaccactatcatcatcaccatcatcacctctatcaccatcaccaccaccaccatcaccaccaccatcactaccaccatcacccccaccatcaccaccaccaccaccacctccacaaccaccatcaccaccatcatcaccactatcatcaccaccattatcatcatcacaaccatcactattaccaccatcactgtcatcattaccactaccatcatcaccatcaccactactaccactatcattaccactatcaatatcaccaccatgactatctttactatcaccactaccaccatcaccatcactaccaccatcatcattccaatcgacttaaaccataggacaatgcttttctttgggatgtggcatgtggctccttgtacctacctagcacttgcaggtagcagaagccgagagaccattccaccaggtctttcaaagctgtaggccattaacgctaatcttttatttacagttgttaccctaataaaaatcaatctgccttttgctcttctatgctttttctgacatatagagcctctacattccaaccagctttagtggcctgtgggtggtggtgggaaattggaatatgacaagcgggaggtgctgt

SEQ ID NO: 476541 - DNA, 723 bp, Homo sapiens
cttttttttttttcccctgaaaacacctttgggagggtatggccagagcgggagggaggcagcgggagcaaaccctctggagtcagccaggtctgagttccatgtctgtgcaggcaccggataattgtatgcctttaggccgtggcacttggaaggtgctcctgaagacagacctgagtatgtgtaagaacgaattattccgaggcaggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagggctgcctcctatgaggaggcaggctcagaaacgagggcaggtacagcggtgacctacacccctgggtgggacagcagccacagtgtgcctcagatgccttttaaaaagtgatgtaagcattttattttaaaataccagtatttagattatagttgaaattacctaatcctttgcaactattttgttactttatcaaattaaccagtttataatcaaaattccaggtgacagtctaattggcaaaggggtgcatacatttttcaaaagtattttatgagataagtgaataaaaatttggggagcattgctc

SEQ ID NO: 476542 - DNA, 767 bp, Homo sapiens
gagggagagggagagggagactgcaaatccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagaggtgaggccccgctgcgtctcacgcacctgcccataatcacacggatgcgcggcgtgtacatgtcccctgttggctctccccagcactctcagtagcgccagggagagatgggtacatgaagttccaggcaagtcaagttgaagtaggcaaaaaagaaatctggcctgttttcattcctctggattgagctgtgcctcctttctcccagccctgaacatgtcctttatcctttgtctccctgcaaacttccacgacataagtaaaaggggaaaaggtgaggtgagattagagcttatgct

SEQ ID NO: 476543 - DNA, 517 bp, Homo sapiens
ctcctccccgaccctgcccttccgccatccgcgacacgggcctccacgatgaacacggccatctgcttctccatcagttggaggggacgccatggaaggacacatctccacaccagtcacttgttaatatcttatggggagactctggaagggcaggaacacatggcccttgaagaaagtgtgactggggaggaagcctggagcctggacagacctgtctttgaccacagcgacatggacagcatccatgggccaaggccttggaagccgctgtgtcagagagaagatggagggcaacaggacccagacaaggaagggcttagtggatggccatgggcaggttctcagtgcgctggctcccagctgttctctagagagggaaggccacacccagccacatgcaagtccagggctgacacagcttggaggtcacagctgccccagggctgcggagtcctgactggattctgagaggaaagccattcccctcccctctgcagtgccttctgctgtccct

SEQ ID NO: 476544 - DNA, 893 bp, Homo sapiens
aaactattcctttttttctaagcctgcccctggggtctggcagccactgcagcccggatggagccccgcaggtgctgtcagaggcggaggagaccgtgtcagttggcagctgttttgcgtcggaggacacgaccgaggactcaggagtgatgagttccccctcagacatcgtctctctggactcgcagcaggacagcatgaaatacaaagacaagtgggccacagaccaggaagactgcagtgaccaggacctcgctggaaccccagacctgggtccccagaagagccccttgtgggagaagaatggctctgagaactcacatctgaggtgagtcacgggaaggatgggtgggtacggaagtcacagccacatctgtgtctctaaagagggtcttttgtcatgggatccaacacgtgctatcacaacctgctctgcaccaggggccccgaccctgattcacagcagctgctctcaggcatgtctctgtgctgtctatacatctgcaaagaggaaagtgacaggaaagagactcatcttcagctttatgggatacctgaaatgcttatgcagttggcgggccccccagtgtctgcaaggtccccttgttgcacaccgatgccagtgattaagataagtgtaagaactcatcaaataaatattatggaaatgttaacagaaataagggacaggcttggcattcacatctggagtgaaccctgtcgaaagcctaggcagcacaggggtggtaaaggcagggctggcagggagctgcccaggcagcagaactcaggtgtggcccgatggagcaggcctgtcaggtggtcacgatccctacagtgaggacccatgcctgggggctgacagcccagactcaaggtgaacttgtgagagc

SEQ ID NO: 476545 - DNA, 3950 bp, Homo sapiens
cccatgaacaatctgcgtctccgtagttctgaggacaacagcagtacagtgagtatgtgactgcttgaatttgagtatgagctgttctatcctcagatattcctggaaaggagtacattaaatcaatagtaagagaaatgagtgctcctttctctttggtcttccctagaactgaaaaagctgtcacagcctcaaatgatgaagaagacctattaattgctggagagttccgtaaaacccttgcagaacttgatgaagacctggaagaaatggaagacagctatgaaacagacaccagctccctcaccagctccatccatggtgcatccaaccactgcccacaggatgccatgatccctcacggcgacacagatgcaatcccagtaacattcataggggaagtttcagatgatcctgtggattcggggttgttttccaatagaaacaacaatgctgggtctttcgactcggagggtgttgccagcaggagagactccctggcgccacttcaagctgagcacagccagccccatgaaaaggcaagggaggaagtacctgccctgcaccccgcttcccatgacgtcggaaaaggaatccgtgtggccttatctaacatctctaaagatgggaatctaatggaaacggcgcccagggtgacttcttttgcttcgaatcttcacacagacaacctaaatgcaaaagtgaaagacaaagtgtatggctgtgctgacggggagaggactcaagccacagagagagtgaattcccaaccggtgaatgaaaaggacagcaacgataaaaacgctgccttggcaccaacatcatggcaccaacgaggccaaaacccagggaaaagctacagacttaagcacggcctcacaacgtataaaatcattcctccaaagtcagagatgcgatgttacgacagagatgtgtccctctccaccggagccattaagattgacgagctggggaacttggtgagtcctcacgccaccggcatcaggatcatttccctgtcttcgtctgtgcctgaagcagaatctcagcccattgggaaagtcagagagttctggaggtgcaactctgtggaaaaacacctgggccgaccctcagagagctctgccaggggacccccctccacccctgtgcccacgcagacgcagaatccagagagcagactccaagcagaccccaagccaatatcgccccagcagaagtctgcccaccatgagggccggaaccccctaggggaggggagaaaccagccccccaccatgggcatgggtcacgtgagggtgccagcagctcacaccacagaagtcacatttctcaagcctcagagaagaacgtccagccagtatgtggcctctgccattgccaagcgcataggagccccaaaagtccatgctgatgtggtgaggccacacggttatgccgagaagggttatgcaggcaaggcgccagtgctggctgcaccacctgtcactgtgaaagatgacaggacatccagcccacactcagagacacaaggatggaaggatggtgcccagtggccctgtgtcactcctcccaacaaccacggggaagatttggcagtgggagcccctcctaggggggaggtcattggcccacacaggaagttgtctactcaggacagacctgctgctatccacagaagctcctgtttctcactggttcagtcttcccagagggatcgtgtttctgtgggacagagctgtggtttcagtggaaagcaaagcacaagtagccaggaggccagctcagcatctgagcccagacgcgcacctgatggtacagacccaccccctccacacacatctgacactcaggcctgcagcagggagctggtcaatggctctgtgcgcgccccaggccacggcgagccttcccaccctccaggagggtctggcacagaaagccacattctcctagaaagagaggaaaagcccagtgtgttctctacagatggaaatgaaacagacagtatttggccacccagcatttttgggccgaagaaaaaattcaaacctgttgtccagagaccagtcccaaaagacacatccctgcactctgccctgatggaagccatccactctgcgggagggaaggacagactacgcaagacggcagaacacaccggggagggcaggccagcgaaactgtcctacacggaggcagagggcgaacgatctgcactgctggcagctatccgcgggcacagcggcacctgcagcctgaggaaggtggcatcctctgcttctgaggagctccagagcttccgagatgccgcactctctgctcagggctcggaaagtcctctgctagaagaccttggtcttctgtccccaccagccattcccccaccaccccctccaccctcccaggctctctctgcaccaaggacggcctccaggttcagcacgggcaccctcagcaacaccgcagacgcaaggcaagccttgatggacgccatccgctccggcacaggggctgcgagactgagaaaggtgcccttgctcgtgtgaatgaacagaggccagagaattgcagaaacccacctgtaatatgcccacaggcgtcactcaaggagtctgcatagccaggaacatcaagttttggtgttactttcttgtctacaggccaaatgcgcacagttgattttcggtgtgttcctgtataacggcttgaaaggaaaggagaagatgctgtgtcgctgcgcagctcgtgtgccaaggaaatgtgttttgcctctgaatatcttaagttgctaataaacgattcttgttggcaggttaatgggactataaatgctggagcccagcactcacacttaattatatttatgggcaaagtaaaaagaatcatgccttagactgattttggacctttgagacttttaccacatacagatggatgaaactacttactgatttaagatcttttgaattttagaaaaaacatatgaatcagatggaacaatctgaatgtgatatgctccatgatgctgtgtgttttggtagtaagaaaaaaaaattgggaggcttttcaaaggtggctttgttaggtagtaaaactgctggattcttcttcctcaaatatttggggctaacacttcacagagggtcacagtccatgatctgaccaactaagcttttaaaaatcaactattaccacccagaaaacagtcctacgtgatcatgtggccagggcatgcccgagtcctgcaagggtggcgggtggctgaggtcacaccaccactggagtggatgggcagtgccccacatggacagccattccccaggctatgaagtgacataggcctcccccacggtgcctgtgtacggagcctgatgacttcactgggagccttctggaatcctgcagagggtcaaggagcagggatgttggatgcccacctgtcaagagttcagatcaaagttgcgctgagagcatcacaattttggttcagccttgacgcgtttgtccaacagctcattggctccctttgtatgatatcgtggtcttctcacatggtgcccagtcaccaatatttataatgaggtctaactacagcagtagtttttcatatatatctctaaaacattttgttatattgaaaaaagtaatagaaatcaagatgtgttgatgaaataaaatgtgtatctgagtgagaaaacaagtatggtgaggtcactttaatgtttcacagcgatctcagatctaggcctcaggtagaatggaagctgttctgcattcactgattaacgttgctaaactcttggtgaggcacgagctaccagccaattgctcttcatcacagctatctgtcttttagtgccacaaataaaagaaaatcaaatcttagctgttgtgtgaatttcatactacagttggtttggatacccctcttccaaaatgggaaggac

SEQ ID NO: 476546 - DNA, 1496 bp, Homo sapiens
gttcatttttctcctcctcaactgccaactctctacttgtccatatgcaattgtatttatttacttctgagattcctcttctgcttcactgtctgttggagaggagcagctggacaagaggcccctatcataaatctataaacatcgagaacactttaaggaccatcaaagccaagctaactgtgggttctctccccagcgatgcctatgctttatgtcatccatttattcgacaaacacattctgagcatccactctccttcactggaacaaagaagagaaacacagtcccagcctcctggaacttgggcacacggcatagctctgttctctgcaagaaccctcattctgtcctccctggcaagagcaggcgaagaaaagaggcttgggaaagacagaggaaggcatggtccctgctggctgcaggactgaggagggctcgcataaaaggatccacccacagtacactgagaagtgaggggctcaggcagaggaggaaggttttgggaatgtgggccacaagcaagtcagaattccacattttacatttcgatttatgatccattttgtattaaatgctgtctatggttcaagttttacatatgttataaaccctatattacattgttattatttttgtttgaacaatcagttatcttttcaagaaatttaaataataggaaaaaaatcttatttatttatatgccatttccagagctcttcactcatttgtgtggatctgtatttccctccaatattgacttccttttgactgaaggacttcctttaacatttctcatagcacaggtctgccagggatgcattctttcggctttggtatgcttgaaaaaatacttccttgtgttttagtttttgaagacattttcactgaatataaaagcctaggttaccagatttttttcctttccatacttccctacattgtcttcttgttcatagtttctgatgagacatctgcttgttatccatatatttgttctgctatacaaatgtcttttttctctggcacaatatatatataatatgttatgtatacaatataatactaatataatataatataataacatataatatagacatatacatatgtatatgtatattatgcttcttgaaactataccacaattcactgatggctatgttcattttatttattatttatttattaccttttctttctgtatttctttgtgtatctaattttgaatagtttctattcttcaagttcattaaaatgttcttctgcaatgtctaatcatctgccattaattctatctaatgtatttttttcatcccacatattccaattttcaactctagaattttaatttgggcattttttaatactttccatgtttctacttaattttttaaaacatataaagttatcatcctgtcttaatattcttgcctgctaatccaagcatctgtgtcagttctgtgttacttttcactgatggatttatatcatt

SEQ ID NO: 476547 - DNA, 657 bp, Homo sapiens
attccacttcttgggcgcagactaggaagctttcgtgcagtaggacagctgtgttggaggctccactgcctcataaatgaactccaacagcacagctgttagaacatttgctgttgttccacaggccacagaagcttttcttctccttcttcccctcctcctcctctgtcttccctgttttttcctttttactctctgccttagtttcaatcctttctattgctatgacttcaggctcattgatctttatttccttttttttctttttcacttatgtaatataagctgcaaaatagtggtgaactatactaaggggtatagccctctgctgagtgtggtcttttctttattttccaaaacagcccacgtagggttgagaacagtgcctgcatcctgtgtgctgtcagctggtgtagtccattgcagccatggccccacctcggcggcgcccctgcccaaccgaggttggcagggcactgtcccagggatgtgagggcgtggtgtcatctcatttcttggagtgctcatttgttcatatcataagaattaggtgttttaaggcattagtgctatgtgcaattgaaaatagtttctccagctgccagtctgctgagtcctgcagaccagctgttttccacgaccacagaattgaaattc

SEQ ID NO: 476548 - DNA, 875 bp, Homo sapiens
tctccatcctccgggctcttgggaagctctctggagctgctgggagcagttccaggacacagcacagagctgttccctccagcaaaggagcccatgtccatgtccacgtccactcatggacaaggtgacgtgcctcagcctcaccaaggggcccggtgtggccagcaaaggccccacgtgggtcaatttccaccgagcggccagataccccgggcattttattgatcctattgaccacggcaaatggccgctggacaccaattcagtgccagccccggctcagggactgccacacgtggtccatgtaactcagagttatcctgtgccatggttaccccacgttacagctgaggccactgaggctcgctgcggcccgcagtcccagaaagactttaccgcacctctccggcctggggtgtcctgggggatgaagctccaggaggccacctatggcttggggccccagtcccagaagcctggcctggggcgcacctctctggtcttcaggaagaggggcctggaatgagagtgggggcgtccagtggggcagcttaaccgggcagggctgacgggaccgcggcctggggagggaccagaatctgcctggcctcactgtgtgacttggggaaccgtgtcccaagcagggcccttcaccccatctctgtctgatctccactgcgtgtacggattgacgggaaagattctaatgggctttaagttaataagctgggaacgaattaagtttgatctctgccagaagcagatggcacagctgcccggcctggaacagcccggctggagcagtggcaggcggcaagggctgggtgggggtttgccccactgggctctctttatttttctctccttcccccaac

SEQ ID NO: 476549 - DNA, 1082 bp, Homo sapiens
tccttccccgccggctgcagctcttccttctcactgtaggctgggaaccaggatgcctgccttcctagaccccaacgcgagctgctggcctgagtccaatgggacagccctgcaggagttcgtgatcctgggcttctccgtgtggcccccggggctccgcgtgctgctcttcgtcctcttcttgccgctctacctggtcaccctggcggggaacctactgatcctgggcctggccctggtggaccccgccctgcactcgccaatgtacttcttcctgggggcgctgtccgcggcgcaggcagcctacacgctggtgctcacgccacgcatgctggccggcttcctcctgccctccaggggccaggctgtggacccctctacctgcgccgcccagatgggcctcttcgtggccctggggggctccgagtgcctgctgctggctgccatggccctagaccgctacctggctatctgccatccactctgctaccctcggctcatgaccatggacctgcccttctgccgcggcggcctggtcaaccacgtcttctgcgacctcccggccgtgctggtgctggcctgcgggtgccgggccctgcaggagcgcgtcctcctggtggcctgcctgctgctgctggtgctacccctgctcctcatcctgctctcctacacccgggtgctggtggtcatcctgggtgttgggggggtcgcgggccgccgcaaggcccttctacacggtggcgtcccacctcaccgtgggcccctgaacagccgttcccttgaggaggacaagctggtctcgctcatctatatcaacgtcaccccgctgctgtacccggccatctacacgctgcggaaccgggacatgcaggaggccctgcaatgcatggtcggccagaggacgctggggatggccaccaggggctctgtgatacgtgacgacaaacagaagaaatggtatgtggtgctgcagtgggcctccctggtttaataatatgttcatcttattccagttctgtatcacaaatacagaagggtataatttagcatagaaagtctccatagatcttctatatattatg

SEQ ID NO: 476550 - DNA, 657 bp, Homo sapiens
gatgtgtggtgcagaagaagagcttaactggcttttggtgtgagctcagctttattccaagaagaggatccccttattgctgaactttcccaggacggctgaagtacttggcatgcttctaaccctatgccccaaacatctgtttcccctgcagactgccagcttctttagggcagaggctttcccttctgcaattcccacctgggggacgttgatttattttgggcattggcagcagaaagtgcatcttgctgtggctttcattttggtgatatttgagctgcaccagcaggtggggcctgaagctagtttggctgccatcagccttgtttctggagggcctggaattcaggaatggctttccctttcagctccaactttcctctccccaccaaatgttgatttcaatttgcctggggtctgggtccatccagaccctgagggttccggatgttctccagttcccaaaccagcctgctctgtggcttctctgaagctgtggcttgctcatctcagcacctacgccatcaatccagctttctctggtggtcgcgctgggctagaagaggatgtcatatttggttaagtactttatatgtaagatgagtatttctcttgtacatattacattttcaatgggtttccaaccatttccaa

SEQ ID NO: 476551 - DNA, 664 bp, Homo sapiens
atatgaaatctgacagagctgctgccgctggccatgcggcgcccaagggtgggtggggtgtactctgtggctgtccgtcatcagcaggagacagctgccctctgccaggttgccggggccgaattctccctggcttcggatggcatggtccagggatgggaaaaggccctttccagctcagcggccaacgtcgcatccctgaggccgtgtgcctgctccggggaagacgccgtgcctgtagccgtttcgggctttgacttggacagcttccgggacaccgagaaacccatgtgggcgttttccagtattaacggcagcgtagacccccgtccagccgtccctgaagtgtccggcatctccttcgagggaggctgtagggtcctctcgtgcaaggcccaggcgcatcgtgacagcttgcacgcgctgtggttcggggaggtcttcctgcaggcactgagtcacaggtcaaaggctggctcagcctgctgccctcgcaaggattccacccacctggcttctgatgagtcagcactgccacctgaccccaattattctggggtcccatgattttcattgctactagggaaacctttctagaaccacgtcttgtatcgtctgctctggcttacagaggacagacactcctgagccccttgacagcacc

SEQ ID NO: 476552 - DNA, 556 bp, Homo sapiens
ggtattcctgtcttggtattcctggcagtttggtccctggaggtggccatgtggcatggacaggggcctctatgcagaggctttttcagcaactgtgctgtgctgccgccatggccacctccatctgagcctttgaggccagggctggctggacaaatgcccccaaaacagcacgtgtgcactcctccattggcagccaaccgggctttgctggagctgtgcgtgtgtgccgttcagaggcctcgttctgtcgcgtttctgcttgttgctgccgctagggagtctgccgcccctctcgtcacccgcccgtgggtgaccggtgtcttctccctggaggaatatctatctttcatcagttccataaaattctcagcccttccctctgcctctggcctctaccccatttccatgtcctccccgagcacctgtgagagggacgcaggtggcctcactggcctgcaggctcttagctttcctgggctgccctgttgctggccctgagttcacctcgccctcctctctcttctgcctgtccccacctgggtttagacacagg

SEQ ID NO: 476553 - DNA, 988 bp, Homo sapiens
gatttcaactggtttatttgccatgtgctttttcttattccaagcccagctagcgacagccagcattcattacagtccagcctctttaacgctccgtggcttccttgctcatgctgtcgtcctctggtacttcctgtccatccagtgtcttatggacactggcctgagaggcccatcaatgctgactgtgacgtttccagcacataatgcaattgacattcctgctctcaccaaggagcagggaacataccctaaagtcatcatcaactcaggcccattctatcttgctggtattgccatttttagtgccagatttttacctcatgggctaagatggctgctggagcttcatctattatgtcaacatccctctcaattccctctcaatggggaaaaaaaaaaaaaaaaagggtccgaaacacattgccctcatgctttaaagaccatttttggaacttatacgtgacacttctgtttacatttcattgaccagaacttagtcacatggacattcctagctgcaagggaagcttgaaaaacgtaacctttattccaggtagtcatgggcagagctaaatgagagtgttgtgtaagatcactgggaactgtcccagatcaaatatctggagaattctttcactttcaaatatttatgaacaatttttatagaaagacttcaacattaaattaggaagtactatcccaggaaggacaatctgaataggagataaatcacattgaactgcttcattcatgtcttaacacatctgtgcagagctgtgttaacctatcagggtgatataaggtagttgggggttatgggttaactaaaaaagttttcatggataaattttatccaaaagtaaacagacagaaaacatataatttgatagaataatggggtaggctgtttcaagaatgagcagaattagtctttggtgaaaccataaagtaaatatgctccttcagtgcctttgtggtaactgct

SEQ ID NO: 476554 - DNA, 642 bp, Homo sapiens
tgctctgaatatagagtcgcagagaccacagcatcgggcaaggttatggacgccagatgctgttagcagttcatgactggagcgactgaaacacagaccttagcgatacaccataatctggctcctggagttagggctcttatcccactactcatccatctactaaaaaaagaagaagaggaggatgacaacgacaacgatgacaatgatggcaatgatgatgaagaagaggaagaggaggaacaggaagaggaagaagaagaagaaggaggaggaggagaaggagaaataatagtggaggaaggagaagagggaagagaaagaggaaaagaagaaggaaaaggagaggaaggagaagaggaaagagaagaggaaaaagaagaaggagaagaagagaaggaggaggaggaagagaaaggaggaagaggaggaggagaaaaggaaggagaagaggaaagagaagaggaagaggaggaggaagaggaagaagaataagaagaaagaaaaaataaatgcatttctagtttatttcttacagttgtggaggctgggaaatccaagagcatggcactggcatctgaagagggccttcagctgaatcataatgcagaggtatggggttgggggcttgactgatatccc

SEQ ID NO: 476555 - DNA, 610 bp, Homo sapiens
tttctttgagtttccatttctgaaggctcctgtgtcatgtaaaatgtatacagtattgaataaatttgggttgctgcgaaggggaagtctttcctgcgctctgccctcgtctgctgcttctgtgtttgcttgtgaaactgctcaaggtccccctttcaattccgctctctggattccagtgcttttccagtttcaatttccactgagaaaaaaacctcattccgtgtcatattacattaggggcaagaactgctttgggggtgtaaggggacaaggcggggggcctcacctgaggcgcaggccagtgaggcgggaaatggcgctctccatcccaagacagggtctgcgcctgcttccggcctggtggacagcaccttcatcatcgccgccatcgcagagccgctcgctgcactttcccctctttcctgagggttctctcccggctccagacagagtgattaatggccccttgggccaactctaaaagactgaggagacaaatatacctcatccatggggaaacaagccccgggacatatattatctaggaaaaatgagcatcaccacaaacacgtgagttatgtctgtgctatgacgttatgatggctac

SEQ ID NO: 476556 - DNA, 636 bp, Homo sapiens
aggcctcttttctgagtttctgagtactatatttgtatatcaatgtgcttacttgacatcccaaagtattactgctgcaccatgatggtactgagcttggagaatggggtggactatgcaatggaagagcgcattggcagcagttccatcgtggggttcctggtctttgggtggagtggaaagagaaaatctcagatggaagtggaagggaggtactgggaggctaatgctccttcccgccctgctttccgtgctcagagtaagttctgcagcacagttgggcctacggacaggattcctcatcgtgacagtgtgacttcagtcgggaaagatatctttaaacattttcacatgaaaaatcttgacctaaaagaaaaactcaaattccataagcttgcattcaggtcttccataatttggctccgatgtacttcttcattaagaaatcatttctttgagatgagagagtacctgcagaggactgagattgtgggccctggaatcaaacaggctggggtttgatctcagttttgccaactacgggctttgtgttattggcaagttatcttacctttttacacctgtttctttgtctttaacatgggggttatagtactgatgtcactgggttgttgc

SEQ ID NO: 476557 - DNA, 796 bp, Homo sapiens
cgtcgtcttgcagactcctccacgttggagacgcaaacctcaggcgtaagcatggggaagatgctcagtactaagtgggcaggcgccttctttgcacaatgcatagctcttcacataaagctctccccacttcacttcatctctctgaaaggtggtgtttttggagaaaagggcccatgtgaagagtcacttacatttctagcagtttctcctctccccggccctacctcaccacacagccagttgttccattcctgtctcatttctgacagagcagaagagctccctgatctgcccaagaggtggtgcatgtgtgggatgacccggacccgggatgaaggacgagaagacaaaatgatggctgaacccactgtggatgcatctctaagctcaaggggtggccaaggagtggctatttccagggggatgtggcctgagtctgggcttgcaggcttgggtgtctacatgtgtccttggggtggaccccaagttcctggggaacatgtgctttaccaagaagcacaagaagaagggcctaaagaagatgcaggccgacagtgccaaggccgtgagtacatgtgccaaggctatcgaggccctctgcatcatcgcagcagtcagcttcccataattgttgaagatttcaacctttaagcagctctgttctatgggatgaacacccaagcctaccacagtcgaggtagagagaaaatatttgattggaaaaaggtaagtttcccctttttagagccatcagacaactaataaacagtcatgaatgtcttctaatttctcc

SEQ ID NO: 476558 - DNA, 1046 bp, Homo sapiens
gagtcaccactgcccttgctttcgacaagcctggcatgaagaaatgaagggggaacagtatggctagagtacacgcagcaaggcaggacctattggaaaatgcaggagagataccaacaggggccagaccagggctttgtgagcctggaaaaggatgcacggagcaagcagcaaccccacaattacatgcacgctacatgagcagttctcagccgccgcggaccttcgcggtgagtgttacggttattaaagatggtgtgtctggagataatccttcagctgttcacatgtgcccggagtttcctccttctggtgggttcgtggtctcgctgacttcaggagtgaagctgcagaccttcacggtgagtgttacagctcttaaagccggcgcatgtggagttgttagttccttctggtgggttcgtggtctcgctgacttcaggagtgaagctgcagaccttcacagagtaaagctgcagaccttcgcagtcagtgttacagttcataaacgtggcgtgtccggagttgttcatccctccctgtgggtttgtggtctcgctggtttcaggagtgaagatgcagaccttcgcgagtctgaattcttttaccaaattatgtctatcatcaaaacaaatgtctggtgcattttgtgctctaacagggctgagagggccagatctaaggaaggatgtcctgggcctgaaggagcctgggccttgcctgccctgctgctggctgggccttttggggtatacagagttgtctctcttgttggagccacgaatgagacagctggaaaacacacattttatttcatctgtgatgtcagggctgctgtgctttctcccagtcctgtttcacgtatgaccctcagagggctgcttagagaatagtttattctcacttattttatgtgctgggcagaatttacatcttgtaaaatcagcatcaaagcctgctgtcaaacagcttatgttttctcttttccaagtcttgtttgtgtgtgttgttgttgttgtttgaaaaacccaagttttaatggtatt

SEQ ID NO: 476559 - DNA, 607 bp, Homo sapiens
tctactggagagtaagctttctacattgctagcaagtcaacattgatgataatgtggaaatcgtatggtgttgaaacaccaaccctggttcttcttattcatatgatctgggattccccgtgtatcttcagcaaaggaaaaacaaaaggagaaataaccagacttctgctgcttgcaagaaacaaaacctgcagtcaccaactgggctgctccagtatttcaaaccattccaagaagaagaaaaaaaaattaaaagtgactccacggacagattttcctttcatcagggaggtagctggggatgacaggagagacggacagtactcacatacaaatgagtgctttgcctcggggctcacacagttggatagagagctgatgcagagacagaaattcatttcccatgagaaaggagagaagtgcacagggaacagggtcacaccagaacaggtgataatgaaattagagttaatgaaggctggaagaaacctagagtggatgggttggtgaaactgttatctgagatgcacactaaaaccagggatgatatctcagtacgggggaaacaatggttggagatgcatggtagaaaagtcctgggaaatat

SEQ ID NO: 476560 - DNA, 730 bp, Homo sapiens
tttgagttcattatggtagagccattttaagcctcatggagaatttacccagtcataaaaggcattgtagcctcctccttgctctttatcttggattggtcactctgggggaagccagctgccatgtggtgaggacaattgagcaagcttatgaagaagttcacatgaaaaagagagacaggctcccttatggaatttacaaaccagaatggaaaacagacatggaacaagaaactgccagcgtgagctgcaccacactgtgggtagcattagaagagaaagcacaagactgtgtggtcagaagagaaggtcgtacttctgttgaagttggccctgctaaagagcctcctgataaaagaaatcccacgtgtgaactgaagcacaggtctctgagtccaggaggccatgggcacagctaccatgtgaggctgcatgtggctgtgtggtttgtgcactgcacagaagccatggctgataggactattaatagctcgtgaaccaggactggtgcctggacaacactttgattagtttatgccatccagcctacatccccatgccaatgatgcagggttgagctagaacttgcactgggggagccgctgacagaaccaggttggacatctcacctgcaaagggcctactcattgactgactattaatctatttaatgagacacagcacatgaaagtcagcctgattgggagaggctaatctctggaccaatcag

SEQ ID NO: 476561 - DNA, 493 bp, Homo sapiens
gagaaaccccctacaatgcacgggacagctttccgcaacgaagcattatccagcccaaaatgtaaaatctatgaagaattcatattgctagaatgccttgcaactagggtgtacctgattgacttggcttcagccaactataacacccatgagaggcttgattcagaagtaaccatcatgaagaagtggctgggcaggcgtatggaccttctgtcaagcacgagggcaaaaaatgttgttctttctggaacaatagtgttcagtgctaacagtcatggttgcccatcagcagtgctcatgtttctcaagggataccttagtgtaattgggcattacaactgtgcagcctcaaaatctggctttcttatcctaatgaactttaaaagtagaccacatcaggagaacagtggccaagctgccaatattgaaaatgctacctgcctgtggaaatgagtgcatttttgtcatgaagtcattggcagtgttagtgttc

SEQ ID NO: 476562 - DNA, 1041 bp, Homo sapiens
atgtccctgtgacctgtcactgctgtgagaacctcaacctctactgtctgggaaggatggctatcttcagctggacaggcttgcaaatcagctcctggaaaattagaaattggtgtcgaagagtaggagaaacacaccgtgtgtggcataacaataatagcttacacctacataccattttggagcttacaatactgtttctcaatggttcctgggagacttgcctcattcaccaggtgaaagctcaaatgcagacttctgtgtcataccccacacctgatgaatcagaatctcagtggagtttagcaacagccaagagtgggaacgagggtccgagatcaaggcagggggtaacacactgcgcaaagaaagaaagagtgaaagaggatgccattttgaatgtagatggcttagctcttactcacagacatacacactcatacttaactacaatcactcaattaactgctaaaccttatgaaggaagtagtatttgaaaaacatttaaaatatttaagaggatatttaaataaatacttaagaaacagtctatgaacttgcatgaagaactctacaagtacaatactttccttcggaaattaaactttgaaataaaagatagcattttaaaatgtgacttgtatatgcctgcccaaagtcctgataggtattttatatcataaagaattgggaaacagtaactaaaggcaaataatagtgccttgtttcaccaggaatttgcatattgtgctaatattaatgtaatctcttagaaaattctcatctaaagtgtgaggtttcttattaaaaaaaatttcatgggttcatgtagaaaatttttcatgggtctctttatttaaacattttaagttcaattcctcttcagttatatcttagccagtggaatacagataatgcattttgttcttctttccccagaaactgaagtgtttactcttatggactcagaggggcttttcaagttacttcaatttttacagctcttttcatatcccatgtgtggatttactgtgaagactt

SEQ ID NO: 476563 - DNA, 1186 bp, Homo sapiens
gggagttcatctatcacactgttaccagtcacacaaccaggatgtcagctcagaggctgtattgcccttaatgcatgcacaccttgctgcttaacacactatgtaccggagatgaaagtggagctgccctggatttggcagattgcagctctgacacgtcagcccctctgagaccatttgtagccatctctaagcaacctacaggaaacttggaggctgcaataaacattgagagctcaagcagctgccagaagagtggaagtcagggacatttctcatcttcagggagaggactgctgcgtgtgctagagaacagggaaactggaatgtgtggatatcacacaagggaggggacagcagcccaggctgtacacaaccatcgatgtagccatagagccccaccttcatgtaaagagcaagaaagaagagcgtgggaagcaaagaactttgtctctcttgctggtgctcatgggagccaggatcagcatccatatatggtcatgccaaactaaagattgatggcaagacctagagaggaggagacagtggcaggggtgagttgtggagggaagggcataacctatatcactggtagaaatgtgaatttcttcctggttacagaaaactattctggaaatatctgtttaaaacaatacacatacctattgacctagctatctcctctgggtcttcatcacattatagaaataaaagcactggtatataagaatattagaagtttagagtaaaaaaaagtttagagtaaacttagaactaagaattttaggaaagtagaagaaaaatgtttattatagcattgtttgtaatgacaagaaactgttaaatatcggaatacttgtgattagaagaatggttcaataaactgtggtatatttatataatgaaatgttatggagctcttaaaaagaatgagctatatctagattcattgacttggaattatccccacagtgtactgttagatgagcaaaggaagacagagaaaaatatacagtatgatctcttaaacaaaacccttagaaaagagtcgataaatgtacatcagtgtatatgggaaactaagaatatggaaaaaggtgagaagaagatacatatgaggctatttattttggtttctttggtagggttggaaaagaatccctgttcttggtagccttactaaagt

SEQ ID NO: 476564 - DNA, 764 bp, Homo sapiens
gggagttaacatgtacagaaggaatggtaccagctcctccttgtacctctggtagaattcggctatgaatccatctggtcctgggctttttttggttgccttatccaggccagaaggcaacagcaggtcagtggttattcatggagggaacatccggtcccacccactcacggctgttgagtggcaactctacatattcttggtactctgcttaagcccactttacactgagaggcaagcccaagtccatgcatatctgtggaacataacctctggccctacccacccagtgtgggccaaacagcaagcccagagatgttacccagcctcagtgccctgcacacagcatttctcaacttcagattccagacaatattgcccagccatggagacaatattcatccctgcccaatcagaaatatttacaggacctagccagcagctgtgtgatggcatagtccagccagtggtatcaccagaacatggagcacagccaacaataccacatgatctcagagcacaagaagtaacccagcccaactagagaacctaacaccaaggtttgcctgtacagggttgctaccagttagcccatccaaaatcccaagcttgactaaagggtaaaggtctgtaaattccaaagaacacctgcaaatgatgaaagaggtggccatcttctcaaatgtgcaagcattatgtaaggacataaggattatgaaaaatcagggaaatgtgacaccatcaaaagaaatgaataaagttct

SEQ ID NO: 476565 - DNA, 573 bp, Homo sapiens
cagcagtatgctcttattggcccagggatggcaataacacaagcagcagctgatacggctctccttcatggatcattgaattacactaagtgttttgaacaaagtcagtttcaaaacatactgctttcctcccaaaccttggaatttctcttcataccaaagttccaagagcctatgctagtaggaagagaatctccgaatatgggtcattttggttccagacatcagcttcttcatctgtggatagtcaagttatttgaaagagattgttccaattctcagctgctgttacgggctgagttctgtcctccaaattcatatgttaaagccctaacctccaatgtgactatattcggatatgggacctttaaagagggggagccaatcggctgtcagcctccaaagagtgcctgctcatgggatggcaagctggctctcttgcagagcgcaattaaagcatctgccaggaaaagattgttttgaggcaggtatgcatttgataaattggtgttgtgggcatcccatgccaaggtttcagtgtgtctcagggttacctggtatttaaaataaact

SEQ ID NO: 476566 - DNA, 768 bp, Homo sapiens
gctcccagactgagccctgtgttcgttcttttttttttttttcaggcatctggctctggttccaatgggtgtacagttccaagaatgtggagggaccctcttcagttgtgagattatgaacccaaagttcaaggtcccaaagttttgttgcagtgtggatggcaagagcagtctttctctgatgttctcagaagatccaatccatgccaggcttctggattccctttctctgagcagccctactgagcctgttcaccacactatagccgtggaggtcaagctgcaagacaaaagaaaatctttgttgtttgtttgtttcatggaaccacaggcaacagtctctcagttttgtaagatgctgtccaaggggttgcatgggatgggtcctgtcatctttaatccattcaaagtggataaaggagtttcaacatgtggactctgggcaagatggttgccctgggtaacagaaaagataagaaaaggaaaagagagaaagggaaaaaggcattgcctgtggcagggtggggaagatgtaactaagctaaaaggttagcagatttaatttttgtaatcaattcgtcgcttaagctttatacttgcctttcgtaaagtctttaaataaaaatactgaaatacttttagaagcttctgcatatcaataggcatccctagatgaaactaatctgggagccctcattttcaaatgcacttcagtgttttgttgttcatttggaacattccactataagttatccttagtaagatttt

SEQ ID NO: 476567 - DNA, 732 bp, Homo sapiens
tgggccggaaggagatgtgagatggagctggtggctgctgaagaggatgttggaatcattgttctttgctggggcttcaaagggggctgctgccagctgcctgctaaggttgaaacagctgccaccaaaaaaggggccagcccttcctgcctcatctccagaggatgcaccagctccagcctgcaggtctgcctccgggccctctggctagagggggatggcaggcttccagataggcctttgagtagttctgtttatgggaggctagagggagaattcaacagtatggtgaggggatccgggatatttccaagtgtaaaagccaaatccatgagtatggcaatggaacacatcctggtatcagctattaatcaagacaggaataaaatgggcagcagtggttctagaagcaagggcactcttctttctgtgggagagtgtgggaagaagctggtggtgttgagccaaggctatttcatgcacaatttgtctatcttgggctaggtcaagaagttatgccttgactaggaatggtttgccagagttgaaaaatactgtagaagtcactgattggagagatgaagagagtttgtgttgccctcttgcattttctaaataaatagaaatcacaaatatatgcttttaatttggaagcttcttcttttgctgtgttttatttttgttttaaaactcaagtgtattggttaaattggtttacttcttaagtaaatc

SEQ ID NO: 476568 - DNA, 624 bp, Homo sapiens
gccgtcacactttctgcataaccactgagaatgagagcttcagcctgtgtatgcattaggtcctacaaaaggaagacagatactgggcaaggatcccctcatcctgatagaatggtttgggagccttgcaccaaagtttctcttatttgttttgatttgttctcacctttacatagggagggctgtcctgtgacatgtgctgtggggagatgtattgaaacaacagccaaccctcttgagacatattctcaaggtataggtatggagggtatagagggtggcagatgtgaaacactcaataatgctgaacgaataagatccaccccgttagatgcaatagaaaaatgcaaattaaattgtagctgtttggaaatgagaaatgaccaaactgtcagaacaccatgacctttgccttatatctgttcctgtggagagagatctgcatctattgcagaagctggtttcccagtacttgcattcttatagctgatttattgagaccgaacaaaccattaaaaaaattatgttttaaccacaggatgtaaggaagatgtaaagtctaaggtatgtgtttctaacgtaggtactaagataaataacactgactgagttcctaatgtgtat

SEQ ID NO: 476569 - DNA, 1256 bp, Homo sapiens
cgggagtcattctctcctacttgagaactagccatgcaaacttttggtgttcttacggagctaaagacttgccaggtacatacctatgggttgataatgggtggcagtaacagatctgctgaagcacagaaacttgctaatgggatcaacatcattgtggccacaccacgctgtctgctggaccatatgcagaataccccagggtttatgtataaaaacctgcagtgtctggttattgatgaagctgatcatatcttggatgttgggtttgaagaggaattaaagcaagttattaaacttttgccaacatgtagacagactatgctcttttctgccacccaaactcaaaaagttgaaggcctggcaaggatttctctgaaaaaggagccattgtattttggtgttgatgatgataaagctaatgcaacagtgaatggtcttgagcagggatatgttgtttgtccttccaaaaagagattccttctgctctttacattccttaagaagaaacaaaagaagaagcttatggccttcttttcatcttgtatgtccgtgaaatacccctatgagttgctgaactacattgatttgccctacgtggccattcatggaaagcaaaagcaaaataagtgtacaaccacattcttccagttctgcaacccagattcaggaacactattgtgtacggatgtggcaacaagaggactggacattcctgaagttgactggattgttcagtatgaccctccggatgaccctaaggaatatattcattgtcttgagaaattgattgaaaagaactactttcttcgtaagtcagcccagaaaccatataagccgtacatacaagcctatgattaccattctctgaaacagatctttaatgttaataacttaaatttgcctcaagttgctctgtcatttggtttcaaggtgactccctttgttgatctgaacatcaactgcaatgaagccaagcagaaaaagcaagggggtggtggtggatttggctaccagaaaatcaagaaaattgaaaagtccaaaatctttaaatacattagcaagatatcatccgacagcaggcagttctctcactgaagacatgcctttctttcatcttgaataactttatcctaaaattaattttttccccttgatttaacaggatttttgtagcctttagaatttggacttatctaacaagagtatgaattgagttgggttccaagcattgagcactgttacttctatcaagc

SEQ ID NO: 476570 - DNA, 1112 bp, Homo sapiens
agcaggccattggcatacgtgcaactgacagctggggacgaaagaatgcagggtcatgagtggcagggagggaatgtgaattcaagccacagtgcaataccactatgtggtatgcaggagccaccagaatggctaaaatttaatactgtgacttccaaatatgggaaaaaatgtggagcaagcgtcaggctcatcaatgcagaccaccctgggcaacaaactgagattccatctctccaaaaagaagaagaagaaggagaaggagaaggagaaggaggaggaggaggagaagaagaagaagaagaagaagaagaagaagaagaagaagaagaagaagaagaagaagaagaagaagagaagaagaagaagaagaagaagaagaagaaagaagaagaagaagaagaagaaagaagaagaagaagaagaaaagaagaagaaagaagaagaagaagaaaagaagaagaagaaggaagaagaagaagaagaaaagaagaagaaaagaataagaagaaaagaagaagaagaaaagaagaagaagaaagaagaagaagaagaagaaagaagaagaagaagaggaggagaagaagaaagaagaagaagaagaaagaagaagaagaagaagaaagaagaagaagaggaggaggagaagaagaagaagaagaagaagaagaagaagaagaagaagaagaagaagaagaagaagaagaaaaagaagaaaaaaaaaacaaaacagccaggcatggtggcaccatataattggattttaggatatgctatcaccctatatttcttccctgagatcaactaactctttttttttaaatcaattcttgttttagccctcatttgggttcttaaactttgaagttttacttttatgtgtctttttatgtctccaatagattgacaataaatagtggtttcaattgtgttacaattttcattgacttcgtaattatttgttttattaattattcatttggaagaatttttcatttttttatagtagctttgtatagaagaaagttgctcatacctatatatttgattgactggcttggcagattggggtggtgttattagtcggttttcacactgctgataaagacata

SEQ ID NO: 476571 - DNA, 1281 bp, Homo sapiens
gacggtggagtgggtgagctaattgccggagctgctgcagacactgaggccttcactgctgctctgcaccagatgtgcaaacagtaataaaatgggcgatggggccgattctttgcacgccagtcctgaaacaggctttcctctaattgattttcctacttcatgtgaactcaggcagctgcaatttatatggagtgtgttcctggatgtggtgccgtcagagctgcacacatctggtgagcagcttttggtttgggctgtgaaagatgttcccaatcccttaagtgttcactcctcacggctctccttacccaaagcagctgctttttccacagggtcaagctgcgttaccttcgacaaagatgtcactagaaatggctctctaggaagtcaccaagatagagtctgtgcgggcagaacccagggcaagcagatacagaaggaccagcttctggttcttctcaacagtcaggacggcttccacagcatccaggcttttacacccctcatcttggggcactatctacatatcttagaagagggtgcagccaccgtgccaattatgcaacttcaagagatgctggggcagtcccctgtagtttgatatctttgaatgtcaaaattatttagctattctaattagcattgcaatggaaatcttcattgctacatccccaattattgtggcaaataactagtaacggaatttttaagcaataaacaatgcacccttcaaaatgtgttaatatttgttatgatctagaaaattattccttcttcatacatacctgttttgaaaaacacccagcctcgtattcttcatgaagactactttgaatgaacaaagctattattacaacctcttggtcctaacacaacttcatcaatttttaatctaaactgttattcacttagggtacaaataagaatgcttttatgtgcttatgctagaatgcattagtgtattcaacttatatgtttatctctgtttccactttttcatgattagttcaatgctatactcatagtggggagtcagtaactcatctttcatgaatctcattcatttggaaaataacatccagattgctcatgaagaaagtcttgagcacatcatttaattttaaaatttcctatattatgcttggaaatgtgtatcttaaaggaagctagacagtgttttctccacagaagagccattattctgggaatgagtgaaattgtctggttatttgcaagagaagccttaaaattttgttttgttatttagctttaggggag

SEQ ID NO: 476572 - DNA, 566 bp, Homo sapiens
ctctctctctctctctctctctttctctttcttccttccttccttctttactcaatatgcaactaatttatgaagcccgtttagaccacaacaaccctgatgcaagatggctccccttcaccttccaccatgagtggaagcagcctgaggctctcaccagaagccaagcagatgctgatgctatgcttcttgtacaaaaggtaaaggtcaaggaagctctgcctgagtggttgcataatgaggatctcatacacagtttgggtgtaaaagttctgttgggctatagtcatcagtcagaggcacagttagcacggattaactggttgtctttatggcagaatgtcacttgttgcttttatgccaaagtagatgctttgctgcactgcctaaattcactcctcgagcactcatttccccagtcactgaagaatggtacagatgactctcagcccaggaattgccctaaaaaaagcagttttgcctcatattataccctcatgatgtaggccacattcaatcactggacaatgtggggatataattctgatctcctttgccctattaag

SEQ ID NO: 476573 - DNA, 837 bp, Homo sapiens
gggaagcaaacagaaagaaatgtcaatgccccttacaattgaggtgaacatatccctgtttgtctaccttcatacaattaccaaaaagttaacaggatcaaataagaaaacatatgcatattattctcattctattccatataaggtagacctgaatagtatcttaattgaggaaataaatgactgtgaaatgcatgagattcggaatctgattgggcttccaaggttcttggcttgccagcattgtgatgctgtagccctctgggtggacatggaaggatgtcagcagagttccagacatgtggagatgcagatgactaaacagaaaatagaagataaaaaggtcaaaaagaactattcggatttaaaagatataaaagaacaaagcacagcagatttctgactggggtcctgtatttgaatcttattaattcccttagtctttgttatccctaattatagagctgtcaatctcaaaacccacaaaagagggaaatttgaaaacattctggatttgtattatactattgaatgcattgtgggttttttcatgtagctggaaggagacagctttaaatgaacttttcacagggaaaaaataggctaattaatattccattgtatgtatataatacaattctgtatccattaatctgttaacagaccctttggttgtttccgtatcttggctactgtgaataatgaacacacaatgaacatgggcctgcagatatctcttcaatggactgacttcatttcctttgtatatttatatctccagaagaaggactgctaaatcatacagtagttctatttctaattattttagaaactgcc

SEQ ID NO: 476574 - DNA, 937 bp, Homo sapiens
aaacttcagcctagatttcagatgatgtatagaaacgtctggatgtctaggccaaagtgtgctgcagggtcagaaccctcatggagaacctttgctagggcagtgcagaagggaaatgtggggctggagcccccacacagagtccccactggggcactgcctagtggagctgtgagaagaggaccactgttctccagaccccagaatgatagatccactgagaacttgcattgtacaccaggaaaagccacagacactcaatgccagcccatgaaagaagccaggagaagggctgtaccctgcaaaaccacagggacagagatgcccaagtccatgggaacacacctcttgcatcgatgtgatctggatgtgagacatggagtcaaaggagatcattttgtagctttaagatttgactgccatgctggatcttggacttgcatggaatatttcatatcaggtagatcctgtcactagtatcacacttgctataaagcatattatagtctttctcttctgcaaattttgctcatgctgttgttatgtgtcttatgatggaaagacttccaaagggggaaagcagttttcttcatgtcaaatataataaacccaaaccagcgccgctttgtagtttccagtgcttcaggttgtaaatgccttatgttagatttgttgctaagtggctcatacttttgttgcttctgtaagtgaatgttaatttcaattaccaatcatacctagtatatggaaatgtattttatatttttatattcaccttgtattctgtaaacttgctaaattcacatattagttccagttggatttttgtagattctctaagttttaatacagattattatgtcacctgtgaataataagtgttttactttgtcattttcaatttagatgccttttatttccttgtgctgacttaatc

SEQ ID NO: 476575 - DNA, 464 bp, Homo sapiens
accagagcacctggcacgcagtggatgatggatacctttctgctgaatgagttaatacatacatacatacatacatacgtttccccagtggttctcaaagtggggttcctggcccagcagcagcatcccgctaggaacttcttagaaatgcaaagagaaagtgtgctgatttttgtgacccaattagaaatacgcggaaatagtcaaaaatcatttggacagtcagtgaacccaagggtctttacaccatcacaagatcccacagcaggctgtctgcaagctgaagatcaaggagagccagttcaagtcccaaaactgaggaacttggaatccgatgttccagggcaggaagcatccagcagggagaaaggtataggctgggagggtaggcctgtctctctttttcatgtttttctgcctgctttatattcactggaagctgattagattgtgtctaccagatt

SEQ ID NO: 476576 - DNA, 1274 bp, Homo sapiens
actgtgttcttattttctgagatcaatgttttcgatgttttaccattatgtaggatatttgctgtactcatttgatagatatcatttgccagagttacccataggggtgtctgcaggcctttttgacatttgcaatgatatctttacaccacaagcagagaaaaagccaaaacaaaaacctcagtgtagaaataaactcactcacggatcaggaacctggaaagttaaaggaggggatcgaacagcatctggaatcactgtgggtctggctgttgccctattccaacatgacacagttactatatctaatcaacacagcagtggggcttgccaaaaacctataaaactaatggatttgcaagaaaattacatcaccttcaaatcaatgctggtaacacaggtggcatttataaaaagtaaagaaattgacattaacacagcctgtctctgctgcctgccaatgaatactccagctttgctaaagaaagatcttctctcttccaagaaaagaattatatttaaatgcctgaacttaaatctttctaaaatagcatagtagaaagaaccagtgactgttgtaaatttgatgccaatcaatagattgaggatatgtgggtataaatattatacggatatccctgtcctgcaatgggtaaatactctttagagtccatgattttttttcctataaaaattaattaattaattaaggaattcactatttaattcaaacaacactcacccctcactgaagaagcctacagaaattgcattgcacaatataatgaaaaagcagctgaagactttttaacctgtggctgctgcatgcataacctctgctctggggacctgcattacttggcagatggaattaaaatcctgataagtgatataaaaggtttgtaagggaggaaattggtgtgtggtcacattgtctgccttaatccccttcactttgcactacccggcttgttgttaaaaccaatccgtgaggaatcattttcaccttgaaaactgcagatgtgcacgtgaagcctagaagaaagctctctggaaaatgctttcctgagtaagcctggagaaagaggaagtatgtgttgaaagcacacatacacacatgtatacacatgcgagagtctgtgcttatacctcaccatcataaaacagctatgtgaaattagcatatttccagggaagaggtatcatgtgccatgaatttaatcagctacaaatctactcaagcatagaaatggctcatctgccactgactgaac

SEQ ID NO: 476577 - DNA, 646 bp, Homo sapiens
acagctcattgagaacgggccatgatgacaatggcagttttgtggaatagaaaggggggaaaggtggggaaaagattgagaaatcggatgggaaaagcagagctgtacgttttcaatgtgttgaagtgtgtgttatttggggaagtggctgcagaggtggaacatggatttccatttcttttggcttcctttttacaattgatcatatttccttggaatgcttctccccttttctcaattggtgactctttttcactttttaaaaagtcaactaaggtgcaactttctgtaggaaatcctaatcctatgtcacagtcaaaagaaagactatgggtcacggtggaaggaagaaatggcgaggcggctttatatatctgtgtgtgggaggaagctctttccattaataagcaggcctttaatctcctgagcccatttccccagcagtcaattcacctagaaaaataaaatgtcatttaattggcagaaaaattgcttaaattctgtgtgacaaactcaaagaaatacattctgtacatggaaaagcaaagagaaaaggatacaaattaaatgttaattataaaggtgattaaaatgtaataatatacaaaattcagctagttccttagtaactgacacaaaattatat

SEQ ID NO: 476578 - DNA, 707 bp, Homo sapiens
ccgcgcctggagtgcagtacacctggcacccgggactcgccatctgctcccagctaccgcctctcgggccaggggtgtgggcctggagaaagataagagtaccgcgtgggagtggatggcctggcgtcaaccgcctcaatgaactcagtcaatcaacgtttatggtgctcctactgtgtgccgagcgcatcctcggtcccctccagctgctgggctgggaaactgcaccatctgttcataggcctaagaaatgagatagaaagtaacacgagaatactggggaacttcagtactccactgacagcactagacaggtcatcaagacagaaagtcaacaaggaaacactggatttaaactataccctgaaacaaacggacttaacagatatttacagaacattctacccaacaacagcagaatattcattctattcatcagtgcatggaactttctctaagatagatcatatgataggccacaaaacaagcctcaataaatttaagaaaattgaaattatatcaagcactctctcagaccacagtggaataaaactagaaatcaactccgaaaggaaccttcaaagccatgcaaatacatggaaattaagtaacctgctgctgaatgatcactgggtcaaaaataaaatcaagatggaaattaaaaaattcttctaactgaatgacaatagtaatacaatctattaaaa

SEQ ID NO: 476579 - DNA, 582 bp, Homo sapiens
ctgccagcacgctgtcacctctcagtaacatagacacaggatgtattgaaactatggaaaagacaaaaaaagtagttaaacgtgtggattcatgtgatgactacgaattgttaagaagcatagtggtcagcattgttgtgaggttaaaacccaaaaatatgtatggtcaccttatccatggtcaagaaaatgttaaaccattctcagctagtgctggctggtttgcatgtttcaaaaagcaatgctacatggaaaatgttaaactggcaggcaaggcaattaaaaaacatttgccaactgtcatacagaaaaagggttatgtacaacagcaggttttcaaaggcgctggtgttggatggtggtgtattatgaatgcactgccttacctgctgaacatctctgcatccagaaatttacttagagataaagagaaaaccaaaagtattgtgaagaggcttccgagaaagagtgaagatggaaagaccaagcacttgtcatgatcaatgtaataatcttgttatgatcaatatgtctacatgattaactcaggtgactatggctcaggtttgctggaatctcagt

SEQ ID NO: 476580 - DNA, 741 bp, Homo sapiens
caaataacaacaataaaacttcgaatactatgttgaataggagtggtgagagaggacatccttgtctttgccggttttcaaagggaatgcttccagcttttgccattcattatgatattggctatggtcaggtccctctgctgcaggtctgctggagtttgttggaggtccactccagaccctgtttgcctgggtatcaccagcggaggctgcagaacaggaaagactgctgcatggtccttcctctggaagctttgtcccagaggggcaccggcctgatgctagccagagttcttctgtatgaggtagctcagagctcgagcgctgtgctggaagaatcctccttgtcaggacctgctgctgtcttcagagctggcaggcaggaaggtttaattccactgaagctgagtccacagcctccccttcccccaggtgctctgtcccagagagatgggagttttatctctaagcccctgactggggctgctgtgtttctttcagacatgccctgcctagagaggaggaatctagagaggcagtctggccgcagccactttgctgcactgtgttgagctccacccagtctgaacttcccggcctccttagcattgtcaggggaaaaccgcctactcaagcctcagtaatggctgacgccccttccccccgaccaagatgggtcatctcaggttgacttcagactgctgtgctggcattttagggtacatgtgcacattgtgcagg

SEQ ID NO: 476581 - DNA, 536 bp, Homo sapiens
tgcctgctgccacataagacatgactttgctcctcctcgccttctgccatgattgtgaggcctctccagccatgtgaaactctgtatcgtcaagacacttttgcttacgccaccagctccaactaccgcaagtttatattcagtcattttcagcaggtctgggagccgctgagcctctggccctgccgccgccttcagtgcctgcgccacggagctcccagtccgaaatggcggaggccgggagtactggcccagcttcatctaaaccagtatttgtcttatatactttacgtgaatatgcttattctcaagatagagctcaactatctattaaaagaggacaaatttttggataatgggtataatctctacccccatcaagaaaagcccgattcttggaattataatcagaatataaatactggctctgcaaagaaattaaatgggtcatagagacgtaacggaatgttaaactctttcttcatgcctacaaccatcgttaaaagtaggtactgactgttgttagaagggcatac

SEQ ID NO: 476582 - DNA, 843 bp, Homo sapiens
ctttcgtgttctgcaatttaacatgatgtgcctaggtgtaatttctgtgggtgtgtttatcctgcttattattctcagagcttcctgcatctgctataattcttatccttgttcctctagacacaagggagtctttctggttctttgctctgaggacctggtgggtttcctggagattttgtcctacaacctccgtatcctgttggggccaaaacgagtttttgattttcaacttttagctttttctaatggtgccgacatccataaatttgaagatacatttgcaagtagtaagagaagtaccaacacttatcacagtcttatccaactggcctggggttctcccactggcacagcaaagccaaatgctgacatggagatatcggtaaaaatgaggcatttattgctgggcaccaagcaaggggaaccaggcagttcatgcttcagacctgtattcccaggtagcttacagaaggttctgaactgcccatattcaatgcctgaaaacaattgcctcatatgctttgtccagttttatcgtttttcacactgggagaacaagtcttttaccagttgctacatcctggagagatgaagtcaataaacactttaagcattttaagggaatcagtgctgtaattgtaaatggaaactccagaagaaagcaaccaaacttctatgagcatccgttgtaagcacattttgtaaaatagctcagtgtctgctggacttttgtattactacaaaacaatattccgtttccttaaaaatacttcatttatctaaaaactaaatttataattaaaattcacctttacctcaaagacttaaagctcaaagttt

SEQ ID NO: 476583 - DNA, 499 bp, Homo sapiens
ccactactgccaccatgagcacaccttgttctctcccagccttgctgccattaccagcatgaatgcatgcacacacacggagaccagaggcccgtcgccaccctgtaccaccattgctgccagtgcagacatgcaaatggacagcaacagcccagcccctcaactctgcaccaccaccaccaccattggggtgaatgcatgcatggaggccaccaatgacccatgttttgcactgacactgctgctggtgcaaatgcacacatggatgccagcagccctgccttcctatgctgccaccaatgcctctcaggtgagtgagcagcccaccccgctgctgctgctgctgctgctggcacgtgtgaaagagcatggatcctgttgctaccacacaatgaagcacttcagctggcactacacatcagagggttgtggccaatggtcgaggaacactttggcccctctagcacagcaggttcctaaactcaagggaacttgagaa

SEQ ID NO: 476584 - DNA, 616 bp, Homo sapiens
aggagtgtgccagtcatctgggtccctcactaatgcaaacatcctcaatgcagaaatctgaaactacgggactttatcggaatccaagcaggcacaggatgtacaattgtgccttctccccttcctccagacttgaagtgaccccatgctgcatctttcatttgcacctggatgtcatccaggggaaaactcctgacaacctctggaaggtctggtccatcccaaccctgaagccgctctgcttcacagctctgcccagccactatctggaccttcactcaggacagcatcagtcttcaggccatgctgaccctataactcgaagaggcacatatctagctctctgggggtggtctgttgaagcttctgcagggcttgaagatgggacaggcacccctcactcctcctccctggaggtggtttgggcaacagtgtttcaaagaagagcattgcagacatgaaggcaaaagtgagtaaatacataggagaggatttttattgtacagatgggagaaggaacagatgcttgaaaggaggagggtagcctttcacaagtgaaatatgaaaatgaacaaatcttagataaataaactttgtgcagtatacttagtctgtg

SEQ ID NO: 476585 - DNA, 1412 bp, Homo sapiens
agacggtgaggtttctgagtcttgggtatgtctttatcagcagcatgaaaacggactcatacagtaaattggtacaggagagtggggcactgctgaaaagatacccaaaaatgtgggagccattttggaactgggtagcaggcagagtttggaacagattggagggctcagaagaagatagaaaaatgtgtgaaagtttggaactccctagagaattgttgaatggctttgaccaaaatgctgataatgatatggacaatgaaatccaggctgaggtggtctcagatggtgatatggaacttgctgggaactggagcaaagaaaatttgcagcctgacaatgcgatagaaaagaaaatcccattttctgagaagaaattcaagccagctgcagaaatttgcataagtaatgagtcaaatgttaatccccaagacaatggggaaaatgtctccagggtatgtcagaggtcttcacagcagcctctcccatcacaggcctggaggcctaggaggaaaaagtggttttgtgggctggacccagtatccccatgctgtgtgcagccgaaggacttggtgccctgtgtcccagctgtgccagctgtggctgaaagggacaaatgtatagcttgggctgtatcttcagagggtgcaagccccaagccttggcagcctccacatggtgttgagcctgcaagtgcacagaagtcaagaactagggtttgggaacttccacctagatttcagaagatgtatggaaatgcctggatgccttggctgaagtatgctgcaggggtgcagctctcatggacaacctctgctagggcagtgtggaaggaaaatgtgggatgggagcccccacacagagtccctactggggcattgcctaagggagctgtgaaaagagggacaccatcctccagaccccaggatggtagatccaactacagcttgcactgtgtgcctggaaaagccacagacactcaatgccagcatgtgaaagcagccaggagggaggttgtattttgcaaagccacaggtgtggagctatccaagaccatgggaaccaacctcttgcatcagcgtgacctggatgtgagaaatggagtgaaaggagatcattctgcagctttaagatttgactgccctgctagatttaggacttgcatggggcctataggccctttgttttggccaacttctcccatttggaatgactgtatctacccaatgcctgtactcccattgtatttaggaagtaactaacttgtttttgattttacaggctcataagtggataggacttgccttgtcttggatgagactttgaatgtgaacttttgagttaatcctgaaatgagttaagattttgggggattgttgggaaggtatgatttgttttgaaatgtgaggaca

SEQ ID NO: 476586 - DNA, 527 bp, Homo sapiens
tgagaggatgaagctctgagaatcccagggaggagagtgaggtcaggatggccactagaagaaggcagcagctgctgcctccttctccctgcctgcccactcgccaaggatttttcaagcctcatgtccttcagcatcaggctgaagctgcgagttccatcctcagactgctgggaaacttgcttagggtcacagagttagaaatggccttgccaggtcgcaaacagagacctggtcctgaagctgtctgtgtggtcctgcctggcagaccccaggttttctgtggcttgctgccctgtgagggcccatggaagccctccccggaggggctggtggagagagttctgaattcctgggctctgggatgtgaagggagcggactgcaggtgaggggctgtcagattccaaaatgctgcctgcataaatgttattgaatgagtgattcattctgggagtgtggggtttcggtgactctgagtccctgtcctccaaacatttacacactgcacctccatgtgggcagggag

SEQ ID NO: 476587 - DNA, 823 bp, Homo sapiens
tatgtgtgcatatatatatgcacactgaaactaaagatgagtccttaaaagtggaagacaatgaaagtagagtgggtcagagtgacgcaatgtgtgaaggattcaagccactgttgtttgaagatggaaatctggtggaaggctgtgggcagagcctggaggtggctctcaagagaatttggtggaagtctgtggaggaagatcctggatgtggctctcgtaagaatttggtggaaggctgtggggagagcctggaagtggcctctcatgagaatctggtggaaggctgtggggagagcctggaagtgtcctgggagcttggcacatatggaacacatcagttggactcctttgctggcttccggtcctgctcctgttcatctcatgatgctcagagagatgtgggaagcaaggcatccttacttggcctcaaacgaccttcaaattctcctgctcctgccgtgaccatgaccaccgcctcctgctttccagaacatcctccgactccagcctttgtgtggctgctcacatccctcctcccaccagaagcagtggttgctgtcctcacctcctgctggaattgtactcagccttccgggggagatgctcaaaatatcacgataccatggatactgagcaaacacaaagcagcttggagcaggagtggggtttaaagcctgaaggctcccaagctgtgcctggtgttcaccctttagttgctagacagtggaaaggtagggggagccccagaggaggggcctttgtagtgaggagggaatctggacagcgaatattttctgattctgccgattcgtgtggccgc

SEQ ID NO: 476588 - DNA, 591 bp, Homo sapiens
taggcggcagctgcctgggaaagcaccatgtgttttcacaacggggttccaggttcgcaagagaaggactttctgctcttgcacctctctcccttatgggggggaaatatttctgggcagccccagcagacatcctactggatgacagggtctctcctggcattctcccctggcaaggggagtgtgtgggtgcctctgtttgggccattcctcagagcgactgtattgttccctgaacataatcaggctgccccgcaggatggtggtgggaatggctgtaatgtgtgcttcgaatcatgtgaactgaaacctgtggacttcccacagcccagcaggacccaccttcccaagcagcaaaccctggagcctcgagctgacacgtcagtccttgtgcttcgtgcacatttagaaggaacttcagacaaacttcattcacttcaaactctgtccccttggagcctcgagctgacatgtcagtccttgtgcttcgtgtagatttagaaggaacttcagacaaacttcattcacttcaaactctgtccccttggagcctcaagctgacacgtcagtctttgtgcttcgtgcagattt

SEQ ID NO: 476589 - DNA, 600 bp, Homo sapiens
gcagtgacagctcttaaaggtggaccctgacttcataagagaaacagcagcatatcctgaaagtttctgacacttcctgctcacaggcaccaaagctatatgtgtaaacttatccacttcttgccaaaggaaccctcccctgggaagatgaagcttcttggacgtgaccacctccaggaaccaacgggcgggcaacctttatgcatgtgtgaccagacctccaactataagcatggtgcatggtgtaagctgttggtggatctagcattttggggtctggaggatggtggccctcttctcacagctccactaggcagtgccccaggtgagatgcagcccccactggacaggaaaacaccagacagttttaaaaaggaaaaaccaaggagtcccaagtcactgacccctgcagcgtgggagcagcatgagccatctgcagtgacattgtctcctccggcagcagcctccatccagaaatccatctcagggtctgtcctcacaggaacctgatgccagagctgtgcactgaaaggatttggacacaggtattttgtggaactgagcattttccaggtcttgctggaggtcattctgtgtgaa

SEQ ID NO: 476590 - DNA, 1020 bp, Homo sapiens
gcccagagaaggggaggagcctgctctgtcacttctcccaagatgatttatgacctgttcagaaagcgcaaagtcatctcctttggaggctgcatcgctcaaatcttcttcatccacgtcattggtggtgtggagatggtgctgctcatagccatggcctttgacagatatgtggccctatgtaagcccctccactatctgaccattatgagcccaagaatgtgcctttcatttctggctgttgcctggacccttggtgtcagtcactccctgttccaactggcatttcttgttaatttagccttctgtggccctaatgtgttggacagcttctactgtgaccttcctcggcttctcagactagcctgtaccgacacctacagattgcagttcatggtcactgttaacagtgggtttatctgtgtgggtactttcttcatacttctaatctcctacatcttcatcctgtttactgtttggaaacattcctcaggtggttcatccaaggccctttccactctttcagctcacagcacagtggtccttttgttctttggtccacccatgtttgtgtatacatggccacaccctaattcacagatggacaagtttctggctatttttgatgcagttctcactccttttctgaatccagttgtctatacattcaggaataaggagatgaaggcagcaataaagagagtatgcaaacagctagtgatttacaagaagatctcataaatgatacaataagcccttctcgttaaacatgatatggctttatgtttctttctttgatattttagattcaggaactatgagacattatgtattgatttgaatgttattagacctgtaacataattcttatctgatgaatatatgatgaatatattccttgttcaaaatgagtcataaattcaacacatctctacatctatattatgcccatttaatttctttcagcaatgttttgtagtttttggtgaacagtctctgatatctttcttccgcttgacc

SEQ ID NO: 476591 - DNA, 777 bp, Homo sapiens
tgggggacctgtagatgggcttgccaggtccagccccacccagtgttttctcgggagacacatcgcctctgcctcccactgtcccagactgtctgcgggctgatgtcagggttcctccttctgagagccaaaaatgttccttctatttagcagacaagaatatcacccacggcttcctctatcctcctgaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctataaatgagaatgtagccattagtccaagtgactttcattattccacaagtttttacatgcactcataagatattactttttaaagtttacacaaccaactttttttaagcaactctgaaagtaggcacagatgcagcaagtaaggttcagagaatttagaatattgtttttagtctagtgtatcgtccccctctgtgcagagtatgggatggccaatagggtgaaaccaactggatttaaggctctttctgaaaacttttctttctgggacctgaactattcccataggagaggtga

SEQ ID NO: 476592 - DNA, 3281 bp, Homo sapiens; identical to SEQ ID NO: 465154

SEQ ID NO: 476593 - DNA, 724 bp, Homo sapiens
tggaatcaacccgagtgaatggaatggaatcaaccgaatggaatggaatggaatggaaaggaatgaatggaatggaatggaatggaatggaatggaatggaatggaatcaacccgagtggaatggaatggactggaatggaatagaatggaatggaatggaatggaatggaatgcaacggaatcaacccgagtagaatggaatggaaaggaatggaatgaaatggaatggaaaggaatggaatggaatcaacccgaatggaatggaatggaatggaaaggaacgaatggaatggaatgcaatggaatggaatggaatggaatggaatggaatggaatggaatggaaaggaatggaatggaatggaatggtatggaatcaacccgagtggaatggaatggactggaatggaatagtatggatggaatggaatggaaaggaatcaacccgaagtgtatggaatggaatggaatggaatggaatggaatggaatggaatcaaaccgagtggaatgcaatggaatgaaatggaatggaatggaatggaatggaatggaatggaatggaatggaacggaacggaacagaattgaatggaatggaatcaacccaagtggaaaggaatggaatggaatggaatggaatggaatggaatggaatggaatggaatggaatggaatggattggtatggaatggaatagcatgcaatcaactttggtggaatgtt

SEQ ID NO: 476594 - DNA, 2019 bp, Homo sapiens
acatgaaaccagaggcgatggggttgttgtaagtgatccgatggcactcataaccctccagagagtaatagccacgatcaattacatggtcgacttgctgggcgtaatgggaggaatctacccaggacagaccaacccccaccaggtcctgcatgccgaaagatgcagaccccccttggcctttgggctacgagggcaagtaaaaccacacgcgaatgctacagcccccatgttctgtccactgagaggaactgggagcagtgacactcctgctgcaatgagcactccaaatgcccaaatttggcttctaaatattattctccacaacaacgagctacggctttttggagaaatggctgataccaggactggagaagagaaagtaaaggagcttagaatcagagaagtccctgtgaaaaccaccttagaagtatttctttaccttggaaaatccatgttgtttatcctctttggaagtgagaacaatgattattcagagctttttatccttctgctcaatgccggctaaagtattccccctttaagtctttgcatgcagtagaaggtggtcttcaaaggaagcatcgtctgctgaagacacttccaggaagaaggaagattgtttttaccaaggaaaatcagcttgaaatgttttaaaaatatgcagaatgtctgggagttcttccaatacgcttatgtttaagtcatttggaatcagagcctactcttctccagtttggcatcatcttaactaattacatctgccaagactctatttctaaataaagtcacattcacaggtacttgggttgagaacctcagcatatctttctgggggacacaatgcaaatccaaaacaccagctctgttaagatacaattcacatattatatcatttatccacttaaagtgtacaattcaatggctaattccaaaaatacctcccctggacattgagttgaggcaaacttggtgtctgtagcagctgccattgtccagtggacgaccttcctttgctttaagatgtaatatcttagacttgaggcgctgtactagacactggacatggcaaggaggatacaagagcacatgatatgtaggccttgtttctgtgaaattccaacttggttatcagcagtgttagtgggctgtcaggttagcttcaccctccagctatatatatatgtgtgtgtgtatatatatgtatgtgtatatatgtatatatgtatatacacacacacatacatatatgtatatatgtatacatgtatatacacacatacatatatgtatacatacatatatgtatatatgtatctatatttacacacatacacatatgtatatatatgtacacatacacatatgtatatatatgtacacatacacatatgtatatatatgtacacatacacatatgtatatatatgtacacatacacatatgtatatatgtacacatacacatatgtatatatgtacacatacacatatgtatatatgtacacatacatatatgtatatatatgtacacacatgtgtatatgtacacacacatgtgtatatgtacacgtacacacatgtgtatatgtacacgtacacacatgtgtatatgtacacgtacacacatgtgtatatgtacacgtacacacatgtgtatatgtacacgtacacacatgtgtatatgtacacgtacacacatgtgtatatgtacacgtacacacatgtgtatatgtacacgtacatatatgtgtatatgtatacacacgtacatatatgtatatatattttatatataaaaatacatatgagaaatatatattttttgagatagagtctcactctatcacccaggctgaagtgcagtgattctgggagaattttgttctcgtcatagtgagttagctgacttgcgtgattcatatagaaaaaaactcactctgaatttaacgtgataggcttgttaaatgacaacaaagtggtcaccaaaagtgctgtgctgtaacttaaccagagtaaa

SEQ ID NO: 476595 - DNA, 538 bp, Homo sapiens
ggattggtttgcccagaacaaagctgagctctcatgttgcatacccagaccttgtatgcccttccgtgactccaattacaagtcaacgtcttcatcaccaagaacagatttcccaaatggccctcttaaccccataaatcacaaccagagctacagagcccagatttctgaaactctcattctgggagtggctgaattacaatataaattgaattctcagcctcacggaacatcttctgttcaagtgagagcattgattgggaagaatctggatcctgaatattggaatggtaccaatgggcagatcctgatgaaagcctatcccaccatctttttagcttctatatccataactagactgaagtcccagcctcaaaaggtgaggtacaaagtgacacatgagacagggtactgtgctccaaaagaactaaatgacttttccaatttatacaaacagaaatcccaggaatgtgtatggggatggatattaagagcatgagatagtgaagcaagaaacaccaagttgaatgaagtcaaa

SEQ ID NO: 476596 - DNA, 587 bp, Homo sapiens
cagctgcacacgtggaaagagagaatgctcgagcagaccccgtggtgctggactggaattgaaggtattggtaaagatctagagctccttggggaagtggccaaatccaggactggaacagggaagccaaagatgagactggaacattctattgtgctagcatgtgagaaagtgccatcatcacagaatggtggggacatgccagatggacacagaagccaatctgggggaaccctgactggccggacctgggacaatatgataaaaaaaaagaaggaagaagacaagaagtgggacatggaaatcaggattaaggcaaaacagtgcagcaaagccagccaggcattcaggaacagcgactttgttaagatctaccttaatctcctagttggctctgatccactgggacatttattccggctttattatgtggccatgtgactgtgggagcttaagggctgttttgtttgcgttaagtcctagttaccatctgtgggcttccagatccatgaagatttctgtggggggaaactgttatatttacctccttagtgagaaatacaaaatgatttaaacatcccctttgg

SEQ ID NO: 476597 - DNA, 781 bp, Homo sapiens
cgggtgtttcaaaggatgtgtcatcatccagactgccaaagcctggagctaccggaactgccacgtgttttgatttctgcccagggccattctctccacataacagcacagtccttgcactgatatttcctgtttctgctgaactggggatgagggagggaatctgttctcctggtgtggccagggtgagaaagtgttgatggtggatgctcacaggagtgggagccagacagaaagcccccaggaagagcgcagccagtgctgcccttcctcctcctcctccccctcctcctccccctcctccgaccccctcctccccctccccccctcctcctcaggactgcggtctccctccaggcctcccactggaagatacttccccattcgctgggaactcactgacaaagcagaaatgtagaaacgtggctcgcagaatcccagacccagcatcagggaagagactgaccaaaggtggacgaagaaactgtccccagtggcaggtcctgaaccacccagtcagctcttcctattgtctcgcatctggtgtctgcaacactgaaattaggggtgtcgaggaccaacctggaggttcagaagtaaaacttcccaccaaggtggccctcacagtccctcagctggtcacgacttcagaagacttcttcctgacccttgccccgaccttcctttactgagagcatttactttagagaagtcataattgtaagttatttctcttcccttttgagatgtgaatcttttcaaaagtcctcttgccagttct

SEQ ID NO: 476598 - DNA, 626 bp, Homo sapiens
gacaagcagcagagcaggacgcagtcactgttaccagcacctgatggttttctcccttgcttgctttctttccactctattaatttgtttggatctctgtgtcttgactggcttcaaggaaagctttgaaaacatcaaaacagaactctgtctgaaaatgttcttacagcactgtctccaaaacattcatgccttaagtgatgaatacctaaacatctctcagtcagaatggctttctttcctctcttccctgatatgcataacaatgactaagtgtggacttctgatttctttttcacacaatggtagcccatgcagtgaccctcatacttctacaaacttaggacactcttggaacgtggtgtctgtggcctgcttgtcccagcagcatgacctgcggctgggcgaaccgtcatggcaagtgacctgctgtgtcatcccatcactcgttataaaacaatgcccagtgaagtaatgtctcacctggcatagtttcccatcctctgttacctgtagagggtccaaggtatttgggggcctaacataaaataaagtgtgatcacaaggtgacacatgcaactttatttaagtgatgctttcatgggttcacatgaaaaggaaggaag

SEQ ID NO: 476599 - DNA, 734 bp, Homo sapiens
tttgcttcaaactgggagaaattcgaagatacatccgcactccaggcagaactggctggagccacatctttcttccctgcctctgcctttgttttagccttgtatgtacaattatattgttatgcagacgactggtcgttttgctgaaatttttataatcatctcttattccaatgaagctcaccccccgttagacacacaattccctgtgttgctaattggttccttctggtgggttcttggtctcgctgacttcaagaacgaagccgtggaccctcgtggtgagctgttacagttcttaaagatggtgtgcccggagtttgttccttcagacgttcagatgtgtcccgagtttcttccttccagtgggttcgtggtttcatttacttcaggagtgaagccgcagacctttgcagtgagtgttacagcccttaaaggcagtgcatctggagttgtttgttcctccccgtgggttggtgggttcgtggtctcactgacttcaggaatgaagccacagaccctctgatcaggaagctgaggtctagagagttaatcacatacccactctcactgaatactaatagctatgtgaaataatgcataaaaagggctttcattagagtttatgatgcgtagcaaatgttcacaaagtattagccattattattaacaaaataatgaaagaaattaggaagggcttcatagagtatcagggcttaatgtgtacattaaaa

SEQ ID NO: 476600 - DNA, 625 bp, Homo sapiens
tctgtgcttgaatatccttggtctaatgtctgtctctagattttgcttctgtgaaagccaggccctggctttctgctgccgctttattttcaagagcccccagctaaaaaccaccaaatgttctttaatggatgtatggctaaacaaactggcacaaccataccatgaaatactattcagcaataaatgggagaagggcagagggaaggaagatctgccttgttactgcgtcttcactgaccaaggatgcggacgtggacacaaagtctgctccattatgtgtggacccctattcccagtattctttgtggaaagcactggacttgggatgcttgattactacaatccctctcccctactcatagatgtcttcttccacatgcacctctcattggccaaaatcaccagaaagccagttggcatgggagcctggaaaatggaatgtcctgaacacacagcaaataggggaagtggagaactgaaactctgtacccgctaaacagtagctccccattcccttctaccccagcccctggtaaccaccattctactttgtctctgattctaatgtaaatatctcatttcttcaaacatctctaagatggttatttaaaactttttgtct

SEQ ID NO: 476601 - DNA, 881 bp, Homo sapiens
aatcgggggatgctgtatccctgcctccatgttggggagatggagcctccagcagttggagaagaaggggacttcttaggagcccaggtctttgttgcatcaggagccatcctgctgtggggcagccagtgtttccaggccaggtcacttgatattgtggaatactccttgccctgtctcctgggtgcttgttgtgaaacactgctggaaatgtccagccttttccagagaagtggaagtggccagatgttcaaccagctgcaggaggccctgagaaacaaatttgtaagaaactttgtagaaaaccagttgcacattgatgtagacaaacttactgaaaaactccagacatacgaaaaatccattgctagcacaggagatgacagctctgcgtgtgttagtgccctgaagacctccttccagtgggacaagaggtggaggtggaaaaaagtgatattgatgataatgaccctgtgtaggcctaggctaatgtgtggttttgtgagttagtttttaacaaaaaatttaaaaagaaagaaaaaacctaaaaataaaaacaagctagctcatagaataaggatgtaaagaaaatatttttgtacagctgtacaatgtgttttgtattttaagctaagtatgattacaaaagggtcaaaaagtcaaaaaattaaaaagtttataaagtataaagttatagtaatctaaggttaatttatttttgaagaaaaatttaaaaaataaatttagtgtagcttaagtatacagtgtttataaagtgtataaagtttataaagtgtacggtaatgtcctaggccttcacattcactcactgctcactgcctcatcagagcaacttccagcctgcaagctttattggtgag

SEQ ID NO: 476602 - DNA, 743 bp, Homo sapiens
cgccatttgagaactctggcttgagctattttcttctcactgatttttccaatgagcgtgttttattcttctatgaattcagaggatctgggagcagggaaaccagtagaggagggaagcaagcatgagaggcagaggcagctgtcagtgggtactgatgctgccatgtccggggacaaatgcccacaggatggcagtggaagaattcatattcattttcaaatccatttgcacaatctccactatatgagtggagggctgctggatgagatgtttaaccatgcaggcgctggacgcttccgtttcttgggcagcatcttggtcaatctctcttcctgcgtggcactgaaccgtttccaggctctgcagtctgtcgacatcctggagactaaagcacatgaactcttgcagcagaacagcttcttggccagtatcattttcagcaattccttattcgacaagaacttcagatcagagtctgtcaaactgccaccccatgtctcatacacaatccggaccaatgtgttatacagcgtgcgaacagatgtggtaaaaaacccttcttggaagttccaccctcagaatctaccagctgatgggttcaaatataactacgtctttgccccactgcaagacatgatcgaaagagccatcattttggtgcagactgggcaggaagccctggaaccagcagcacagactcaggcggccccttacccctgccataccagcgacctgtgagt

SEQ ID NO: 476603 - DNA, 2188 bp, Homo sapiens
gtaggcttacttataccccatgatgtttcagaataacactctacagccacccatatggaggggccttgctgaacaaggacaagattcgataataaaagtgggtatttttgaaaaactttttatgacctaccaaattaagtcgcagaatgcaaatctgcttaatgggcattctctgctcaagttgttaatctggcaggaaccggcaggaagcaccggttgggttgcagcttgtcctcacgttcacttaatgattttcagggttctagctttaacagtgtctgacacctgccagaattccaagagtaggctagctgacatctgttgtagaatgcgacacgatggagcagaaggcatggcacagcagatgacttgtgctgaggagttccatcgtgtcggcctcctgaaagaccatctgtgcctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatgctcttttacttggtttccgtctgcctgtgtgttgccgttattgtcgccttccagttaacagcttttactttccgcaagaacttggcagccacggccctcctgctgtcacttttcggatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagagtgctttggacttctaggggtgaatggagctgggaagagcacgactttcaaaatgctgaatggtgaagtttctctaacttcaggacatgctatcatcaggactcccatgggccacccagcagagctaccaggctccaggatggtattggggagtgtctgcaaagagtcctgtgatgtgatccatcttcaggtctttcagccgtggataccagcacctgctcaggtggaggccctagggctctacaatcagcaggtggagaaaccagccatgtttgtgtcattcccttcaggggaggagcctctctcagtggccaccatcactactggctcacagggagttcttcaaggccaacgctgatgtccctttaaagcccaagaatcagcttgtgataaatgctgccaggcctgtgactcacccttcaaggcagtgggctcccttctggtccaagacaggtccagaaataatgtccaagagcctaggcttggactctgataccctaagagctcactcagatccctcagagatttgaggtcagaaagcaaactgctaccccagtactagagagacagtcaggggaccccctacacccatgggttcatatccatggattcaactaactgtgccacaaaatattcagaaaaaaagggatgattctgccggtactgaacatgtacagacttttcctgttgttagtattccctaaaaaatacagcataaccaccgtttatatagcatttacattgcattaggtattataagtcatctagaaatgatttaaagtatttgggaagatgtatgtaggttataagcaaattctacagtattttatataaaggacttgagcatctgtggatttttagtatccaaagggag

SEQ ID NO: 476604 - DNA, 475 bp, Homo sapiens
gttttgtaggccatgatgagggagagagaaggtgcccggaatgggacatggatagggtcccggaattggccttctccggaatcggaatctgagcgaggactccgggatccccagcctgaggacctccggcgtttccactccctggctccccgtcccacctgttgcctttgctatgcctaccctggttctttttcgtgctatggagacagcgtgggcaactccagcgcaagaagagggatgctccttctagagacagcaggtgtcctggaagagagatgtgaaacttcgggaaagatctggctgcagaacatcctggaattgtgtccgcataaacccagggtcattgcccccaccaaacgctgaatgccctgtgaggagccagaggagcccccatttagcgtgatggattcatattttaaaagtaaaaaagacagacacaaaatgactttgacaatcaatttttaaagctgttaac

SEQ ID NO: 476605 - DNA, 606 bp, Homo sapiens
ggtgatggtgatggaagggcttgtgcctggacacaaaagactcgatgtccaccctacccaagatctccacctggctcctcttggcacgtcttgccatcagcccctactgccattgtgtcactgtcatctacttgcctctccagaagcccttttttggctacctcaggagggtgatctgtgtgggctgcaccagtggcctctctgcactctggctgaagacggtgggccctaaatccaatgactgtgtcattagaagaggctacctgaagacacagggccatatgacaatggaggcagaggttggagtgatgcagctacaagccaaggaagggcaagggttgttggcagccaccaggtgcaaggagagaggtgtaggatggtttcagaaggaaccgaccctgctgacaccttggttgtggattgctggcttcctgaagatctgtctctgagtccacattgtgggagaaaagaccattcttcggaaagatgcagagtgagtgagtgtgatattgaggtgggaagtgcttcccctgcatctcttgtttctcttcttctgagtcccttgtcatctgatctgaattttctccctttttagggaagccccgt

SEQ ID NO: 476606 - DNA, 888 bp, Homo sapiens
gacaaattccctctacatctggcagcatcccctgagggcctctgactatgcagtattttctcccaggacgaagattcccaaatgtcaaagacagcatccggagaggctggtataacttcagatctaacctatttcagaggcagaggttaaagatagacaattcacctggatttttctcttcttactggggtatgggtgcagggctccccctgcggcttgccagctgccagcagatgacatctcctttcatgtttggggctgagcacagctttgaatctgcctacaccagcaggaggcggcccggggttaatggcatgacatccctgcggcagtctgcccgatgggcttctgatgccttttctaatttggttattatcctgccaactcccccggcgcccaagggagggagtcagcgtgttccaggagaaaaggaagcagggcctggcattctggatcgggtgcccctggggagcggggagggagctggggctggtgcaaataaaattgatgctattaatggatctgtttacacaggggaacaaggagagagagaaaatgacaaagccgaggatgaaggaatgagaagaaaaagaggaagaggaaagagagaatggaaagagggaaaggccacctgagctcaaggctccaacctgcaccaagctgggggatgggcaggaagagacacaagggtcgggaccccaggggcttaagagagggaacagaggacagccagctgcagaggagcccagtcctactgacggatgcacaaggaggccaatggcatcagagaagcccgaatgggttgcttggagccttttattaggcatccttcaagcccaagcactgcctcctctgggaagccctctcatactgcccccagcctgcttt

SEQ ID NO: 476607 - DNA, 2552 bp, Homo sapiens
agcacagtacctggcacacagtagttctctggaaatggttcctgacagtgcctgaggacaccttcaaaccttctctgctccgttgtagaactttttccagcaagggggagaggaaggacaaaaggctatgccttgggctccaaagtttaggagaggagccatggagatggacagagagaggcctaagggtcaagctgccaggccaccaggcagtgccaggtacgaggatgacaacacctagccaacccgcggagaaggcggctgcccgcggccctccggcggggctgcgcggtggcgcgcgcgggaagggcgcccgggactctccgccgcgccgggcacccgctcgccctgcccgggccgtggggctgcgcgccgctggcctccgggaagaacctgccattccccctgcagccgagtccgacagaggggccgccaagagccgccgggccgccgcactgccctccgccctcacccccggggcgcccgggcctcccagcgggggcagaacgcgaggctggggggctcccccgggtggtagcccagcgggcgggcgcccggccaaggccgccctgggcagggccttactggcgctgacagagcctcgcgcccgcggcccaattagcgcgcggcgcgagggacgcggcatctggaattgcgctgcgctcacggccaaggccgattgtttagtctgcgcggcggggcgggcggcccgcgcggtggccccacatctggagcctcggccagacggccctgctggcggctggccgggctaagtggtaaagcctggctgtgtgcccagacctgtccacctccaaagcagttgtcttgtaaagactgcctaggctgtccgtggctgatgctacaggaatggagcccagagaggactagggatggggagacttcctggaggaggtggggtttggcttggccttgaaagaccaggtgagaaaccaagatcagagagggtgagtgacttgtccaagtcacacagagttctcgtcagggccacagggccaggctccccgatgctctttccatgggatagtttccccagtgtatatgcccatcctgctaggagactggaagctctagagagcaaggaccaggacgtggcatctctgtctccactcaacaaacatgtgatgcctgcgtgttatttcacaggcatttgatccccaaggctggcagctttcggagggtccatgttatcaacttgcctccacagcacccagaccaagcaaaagtacaaatggagacccacattccatatgtctaaatatttaaaagttaaaaatcaagttaacaaactgtttaataaaatatgttctattcatacaccttctaaagatctggaaggctggatttgaatttagagttctcaggtttcttggagttctacacagggacacggagtggggagaaactccctctgctctcccccagccctgccctcagcctgcctcttcccttcccatccccaccttcaccttaaactagggcttcgagcatgtgtgtagatactccaatccgcacacacagctgctgactgcatgccccacactcaactcacagccaagacacaggctaccctctggaggttgaacctggggaggtggcctgcagaggtcttggatgcagggtacaggcccttagggcagggatttctagggccctgggcatctggagcatggttcaggagtgggggtggctccctccttctgaacagactcctaccctgtgaggagggccaaaggagggccctaagtttagggccccttgtctacaggcactggagctggaggtgggtcactctttcttccttctgctttctaatctctttgcctgatcagccaacatctgaacatcctggcaactttcctttctaaacagttctccaagccccatcacagcccctgtagtccaggccactctcatctatcaccaggtcaccacaacagcttcctaactggtcctccaggccccagtcctttgcccacccctccacagccagtgatctttgttgaacacaaactggatcatgatgcagccatgcttaacactcttccgtggctccctgctgcacacagaagacccaaattcaacttggccattgacgttggtgtccagcccctctcaagccctccagcctcagcctgccctactccctgcccctaaatgatgctctggcctatctacactgcccccaggtccctgcaagacatgaagtacacactgcagtgtgtgctgctcctctgccccactttctcacctcctgtctctacgaattccttcttcttgaagatttggcttcatggtcaaacctgcagcaatcctttcttgtcaacagcccactcccgcctccaggtctggcagggagtccccggcttgtgctctcatactagtatctacactctattataactatcactaatttaaccacttcttaataccctgaccattgccatctcttgcttgaactattgcagtggctccctaactactctccctgcttccactcttgccccttcctctaggctgtcctccaccagcag

SEQ ID NO: 476608 - DNA, 620 bp, Homo sapiens
cactgccacacccggacctgccacaacctcttggagtcagtgacaagaaccaaacgcaccccagcctccacccctcccctttcctgcttttattattttcttttccataaagattagtctgtgttgctcctctatcaaggcctggaggataaacatgtggtccggaggcagagaaaccccaggcctgaaggccccactgcccccaccccagcagcataaacccagggcttttaagcaaggaatggttttcagtaaatctctcctatcagcagaaacctttgaaagagtttgtttaaaggccagggagataaacagcaaggagaagtgtttgtttaagatgtatgttctgtgtggccactctggggcccggatttacatctctggggagaggaaccactcggaggccagggtgggggccttccaggggcaccttgggctcccggtgtggacttcagcccaggcagggacccatgagctcaggggagggaagttagctggactgcactcacaggcctctccaggcttggggcaagaaagcaggggctgaaaggagctgcaggaagggaagaagccctgtaaaggaggggaggggtgcctggaaggacctgctggttggaatg

SEQ ID NO: 476609 - DNA, 750 bp, Homo sapiens
cttaggcctatgatccattttaagttaatttttgcgtatgtacctgggcagggacctaatctacactggctcccccagaacagtccttggaacagggatgaccccagccctgccccctgctgtggctgtccatctttcctggggcagttcttgctagcagagtattctctcattcctggagctgggaatgctctttctgttatgtctgcttctcggtcttacccctacctgctggaggctgaacataagccgcactctactcaagctccaggaggaaatgtgccccgcacccagaaagaagcagacccggagatggcagggattgtgaactggacggtggctacggcctgggggaaagcggtgaaaccagggccagccccaaggacgactaagctgttttccagctcggtcaacaagtggagtcccgctgccccctgctcagccctgggattgtgtgcagcagttggcctgaaaaccccagagaccagccccagcccccacaaccggaccatcaccctggggagcagggatcagggccacctgggcaaagacagggagatgtggtgtgagtgtgtgtgtggtgcgggtgatggaatgcatgagcctgcggaatgtatgtgagtacgtgactgtatggaaagtctgtgtgagtgtatgtgtgtgtgcatacaggtgtgaagtgtgtgtgtgtgtgagtgtgtgagtgtgtgtgtgtgtgtgtgtgtgtgtgtgtgctggggggctggctaa

SEQ ID NO: 476610 - DNA, 676 bp, Homo sapiens
caggccctgtgctacgtgctttatatgaattatcccagccctggagaccaggcctggatccctggaaagggacctggacagatcacagtgacagccgccctcgtggagcacctgcttggcaaagaaggcactgctctgagtacttttcatgcatttgctcatccaatccccacaacaagcctatggagagggtcccagtttccaacactgtgggacccgggaaattctgcaggaggctgccgggccaggggagagcagcttggctttggagaaggcctgcttggacctggctccacccctcactcgcagtgtgaacctcctgggtatatttctcaattttgtggagccggtctcctcaacgtggaagacgcctggaggaagaaactcagcgctctggaacacctgctttactcctcatctgggccaggggtttgaaggaggagggctgcaaaggccaggatccaaggcgctcagtgatcatttgtgtcacgattatggaagggcagctagcttcaggccagggcggcttccactgggctgtgtgcccttcctggtcgctcagctccaggagctggcaatctagctggaaaccatcagccaacaccacagggatatggggacatctgtgtttttgtctccctcgaattcatccagcttttggtaacatggaattact

SEQ ID NO: 476611 - DNA, 2498 bp, Homo sapiens
cctctgacgtttgtctcagaagtgagtctgtgagactggcgctatgccagaccccagcttccacgcacgcacgtcccaggctgccctttcccaaccgcagcgtggctcttgtgcttattttagcctgatgaagcctcttgaaatgtcagagctgcaaccaaccaagctagggaccatccagttgaatcctttcattcaaccagggagaaaatggggattcagagagggagtgagagatgcgcttcaggtcacacagctaattggttgtgcagccagaaatgaactgcaggcttccggagcccagatccagctgtccttaactctagggggcaatgtgcttcagaccctcaaggccaccaaccttgagcaggcagcaaagggtggcatggagtctctggctgccaattcctcattcaattattccacagatgtttactatctgcctggtcggtgctggggcctgggcaaggcccttgggctccagaaaggcgagacgcagttctgtccttcaggccacaaggtctagtgggggaagcagtggcagtccagaataagagcagcagctgctggggcacagtataccctgagagagctagagctggggatcacggggcacgtatacggatttttgacattgacactatactgaacatactcttagcattcgtatttttcagcaataacttcccaccttaataaacagtcatgcacaatacgatttttcaaggccacatcgtatcacaccacatgggtgctgtaatttatctagccctccctctgctgctggatatttagttttttcagaggcatcactgaggagggcttattttccttgcacaatgagatgcacaaaggtggcagcaggctaccgctgatgttacagccgtgtgtgctgccatccacagcccaggctccctctagctttctgcccctcccgcctgaatttgtggcttcctcgttcttgctcagagaacggctgttggacttccagccatcacatccacgttgcaggcaagaaaagtggggagagagaagagcagagcatgctgcctgctgaaaactcccccctttaagcaagaaaaccatacagttgatcctgcaaggacatgctccccactcaccagggcccccttccctcccccagcaccaccacacccctccttggcacaaccagggatgggaagcccaggagtacagcctgggcctgccacctccatgtctcagggggcaagaccctccctagagctgcccacaggccccctccaccaggcctcaggcctggagaaagaaacatggccagggccatgtctaggcccaccctagttgcaaaggagcccagaaagtctagcctttgctgggcacactgctgctgccctgaagagagctggaattgtattaggaaggagggtggggaggaaaagcaggcacctaacaccgtctgccaccttgatcctatagcacaacaaactgaatgccttattgtggatacgcagcctgggaggcagtgggtcccccaggcacagattatcccaatagaggttagctgatgactttgccagaaatgtcttggcgaggattcaaacaaaagaaggaaatcaagaggctccacagctctttttggccttagggctttgggggaagagtcccacacccttaattaggttattctataacttgagtttaacggagaaagtatgatgaattggaagtcacaggttctaacctcactctacctctcactgtgcaacctgtagcaaattcttaaattttctgagcctcagattcctctgctataaaatgggaataaagtaacttacaattatttgtgattaatatgtgctggacactatgtgaattatttacatgaattatcttacttaattctgacagctctatgagatggttgttactatttcccccattttacagacaaaaaactatggcacaaaaagggttaacagtgaaacaatgctcttccccacccccctcaagcattattgatgtatagttgacagataaaattgtatatttttaaagtgtccaatgtgatgatttgatatatgtatatattgtggcatgattcccgccatcagagctgacagttgtaaggaaaggaagggcagctcagggaggacatctaaagggctctcttgtctcctggttacctggcctcagcacatcgcccacaccctctgccacttcaatccctgcccagaggggacagaggggacactggaaaatcccctccctccctccctctaaccctctcctctctccaacaagccctgggcacagcaatgttcacccaagagtgatgctgaagtcagccaggttcctaagaaagggtcatggccagaggacttcgaaactgcttcaagaaatggagggagggtgcggtgacttcatatgtttaggaccaaagaacagtcctagggatgctggaggagataggggggaggacgtggtcactgctttcagaagctgctgcatgaaggctg

SEQ ID NO: 476612 - DNA, 721 bp, Homo sapiens
agataaattacagcacccatgtggtgtgatacgatgtggccttgaaaaatcgtattgtgcatgactgtttattaaggtgggaagttattgctgaaaaatacgaatgctaagagcccgctggcttggccgccggacgcagactctggctcctgtattcccggactccactttctctaatcctgcgattagtgaggagggggaattggcagtgtggctcagaacaagctgctcagcgtggaaactttctctgagcatccccaggcctgcctcatccccacttcatctcccttttatatcccagacctctctctctccaggcctgaggcctggtggagagggcctgtgggcagctctagggagggtcttgccctgtaagacatggaggcggcaggcccaggctgtactcctggacttcccatccctggttgtgccaaggaggggtgtggtggtgctgggggagggaagggggccctgggatcccccaccaagccctctgcccctgaaggtaatggtgatcaaccttcttgctgagggcaactagaagagctatatatttttttaaaaactaccactaccaccacaacaccagaccatttgaagcatctgagcactaataagacaaacaagatagtagacaattattgagctaggatatggagaggactgagactagggagatgcagattttataattaaaaaaacagcaatgcttattatgttc

SEQ ID NO: 476613 - DNA, 1130 bp, Homo sapiens
gaagatgaagaaggtgatactatacagctctgccctaccccaatgggctgagcttctgacaaccccatgatgagggctccaggccctggctcaccctgcaaggacttcctaagtgcccaagcagtgccccctagaggccagtggcagcactgatcagcacagcgggcagcgccatcatggctggaggcccaggcgaagacgtgcaggccagggcgtgcctgtgtggggggaacaggaccgagcttctgccaagggcccgctgccggctgttgctgagcttgtgctcgccagaggggtgggggcggcaggcagacaatggaccccacggcccagcctcctggccttggccccttgagctgggcaggcagccgctggccaaagcagccgcctccattggtccctcacgtagcccacgtcctgcctgctgggtggcccttatcaccgggcagcaagttcttaggttggcttcccactgtgtgggcaaacacgcggcctcactcttactggaagccaagacttgctccaactgggctcggcaggagagagttctcaagaagcccaaccctcaaatacatactctgtaacctagatggaggctctcacagaacctgccagaggcaatcactaaccctgctttacacacctaaaggtagctttttaaactttaaaaaatttgtgataaaatacgcagaacatttaccattttaaccacatttaagtgtacatttcagtggcattaaatacattcacattacatacgttcacattacatatgttcacattgttgtgcaaccatcaacaccatccatctccagaattcttttcattttacaaaacagaaactctgctcattgaacactaactccccatctctccagcccctggcaaccaccattctactttctgtctctatgaatctaactaccttagttacctcattaaagtggaattatacaatatttgtccttttgtgatttgctgatttcacttagcacaatgtccttaaagttcatccctgttacagcatgtgtcacaattttcttcctttttaaggcttaataatattccattgtatgtatgtaccacattttctttctccatttgggtagctttttttatttattaactac

SEQ ID NO: 476614 - DNA, 693 bp, Homo sapiens
agaagcgcaagcgcagccgcaaggagagctattccgtgtacgtgtacaaggtgctgaagcaggtccaccccgacaccggcatctcgtccaaggctatggggattatgaactccttcgtcaacgacattttcgagcgcattgcaggcgaggcttcccgcctggcgcattataacaagcgctcgaccatcacttccagggagatccaaacggctgtgcgcctgctgctacccggggagctggccaaacacgcggtgtcggagggcaccaaggcggtcaccaagtacaccagctccaagcaacaggatagcctgaagttggagcaaagaaatgaaaattcccggtgctacattcagacgcttttatctgtcataggaccctcatgggtgaaagaatatgagaagcatcgtgggcaggaaggtctctctgatttttcccaactcttctcccctgaaacaggtcataggaccctcatgagtcctagagagtctgagagaaatctgaacaaaaagaccttgctaggtttctgttttacccttagctgacagtcttctttttgtcctattatatttctgcatgactctccactcttcatcaaacctagtgtaaaaatactcaggtttaccccttctccaggtcttcatttccttacgaagcctcccatgtcatgtgaaatttatattaaataaatgttgt

SEQ ID NO: 476615 - DNA, 620 bp, Homo sapiens
actcttatgtttttaatcatgaggaggccattagtttttggcagtcccacaaaatgtattaaataccgaatgcatgtcaagaaccccctgctaggctcctccactgctttagagtcctttcccttgctccttttcctcacttcctgtctctccagcccttctctctgcccctctcatccctcacaccctcccctccccttagtccctgccaccctctcacccctgaattgtggcactaacactgtccctcacttcctgcccatgtctgttctccccacagtgctcagcagttctgctaatgtgactcaggtcgtgtcatttcttcacttacaatggttgggttttggtctaccattttgctgtatgttttcaatttgtctcgtatctttttgtttctattcctcctttcctactttcttatgtgttaagtaaacattttttagtttatggttttaattctagtggcttttaggtatatttctttacactaattttttattgttgtaagaattgaaacccgattccttgacttttcatggtgaagttcagatgttaaaccaaccttactttccctttaaaaaaaccaatatggcatggcatattattcattttatgtatat

SEQ ID NO: 476616 - DNA, 592 bp, Homo sapiens
tctcctgaagaagaggaaaagccttgccaaatgcgtcttcccagcaggatgcaaacctccttcagcaaacactgatgggggctgctggtgctgggtgttggcgggggcctcctacccagcagctgctgctgctgagctctggaagtttgctatgggccatggattgggaggaaaacatggtccaattgaagaaagggccagaaggaagaaaagaggaagatgggctccagtgctagaaaagagagaccaaatacagtcgaaaaagcagagaaatgtatttttcctcaagttcttctgctgtcactttcactgcagatctcagctttgctcttccagagtccctcctttggcactgcactgcagccctctagccgaccgagggcggctcctgttctctctgcagactgcacatccctgtcctcgctcagcgctccccatctgctgtcgctccttccaagtgcacgaatacttagagcttaatccccgcaaacctagtttgcgtgacagtgccccaagccgggagacccacagctcctttccctctggacctctaactgacctgcagcagcgggcttagtactcagctcagcac

SEQ ID NO: 476617 - DNA, 758 bp, Homo sapiens
ggccaaagacaaggaaaaatcaattgtctgaggactgttactacaagaaagactataatgaaatgtggggcaagtgtgagaaggcagtgttcattatctctgattgcccaattaaggatccctacttgggaagatcaacactcacacatcaagacagaaattccattccgagagaaacattttcttgttactttgatttcccaagaaaggactatgcccctttccaaaatctacctttttcacatcagcaacctggacctgttggtccaggtgttttactattttctgtggaaaatgctgatcgcaactcacgagctccacgtgggctttgttagccccacacctgtggatttgagaaggaacccagatttctgcgttttaaacaaacgccacagctgtttctcagaaaggctgtgtcaagagccctttgagataacagtccttaggattggattgagggaaaattcggagaaattctgagagcctcattgacctgataatttttttaacaaaattaattaaagtccgctctacagacttttgcaaaggcaaacgtttccggatcttctagaagttccgactccacgattgtgttcatgtgaaatatgttagaaataaaatggtcacatcttaattcaatgctatttattattgattcattacatcaaaggatggatttaaacgggaagatcaagagtcaaggtgttaggaacctttgagttatttagactttcctcgttgctacagcgtcaagtact

SEQ ID NO: 476618 - DNA, 598 bp, Homo sapiens
gccaaaacaatggtacatactcgtggagcagtaatttctctaatggagcaattttgccttcacaacggtcatctgacaatgtttactgcgtacctgctgcgagctgatggaagaggccctgggttctttgcgagcgcgtggtcccttgagtcccttgagggtgaggaaatcgcaccaccgacctccacgtgtaggggaggacgtggtgcagcagcgccagataacgccggaagaaccccaagtggaggctgcttgggtccctcgggagttcttggcgtcttgaacaaagaactggacaaaacgcacaaacagagcaaggaaagaatgaagggttttattgaaaacgaaagtatactccacagtgtgggagtggggctgagcacaggagctcaaaggccccgttacagagtttttgtgagtttaaatatcatctacttgggggagatctacaaaaaaaaagaagaagaagaagaaaggaagggttggatggcagaggacagacagtggtaatttgtcactgtgtctccagtgtgctcagagaatcttcacagacttcccatctctcagttaaatctaaagtccttacaagcccagaagg

SEQ ID NO: 476619 - DNA, 727 bp, Homo sapiens
agcagcagggggtgaggaaggatttagcagcaggacatcaacaccggggcgagcagtgcaggcctgatggagatgtggcagggagacacctcagtgctggaagtctggataaggcaccaagacctcagcacagatctggggccgtttacagttaaagaagtagcagtgggtaaacagatgtcactggaaaacagtacagatcacaaacagttcagggatgaaactctgaatgtagcatcttcagtgaaacttgaaaaggcctttttgaacacacactgttacggagggctgacttttagtttccgtggttctgcagggctgactgctggacttgaagaaatcccagtttcttccaatgataaccactattttgcaaaattagtacaatcatacaacctggatattgacaatgatacagccaagctacagaacatttctatcaccccatggatacatcatgtatccttggataactacacctacctcactccccaacccttatacatgacaaccactaagctttgagataattatatttgtaattgaattatgattattgaactgcattctttttggttgttgatttctcattttctcaaagcagatgcccaaaatctgtggaggtggttgtcattgcaaagaagtaccacagggcttaaaaaggcaaaatggaaggattccctctgcaagtgttaactgctttcagcttctctcactcatttaaaat

SEQ ID NO: 476620 - DNA, 755 bp, Homo sapiens
gcagacctgtccttggcttgtgcagggccttcagcgggaaagcagggctctactaagagcaggtcttctcactgatggcccagggcaaggcgcagtggctactcattctctgcaaagaaggaggagaaagggaacaaggagaaagtcacaaagggaaaactcgtgctgccaaaatgtcaagtttagggtattccgggacagaaaaaggcacatcccagcaaaggaggacatgtttacccacatttatcatgtcagcacctgaggtggacagcagaagtctttctgcagagctagtgcccacgacacttcatgctgcagaacacatcctccgtaaacactgtagcatgaatgatgacagaggtgaaagaaaaggaagaaaagattctggagacgttgtacaggaaggatctactttatttgcaggagaaagcgctatggcagttgctggaagattgcttctgaccattggctatctctctgacctgatgggagaagggtgacaaaaattggacacttgaaaaacaggccaaaaaaaaaaaaaaaaatcaaaggaattttaaaagaaccatgcacaaattcttaattagattcttttatccaaatccattttgtctggaaaattatgccttagtatgtatctgtattctattcctccataatctattttattttattttattttattattttattttattttattttaatgttcacaagaagctggatgctagctaccaaatgagcaaatcagctac

SEQ ID NO: 476621 - DNA, 515 bp, Homo sapiens
caggaggaaatgagaaaattatcacaattctttcagattcacaaatgccatgttccctttgttttaaggccacgaaggtcaagtaaggacccaaataactaccaaacatctcagagaacgctttgggcaagagtgcggagacaatcaattgcattgttcccattacagtttgcagttattaatttcatggaagagagcacgtcacaccgggggcaagacacagtaggaactgccagattaagtagcacagatatcccggaatgtaagaagcaccgccgttgtcaacaggagaaagaagcgggtatacaaaccaagagacataaaccggacaaggaactggagaatgcgggcgagcctgccggtactttgggccgccaaatccctggcaggacaagattgagggcggagcttctcagatactgccttgggcaaagttctacgagcctgagagtgtgaagaatacggatttccaaaataggtcatgagggagacctctctcctcacttctcaatttc

SEQ ID NO: 476622 - DNA, 604 bp, Homo sapiens
aggctcgaactcaggaccttcagattatgagactgacgcgctgcccgctgcgctaagagggcgacgaagtataatgccgcgccagcttccacaggaatttcctaatttctttccccaggtgcgcacgcacacgtgtagatgcctgtgcttatatgtgtacatacacgtatgcatacacatatgcattctcgtgtacatacatgcacgaatgctcgcatgcatgtttaggtgggtaaacacacatgtacacacatgcatgcagacatgtgagcacatgtctatctgcacatatatctacacaaatacatgcatgcatactgtgtacacgatacatggatacacatacatccatgcacacacacccacatgcatttgcacatgcatgtgtacatatctttatacactcacacatgcacgcacgtgtatatacatgtatacatacacatatgaatgtgcagctacgtgtgtacatgcatgtacttgcatgtatgcatatgcatatgtgtcagcaaatacacacatacatacacacatacatacggtgtacatgcatgtatacataaacatgcatgcatgtatacacatgtatgtgtagatacctttg

SEQ ID NO: 476623 - DNA, 2118 bp, Homo sapiens
cgccggatgttcctgtgtaggctgtgtaaggagtgaccggaagtagaaactgggtgctccagtggcgcaatcggttagcgcgcggtacttatatggcagtatgtgtgcgagtgatgccgaggttgtgagttcgagcctcacctggagcattgttttccaacccaaaatagcattacttgaagtgcctttccccctgtaatccgactccatcgtctttaacgtgtttggaattgtgtacacagtttattgttattggtttccttagcctttttagaaccaagcaacgccaattaccaacaaaatccgttgcgccgcagtgagttagctaccttctatctccactttgttctgcacgtcgatctcaggagaagccagctcccatgttaagaagttcaaatacctagagactgcgatggtttgcagaggctcaagctaaccacatggaaagacatggagagatattccttgccaaccctcaactactccaactattctaagacatcaaacctgtcacccaccggtctgaagaggaggatgagagacaaagaaaaaagttgtctggctgcctctgctgtctacagattgaagaagatccatccagctgagcccagcctagaccagctgacttctccaataagcctgtatgaaataaatgcttattgttatgtgaccttgagctttgaagatagtttgttatgcaataatttaaattaccacagtcctaccactgaagatggaaacttagaccttccacagccctcttcctttatattcaattgttcactaaattctccagaagataaaagccatattacaggaatgacggaatgggaggccagaaagaatcttgtctttacaatttcctggaacccctgaacaagccttagattgcctagtaccaggattcttcttaaaataaaaagtaaatctatttttaaagccttgattaagttaatactctgacatatgcaggcaaaagcaatccctaaagtatacacccttagttcctggaggaatcattgcagaaagtaatttcccccagtttcctagatgaggcttatggttgtaaaactgcacattaatcacagaaatgaatttacaaggcaatttggagagagatttgagttggctttatgtttccttatgaatgtcaaaactgaacgcatggaggagtcaatccactttggatgatacattcagtagcgactttagtgtctcctcagatgtataaataagtcaaaattcaagacttcccttgatccagagaatgacatggaccattatttgagagacataaattatgttcaattttcacatgtcacatctccgtattgacctgcttctgactgaatttttttttaggatatacttttccgatatcttagacaccaataacagattttggaatatgaaaattgtctttgctttcctgaagagcatcatacctagatgggaaaagctacatgcttatatttactctgggagctattggtgagagagagagaaagagagagattcctttatatataaaatatttaaaatatatttatatataatatatattatatataatcttttaaaaatgtatatataaatatattttaaatcttttcacacagatgacattttgttgatccttaaatgctgaaaatttagaaatttgtgaaatttgtgaaatttagaaatttgtgaaagctgtctaaaatatataaatatattttatattttaaattataatataatatttatatattatatattattatatataacatattatatataatacatattatatttccagcttcacccatgttattatatatattatatatattatatatataatatatataatatatattatatatataatatataacatattatgttatatattacatatatattatgttatatataatacatattatatataacatattatatataatatatatattatatgttttatatatatattatatatataaatatatacgtattatatataatatgtattatatatattaaaatatatttatatacattttagaaagctttcacaagcttattttcagcatttaaggattaacaaaatgtcatctgtgtgactct

SEQ ID NO: 476624 - DNA, 664 bp, Homo sapiens
ctacgagcacatccggacatcatgaaggaacaaactccagacctgtcacctttaagaactgctcactgcgaggactctagcaggcagacacacacgcggctggacgtcaagacaaacacattggcagaggaacacacaagcacctggatgtggagagggtgtcgagagcacgctgacaggtaccggcaagcctgcaggccatcgaccgaccggccgaacgacttggagtttggtcagggcgggctcacaacactaaagctttcacatgaaagggttgtgactgatttgagcaatcaggcagtacgtgacaggggctgcatgcaccggtgggaagtggagtggctgaaactactcagcaggtgcttctgtgcactgttgactgagaaagctgaggtcaaacctgcttccctgggaattccctgctacactgggaattccaccatggctgcatcttccatgaagccctccctgatgctcagtttatttgcagaaaggttggggccacctagagaagtcttcactggcttcatcatgtgggtcctacacttgaattaccagcattcagataatcaatagtgtctacagtggtctatcttttctaagatgaaaagaactaatgataggttaggccagtgctttcaaactgtgtttaagtttccattag

SEQ ID NO: 476625 - DNA, 519 bp, Homo sapiens
ctctcgtcttctggtcacttctcacaatgtcccttcagctcctaactctggagacatgagacatcaatcaacatatgtaagatgaacattggtttggtctggaaaggtgggacaactccaagcggggggagagggcttccaggtcataggagagagaaattgtattatccttcaaatgagataacacttttgaaatgtgagaagcaaattggtctagggaaaccagaacattcactaatgtgtcaatttcccttgcccagaaagccaaaccatgcagaacatgaaaatattcacttcctgacaacacctttcaaaaagagagatttaagaaaagcaattcataaccaagcttccccagggctccaattcccgcacaaatttcaaacatggaaagctagaacggaatgctacagaattttatttcaagacctccctatgctgtctatgcacgtttctttatctgcaaaacccgccccgatagtcatatcttggtgacttttgggaaaaccatgaaggagc

SEQ ID NO: 476626 - DNA, 1151 bp, Homo sapiens
ggtcatagattcccgtttgtccctgcctaagaacactttgtggtggttcctactttctctctctcataaagaagtttcacacgcctcccgctcctcctgttgtgtgaccgctacgcgcgccgctaccgtgctctcccggctccaagcgcagaccaagagttccgctgccagcaaggctgctctccgcgtgccgcaaaaggatctcagagtaaagacgatcttaaattcgatatgtgaagttgattcccatggaaacctcgtcatcctctcatgacaattatgacagctttgcttctgataattttgcaaacacgaggcttcagtcagtccaggaaggctgctggaccagcagccagtgcagacactctggacttctcaggcaggcgatgaagtttccagggcgaaacaccaggggagcagccaataaaaaagcagagtaccccaaaccctcaaggaattctatgactggttccaattccgattcagaagatgaaatattagaagcttctctggtttgttccccggaagacattccccgccaggccccaactcacaatcaaggagaccccaaggtcaggatcctcgggtcccttggcgctctacctacggaagagaaggaagaaaagacagaggctaagtacatgttggtgagaaagaggaagattgtggacggctacatgaacgaagttgagatgctcagaaatcgtcccgccagatcacccatgatccttccacatataattcggccaccggaagaaattacagaggaaggtttggagaacatctgcagcaactctcaagagaagatatataaccgttcgctgggttctatttgtcatcaatgccgccagaaaactattgttatcaaacaaactgcagaaacccagactgttggggctttcaaggcctgttctgcggccccgaccttagaaacccttgtggtgaagaggtcaggaatactctgctggatgcgaactggcattgtccgccttgtcgaggccgtgcaactgcagtttccgctcgcagcgagatagactgtgggaaactggggtccttgaatatttagccaaatacaatggctttgggaatgtgcatgcttacttgaaaagtctgaaacaggaatttgaaatgcaagcataatattggaaaat

SEQ ID NO: 476627 - DNA, 863 bp, Homo sapiens
gaagagatcaaccagaatcctagaaaagttattcccaggtgggatgaattcattatatgaaggaagcggctctgagtagagcaagtggtagactgtaatggatatgatggtgttctacctagaacccaatggttttctacattgcccaatgttttgtggagcaagctctttggtggctgaaaaccgacgagtttctctagaactaccgagaaaaagtactgaggaaaatatgtggccgatatggggatcgaacccacgaccttggcgcttttggcaccagagaggaccctgttattatataagtgcagcggcctgtcttccagggctgtccggagatcttggagcctcagggttcttggggcaagcagatgttgagctgtgtctccaggctccgactgggacaacatgtctgaagagttcaggctacaagccccaggccaccagtagatatccttcacctgaggaaattggaacaccttcgcctcggggctctatgggcatcttctgggtgattgccatctggcacagcctaggggattgcgaatggatgaatgggacccgcccagaacctgagttccccacagcaagtccgctcagtccctgtcttaagccatccctgtccttccccacaacagaggataagaaggcttttgttcaccatttcaaacagttaacgttctaattttaaagtgtatttggagaaattgaatttagcatttttattatattctctgagaacttctttagtttcactgagaatcatttcatgtatctgattttgtaaatcagttacccttttaaaaaataacaatttttcactgtatttgtctttttcgttattttctctatgaactagctaatac

SEQ ID NO: 476628 - DNA, 879 bp, Homo sapiens
ttctgtgaaggaaaaaacaacaacaataaatgtttgccagaaatggaagaaacctgttcaaaatggatcataaagcagcgaagacaactcgcaatatcaacaatgcactttggcccaggaactgctaatgaacgtacagtgcagtggtggttccagaagttttgcaaagtgtcttcttcctttatcctacgcaacaaggaaccatttctccatcggattgtgacgtgcgatgaaaagtggattttatacgacaactggcgacgactagttcagtggttggatcgagaagaagctccaaagcacttcccaaagccaaacttgtaccaaaaaaaggtcatattcgctgtttggtggtctgctgcttgtctgattcactgtagctttccgaatacccgtgaaaccattacatctgagaagtatgctcagcaactcaatgagatacatcgaaaactgcaatgcctgcagccagcattggttaacaggaagggcccaattcttcacaacaacgttgactcgactgcacgtcgcacaaataacgcttctgaagttgagcgaattgggctacgaagattttcctaatccatcatattcatctgacctctcaccaatcgactaccacttcttcaaacatctccacaactttttgcaggtaaaacgcttccacaacgaggggatgcaagcattttctgtccaatcccgaagcacagatttttaccctccaggaataaacaaacttatttcttgttggcaaaaatgtgttgattgtaatggttcctattttgattaataaagatgtgtttgagcctagttataatgatttaaaaattcatggtccgaaactgcaactacttttgcaccaacctaaatgttaattttaac

SEQ ID NO: 476629 - DNA, 868 bp, Homo sapiens
gccttctgaatgtctagtcaatacatgcagacaatgaatcagattcggatcctttcgaggaccccagtgtatgtacatgccgggaaacaccctagctttaccccatatccacctggagcgtccttaagtggaactttgccatgcttcggagggagccaggttcacagcagtgagccattaaacaaggcgcctgcgaccctaatccctgacgtctttgtggcgatcgggaccatcaagggaaatgatcgtggagaaacaggcgacgcatggtcagggactcttggtctagaagcggagactttacttacggaaatccccaagagcctctccttgaataaagccagcaggcgacagttcgcattaggaagagagcagagacccctccaccccaatctcgccccctttaaaggcagggatctcctcctattcagaacactgccgacaacatgcagagagaaacacctaatagaacagtattctgcttttgaaagctgagagtgatcgagagatcgtgcgatggtgccattgtaaagacgtccactgtcaaggtcagctaagggaatcttggaaaacagaaacaccccgaaaaattgcaagttgtttccgctcggtttcgacccgaggacctttcgcgtgtaaggcgaatgtgataaccactacaccacggaaacctgtgtgctgcgttggcttccttcgttaagggagaattaaatttttctgtttcagctttggtaacatcgagttgattggcctttcctttcagtaaattatcaaggttaccatgcttttctttactacaaagtcctccattaaaacttttttttttcagacgtgactggagaatttaagaaaatttcccctcagatgc

SEQ ID NO: 476630 - DNA, 686 bp, Homo sapiens
gtttctatcctaactggaaaagatgactctggagaggtctccgactcttcagccaaacatgattcccagcgtgtcccagttgttgcgggtgtctcctgcatccccatcccctgaaggagcaggaagcttgatctctgggaatgcatcctgcttagtctccttctgtcagaacgtcagaataaggggtcctcccagagagctaaagttcagtacagtgacttatgctaatgggcaaagcattctttgtgtagtcgtggccgagtggttaaggcgatggactagaaatccattggggtttccccgcgcagggatctacttcagtaaagtaaacatcctcattcatacagaaaaggaaattccaggaaatccaggatcaaatacaagtgaaagcaaagactcagatatggtcgccaagatgggaataacttgggctttattaagcaaacaactaagcaattaaatatattaagtaaggcaattttccttgaaatcatataaaaacgaactgacgacgtcaagccagactggcttgtccaggtgtccaggacgatgatgaggcaagaggtactgaaaagaaactttttaaaaaatcccacttaccagaacgtcttctttctactgtctccctccaagtgggcaagtgggccaaggtgctctgaagggatgtatggactctccctggggtg

SEQ ID NO: 476631 - DNA, 479 bp, Homo sapiens
ttctaaagccacctggacgcagtaaatttgtgccacaatgtcatcgtttgctcttgggggcaacgaacacacaactaaagcaataaaatgtctttggaaaacaggaggggaagggcccaagcttgatctgagaaacccagcaattgctaaaatagcagtgcagcatttactgaagtctcttctgccagtggctcccatatgtccataccttggaatgcttttggctggtgcttcaagaacagaccatggacctagcctcctagcttcccccaaaggaattcctgcagaagactatgggaaaagcttctttgtgatcttctttgtttggaatgatggaaaacatgagaaaagagccattttggcccttctgatgatagcgctgtcctctgaggcgcagatcttcctggggtgcctgcaccctctcttcaccgccctccaatagcttgacctaggagaccatgtagggcacctgcggttcc

SEQ ID NO: 476632 - DNA, 666 bp, Homo sapiens
ctgtcattcccgacactggctggcagactggcagagcccagcggattcacagaccaatagatggaaatccgctgcttactttctcgcaggagaaaatgatctccaacagtgctgcgggactgcgtccaaatggcactgaaaatatcccaggattctgtaaatgtggggttttcctttgtcgattgactatccgaactgtgatttcaccaccggaagtcatccttacatgtttcatttcgttacacagttcaaatgaaccaagctattgcttaaagccagaagctgcatcgcattcttccccaggccagatgcctcctcacccttttttgacagaagtcattgtaggcctaaagaaaccacattataattatcgattttatgatgcttatttaatggactgtaagctccctgatagcaggcatcatatcttatttaatattgtatctcagagccttgcagagtatgaaccctggtctctgctaagtaacagtttcttgaatgaagcacagctaaagaaatacaaccaggctgggcacggtggctcaagcctgtaatttcaggccaagtcaggatctcaagagaatacagatgtcttattctaattgcaataattttagaaggatttaataaagggactgtttaataaaggtgtctagtaagggtatg

SEQ ID NO: 476633 - DNA, 606 bp, Homo sapiens
ccagcagtaaagccccctagggggtctacagaagagggattaagttcctgcagcctaatcccgggatttctggggtgtggcataatggctgtcattcccgacactggctggcagactggcagagcccagaccaaaatcgaacaatcaagcaacaaagttggccttaaaattgaggccccagagatgaggttactgagcgggtatatgtcacagagccaaactttctgcaatgaattggaaaagaacatcaagacagagggaggagcgctgggggtgaacaccgccttgacctttgtaacctgctgcacaaataaggagtggttgctgtgccagttttccctgaagaggtgcctgaccagctggctctgtgaattcgaatacagttttcaggcaggctctgggagagttttggggaatcccgaaagacagcccagagatgctggactgcgaatgcaggcgcgctgcaggcgaggctgggagggccgccaggagcgctgcgggtatcgggagacacgcagagggaggggcaggcggcgggctccgcttcttcgcgtcctggctctgaaagcaaccacaggccagcggggcggtgctaggtgaagctac

SEQ ID NO: 476634 - DNA, 899 bp, Homo sapiens
gaagtaccaccaggagcttcgatgtttttcattcttctagtcctcaagagggcaactgtgcattggggaaaggaaaatgatcagacattttgggggctactggacattggctctgagctgatgttgattccaggggacccaaatcgtcattgtggtcctccagttaaagtaggggcatacggaggccaggtaattaatggagttttagctcagatccgacttacagtgggtccctggactcatcttatggtcatttccccagtgccagaatgcataattggcatagacacacttagcagctggcagaaccctcacattggctccatgactggtagggtgagggctgctatggtgggaaagaccaaatggaagccattagagctgcctctatctagaaaaatagtaaatctaaaacactcagtcatcaaaggaaagcttgctacaccagacttgagccagtttatagactcagaaccctttgaatggagtggcagtcgggtcttcttgaggaaggacctggagaccccagatcactgtggtactccagtcagagtaggggcttatagaagtcaggtgaccagtgaagttttagctcaggtctgactcacagtgggtccattccctgacctatggaatgagggctattaaagtgggaaagaacaactggaaggcattagaactacctctacctaggaaaatagtaaatcaaaagcaatactacatttctgaagggattgtagagattagtgccaccatcaaggacttaaaagatgcaggggtgatatttttgctttcccacatcagagctccctccaggttctcaggccttcaaaatctgggactccagaggagtctcccttctccctggcccactgcttcctcaggctttgggatgcaga

SEQ ID NO: 476635 - DNA, 804 bp, Homo sapiens
catctcctcagaatctcatcagctgaggaaacaggagtccaggtcttatttgccgcggcacgctggggccaccggcctctcacacaggcggccttcgcccaggtgcagccgtagggactgcggctcgtcagcctgacgccatcaagctgcgccccagccagccagtcaatggctgtgtccagagcttcccgcctcgggctcagcccttcctggatcttgagtctagagttttggtatttttggttttgttacgtggaatgtataaggaaagggaaaaagcgccgcaaatatgacaatggttgttacagtagtttctctagagtagtagttctcacgttcacttcaccctggaaggaccctccgtctgaaactgggcggaaatacctcccagattcttcccactcccctctctatttcagcttgggtaacttgtttcatcgaactccaccccagctgaaggagccaatgctgtcccaagagaaggatcgctatggggccctaactaacctcagtctctatgctgatgtgacccaggttttgcatcttgccaatagtgcatttttgatctgcgacagcagcagtagcagcaacaacaacaacaacaaaaacaacaaaccaaaccaaacaacaacaacaaaaaaccagtatgatactgatacaaagacaaacatagagaccaatggaacagaagagagggctggagaagtgtaatgcctcctggtttattgttttttttctcaagattatttagtgattcagggtcctttgtagtttcatataattttaggattgttttctctgtat

SEQ ID NO: 476636 - DNA, 552 bp, Homo sapiens
tttcgaaccggggacctttcgcgtgttaggcgaacaaatacttgccgacctccttgtggaaaaccctccctttccgctgtctgcattcggatgagaaccagatcaccagggagatgcagaccagggggacacttcctcctgttaacactagcggagctggtggaacccagccgaccatgcaggagggaggagctggcaacgccctgaacgatgccccaggttctataatctcaaagctgccctttcttcccagaaactctcacagtggtggaacccggacctgtaagactgagctcttgggactattagcatttgttacagagcagaagcaagctgccttcttccagattcctccttataacttcactttgcatataaacaccacacactctctgtgcttagaggtggtggttgggctgccagaccagtctggagaaagtctgtgcttactttttcctctacttagtattctttcttccatgggtgccaggaacagagagccccttctcaccttgagatcatgtgagctggtagtagctggatcatgaataa

SEQ ID NO: 476637 - DNA, 951 bp, Homo sapiens
tctctctctctctctcgctctctctctcttaaaagtcctttcagaggctcgcgcggccccacgggcttcctactgccggctcaccaacgggaaatatgcgcaggggagactcccaaacggacacaaaaaagattcctcatccctgcttctcataccccctttttcgcacatacacaggagcccatactgtgaaaatccaccccctacaccacagctgattgctgcgatgggtctctggggatgttctcaattcgacgcctgttcatggacagcgtgcttagtgcaaattgaatgtaacagtttgcaggttggggttggtttccgggatttcagatttttaaacggacacaccgacactctggaagtggtcttcgaggaccgcatgctccctcttgtggatgacaacagttcccaacgccaaacaaacaagaaaaccacaacccaagacccggagaacagcaaaagtgagagtttaacgacgatcttgcaagatcggttgtctgatgagcgggcacacccagcacactttgaacaaccgatttatcccgtggtgcgcaggtccctccccgggttcctcacagggggtactaatcccattcatgaggacgccatccttatgacctattcacctcccaaaggccccacctcttaataccaccataatggggattatgcttcaacacaagtatttgtttcttgtttttgttttcaacataaatatttggagggtaaccattcagatcatagtagtaccagtatccaaaactgccaccaaatagtttgttgtaagttaagataattgcagagcatcacttaacttgaaaagcattttctaaaatgtccaaatattagacacagttgaatatcccatagatatatatctattcagtgtgcaattttgattcattggcttatttagttatatattgtgacggtaacaatgctctattt

SEQ ID NO: 476638 - DNA, 468 bp, Homo sapiens
atttcaaccaatggaatcgctgttatgaaacatgcttctttggattggacaaacttaaactacaacacgcctgaccccaccaagtcggccacagccccgaaaaagggcaagaagcgaaagcgcagccgcaaggagagctgctccgtgtacttgtacaaggtgctgaagcaggtccaccaacaccggcatctcgtccaaagcaatggggatcttgaacaccttcgttatgccatcttcgagcgtattgcgggcgaggcttcccgcctggcgcgttacaacaagcgttcgaccatcacctccagggagatccagacggctgttcgcctgtcacgcatgctgtgtccgagagcaccaaagcctgttgaaattaggagaccaactcctaaaacaaatgaccacttcaggaggtcaagattttggtttctttgacacccagcttctatattttattgttcaaacttcagttac

SEQ ID NO: 476639 - DNA, 834 bp, Homo sapiens
tcaggccatccttggcttgaagaagtggccgccgccgagttaaccatttcctctgtgaaagccagcactgatcaagatggcttgtttggatgttcgtgcagtggaaatgctggcttttgcttttgccgttctcattgtcctactgcccctcactcttattcttgtctcctacggctacattgctgcagctgtgctaagcatcaagtcagctgccaggcaatggaaggccttccatacctgtagctctcacctcacagtggtctccctgttttatgggagcatcatctatatgtatatgcagccaggaaacagttcttcccaagaccaaggcaagtttctcactctcttctacaacctggtgactcctatgttgaatctgctcatctatactttaaggaataaggaggtgaaaggagcactgaagaagtcacctgattgtctaaatcaggggtccccaacccctgggccatggaccagtaccagtccgtggcctgttaggaactgggctgcacagcaggaggaacacattgttaaatttcaagtaaattctaacccattagtcctaggaacgtattatgacttcaaagaaattagagatttacagacaactgtcttcttgttgtatcctcacatggtggagaacagaaaggatgagcaacatgtcatttctgttcttataaaggcacaaatcccattcatgactgctccacaatcatgatataattacctcgtaaagtccccatctcctaatatcatcacattgggggtaaggatttcaactcgtaaattttgtcatttatgcttgactaaatgacaagcatttagtccatagca

SEQ ID NO: 476640 - DNA, 1040 bp, Homo sapiens
tccttcctcgcctcttcaagatcccagagaggaaagggcagcatgcctcacaggaccaacagaaagcgggccatccacaccgagctggtggcccagcaacaggtaatacgagaaatgaagccaacaggtgcagacccaaggatcttatctctagctgctgaagttgcaaaaagccctgagtggaatgtccctgttatactgttgaagttaaaagccattgctgtgcaggcttggagccaggagaagatgcagaggaactttccaatgaattacttccatcagctgcagaaaattttctatccagtcataagaagtactgctgcaaaactcctactgttgatggctgaatcctatcaggaaattttgattttactgagacaaagtgcctgctacaaaggactcagaagtctactaagtaaacaggaaactgggacagaattcagtcaagaacttagacagctcattggccttttaagcccaacggtctatcaggaagtagaaaagcagaaactacatcaagcagcatgcttgattcaagcctattggaagggttttcagacaagaaagagattaaagaagcttccatctgctgtgattgctttgcagaggagtttcagatctaaacgagcaaagatgttgctggagataaataggaagaaggaagaagaggacctcagattgtgattgcaacttcaaagacagagagccatgagactttcccaagaattgtggctgagtatgctcaaagtagttcatccaggtcaagtggagaaacacaattgggaaatggaagagaaatcagcactgattatccagaaacattggagagggtacagggaaaggaaaaatttttgccaacagaggcagtctctcacagaatataaagcagctgtcatacttcaaagagcagtgtttaaattcctagcaaagtgccgtaagaaacagaaactatttgttccttggtgaggactccaagaactcactgatgcatgccgagctgaactgaagcaacaagcggatgactatgtcagaagacattc

SEQ ID NO: 476641 - DNA, 2068 bp, Homo sapiens
ttgaacagctgatttttccccttgttactaagtttgtggtgtcatttggcactatatgatggtatgaagactgagatcacaatgttaggcatgaagcaggaattttgtgaagtaacagaaccacatagggaggagtttgatggatgtaatgaaactgtgtctcagcatgccaaacatagaagagacagtgagcctaatggcaatttggaaatgcacgatggggatgccacaggtgaaaaaatatataaatgtgatgagtgtgggaaaactttcacctggatcagaggccttcagatgcataggaggatccataatggagaggagccatacccatgtacagaatgtggaaaggccttcatcacacatgcggaacttacccagcatcaggggcttcacagcaagaaaaaaacccataaatgtaaagagtgtgggaaaagcttcagtcaaaaggcaggactcttccaacatcttaaaatccacactggagaaaagccccatcagtgtagtaaatgtggcaggtgttttagttggagatcagttcttaggaagcatcaaagtctccatactggagagaaaccttttgaatgtatggactgtgggaaagccttctgccatagttcacacctcattgaacatcagcaattccacaacaaagagaaaccttatgcatgtaatgaatgtgggaaagccttcaggcagtgttcacctcttactgaatatcaacgaattcacagcgaagaaaaaccctatgaatgtaaagtatgtggaaaagccttcactcagtatgccggccttaaccaacaccagagaatccacactggagagaaaccttttcaatgtccctcaatgttcaggcttaataaacacaagttaggaggcaagcatggaaaccctcctgagccaagaaaatataaatgtgatgagtgtgtaaagacctttactctgtcaactggcctgaggaagcacaaaagaatccacactggagataagacttaccaatgtcctgagtgtggaaaggccctcacaaggagacaggatcttatcgaacaccaggggattcaaaacaaggtgaagctctatcagtgtcaagtgtgtggcaaagccctcagtcagaagacaggtcttagttgccatctcagaatccccccaggagagaaaccttttgagtgttctgaatgcgggccagctttctgctggaagtcagatctcaacaaacataaaagggtccactctgagggaaaactctataaatgtgaagagtgtgggaaagcccataggcagagagcaaccctggatcaacatcagagaagccacattgtgccaagacctgggagtggggtgagtggtgcaaagcctgcagtggaagctcagccctgattaatccccagagaatccactacaactgaacaccttgcccacgtgtttggtgacaacttcaagtagtatccaggattttttcttactgagataaaatgtttcttgaacttcattgtttaagaacatcatggatgccacatttaagactttttataaaaatcataaatactgtgaaagttgagaatttaggaaaataaacatcgaggaatttacctgcaattaccttttgtaaatgcaatgaagtatcagtgcaacaaaaaagtatacaagggcagttgtttaaaaattatatttttctgctgaattatttattttgttttgaagccatttcaatttctgactaactttagcatagcctagtgttgaaattacttgtttgagtaccagttgaggacactggaatatctaagagcatggaatgtgcaaggtatcatttttctttggctactttcaagaattttttctttgtctttggtttccagaaggttaattattacctgtcttggtatggatttctttgggtttgttatgtttagcattttctcaacttcttgaatttatctgagaatttcttgctccttggtatgaagaaggatttttgactgaaacctggaaattgttatattatgttctgaactctggatcttattcagaatcttttgtttaacctggctttctctgatactactct

SEQ ID NO: 476642 - DNA, 713 bp, Homo sapiens
acactgttttccaagatcatgcagcagccgtaaaatgtcgcaatggtcccctctttgagcaattgctgcctttttacgagagttggtgttgatcagtctatgataaatcagcaacaggacagtgaaagaaagaaagtctttttgtgtttagcacaagattggctcagtccagttgctaccgacactgggaagggcctgtggggacccagtttcccaaatatcaaccccaaagctgtaaaacgaagtttgctcagtgagcagttaaggagctctctcgatatctccggtggctttcgaatgacgctactccgagccgcggctcgctccgaggcgggaagttgggtttacaatcagttctacgcgctgccccgcggcccttcccctggccacaacctctgcatccacccaaatcagctgcccctgtttgcagccacgagggagtcgggaaccaatttatccactcatctgttgaaggacagttttgtaagctgagctggttacaaattttggcaattacaaataaagccgctattaacattcatgtgcatgtttttgtatgggcataagtttggggtaagtactaaggaatgtgattgctggatcatatgtgtgatgttatgtcatcatatgagttgaattgttatttgcgtgaactgggtagctacaatcttaccacaatagcataagcattagagacatataaatgctagcac

SEQ ID NO: 476643 - DNA, 1988 bp, Homo sapiens
aacaagacgaccctcacttaacgtggccgctgtcgccgtgggcatgctgggggcgtcctacgctgccgttcccctttatcggctctattgccagactactggacttggaggatcagcagtttcaggtcatgcctcagaccagattgaaaacatggtgcctgttaaggatcgaatcattaaaattaactttgatgcagatgtgcatgcaagtcttcagtggaactttagacttcagcaaacagaaatatatgtggtgccaggagacactgcactggggttttacagagctaagaatcctgctgacaaaccactaattggaatttctacatacaatgttgttccatttgaagctggacagtatttcaataaaatacagtgcttctgttttgaagaacaaaggcttaatccccaagaggaagtagatatgccagtgtttttctacattgatcctgaatttgctaaagacccaagaatgattaatgttgatcttatcactctttcttacactttttttgaagcaaaggaagggcacaatttgccagttccaggatataactgaagtcagcaactaagtcttccttcaaagttgtgatttttgggaaaatcatgtatcctatcttctcaaaggagaaatattgtacaataatatgaagacttatattttaaataattattttttctcaactaatttatttcacttaaaattgagagaacaagttcagcttttatcataacaaacccacatgcctagctagaatatatgagtgactattcaataccatactgaagagtttgatagcattaaaataagccgctttgttttttaaatatgcaggcatgggttcagcttaattctataattcccttccagattattaactcttcatacttatagcaaagaatctgacaatgtttttcaaaaatgaatgctcagggttatttgtttcaagtcataggccagaacttctgaccatgtttattatgtctaaaagagttggttgctattttccttcattataaacagtcagtattttaaaagctcaaagtagaagaggagtcaccaagccctaacagcttgtccaaagatttaaattcttatttcaaatttgatttgtcctttaagatttagggctattttatattcagagttctgaataattactttgaaattgtagtatcatgaaattgaaataaaatacatctactaggctgctagccaaagcatcatcattacaagtccatgaatgctaaaatgtacaagtgggattgtgaagatttactgacatcaaaagttcttctggaaacaaacctttgtaaaaaaaaaagtgtaaattattttaatagtgatttatttgtcatcaaatgtacaacttattctgaatattttcattttctgtgttccaaacagaaatgttaagttgcagtaaaaagagaaaaaaagactatttagaattacaaagaatcatatttaaaggctgcccaatgtagagtctagtgacctgttcaggacacctgaaatataattaaatgacaacatcaaggttttaacaatttataattccaaaccagaggattataaagaagtgcaaattgacttttacattcaactttagttaaatgaaggcactcaatattcttcctgaataatacattcagtttctcacattttatgttttcatctgttccaattattttgtagtaaaataatctactcttatcacagctgtgtgacgatttctaaatgtaggaaggcctgtgaaacatatgacactgcagttaaatttgttggcctaaggactaagtaatttttcttctgctgaagttttaataaatgggagtttattctattgcactcttgtgtagtctttatctctgccaccttggccactccattcacatgctcattgtgctagttatgtgtctgctggttgttatgataattgcagtcccttggttgctggtgtttaagctctaccttcttacttcac

SEQ ID NO: 476644 - DNA, 708 bp, Homo sapiens
ctgccagcacgctgtcacctctcactatatctggttgaagtgactgctatgagcttaataacatggcgatcagagtcatcctaagatcacttctcataaaagataaaggaaaacaaaaaatagatctgctagtgccttataagaagggcatagaaatcttggtttctactcatacactcctcgtcttctttgctaccgagttgggcgtatggtgttctgacagtcatttgcactcaggaggcagctatttggaggaccggagcgtcaaccccttcccaatttctggaggccaaaagtccaaactcagtatcactggtttgaaatcaaggtgttggcagggctatgctccctccggaggctctagggaagaatatgtccttaccttttcccagcctctggtggctgctcgcattccttggctggtggtggcattgcttctatctgtgtccgtgtggtcacattgtcttcttctcttctaacgttttctaatcccaggcacttattaaatgcggatatacaagttaatttattgcaacattatttatattgttaaaaatggctgctgaaataaattcagatacatttataaaactaaatgctatacagacaaaacaaagagggaagaggctctttctttgttgacatggaaattgctgcaacatacataaagtgaaaaaggcaaggtgtaatagaatgggtttggaaagc

SEQ ID NO: 476645 - DNA, 652 bp, Homo sapiens
tctggaaacgggaagaatattatgaaatgctttgttttgaaaaagtccacaaatgttgggaattattttttatcttatatcgttatggttatttttgtaaaattccaggtggattgcaacaaaggggtaacaggcaccatctatgagtatggagccctcaccctcaacggcgaggagtacatccaattcaagcagtttgcaggcaagcacgtcctgtttgtcaatgtcactggaattgaggagagggtacagaatactgtagaggatagccttggaatttctctttctctaccactcccagggtggagcaccaaggagtactcctgggaatgggactggaactggagtgtctggttgtgtcaccatgggacattgtatgagtggggccggggggatgcagggataggtggtcctcggtttattcatgtgataaatggatacattcagtgatctttcactgcttgagatgcctgcctattctggaaacttctgggataggccatagatacatgggttgaagcatatccttatgatgttttgaattcaatctattctattcacagtgctcaaatattctctttacttttgaattatttgatggtgaggctaagggaagattgaatggaaaagaagcatagagaaaagaagggag

SEQ ID NO: 476646 - DNA, 656 bp, Homo sapiens
ctggagctcgcatgtcattgcttaacggtggtggtcgcccttacccatccttacccattctgtctctagcaggattatcaaaaaaatcactccagcctcgcgtctatatcagcgtcactgggaggccagagctgttccctccagcggcgagctggatctcatttttctttttgaggcggaagggttgggcaggggcctcctcgtggctggggctccagcgcaaaccagctgcctcaccagctctggagctcgcgccgcttggcctcaacccactcacgcggtccctcccattggcttgcctggctttatctcacctgacgcgccatgcctcgcctacccgggctctgtcctcaactctgccaccaccgctgcgtggccctgctcgccctgcagcccgacccctgccttgcccactctgagcctccgcgccagcccatgtatgccatggaaatatggctgttggaattctggtgttttacgaccttcttaacaccgtctgcaacaaaattaacacattgatgaatctgataattttatgggtcaactttactgggccacaggatgcccagacatgtgattaaacatcatttctgggtatgtctgtgagggtgtttccagaagacagtagcatttgaattgctggactgagtaaagcc

SEQ ID NO: 476647 - DNA, 739 bp, Homo sapiens
cctggaaaacctttgtatggacactctgtatctagttaacctgatggggatgtggagaacctttgtgtctagctcagggattgtaaacgcaccaatcagtgccttgtcaaaacagaccactcggctctaccaatcagcaggacgtgggtgggggccggataagagaataaaagcaggctgcccgagccagcagcgacaacctactggggtctcctcccacagtgttgaagctttgtttttgttgctgtttgcaataaattttgtcatggctgactctttggtctatactgcgtttatacattccagcgaagccacgagcccaccgagaggaacgaacaactccagaagcgtcgccttagcagttgtaacacttgtctggagagtctgcagtttcatttctgaagccagcgagatgatgagcccactggaaggagggaacaactccagacgccctgccttaagagctgtaaaactcaccgcgaaggtttacggcttcactcctcagccagggagaccacgaatccatcagaaggaagaaactccgaacacacctaaacatcagcaggaacaaactctggacatgctgcctttaagaactgtaatttcgtgagggtccgcggctctgttcttgaagtcagtgaaaccaagaacccgccaattccggacccagtgttatgctgaaattttcaggggctgtcagatttattctcttaaccacatttctgaatatatacaaata

SEQ ID NO: 476648 - DNA, 788 bp, Homo sapiens
gaggacaagtcgatgagagattcccgagtacgtctacagtcagccttgctgtaagcttgtgcgctcggaagaacctagggtaacaatgggacaaactgaaaaactgtttcaaacaggagaagatagcgtttcagtttctgatgcccctgaaagctgtgtaatcgattgtgaagaagaggctgggatagaatctcagaaaggaacggaaagttcacattgtaaatatgtagcagagctggtaatgactcggtcaatgcaaaatgtagactataatcaattacaggaagtaatatatcctgaaacattaaaattagaagaaaagggtccaaaattagcggggccgtcagagtctaaaccacaatggccaactcctcttccagcagttcagatgcctgtaacattgcaacctcaaatgcaggttagacaagtacaaaccccagaagaatatcaaatagaaaaagataaagtctctgccatggcaatgccaatccagatacagtatccacaatatcagcaggtagaaaataagacccaactgccagtagcctatcaatactggccgccagccgaacttcagtatcggccgcccccagaaaatcagtatggacacccaggaatgtttccagcaccacagggcagggctctagatcctcagccgtccactgtgagacttaatcctacagcactacctagtggacagcatagtgcattacataaaattattgataaggcaagaaaacaaggagatactgaggcgtgacaattcccagtaacattagaactgatac

SEQ ID NO: 476649 - DNA, 638 bp, Homo sapiens
ccgccatcgtcatcatggcccgttcatcatggcctgttctcgatggtcgctgtctctttggagctgcatggggagacaccaccgttgatacaatcatcaaagctgcaagcagcatactctctggagtttgtgtctcctttgtgttctctagacattttgtagctaactgcgtcagcttctttaattgtgcccaagtcagcagctttgtcttcttggtggatggcaacttcatctattcttctgacatcaccattctgttcatcttagaaagaaaagtgggcccaggggaccggcgctcagcatatggaggacccgtgccgccggtactggtctctgagttccctcagtatttattgttcactatctctaccatctcggagaaggggatgtggcgggactatagggtaatggtggggagagggtcagcaggaaaaaatgtgaacaaagatctctgtgtcataaataagtttaaggaaaagtgctgtgccttgatgtgcacataggccagatttatgtttgactttacacaaacatcttggtgcattaaggaacagtattgccgccagcatttctaacctccagccataaggcggttttctctatctcagtaactggaacgtacgattgggttttacacc

SEQ ID NO: 476650 - DNA, 946 bp, Homo sapiens
aaaagtagcctaaggtctacgttttgggtgggcgttgttttggattcccgttgtgacttgaagggaaactttcacaatgttcggagcccttgatgtactgcagatgaatgaggaggatgtccttaagttccttgccgcaagaacccactcaggtggcaccaatctttacttccaaatggaacagtacatttataaaactcgtgccattgctgccattgaaaaccttgctgatgtcagtgttatatcctccaggaatactggccagagggcagtgctgaaatttgctgctgccactggagccactccaattgctggctgcttcactcctggaaccttcactagccagatccaggcagccttccgagagccacggcttcctgtggttactgaccccagggttgaccaccagcctttaatggaggcatcttatgttaacctacctaccattgctctgtgtaacacagattctcctctgtgctatgtggatattgccattccatgcaacaacaaaggagctcactcagtgggtgtgatgtggtggatgttggtcccagaagttcggcgcataagttgcaccatttcccgtgaacacccgtgggaggtcatgactgatccctgcttctacagagatcccgaagagattgaaaaagaaaagcaagctgctgctgaaaaggctgtgaccaacgaggaatttcagggtgaatggactgcaccagctcctcagttcactgctacccagcctgaggttgcagacaggtctgaaggcctgcaggtgccgtctgtgcctatccagcagttacctactgaagactggagcgctcagcctgacacagaagactgatctgcagctcaaactgctcaggccactgaatgggtagaagcaaccactgaatggtcttaagctattcttgcacaggctcttagacaacatggaaataacattgac

SEQ ID NO: 476651 - DNA, 726 bp, Homo sapiens
tgaccctaattcagctcgatggtattatggcatgtcataaggattaaggctttatatcccaggatttgatgttaagactatgttcgccatccagaagaaaatcctggtctcatggagcccacccaagccaatcaggcctttaactgatctaggcgaccctatgttccaaaaacaccctgacaagtctggagtcataaaagatactctccaaaaggttcgagaaaatctagatagatgccaacaagaaagagaaaataacatcccctggtatcaaagcatgtttaactggaatccatggctaactactctagtcactaggagagaatctgaagacataccagaagattcaatcttggaacttcgctccaggtggacggaaactgacaaagaaagttggctaacagcagtccttgaaatagatgacggctgtgagaggatccaagggtctttcggtccagaatgcctttctcctcttgacacagcgtcaagacaagattccattcagaagtttcagaaacaggagttaaaacatagcggactttaacctatcatgccttaagccctcacctttagataatagcatataataaatcagtaagaaaacggcattctttctctaaagaaggaatgtttagaattttttccgaacgaaagacgcttctggcgaaactccgagactttcaaaatacacagttgagaaaattattttcagagatggaaaaagcc

SEQ ID NO: 476652 - DNA, 846 bp, Homo sapiens
ctggagccacaacgtccccaagatgaaatccatgctgggtttcagccacggtgccggcccaggggctggcgagggtaaggacaggcagcgacccacttcctgggtcttcatttctaagagctgggaattccaccttctcacctcctcacctggacctaaatcccccaggcgactgggcgacagagcgtgtgaggagacgattgaaaaacccaaaaagaagaaaaagcaaaagccccaggagattcatcaggagaatggaatggaagacccatctatctctttctccaaacccaagaaaaagaaatctttttccaaggaggagttgatgagtagcgatcttgaagagaccgctggcagcaccagtcttcccaagaggaagaagtcttcacccaaggaggaaacagttaatgacaccgaagagtcaggccacagaagtggctccaagaaaacgaggaaattctccaaagaggagctggtcagcagtgggcctgaagaggcggctggcaagagcagctccaagaagaagaaaaagttccataaagcatcccaggaagattagaatgcaaatggacattctctgggaggtggggcataccatagcccaaggcgacatttcccaccctgtgccgtcttccccaataagaacaaattcacaaaaaagagagagagagaagtgaagtctctaatgtaactgcatttttaatttgcctctatttgtactgaattttagggtattttcacacatacctgagttttattttttgactatgggaaacactaagatgcttcccagagtcaaaagaaaaaagttataatcagaaaatttgcaagagaatgttgtatgcc

SEQ ID NO: 476653 - DNA, 565 bp, Homo sapiens
tttctaagagctgggaattccaccttctcacctcctcacctggacctaaatcccccaggcgggatcatactatgtcagtcaattcttttaaatttgttgaggcccaaggtatgagactgggcgacagagcgtgtgaggagacgattgaaaaacccaaaaagaagaaaaagcaaaagccccaggagattcatcaggagaatggaatggaagacccatctatctctttctccaaacccaagaaaaagaaatctttttccaaggaggagttgatgagtagcgatcttgaagagaccgctggcagcaccagtcttcccaagaggaagaagtcttcacccaaggaggaaacagttaatgacaccgaagagtcaggccacagaagtggctccaagaaaacgaggaaattctccaaagaggagctggtcagcagaacatcaggaacaatgcctttgtttttaccacaagatatctttctcctggtgtagccatgcccgagagagagagagagagagagagagagagagagagagagagagagagagagagagagagggcgcttagtgtcggg

SEQ ID NO: 476654 - DNA, 637 bp, Homo sapiens
gaagatcaagcaagaaagaaaaagacagaaaacaaatgcgaaaccacagcttccttggctctttttgcccatatgccgaagagccgagcattgccgccaagcattggcaccggccatgcggagactagcgaaagctttgcaattcctctacttctcagtgatgactcgggctttctccttacattcttgatgggcatgaccggtcctgtcagctggacgctgcacattggcctgcagggaatcggtggacttgttctgcctcctcggatccacagagatgccagtggtccgggtcaccttcttgtgaatgcccgccaccctgagctccaggctgaagcctctgccggcgcgcaccttgatgtgataacgcacagcagggcacagcacaatgggccagatgggtcccgactctccgggcgcggggcgatgcagcgccctttggcttgccgggccttgattctgcggatcttctggttgaaccactcttacaccacaataatcatcaacatagaagactactgtggccaaatgtgtgaaggtttttccccacacatcaagcagcagacaccagctaggtgtcctccaattcagttctgacactgtctacctgaagaagtggaatttgtgggttaaaggg

SEQ ID NO: 476655 - DNA, 735 bp, Homo sapiens
ctgccagcacgctgtcacctcagttccccgccacattttctgaatatccctatacttcctcagcagtccacaaaggttgagcgatggagcaattccaccccacctgcatgttgccgaccaccccaggattccccctgcagatgccctttcctgactcattgtttggtctctcagatcctgtttgtgatgccaattgttatgagcaaaacttgggactggacagtgaaaatgagaaaaggagaataaaagggaacaaaatggaagagaggaagctaagcacatatttctgggtatattttgcagaagacacaggatgcaaagtacaagtggaagagaaagtggggatggagccaaagcgtctgattccggatcagaagattgagggttcgagtcccttcgtggtcgtcgttttgcgttctctggttcgaaagatatttgttgattcagagcattttcccttttcttgctccggtctggctgccaattaacaactaaagatatttcatataagtggagttatacagtacttgtgtcctttcatacctagcctatttcatcactaagcaaaatgttttcaagtttcatccatctcacagcatataccagcatatatcccatattgtatgtatattcattttttaaaatttcttatattttgatgcctattctgcttacgcagttttatttttgttattttgcttatctgctcatctgttgatggctggattctccttt

SEQ ID NO: 476656 - DNA, 992 bp, Homo sapiens
ggaaaacaaagggggagcaggcatatcgcctagcgagaatggagcaaggaggccccaccggaccccacctccaatattggggattacatctcaatgaatttccttttccatttctttcattaaatcgcgaacgtagtaatgacttaacgctggttacgcattcattacaatcgaagattatattaatttgcgatgaaaccatcaaaaataaaagtgatgaaactgaaattgaaagcagcaaggttcacgctcaaggttatcggaaacaaggcaaaaggagagaaatgaaaggaaccctggaatcatttgctggcattcatcctttcaagcaaggtgcctgttacaaaatatctgctcaattagtatgtattggatacatcttttggaagtctcctagccttaaaagatggtctaaactaccccagatccaggccccttcttcagcattccttgcttctcagcatagcccgagaacccccgatccctgacactttgcttcttctcagctcccagatggatcctggacaggatgctgcaggtggtgcaggaggggaatcctgccccatttatcatcaacacagtaaaaaggggtcgaagagaccgagagcgccagaggacgccatgggctccacatccacttggattccagggaaggcggtacatctacgaaagccctaatcatagagggaaagactcctcgttcctggcccagaaatgagatgagaaatccagggccccgtacaggaaggcctttcgcaaagtccagactcaattgccttcgcagcccttaaagtttccttaggaaggtctgtgggagaacgaggttggtttaggaattggcccctgccttgtactacgtagttttgtcatccaaagtgttttagaagtgaattgaatcatagttacgccttattttgaaacactgtaattcagagaacgtaaaaccttattaaaatgcctcataatcatcttggtagagccgttggttaagc

SEQ ID NO: 476657 - DNA, 960 bp, Homo sapiens
gcaccgtgcatcgctctgagtgaggcgacttaaatgcgcgatgttaccgttttcagccgagcccttcagcccccccactgcactgtgggagcccctttctgggctggccaaggctggggtccacttcctcagcttgcagggaggtgtggacggagaggcacgagcgggaaccggggctgtgtgcggcgcttgccggccagctggagttccgggtgggcgtgggcttggtgggccccgcactcggagcagccagccagccctgctggccccgggcaatagggaacttagcacctgggccagtggctgcggagggtgtactgggtccccagcagtgccagcccaccagtgctcctcccatccactccatgggctcctgtgcggcccgagcctcccggacgagcaccaccccctactccatggtgcccagtcccatggaccacccaagggctgagaaatgcgagcacagggcgcaggactggtagccagctccacctacagccccggtgcaggatcctctaagtgaacccagctgggctcctgagtctggtggggatgtggagagtctttatatgtagctcaggattgtaaatacaccaatcagcaccctgtgtttagctcaaggtttgtgagtgcaccaatcgacactctgtatctagctgctctggtgaggacgtggagaacctttatgtctagctcagggattgtaaatacaccaatcggcactctgtatccagctcaaggtttgtaaacacaccaatcagcaccctgtgtttagctcaaggtttatgagtgcaccaatcgacactctgtatctagctgctctggtgaggatgtggagaacctttatgtctagctcagagattgtaaatacaccaatcggcactctgtatctagctcaagatttgtaaacacaccaatcagcaccctgtgtttagctcaaggtttgtgagtgcaccaatc

SEQ ID NO: 476658 - DNA, 3565 bp, Homo sapiens
cagctttttaagatttcatgtataagtgccccataatggcacacagctttactcagcaacccctgccagcttccaagccccaggatactgacctgcaccagcacatggggcagcattacctccccaacagtgtggagaagagaacatttcaccactgggtgatgagagtagacagtgactcttggcttctcaatgctagacatgattggagacctttcattgttctattagaaaagtccatgaagaagctgagtcactgcgggccaagaacatgggccagaaacgagtccgggtactctgcaactccgtgcaaagttccgaggtttctcaccctccagcccaggttctatgtcctccctctgtccaccctcaatgccttccctccgaagatcggctcggagtatgccagtcttcctgatatcctggcagaaccaataattcatgatgactacatagtggaggggtctgcaaacagccacatatctgtcaaaggacataacagccagaaggagacactctgtagcacctagggccaggaagatgatgaggtgggccacacagccagcatagctgatggtctttttgttgcaaccaatatttaccaacatatgagggactgtagttgtggtatagcagagatctaagatggagagattagtgagaaagaaatacatgggagtatgaagtttgggatccagaatgcacaccatcatgatggacacattgccaaatatggtgattgtgtatgatattaacaggaccacaaaaaggggcatttgtagccaagccctatctgagaagccaagtagtataaactcttttggggagctctcattttcccaattcatgatgactcacttatttcgcactcctaaaaaaatgtaagataggaaagcaatcaatgtttgtttattgaatactcttactggagctgaattaaatttaatgaatagctcagcatcaaatacaatttacagtcaagtggataaagcccttgtaaagtataatatggttatgtttaagcttaaaagtagttcctgtgttttcagtagtgtttaaattactttaaagaaaatcattacatttaaatgacataaagtatgtaacatatgcataacacatggaaaattgtgagttctcaatgcattttatgttctctcctcttcttacctcctaacctatcttaataaacagtttagaaagaaatattacttttactccaattattttaaatttggcctgaaaatgctgagtaatatagagggtataagagttgaatctaaatctgcaattgatctaaagaaattttgcttcttttagtaacatctttacgtgtttttttgagttgtgtctgtctcctaaatgccatgcatgtaggtccatttccacaaagaactaccgtgggtattagtaataaaattatggctacttgtgatatatagtaatgaccacagatgtcatctccccatctgcaaataccttaattaaaatagcaaaactgataacataattgttgctttacttaacatgtgccagaaactgctcagtgtgtgaaatacattctttgtaattctcatcaaacccctcacagtcatggtttgcattttattgcttctgtgattcagtaagaataaataatttgcacactcattattggtgaggtcaagactaacacctaggatttaaagatcattctttcttttataccgtatttccccctaaatacacagatagtacaataagaatgactgcatacagcacaaaagtggtcataaattaaaatagaaacaaaccaaaagtcatatattcaagttgattttcttcagtctgtaaaagtcatcagttatttagttatattacctaagtgcacctaagtttcttcagtctactttgcatgtttaaatgaaatgtcatcgaggtggtttacaccatttgaatttgcaagcataaaaatagaaagatagactgaagagagaagagaaaataagtattgacacaatttaccacagaataagataacttttccagagtaaaaacactgatatataaagtataatttgataatggaatgaataaatgaaaatgaacagagatgaccttgagatttttaacttcttccattatatatgattttttttagctatagatacacattattttttggcaaataacagtaatacacctttggttgaaaaatagaagagaatatgagattaggcttttttgaatgtccatgtaaatttacaaaatgataaatatgtaaggtaatacatacattagataacttgatttagccactttataatgtacacatatatcaaaacatcatgttgtacactataaatatatacaatttttactcattaatacaattttttatatcagaaaaagactacacagaaagataaaacataaatggcaagatagaaaaatatacaatgtttatggaaaaaatggttattatattaaaatataaataattattacataataaatagaaaaagatcaaaagtccaatggaaaaaaatgagcaatggacataaataagcagtttggggaagaaaacaacataaaatgacagtgaaagtataaaagattataactttttcattattgaagaaacacaaataaaaacaagaagaaagtatcacattgtcttcctacttagtagcattaaaaaaaatcactgttaaaggttagctgttaggtacagtgcctctggagccagaatctgccagggttttattactggattgtgtgatcctgggcaatgaatgaacattcttgtgctacattaaaaaacaatctctgacttgataaaaagagagtattgtgaagctcaagtgagacaatgtatacacatctgaacttaggaccctgtcccaagcatactaagcatttaatgaatgtgagcttgatatcaatagcagtatcattaatactaatcactaataagtcattaatagtaatactatatcattatctcagcttgtcttgtatatgagaaaacagaaaatttactattggtggttcaagtgattgttataatttcataatattataacatgaaattattgaatttcatattatcactttgtctttgtttctagcataatatactgagtacatagttttccagtaaatggaagttaaatcaatgtagtaggtgatatctggttatctaaagggcatggaataaaagaggaccctattcagtagctgttattttctactcctattttttcacgtcctcttctcttcacattttatatggcactgataatttctcttattttcttcatattttatatggcgccaatttctcttttacgttatcagaaaatgaacttacctcttgacaagaacatgttgattccactgtcacgttgactttttgtcctatttctattttctacatgaatcaaaagaaatcttaaatcccactgaccgtttttatgtacggagatataatgagcaaaccattcaaaagggtgaaaggatacgaaggatttttggaatcactgaaaatacttcatattaatttcaaagttcccaggaaacaaat

SEQ ID NO: 476659 - DNA, 1885 bp, Homo sapiens
gaagctgcaaacttttctctacgtaataggaaatgaatgatgatggaaaagtcaatgctagctctgaggggtactttattttagttggattttctaattggcctcatctggaagtagttatctttgtggttgtcttgatcttctacttgatgacactgataggaaacctgttcatcatcatcctgtcatacctggactcccatctgcacacaccaatgtacttcttcctttcaaacctctcatttctggatctctgctacaccaccagctctatccctcagttgctggtcaatctctggggcccggaaaagaccatctcttatgctggttgcatgattcaactttactttgttctcgcactgggaaccacagagtgtgtcctactggtggtgatgtcctatgaccgttatgcagctgtgtgtagacctttgcattacactgtcctcatgcaccctcgtttctgccacctgctggctgtggcttcttgggtaagtggttttaccaactcagcacttcattcctccttcaccttctgggtacctctgtgtggacaccgccaagtagatcactttttctgtgaagttccagcacttctgcgattatcgtgtgttgatacccatgtcaatgagctgaccctcatgatcacaagctccatatttgttctcatacctctcatcctcattctcacttcttatggtgccatcgtccgagctgtactgaggatgcagtcaaccactgggcttcagaaagtgtttggaacatgtggagctcatcttatggctgtatctctctttttcattccggccatgtgcatatatctccagccaccatcaggaaattctcaagatcaaggcaagttcattgccctcttttatactgttgtcacacctagtcttaaccctctaatctacaccctcagaaacaaagttgtaagaggggcagtgaagagactaatggggtgggaatgagcctgtgtatgtgtcatattaacaatataacagagtctcccctcacaatgattcatccttctatttatttatcaaccattcttttattcacgcactctgttagcacttgctgagcatgtactctaacaaggtcgtggagttcctggtaacaggtaggaataaaacacagtcagcctaaataccattcacttgtggagaaaacagctatgtaaaatcaagataaaacatctatagtgatgtttttccatggtacaaacctaatgtatccaagacagacatttctcgattgaaaataaggcatgaaatttgttgtaaatcttgataaaagcgaagctgtaaatcctatgaaaagatgatactctcaatttaaaaatctctacaatatgtcttttaatttcttgctttttgggcagaatacttttgtcttctatctttagtttagttaaatacacagcaaaatacttcaaatccttttctccaacaatgcttattctttgtcggatagtaaattttgagaggaattttggtccatattctttcatatccagtatcaatagtagaacaataagttttatgaattgtagtaagagaggctttgaaacagtatagcagaagtcagcatctgagatccctcttttttgcaaggcagtgagaaatatataggaagtaaaaggagctggtaaagctgagctatggagcttataaacaaatggtcatcataggctaggtatacttaggtgagacttttcattttcttttgggaggttataattatagtatatctaatgttgaatcctagccatattagcctgtgctgtgtaatttgtaatctgagaaatagatcagttaccaaaaattccaccaaagattaacactggtattactgtttttattgttttgtacttttcaaaccagtc

SEQ ID NO: 476660 - DNA, 918 bp, Homo sapiens
tctctctcggtgaaagcagtgcttcctggctgcaactaattggacatcttgtcccttcccatctgtgaaatatggtcatagttcttgtgtccttgaaggatccaaaactccacatccctatgtatttctttctttccaacctttccttggtagacctctgtttgaccagcagctgtgttccacagatgttgattaacttctggggcccagaaaagaccatcagctacattggctgtgccattcaactctatgtttttttgtggcttggggccacggaatatgtccttcttgttgtcatggctgtggattgttatgtagcagtgtgtcatccactgcaaaataccatgatcatgcacccaaaactttgtctgcagctggctatcttggcatgggggactggcttggcccagtctctgatccagtcccctgccaccctccggttacccttctgctcccagcggatggtggatgatgttgtttgtgaagtcccagctctgattcagctctccagtactgatactacctacagtgaaattcagatgtctatcgccagtgttgtcctcctggtgatgcccttgatcattatcctttcctcttctggtgctattgctaaggctgtgctgagaattaagtcaactgcaggacagaagaaagcatttggcacctgcatctctcaccttcttgtggtttctctcttttatggcactgtcacaggtgtctaccttcaaccaaaaaatcactatcctcatgaatggggcaaatttctcactcttttctacactgtagtaaccccaactcttaatcccctcatctacactctaaggaacaaggaggtaaagggagcactaataagattggggaggaggacctgggattcccagaataactaacaaggttaacatatgtttacctttgctt

SEQ ID NO: 476661 - DNA, 619 bp, Homo sapiens
acagtcaagtgcctattagatatgagggaaaaggccctgttggaaggctgcaggcctgccgtttttgtctcagtagagctgctgtggaacctaaaaggacctgacaaaacaatcacattcctgggttgtgtcatccagctctacatctccctggcattgggctccactgagtgtgtcctcctggctgtaatggcttttgatcgctatgctgcagtttgcaaacctctccactataccgccgtaatgaaccctcagctgtgccaggctctggcaggggttgcgtggctgagtggagtgggaaacactcttatccagggcactgtcaccctctggcttcctcgctgtggacaccgattgctccaacatttcttcgtgagcttctggatctgggtgtgggcatgggatagtcagatgggaatggcaccagttggaggaacatgggtaagagagggtgaaaggtaaagtgctatctctgagttttttgtaaaagctattttgggttttcccgaagatggacgtcttcatccaaactctactttattgctatggcaagtcttcattcatgtgatatagttttaaagttattttggctttatccatttggtactgatggactttg

SEQ ID NO: 476662 - DNA, 494 bp, Homo sapiens
tggagccaccattttgatcatgcttaatcccagtatttcttctaaccatcaggcctctctgctgcaggtctcctggagtttgctggaggtccactccagaccctgttcacctgggtatcaccagcagaggttgccggacagcacagattgctgcctgttccttcctctggaagctttgtttaggaggggcacctgctggatgccagctggagctctcctgtatgaggtgtctgtcgatccctgctgggaggtgtctttcagtcaggaggcatggggagactatttcgagcacctctatgcacaaaaactagaaaacctaaaagaaatggctgaattcctagaaacacactacctttcaagattcaaccaagaagacagtaaaaccctgaacagaccaataatgagttctgaaattgaatcagtaatttaaaaacttacaaatcagaaaaagccctgtaccaggcaaattcacagctgaattccactagacatat

SEQ ID NO: 476663 - DNA, 2072 bp, Homo sapiens
gctttattgctcacacaaagcctgtttggtgatctcttcacacggacgcagagagactatggtcaatttgacttcaatgagtggattccttcttatggggttttctgatgagcgtaagcttcagattttacatgcattggtatttctggtgacatacctgctggccttgacaggcaacctcctcattatcaccatcattaccgtggaccgtcgtctccattcccccatgtattactttttaaagcacctctctcttctggacctctgcttcatctctgtcacagtcccccagtccattgcaaattcacttatgggcaacggttacatttctcttgttcagtgcattcttcaggttttcttcttcatagctctggcctcatcagaagtggccattctcacagtgatgtcttatgacaggtacgcagcaatctgtcaaccacttcattatgagactattatggatccccgtgcctgtaggcatgcagtgatagctgtgtggattgctgggggcctctctgggctcatgcatgctgccattaacttctccatacctctctgtgggaagagagtcattcaccaattcttctgtgatgttcctcagatgctgaaactagcctgttcttatgaattcattaatgagattgcactggctgcattcacaacgtctgcagcatttatctgtttgatctccattgtgctctcctacattcgcatcttctctacagtgctgagaatcccatcagctgagggccggaccaaggtcttctccacctgcctaccacacctatttgtagccaccttctttctttcagctgcaggctttgagtttctcagactgccttctgattcctcatcgactgtggaccttgtattctccgtattctatactgtgatacctccaacactcaatccagtcatttatagcttacggaatgattccatgaaggcagcactgaggaagatgctgtcaaaggaagagcttcctcagagaaaaatgtgcttaaaagccatgtttaaactctgaagaaccatacaaatgaaaggcattgttattatgtttcagattggaagagaggtgaatcttatttctacccagaatgctcttccaagctgtctattgtatatattcctctcaaatataattctttaaaatttaagatgttgtgctctaataattttagctttccttcctccctccaattcaagtgttattttaagtcatctttggaaaatttttctgaaatgaaggagaaagacaattagtttggagtctggcctgtataatttaaaacttgttattaacaaataaggttggagatagatgaagctaactgggttaatattatggtgcatatatggtatttccagtgggcctcctagttttctatccatattaagtattcatattaagttcttttactattattacagtggtgatttcaacaatttattcagcccctacctaaatagcttgaggtgtttttttatttttgttttttcgcttttaactttttggaacactttttgctcatatctctcgatctgctttcttatgcctgtgctagcgtataataaaactataataataataatgacatgtaataagtactacttatgccaaggattattctaggcttcaaagaaggaagattacaaaaaacaatgcaactgaaattcatacttcataataatggttaaagcaataaccattaatagttcataagatttgagtccaataacttttaaaggcataattctttatgagcgtattttatttccctttatgcgcagctctaggctccttttcctacttccctgtttctaaaagaaaacatttttttaaaaccagcagttagtgcaactaatgttcacttagcatacagtgcaaacagatggaacaaaaaaaaaggaatattccttcttttcagcttttttctcttcaccagttaaaaaaggaaaaaaaaaattctgaactcttttaagtcttcatagttctgaaataaaagatgaaaaactcacaaagagaagagcactcctctctaaaaaatggtgaattctctaagagagcatgt

SEQ ID NO: 476664 - DNA, 757 bp, Homo sapiens
ttatacacctgagaaagcagcagcagttaccatactgagcatagccggaggagttcaccacagttagagaaatgaaggcagaaatggtgtgcctcatggttttaacaattacttctgcaagaggcctcttggggtgttgtggaagagacctggtgggaagtgattggattatgggggtggtttccccattctgttctcatgacagtgagtggattctcacaagatctgatgtttttatgactggtagttttttctacacttgcacaagctctcttgcctgccaccctgtaagacgtgtctttgcttctccctcaccttctgccacgatttttgaaaatgcaaaatcatcctttaaaaataaaaagtttattccatttgcaacaacatggatgaacctggagagcactatgctcagtgaaataagcctctcagaaagactaatactccatgagtccacttatgaccaaaaggtacataagtgcatggtgaagaagtgttttcatttgcaaaagttctatcgctagaaaaataaattcaagcaacatattgttaatttcttttctttaacttaggtcatcccaccttttcctatcccatgctcttcaatgttattggtatatagaaatactactgatttgtacattgattttgtatcctgaaactttactgaagtttttatcagctctacaagccttttggcaaagtcattaaggttttctaggtatagaatcgtattgtcagcaaggagataatttga

SEQ ID NO: 476665 - DNA, 1395 bp, Homo sapiens
acagctcccatgcaaagatcacaagtggaggctccaaccagtccagaagttcctttctatggggaagctgtggcagcaaggccgtgaagagagtctgacttaattgcaaagacgaggtttcaccatgttgaccaggctgatctcaaacatctgacctcaggaagtcagaggcaccaatgtgaggttccacctgctttccagcacattcttggtttcctcacttctgctagacaacgtttgatcagaaggaacagggaacgagaaggagctgctggatgacgataagcctgggaaagggaggctgggtgagcagagacagaaaagaaacacctacctgctgtgacctcacaaacacccaggctgagttttgataagacaggttgaatcacactggggtgacagcctcatccctccaggtacaaacaagaacaggccatggttaaccaaagctcccccatgggcttcctccttctgggcttctctgaacacccagcactggaaaggactctctttgtggttgtcttcacttcctacctcttgaccctggtgggcaacacactcatcatcctgctgtctgtactgtaccccaggctccactctccaatgtactttttcctctctgacctctccttcttggacctctgctttaccacaagttgtgtcccccagatgctggtcaacctctggggcccaaagaagaccatcagcttcctgggatgctctgtccagctcttcatcttcctgtccctggggaccactgagtgcatcctcctgacagtgatggcctttgaccgatacgtggctgtctgccagcccctccactatgccaccatcatccacccccgcctgtgctggcagctggcatctgtggcctgggttatgagtctggttcaatcgatagtccagacaccatccaccctccacttgcccttctgtccccaccagcagatagatgactttttatgtgaggtcccatctctgattcgactctcctgtggagatacctcctacaatgaaatccagttggctgtgtccagtgtcatcttcgtggttgtgcctctcagcctcatccttgcctcttatggagccactgcccaggcagtgctgaggattaactctgccacagcatggagaaaggcctttgggacctgctcctcccatctcactgtggtcaccctcttctacagctcagtcattgctgtctacctccagcccaaaaatccgtatgcccaagggaggggcaagttctttggtctcttctatgcagtgggcactccttcacttaaccctctcgtatacaccctgaggaacaaggagataaagcgagcactcaggaggttactagggaaggaaagagactccagggaaagctggagagctgcttaatatactttc

SEQ ID NO: 476666 - DNA, 605 bp, Homo sapiens
aggacatgtgaacatgagccatacgggaggtgagtggttggtggacaggcaggtggtcttctccctgacagtgctggtggccctctgtggactggtaggcaatgatgtgatctgctggcttctctactcacaggtctggagcagcccctatgtgacctacatccttaacctggccactgttgatatggtcaacctctcctgtgtaactgtgatcctgctggagaaaatcctcatgctgtatcaccaggcggcattgcaggtggctgtgtttctggatcctgtctcctatttctccgacacagtgggtctctgtctcctggtggccatgagtattgagagctttctctgtgccctctgtcccacctggtgctgccaccgcccagagcacacctctgccatggtgaggtgggccctggccctttctttgtatgcagttagccaggtctggggctcagctcctccacaaaggcagggactgcctatgcacaaggctgtaaaagggatcatgtctggaaaacatgctgaatcctccaaggagcagggtgaatgttcttgagattatttattacctttgtgtattttcagagtaaccagatttctgactg

SEQ ID NO: 476667 - DNA, 2443 bp, Homo sapiens
atgaggaaagggcaagccctctgccctctgcccttcctattgagaggcacatctcagcacagctgactgatcattctcgggtaagtgtgacctgctgtctccccttcctgctgacatgggggcagatgctaccagatggcatcactggcctccggggcgctgtggagggtaatgtcgctgagctcccaccaggtgctttctcttcactgaccatgtattgcagccgtctcattcaccctcacactgacttcgtggaatgggtgctaatgtacccatttgaagatgagatgcctgagactttaagtgtgggctctgatggttactgtgggacccaccaggcactggagttttccagtttgggagcagagctgggagccctctgccctcgaatagttgtggaaaatgaagaaaccctggaggtctggccgaaaggactgtggaatctgccctccctccaccaaagggaggctgctttggagacaatagatcaagccttctccgaaccaaacatcctccttcttgactggtgttattcttcaaatggattcactggccacatggacacaggagatgaagatgtttacatctacaaggcaacactgacaacaccaaacaccatagaggatgtggagccacaagaactctgtgcattgctgctgcaaaatgctgctgctgctgaatgcaaaatggtacagccgccttggaagacagttgggaattgctcacaaagctaaatgtacttgtaccacgtgaccacaagtgtcatagacgttgacctagctgacttgaaaatgtatgtacacctaaaacctacatgtcacattcactgccttattcattatcactaaaacctagaagctactgagatgaccttcaacacaggtcccaggggagatggaggaattcaggggaatgggcgcatcccatgaaatgaggttatacctgtttggtataataaaattacaggttaaatctataaatataaattataattatagattattaggttacatttatttggtataataaaattatacagtaggtattgtcaaatatgaaattaatatctaatgattgtattataccaaataaggcaaatatgtgtcttttggacttaaggggacctaatatcaaaaaaattaatgagtcaaaaggactgaatttagaatttaattttgaaaaaatcaaatatcaaaactttaaaacacctgctatcacaaaataggatcattggtcattggtcattgtaaaataagtcattcatttaaccaaagtgataactcaaagatttcaaaaaaaaaaagtcaaaagacaaaaccattactctttgagagaggagacttaattttccaaacaataagccctaataaagatagcatgaggccaatgaaatctgtttctcaaatcttataaacaaatctattaaattttaatgatcttcaccatactatataatttccaaaaacctttttgtaacattttataattttttaaatgaaaaagtgggttaatactccaagaaaaccttgttaatctgacacaggagctcagaggttagtcttgcatcagtgagcctttgatactaatctttacagagaaactgtaaccaagataaaaccaattttatctttcaaaataggctcttacaatcgcatgtacccacatcttccacaatagcccctggactttgaggggtaagatagtttcaatttctggccctgtgtttcatgagtgcagtttcttttgattatcatcttctcctggttctgaagatacggttttagaagctttcagtgtttaagatttagcaggacttggtgtcctttttagatacaggagtcaaagccctgtaactcaacagaacaaggactttaaaagcaatacagaacattgtatggatgttaataactttaattttttaaatctcagttttcctaggcaaataaaaaacttaatgacataggaattgtttcaataaaatataaaatctgtttgttaggccagttaccaaaaggcaaaaaataaataaaagacctgcagcaattgcttttccctagacttcaagtcaaaactaatgaaaatggtacttgaattagttagatataggaagggtgtgtcttgcatcataagtgaaaattttcagtttcatagaaaaacttcaaaccaagagcacagaatgttatattggaagaaaatatttcctttagacctttaagataaaacacttttagcatcatgtcacagtagcagttagaacctgaggaaaaaaaattatagaaactgacaagaaagttggagagagcgattatctcaggacttatgaaggggagagaaaggtgaaaacagtgagattcaataaaagttgaaatctggggtaaaaaaattaaaatatcttgtaatttgttaagagtaaattaatatcttaagaaaattttgttcttct

SEQ ID NO: 476668 - DNA, 1170 bp, Homo sapiens
tttgtctttgcagggtgtgcccaggcagccaaggcagcccaccatggcccagtttctctcagtgttctctgggaagctggattgggacaacaggacagagaccccaggacaagtgaacatgagtcatacgggaggcgagtggttggtgggcaaacaggtggttttcatcctgacagtgctggtggccttctgtgggctggtgggcaatggtgtggtctgctggcttttctgcttccaggtcaggagcagcccctacgtgacctatgtccttaacctggccgctgctgatatggtcaacctctcctgtgtaactgtgatcctgttggagaaaatcctcatgctgtatcaccaggtgacattgcaggtggccatgtttctggagcctgtgtcctatttctctgacacagcaggctttataatatttcacatgcttatttgtcttgtggtgggcatttccagcctgactttgatcatcaggagcctgtactgcctgaagaactgttcacccatccggatctaccacattgtccgctttgtggccatcagcttcctggtttggggcctgcccttagttgtccttgtgtacctgccaggaaaagaatacctgacctttgcctttgaccttctgttgctgctgtccatggtagtcagtatggctcaaccagccatctacttcttggctggctacctttgaaggaagaggcatagggagtccttaaagttgttctcccaagagctttgttgaatgagatggaaggtggaggaaacaaggggtttcaggcaagggaacagcaggttaccaggactgagctcctcccactccaggaagctgttccccaggactgaccatgatgccctgtattggtccattctcacactgctataaagaaatatctgagactgggtaatttataaagaaaagaggattaattggctgacagtttgacaggctgtacaggaagcatggctggggaggcctcaggaaacttacaatcatggcagaaggtgaaggggaagcaggatccaaactcactttatgacaaaagaaatgttcattaggcacttcaccatcttgtaaaatattctgagagggacaatctgcaacaacgcaaagcttgtggggtttgaggtgggaaaggaaaataaaactcaggactccaattcactatg

SEQ ID NO: 476669 - DNA, 1415 bp, Homo sapiens
atccgttgttgagcacattaatggtttcctcactcccactagacaatgctccactctccaatgtactttttcctctccaacctctccttcttggacctctgtttcaccataagttgtgtccccgggatgctggtcaacctctgggagccaaagaagaccatcatcttactgggctgctctgtccagttcttcatcttcctgtccctggggaccactgagtgcatcctcctgacggtgatggcctttgaccgctacatggctatcttcaagcccctgcgccatgccaccatcgtccacctctgcctgtgctggcagctggcatctgtggcctgggtcattgggctggtagagtcagtggtccagacaccatccaccctgcgcctgcctttctgcccccatcagcaggtggatgattttgtctgtgaggtcccagctctaattcgactctcctgtgaagacacctcctacaatgagatccagatggctgttgccagtgtcttcatcttggctgtgcctcagcctcatccttgtctcttatggagccattgcctgggcagtgctaaggactaactgcaaaagggcagaggaaagcttttgggacctgctcctcccatctcactgtggtcaccctcttctacagctcagtcattgctgtctacctccagcccaaaaatccctatgcccaagagaggggcaagttctttggtctcttctatgcagtgggcactccttcacttaaccctctcatatacaccctgaggaacaaggaggtaaccagggcattcaggagattgctggcgaaggaaatggggctcatacaaagttgagggagagctgtttaatgtgctttctaaattaagaagaaattatttatccttttgtgaacaagtttgagctcccaagtatactacctttcatacacccatcacagtgtttacaatgggtcacagtatatgagtgtgtgtgagagagagaaagagacagagaaagactaagagtcaggatggttcatctccacttgcttgaggtggactgacaggaagctgacactcagagaatttagtaatttcacccaagaacacacagcaatttgttagacctaaattgagatgcatatctgttaacttaccaagtgcatgctgttggttttacaccattataaatataccaacatcattaggatttatacccaaatgggttatcaggcagaaaactctatttttccagtcctagtaagttttctgatcatccagctttccagggatcacaacactaatctcctgccaaatcctgaaaatgtgctcccattcctggagatgattttcctttacctcttctcaacctctgcatgacagtgaccatgaggagttgtgagtctgctcttcagtggctacacagtgctaacagctgtcctg

SEQ ID NO: 476670 - DNA, 650 bp, Homo sapiens
gaaagtctgatgagttatgcccagtctccttcctcctcccgccggcatgaggtttggggccctgtggatgaaggaagttcatgggaggcaaacgtgcctgggcaagcaacagccgcagagattcagtccccacgggggccaggagtggataaagctagaaagagacaccacagaagagaagatgtttgaacagctgaagccaatcgaacctgtacagaagacgctcccatgggtgggcgaggtagctgccaccctgcaggaagccatgaagagagattgctggagggaggcacgggtgaagaagaagccagtcacctttgaggatgtggcagtgaatttcacccaggaagagtgggactgtctagatgccagccagagggtcctttaccaggatgttatgtcggaaacctttaagaatctaacatctgtggatgtgaaggggccatacctgggaccaactcaacgctttctcattcccacacatcagccagaatctttctgcataagccagagctaatcaccaagcttgagcaagaagaggaacagtggagagagtttgtccatctcccaaacacagaaggcctttcaggctgggccaccctttttttgctacacctgtggcaaatgtttcagcaggcgctcctacctct

SEQ ID NO: 476671 - DNA, 1325 bp, Homo sapiens
tgagggagtgaaggcccggactccaggcttggagctcacaggctgattcctgggatgagcagcctccacctgcaggagcagcagcaggaacaagggaggggacaggagggcaaggccccattttggaggctgagggactaggtcatgtggtagcaatggtttgggggtggatgagccccagatatgatcccactgttttggcctggaggtatctcttccctaaagccaaaatccagagtcactcagtggtgggaggaaacaaatccataaagaaaaaagatattcatgtctctgataaagaaaagaaatgccagcaatccagcactgagaagggaagctacgagaccacattttctgcatgtggagaagacacgtctaatggagagaagctcccagaagcccttctgaggccatctccaggaggctgccccagcgggtatgaggccttgcgcttctgccatcctgtgtgtccctgtgatggaattttggcccagctagggatggcaagaggccaggtcatcgcaggtggtctgcaggcctggggaaatttcctgaaggaaacaggaaaaggaacctctattcctcgctgcatatcttttatgtaggcctttcctgttattcaagcatatccccagcagatggcagagaagacatttcaatttcgtgcctctgcttttcctccccctcctccaaccggaaagtcaggaccaagggaatggatgaaggcattaaaggtataaatgagaatgggtgataatttccctttctctgagctggggagtcccattgcaagggtgggaatagaaatgtccagtgtaaccattcagagatgacagatactgccctgaaaacagtcacaaaatcaaaccatgatgtgcctccctgggctccttggctctgggctgctgctttcttttattgagaatctaagaggtgctgagcattcagttaaaacgggactcaagggttcctgcattgtcctctgccttaattgcatttgaaaatatattttgtcagttcaatccttctcctgcccgtctctgtttctctttttaaagaagctgaacattggcaccttcaaaagaaaattgctaacatgtgaaataatatattgtctaggatttagttgaaaataacctggtgttgggctatggttgaggatgtagataaatcaagagtgggtgttactgagtgaagggtacagtgaaggtcactttactcttctgtctacttctgtgtttgcttaaaatatttgtacaagtttaaaaaaataagaaccagggttaccagggggcatggcatatgctgaataatcatgagatacc

SEQ ID NO: 476672 - DNA, 819 bp, Homo sapiens
tggacagagcccaggtgaaagccacccctgctcctcctcccgcatctcccacaggctcagcaccatcgtcggcctggagtgcacctggactgagctcatcatgctctgtccctgtttgtgtcagtcacactgggtcccccacatactctgcacttgcatccccacaaggctctgcacacctctattctgtctccccgacctccccagccacagaaatcttcccagtgcaccccctggatttctcagtccacatcagcaaaacctcctcagcctctctcaggatgttcctgcatctcgcagctccagcagcaacctgggtttccctgaggacatgaccccctccgaagtcctcccacatgggggagtttccccagggacttgtacccctgggttcagagtcttaatcgttggaacctgtgaacaggttgcattgcgtggcaaaagggatattactcatgtaatgaagattaaggaccttaaaatagggagattctgctggactctctgtgtgggcccaatcaaatcacaagagccattaaaagcagagagcctgccctggttggagtcagattctgcagaggaggaaggcagaggagaagctggagaggggaggtcagaagttccaagcaggaggattgaatgtgccttaggcaccgtgtgtgagtatctgagagaaggctctaggagctaagggtggctcttaacaaggaagtggaaacctcttttctatctgcaaggaagtgaattcaggcaagaacctgaatgagcttggaagtggattcttccccagagtctatggaaaggaatgcagaccttccc

SEQ ID NO: 476673 - DNA, 949 bp, Homo sapiens
gctgggaatgggtctcacacccttcaatgggtacacagctgcgacgtggactcggactgcagtctcctcagtgggtatgaacataccctatcacggcgccagttacctcgtccgaaaccaggaactgcgctcttggactgcagcggacaaggcggctcagatgccctggcggaggaacaggcagagctgctcaaaacctacctgcagggaagggtacagaaccttccagaagtgggcagctgtggtggtgtcttctggagaggagcagagatacacatgccatgtgcagcacgatgggctgccagagcccctcaccctgagatggctgtcttcccagcccaccatccccatcatgggcatcgttactgtcctggttgttcttggtgctgttttcaccagagctgtggtcactgctgtgatatgggagttggcttgtatcctgcctagtcatgaggcaccatctctgtctatcaacacttactcttttgtaaagaacttgtgaaaatgaaggacaaatttatcaccttcattggagtcatgggaacctgactcccagcagtcacaggtcaggggaagtcacatcatctgtgggctctgaccagattttgtttttgttccacccgaaacagggacagtacccagggctctgatgtgtctctcaaggcttgtaaaatgacaacttagggggcctgaagggaaggaggagttggggcataggggacacaactaggctctggagattctttgatttggaatttttcagggtgtggtgggctgttcagtgtcacaacttactatgactgatctgaatttgttcatgactattttttttctaagactgccttgtgagggactgagatgcaagatttgttcatgcctcccctttgtgacttcaagggcctctgtcttctctttctgccaaggtgtctgaatgtgtctacatccctgg

SEQ ID NO: 476674 - DNA, 1435 bp, Homo sapiens
gggactcggagtctccccagacgccgacgatggggtcatggcgccccgaaccctcctcctgctgctctcggggaccctggccctggccgagacctgggcgggctcccactccatgaggtatttcagcaccgccgtttcctggccgggccgcggggagcccagcttcattgccgtgggctacgtggacgacacgcagttcgtgcgggtcgacagtgacgccgtgagtctgaggatgaagacgcgggcgcggtgggtggagcaggaggggccggagtattgggacctacagacactgggcgccaaggcccaggcacagactgaccgagtgaacctgcggaccctgctccgctactacaaccagagcgaggcggatcacttactccccgctccatgcctcacggacggccctggtcccctgagtctccgggtccaagatcgaccccgaggctgcgggacctgcagagatcctcgacccgggagagccccaggcgcctttacctggtttcatcttcagttgaggccaaaatctccgcaggttgctagggtccgggccagggctcggtgggcggggctgaccgcgggaactgggccagggtatcacatcctccagggaatgtttggctgcgacctggggcccgacgggcgtctcctccgcgggtatgagcagtatgcctacgacggcaaggattacatcgccctgaacgaggacctgcgctcctggaccgccgcggataccgcggctcagattacccagcgcaagtatgaggcggccaatgtggctgagcaaaggagagcctacctggagggcacctgcatggagtggctccgcagacacctggagaacgggaaggagacgctgcagcgcgcgggcataacgaggtcctgggttctgggcttctaccctgcggagatcacattgacctggcagcgggatggggaggaccagacccaggacatggagctcgtggagaccaggcccacaggggatggaaccttccagaagtgggcggttgtggtagtgccttctggagaggaacagagatacacatgccatgtgcagcacaaggggctgcccaagcccctcatcctgagatgggagccctctccccagcccaccatccccattgtgggtatcattgctggcctggttctccttggagctgtggtcactggagctgtggtcactgctgtgatgtggaggaagaagagctcaggacctgtgatcacagggacttggatgtcacctagggtggtccctacacatcgaagtccttccgtggagatagggagactctggcaggagtacacagaggagagggcatcgcaggcattcaatggaggagacatctatgaggaatgcaggtgaggggcccagatgcctctgcagctacagattcatcatccaatcactctcctactcccaccacccctgtgt

SEQ ID NO: 476675 - DNA, 707 bp, Homo sapiens
acacatttttatttctcttggacatatacctaagaatgggagaactgggttcagggagcttccaggtagctgaacaagtggaggtttttggagaatttgatttcctgaaaaagattggggaaaagatgcgaagaatagtccaggaaacagccctggaaggacaagagctgggtgggtctaaaaattggtctcttgataccacagagactcctgtgtgcaggggccaccccagggcttgtgaggacaatgacagaaaaagtaactcctacggctgtcctagaggagattggagacttggagaccagaactcagatacaagaagaagaacaggcatagtcttctgtcaaaacaaaacaatgaacaagatgggggctgagggccagacctaagcctgagcctaggctgacctggtcacacaaagcccttgccacagtcctagagacaggataaggcctggcccttctcctcctataccaaatgctctttgtcacacattctcccttaatccagagctaggagttacctttctccccaaatcaaacatatctgtgtgtttctcttcactctgggacttccctctcttcatatcatctgtacctagatgaaaatagatgttaagttttacaattgtgaggtagaaaaggattctgtaagcatgacccaaatatgaaaagccataaataaaaaaataaaacttctctatgtca

SEQ ID NO: 476676 - DNA, 747 bp, Homo sapiens
ggggactctgtctgtgcagtgcttctgtaagggctacaaaaaccgcatggagggcaaggtttggtgcaaaatcaggaagaagtgtgagcctggtttcacccaagtctgggtgaaagggccccgctacttgctgcaggacgacgcccaggccaaggtggtcaacatcaccatggtggccctcaagctccaggactcaggccgatactggtgcatgcgcaacacctctgggatcctgtaccccttgatgggcttccagctggatgtgtctccagatgacaccaagcagacccctgaatggacagcggcctgggaccctcgatacttcatccaagatgatcgcttctatggcgtcttcaccgtcaccatgactgagctcagagtagaggccttgggattccatgggtgtggaatctctaaatcccctgagatctctattgtcagaatcatctgcctggtggtatctcaagaaatcttctccttccaccttctcatcactgaaaactggggacatggagaagaaaagcccctggcctaaggtcacctgctgctgaagggcagagccagccccagaatgcaggcctgctggcttttggttcttccttccacatcgtacgtatcgcccttaacatttttgctgctactaacaggactcctccatttatttggaatgagtttaaagtttccccatgcttgagcacaaagggcttaatggtccattccagacatccctacccttgactctaactg

SEQ ID NO: 476677 - DNA, 853 bp, Homo sapiens
tgaccccagctttattcaccagctttattcttggccatgctgagagctgcccctagcaatagaggagcaggtgctgtgcctgaagaacttcacaaacacccaggacagaccctcctcctgcaatgccagtactcacccaagagagggccctatcagcccaaatcctggtgtcagcagacatctccaagtcggtgtaccttacttgtcaccagctccaagccctggacagcagttcagaagtctcattacacaatctgggacaagcccaatgctggcttcttcaacatcaccatgattcagctgacacagaatgactcgggattctactggtgtggaatctacaacgcttccgaaaacatcatcactgttcttagaaatatcagcctggtggtgtctccagttctgatcacttctccagaggggacctctggccatccctccatcaatggctctgagaccaggttacagccgtggagcccccaggccatgactcaaaatttggtagtgaggaaaggggaagaggatgcaggttgttaattgtggaggaaccatggaaaagacagttcaacatggatttctgcaataaaacaaaatggaacccagaaaatgtggaaattggaggccgtgttggtgtgttgagggatgggaccacccagttgtaggaaatcaagttcagggctcccacagattctacattatgttgagttgtataattatttcattatatattacaacatgataataatagaaataaagtgcacaataaatataatgtgctttaatcatcctgaaaccatccccgactctcaggtccatggaaaatttgtcttccacaaaacagttctcaggcgcc

SEQ ID NO: 476678 - DNA, 2665 bp, Homo sapiens
agtctctttgggttggtgatgtgacccacctgtcgtagagccgctggtgaatcccactgtctgtcaggctcctggtcaacccccttctctgggccatcccctctccagctccccaaacacccaggcgagactgactcagccagaaggttgccctggagaagaccaggtagtccctgttggcatgctcagaggacgtgtagatctctcatggatggtcaggacaatcaccagtaccaggatatctggatcagaaacctggatccccaccaaatggatctgctggcacctagacttcagccatctaggagttggggttttaagtgtgaccgcccaattcgccttacttgctgccctgcaaataaatgccttcctttcatctgctgcaaaccttggtgtggacgttttggccttactctgccagaccttcaggaaggcattagagcagttccccgagaggatccccagtggaactatcaggcagattccccaggcagcttacaaagctgttaattatgacaagcttaaagaaactactcaaggtaaagaagaaaacccagcccagttcatggcttatttggcaacaaccctgagacgctttacagacacagaccctgaagggtcaaaaggctgtctcattctaaacatgcgttttatcacccagtcagctcctgacattataaaaaagcttcaaaaattagaaaccggccctcaaaccccacaacaggaattaatcaacctcgccttcaaggtgtacaataacagagaggaggcagccagacagcaacgcatttctgagttacaattacttgcctctgctatgagacaaaacccagccacacctccagcacacaagaacttcaaaatgcctaagctgcacaagcctaagccgcacacgcctaagccgcagcagtcaagcattcctacaggacttcctccaacaggatcttgcttcaagtgccagaaatctggccactgggccaaggaatgcccgcagcccggaattcctcccaagccatgtcccatctgtgcagggacccactggaaatcagactgcccagctctcccggcagccacttctagagcccctaaagctctagcccaaggctctctgactgactccttcccagatctgctcggcttagtggttgaagactgatgcggcctgatcaccttggaaaccccctggaccatcacggatgccgagcttcgggtaactctcacagtggagggtaagtccatcccctgtttaatcaatacaggggctacccactccatattaccttcttttcaggggcctgtttcccttgcccccataactgttgtgggtattgacggccaagctttaaaaccccttaaaactccccaactctggtgccaacttggacaacattcttttatgcactcttttttagttatccccacctgccagttcccttattaggccgagacattttaaccaaattatctgcttccctgactattcctggactatagccacatctcattgctacccttcttccaacccaaggcctcctttgtgtcttcctctcatatcccccaaccttaacgcacaaatatgggacacctctactccctccctggcaactgatcacacgcccattactatcccattaaaacctaatcagtcttaccctgcttaatgccagtatcccatctcacaacaagctttaaagggattaaagcctgttaccacttgcctgctacagcataggcttctaaaacctataaaccctctttacaattcctccattttctgtccaaaaaccggacaagtcttacaggttagttcaggatctgcaccttatcaaccaaattgttttgcctatccaccctgtagtgcccaatctgtacactcttttgtcctcaataccttcctccacaactcactattctgttcttgatcttaaagatgcttttttcactattcccctgcaccccttgtcccagcctctctttgcttttacctggactgaccctgacacccatcagtcccagcagcttacctgggccgtactgctgcaaggcttcagggacagccctcattacttcagccaaactctttctcatgatttactttctttccacccctctgcttctcacctgattcaatatattgatgaccttctactttgtagcccctcctttgaatcttctcaacaagacaccctcctgctccttcaacatttattctccaaaggatattgggtatcatccccctccaaagctcaaatttcttctccatctgttacctacctcagcataattcttcatgaaaacacatatgctatccctgccaatcgtgtctgactgatctctcaaaccccaatcccttctacaaaacaacagctcctttccttcctaggcatggttggatacttttgcctttggatacctgattttgttatcctaaaaaaaccattatataaactcacaaaaggaaacctagctgaccccatagaccctaaatcctttccccactcattttcattacacacagccgaagtgcagggctgtgcagtaggaattcttacacaaggactgggaccgtgccctgtagcctttttgtccaaacaacttgaccttactgttttaggctagccatcatgtctctgtgcgatggctgctgccaccctaatacttttac

SEQ ID NO: 476679 - DNA, 2233 bp, Homo sapiens
agcttctcatcctaccctgtcctcactaacttggtcctcctcgatgaggataaaaacccaaatgcaagcagggatcgcacacacaacacagtgaaggctgtggaagagcactggatttggagttgagagaccatggccggagagtctgtgctacccttactggctgtgtgcacttggctggtaattaaaagtatcaaagcaaagtagggctgtctcattacatgtcctgtttatgtgactctaaggtacttagagatgatttgaagggctaggaaatcagcagcagaagttccttcacctccagcctgaagctggcaaccctgagatagaattccttcactccgtggctgtgccagagagtgagactcaggatggttccagaaggtgtagtaaccgcttcctgttgttgccagtacatggatacttcactcttccttactaattctcttaatcctgcgcatccctccataaatttcttcattaatgtctcttcatttgaaacaaagaaaggcagaaaaagggagaagaaatacctaaactttgatccttctctggaaatgactggtagatatttatgccttccccatagctgtcatagaaagacaatgatgaaaactacttgtccacaacctgctccttgctatgtatcgatcatcaccacagagaatcttcatcattgcttatatcatcatcatcatcttcaccatcacatcatccttataaccatcatcattgtcatcttcaccatcaccatcactattaacatcatcatgatcttcaccatcatcatcactatcattattaccagcatcatcattatcatctttaccatcactatcaccatcattaccattgtcatcttcactgtcatcatcaccatcactattaccatcatcatcatcatcttcaccatcaccgccacaattattacagtcatcatcaccatcagcatcactgtcactgtggagactattatcaccattgcaaccactttttacagcatcatcactgtcttcattattaccaaaaactacacatgcacttttgcaaaaggctcaacagagaaagtgaacctgcccctgtctgtgggaaaacttgtcattgatgattataacatataatctttgctaagaatttaccacatgccaggtgctgttctaaccactttacctgtattaacccttttaatccttgaacaaaccattatgtagggattgtcattattttaattttatagataaagaaactaaggcactgataggaagaccctgagagaacagcatggaatgaatgaattatcatagggaaaatgccaaccatgtctgagctgctgctccttttacagttcttgtgtaaaatacttagtgcacttgtgatcacctgtttaaactgtgtcttttcacttcaaacggtcaccgcaagagagcaagaactaggcctctgattcatgccatggtccagtatcatgcctgcaacatgtagctgctgaatgaatgaacaatgaaaatcctgattgctctctgatactattactacaggtctcagcatcttccagactctcagctttcccctctgaaaaatggaaataatactccaaattttgctatgaatattaaaaaaaacaaattcttcctaccagccaaggagcgtgaaaaggccacacgtaaatgttcccactgttggccctaatagaggtcagatggcagctggcatcgactgtcaggactgcgactgagacgcttctgagatgattccatttgactgtcactaatgtactaatgagagaccctgagaaagaaccgcccaactgagtccagtcagttctcagatttgtgtgaaaaataaataactgttactgttttgagccagtgtttggaggtggtttgttagacagcagaaggtaactggaacagtattaaatgaagtcagtcactttataccaaatgcctagcgccatgtctggcacattgtcagtgtgccaacacatagccattctgcagtgccctgagttcagagctgtgcacagcagggtgggtgtgcacacactctcagggatgcctgactcacacctggtgtttgaagatgcagtgggagaagatgggcctgggtagagaaggctggaggaagaacctggggagggaatcaaagaccacacaggagctaaccttgtctgacagtcgacaggcattgtactaggcattctgcaacatcacatctcttaatactcacaacc

SEQ ID NO: 476680 - DNA, 678 bp, Homo sapiens
gtgggttttctcacctgaatgtccacaagtgggttgaaagatactcattgttggctgaattgtatgaaaagactcctaagaagtgcaccctccaaacttgcctcctctcagtacctccttagtcatatgcattatctgagtgtggaaattctgccttctagaactggggagggagacagcaggtatcctccagcttggaagtggcaagagcttggatgtgaggcctaccgcagcctcatcactaacactgcggaagccagcaccggccaactgatacagtttggatgtcttccccctccaaatctcatgttgaaatgcaatctccaatgttgggatccccaatgcaatcctgtcagtattggagctttgccttctgccatgattggaagtttcctgaggccctcaccagaagcaggtgccagtactatgctactcatacagcctgcagagccatgagccaaaataaaccttatacatatatatatattaaataaatatatataaatatatatatgtaaacatatatattaatatatataaaaatatatatgtatatatatatacatatatataaatatatatgtatatatataaatatatatgtaaatatatataaatatatatgtaaatatatatatataaatatatatatatatataaaataaataaaacttactc

SEQ ID NO: 476681 - DNA, 1039 bp, Homo sapiens
ggagtgcagcagcggtaagtgggagaagacagaccctgagggaagacgctgccacctcctccaggcacaatctcccttcaccgggccaagctgagagatgcaaggataggctccatggagttgccatttagtgagatgaggaaggctgcgggaggaacaggtgtaagggaagaagcaagaactcattgacgccctgccagatctggagcacctgtgaggcaccccagtggtgatgtcagtgagagtcaaatggggacaggacattacatcccctggtgccggcttatccctgtggcttcccgccctgatgctgccactttgcacatgtgatccaatcaactgtctctttaattatgacacggaggagaagccacaaacaggtttaccatattcacggtttgctgcgtctgtgttacatccggggccctactgggctcacatccttgtctctcttccctgcgatgctctcaagagcctcctgaaagaatatgggcctgctgacaccttcatttcagaattctggcctccagactatgagagggtaaatctctgttgttttaatccactcagtgcatggctatttgttatggaagcaccaggaaacaaatacacaaggctctcgacttacctgagaaggtgcccaggtttcccccactatacctattagaccctgtgggcctgcctgaaagccccacatctaaaaaaacaacgaccctaagaccattttgcatgactgtgttcctgctgtgtgccaggaacacctgggtgtttgcattccggtgccaaaatgactacaaccaagtgggagttgggctgcctctgaggctggttcttgtgtccttgacccaaggagcatagctactgcttttcacccttcccttttctctccttccttggagagggagtcgtgagcctcaggtctgagtcctggacagcctttaataactgtgtaactatggagagccctcaacaatctgttttcattttcttcatttgtaaaatggagataaaagtattaaatattcccttcagggatctt

SEQ ID NO: 476682 - DNA, 1549 bp, Homo sapiens
ggatttgagtgcgctgagtgaccagaccatggagaccctgcttggtggcctgctagcgtttggcatggcgtttgccgtggtcgacgcctgccccaagtactgtgtctgccagaatctgtctgagtcactggggaccctgtgcccctccaaggggctgctctttgtaccccctgatattgaccggcggacagtggagctgcgcctgggcggcaacttcatcatccacatcagccgccaggactttgccaacatgacggggctggtggacctgaccctgtccaggaacaccatcagccacatccagcccttttcctttctggacctcgagagcctccgctccctgcatcttgacagcaatcggctgccaagccttggggaggacaccctccggggcctggtcaacctgcagcaccttatcgtgaacaacaaccagctgggcggcatcgcagatgaggcttttgaggacttcctgctgacattggaggatctggacctctcctacaacaacctccatggcctgccgtgggactccgtgcgacgcatggtcaacctccaccagctgagcctggaccacaacctgctggatcacatcgccgagggcacctttgcagacctgcagaaactggcccgcctggatctcacctccaatcggctgcagaagctgccccctgatcccatctttgcccgctcccaggcttcggctttgacagccacaccctttgccccacccttgtcctttagttttgggggtaacccacttcactgcaattgtgagcttctctggctgcggaggctcgagcgggacgatgacctggaaacctgtggctccccagggggcctcaagggtcgctacttctggcatgtgcgtgaggaggagtttgtgtgcgagccgcctctcatcacccagcacacacacaagttgctggttctggagggccaggcggccacactcaagtgcaaagccattggggaccccagcccccttatccactgggtagcccccgatgaccgcctggtagggaactcctcaaggaccgctgtctatgacaatggcaccctggacatcttcatcaccacatctcaggacagtggtgccttcacctgcattgctgccaatgctgccggagaggccacggccatggtggaggtctccatcgtccagctgccacacctcagcaacagcaccagccgcactgcaccccccaagtcccgcctctcagacatcactggctccagcaagaccagccggggaggtggaggcagtgggggcggagagcctcccaaaagccccccggaacgggctgtgcttgtgtctgaagtgaccaccacctcggccctggtcaagtggtctgtcagcaagtcagcaccccgggtgaagatgtaccagctgcagtacaactgctctgacgatgaggtactgatttacaggtgagcaagcggctgtggcaaaggcagggagggtgtctggctggggaaggaggaggggatggggaggtcttggggctgctcccacctatacccctcttccccaaaggtgtctgtggggatt

SEQ ID NO: 476683 - DNA, 1027 bp, Homo sapiens
cagcagacacacctggaaagggcgttcctgctgtccccccagctccgttagccctcctccagcagttctgcacagttccctggcaaaaggtgggctgaaggaatcctctaggaatcttccctgagcccctggtgaagttgggggcagggagcccctcttggctgttacatcagcaggctgcatttctctaccctcctgggctcacctactgcacagtaattacctgtctcctctttgagactaagaagtgggcagatcccagtgaggggctgtggcttagcttaaaagcatgagaaaagttggaggaagcccagagactgctcccttgtggagaggaggacgccacttggagcgagggaaaccagaccggctttctccggcagggaacgcatacttggaagcctcttgatcctcctctctgctccagcccttaccaaccccactcttcctgtggtttcagagattaactggcggaaggggcagggctgtgtcctccacatcggcccttggccatggagggcaataaacatgcatcagggcaagatctagctgctgccctcctgggtgggtcccaaggcaaatggggagacgtgctgaaggctgtgagcgcggtgcagagccagctgagtggagcactgaaaggcacagggcagcccaatggagcccaggagtgggcttcagatgccagcagcaaggcaggccccaaggaggatggtccgagggcccagactcatgctgcttcttcctgggagatccaaggtttcaggacttctcacaccttcggtaatgatttgtctaagagccaaactcccacggcgggctgtggtcccccagggtgggtggggggattcctgcacatctttgtctccccagtgcccacacagtggaggtcacatgggagatgccaactggacaaggaactgcatgaggctcagcttgagccctagctaggaaagctcacagagctcagaggactgtggattccccagggatgcagcactctacaatgacagccatcttctcctcc

SEQ ID NO: 476684 - DNA, 2218 bp, Homo sapiens
tcccaggcatcttcctactgactgcaagtgtggaacaaggagttccaggaacccacaggcaggtcgttaatgagatttccagaaaatgctctccagatgtgtctgttgtttccagaacttccagcccagctggtctctgtggtctccctaatgcttctactgctgcagctgtcccaatgtcctttcccaacctgtcacccaagaccagtaccacagagcaatgagagcagcagtggacaaacggacaaggctactcaggaagaaatttgtaaaaagattggcagtcgaaattcagtcctcacttcccccttatctgaaatctacaagacagtggtcagtatgttccaactggtgggggtccaggtttctgaagaacaactcagggacacagccctgaatccgggagtctatcagggctgctgcattcagctgcatgggttgtacactacacaactccagcacaatcttagtgaagccaaagagcaaaagacctccttaatcccaactctggatttacaacaggtgcctgcaaagcatgcagcctggcagacccagaagatgcagcccatcttcagcctgtcttccagacctggcagtcatcactggaagccccagtgtctcttctctgcccctacagctcagacaacctacaacaaacgtcagtgaagacctgtccttgtcacgtcccccgcaaatgggctgttaaaaggccaggttgggaagtcacaaggatccattgttgaaatctggcaagttatttaagttctcagttcctcagtttccccatctgtaaaacagagataatagtatatagttttcagggttgaaatcagatcataactacttggctccatatgttaaaaggggtaaaaatgattatgcttactatgtgctggacactgtgcttagtaatatttaattatcatagccatcatagctcaatgaggaaggtgcattagaatcctcatttctcaaatgaagaccctgaggtgcagagaggccacacaactcttcaagtatgccacctaccaggtagtggttctcagccaggtttggtactgtctccctaggggacatgttaaaacatgggtgtgtgcttttgggttgtcatgctggctggaaacactggggttggaagagggggcaggaaggattcctagtaagtgtgcccccttggcaatgtatggctcttatcatgtgttgaatagtcctactcaggaaaaattaatcagcctctgttttgagaaacactaattacagcacaatcccacattaacagaaaaggaactgagtcccaaataaagtgatgagtccagattcacttggtgcatcaggccagaagtaggacaagagccaagcccctatcttaaccaccaatctttaccacgtgggggcccaagccagattgtggaccacctgtaggggcaggccagttggcagcagtgggttggtgcttcctctcaaaaatccattgggaatggccctgtgatttccccttcccagcctgaggaaaacttgcccccctccaccctctatcccctggctagaaagatgttcttagttatctttgattggtttctcagatttccattgcccaaggccaatttccacaaagggaaggtgtcaataattacatttctgctctccataccctgtaattaataattgcgattaatctggcacacttagtcaaatattgcaggtcctaattggctgccgtgcctttcttcttctgattgagacaatcctattcttggcagttctgcagccagctgcggtgaactcagcaggacctgtcaaatgcttctgcttggcaatttgcatgacattttgggcggcaaagcagagtagaggggtgaggtagctgggccttatgcgttggggcagaggggctgagattaggaagcccctgggtcctggtcaaggtgttggaatagatctgtttcacccttaacttgccctgatcagacagagcacctcggggtttatttcagttccagatgcaaggtagccctgccctctcctttcacactggatgtgagagggtttaaggggaggtagtctggttccctcctcctcttgtcttcttgtcccagggggcaggaagtttacttcctatcgggtggtaaaaacaaaacaaaacaaaacacaccattgtaaccctggcctctgtcaattcatctctcaggccagaggtatgtactgcagcatccagtcc

SEQ ID NO: 476685 - DNA, 572 bp, Homo sapiens
tgacgtgggccattgctccggagagtgcaagcagtttaagaggatgtatcagaaagcttgggtgcccagaaggaaccctgctgcaggggcagagccctcatggaaagactctagtaagacaatgctgagcagacatatggggctggatccctcacagaagctctattgccaagggaggaatatttctgccaggggacacaactgtgattccattaagctggaagtgtggactgtcacctggtcactctgggctcgtcatatcactgaatcaacaagcaaagaatgggatgatatgatgagcccagagcgaccagatgacagtccaaacttccagcttaatggaatcacagttgtgtcccctggcagaaacattcctcccttggcaataggactcaaagtcatggggacaggaagcaaaagttttgctagtgactcactagggataatagcaagagaagacactctcatttctaccccttgattcctggccccataaatccttcctataggggaaaatatactggttactgatttaaagcatgtaccacattctggagggcattgcctaagcc

SEQ ID NO: 476686 - DNA, 547 bp, Homo sapiens
tggttgagcatgcatgggaagtctcaccatctttcatgcctgattggctatggtttgtcctccaacagaccctccctgctttcaggagacctgaaatcctcagggaatggacatcaactcagctcagccctcaggggagggtgcacagtgactggaatggcagggatttggcacctctatagtagcttggccctaggggacagagcacagcagcagctcagctcagggataatgtgcctccaggcagactgtgatgctccagctgtaacacaaccagggcttaacaactttgaccacaatgccagacaaagtggtcccaccttcaaataccatcacaatgatgagatgttttcaacatatacatttggagggggacacaaatatttggtctatagcactgcccattccctcagagaaaggtccaacttccccagcctctatattatctgatttcaacacctgaagagcctgcatgtctttaaacccagatttagtctaagcctaatgaattccagagactcccctcactgactctgggtctccaaat

SEQ ID NO: 476687 - DNA, 653 bp, Homo sapiens
ggcgcgccgtcccttgcgccgccgtcccttgcgccgccgtcccttgcgccgccgtcccttgcgccgccgtcccttgcgccgccgtcccttgcgctcctgatagtgagatcagttccttgcatcagtctacatgtgccagagatgagaattcacatatttagggtgcagatggcaactggaccatccaggcagcttgcagctcagccctttggctactatgtcctttaccagtatgaagccagatactatcagtggacggctgggtggctatggctgtccaagtgtaaggattgccttgtgatgagccatctatgtactagtcctggtcaggcactgggtcctgtccctcttgtacaaaagggggcatctggagggccagtagacctctgcctgcaccctatccataatggcaggcagaatgacttgagccttacccgacaagatgacagccaagtatttgtggaacctggactttgcattgactctccatcctgtttgccaagtaagagcaaggtgagggctgcggcttgtaagcttgtaaaagacttggaagttagcatgatgttctccatgtgatggagaacaagtaccctccagagtggtccattcactgaggtctgtggccactagactgtgacaatgaggctatgtaa

SEQ ID NO: 476688 - DNA, 585 bp, Homo sapiens
tgggtcaagctgtttgtctgatcagtcccgctgcttttgctcatccattaggtagtgtttagcagcctttggatgactcagctctgaatgtgggtcagatgggacaagctctacacagctgtggtagactcaagccttaattcccacacatttcatggaggagcaagtcaccagcagcacttcatatggtccattctattagggcttcagttgattatcagggtgctggtttctaaacaacctgctagaagacttatggcagtcaaacctaaggattgcacatacctgacagtgtctagctcttttacacctatgcttttgtggcatttcagtttagaggagaagcatgggaagtttctcccatgtaagatttcaaaagggctctgtttggacccaattgtagggaccactcttactctgatcagggcaataggcaaagccttattccagctgaagcacccaggtcagggtgatgagtttgatggctgctgtgaaaccttggtggttcttagtttatgagaatctaaacaagtcatacagcaaaggaaatgcaacatagagtaatttattgcaaaggagaaagaa

SEQ ID NO: 476689 - DNA, 751 bp, Homo sapiens
ctgctgaaaagatacctgaaaatgtggaagcaactttggaactgggcaacaggcagaagttggaacagtttggagggctcagaagaagacaggaaaatatgggaaagtttggaacttagagacttgttgaatggctttgaccaaaatcctgatagtgatatggacaatgatgtccaggctgaggtggtctcagatggagatgaggaacttgttgggaactggagcaaaggtgactcttgttatgttttagtaaagagactggcggcattttgcccctgccctacagatttgtggaatgttgagcttgagagagatgatttagggtatctggtagaagaaatttctaagcagcaaaacattcaaaaggagagccacaggaaagcagatccaggccaggtgcatgtggctgtggattctcgccaggacccagtgagcccggagtctggagcagagcaggccacctgtgatggcaaaggagaggaatggggaaagcaaaagaaatactgtgggacctggtcaaggaaactaccccgtaaaggctgagtggaggacccagcagccccaagaccctcttgggatggaaagtatggatatgcagggtcaaagagttcttccctgacccctcttattactctgctttgttttcatagcttttatgacattttattgcatttttttactatatatttattgtttatatgaaaattttctacacaggccccagaaggaattttattcctcactaatgtat

SEQ ID NO: 476690 - DNA, 544 bp, Homo sapiens
ttctgaggcagggctcgcgcaccatgaggctgaatccttcccccactggacctgcacctgaattggctccttgcttcttttcccctacttccctgcccagcctcccactcccttatggcattggaacttctgattggcccacagctttttccctcactctaagctcctcagcaaggcgccttggtgtatatccaggacccacaatgaggcccttggaggataaagccctgttgtgttccccaccaaccctccttgctgatgagacctctggagaagacaatgagtgtggcagagggtgccagatccctcacaatagcctttctcctttagggaaaaaatcatttcccacagaggtaggattcaaagctcagcaagctgattccagagcctggactgcaggggataatttggcagcggtcatgccaatgaccaaggtagggaatgaatcaggggaggcatttctgaagaggagaacatggtaagctcagtttgggatatttaatgagtcacattcagtggttattaaaaggggagtctgttgctc

SEQ ID NO: 476691 - DNA, 1488 bp, Homo sapiens
aaccccttagtttccacagtgatgtctcctcctctggatagcattccaggactgtgcaggtctacaatacatgacacccccaggtgctccccagcaccctgcacttctgccatcataagcagatggcatactatatgtgaattgcctgtttacttgtttgtttccctttcaatatgcagttatgaacatgtaatatctaataattcaatactctccatcaatgcaaataagagctccaatcctaagaaagggctggctgacaacctgctgaggaggcccttccagtgccacccgctgcacccctcaggactgtgcctgcacagccatgtgactcgtggggggcggggtttggaatgcctgctcgggggaaatgaaaaccacagcgccaagccctggactgccgaggatgtctgcaaatgccttttcttaccatcgttcagtgccacatttctccctgagctgactgtgaatggacagctgggtggaaaggaccactccagagcccacggcactgtggcggcagccactcctgggagaacttacaatgcactgagcaaccattgggactaactatattcccaacaacgaacaacacaaaacacttatcaccctctgaaaccacatgtatgtatgtattgtatggaatgaaaactcctcagaggctaacctgtcctgttcagtgctccttctccagtacagtaggatgaaagagaggaaggaagggagagagcagtcgcagtcccattgtaaacaggtcctctgataggtaccagattggcacacctgcctgcccacatcaagcccaaactgctctcctatgaaggtgccaaccctggaactgagctttttcctctctgcccccacaatcagaattttttaaataacctttctgttctgggggacttggctcatgtcaacatccacaggcccttgctaacctgtaccctgactaacctcatcacctcactattctgctgtctctttctcactaggttttcatttttgggagtttgtggtttgtttgttttgcttttatttttattttctacattttaactccatgaataattctctccaaagggggccaaacaaaatgccacgtataaatggcaaggtggctagtgagagccactctcttttcctggcaagagtttccatttctgaaagtgacacatgagaatctttggagacatctatcatcatttcagaatgctatggggtcatccaagctaatatctgtacctgttgtacatcctcaacagacagaagtaattgaccattatggatggattatgttaggctatctaggaaagtttcagaggagttttgctttcatagatgcattatcctataggagctcagagagggatatagtcgatacggaaggcaagtcctaaagatgtcaacctcatctatgcctgaggaggtaagaatatgcaaaaggcattactttactttttctaattatcaaagtatggcttgcccatt

SEQ ID NO: 476692 - DNA, 2059 bp, Homo sapiens
acatggtggcagccaagacagaatgaaagccaagtgagaggggaaacctcgtatgaaaacatcagatctcatgagacttattcactaccacgagaacagtatggaggaaaccgtccccatgattcagttatctcccacctggtccctcccacaacacgtggaaattatgggagctacagttcaagatgagatttgggtgaggacacagccaaaccatatcagggtctatggcagggaatgacttgacccaatttgcatgacaagaggcttagtgtggctgccacacagagaaggtaggagggagtgagaagcaggccagccgtgtcatgtagctttctgagtgagatcagtcacctaaaatggaaaagcattttggaaatataagtggtgagtccagttgtaaagtgtagtaaaatgtgacacgtggttgcctccagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataataggtccccagcgggatggggccccagttgcccgcaacagtcacctgtgcgaaaacacaccctgaatcgactgccttctgttccccactcccctgcttgcgcatcctggatcaggtcccagatgaaccacgcacacccgcattgtgtcttgggacctgcgctgagggaagtccaacttagacaagggcatccatttcagaattacggtctctcttttgttctctcctccttattacaaaaacaattgttgcttgtcctggacagaaaggccaccgtatctgccacggcgagtgccttccaggtgactgctcaaagatactcagtgctacagagttactcagtcctgcctgaagccctgcagacatccacggatgagctttctaagtgatacacgagagagctctccatgtattgagtttctccagggcaatcgaatagggtttgactctcacgctgcctttcagatttaattctaactcttgcttaagccaggagctggtgcatctgtagcagaaatgagtgccagcactctgttgccccactgattccagatgcttccttctccctccaagacaagcccacatcccaacaaggtgccgtctgggaaagctcccggaccatgtgaagtggggcttgcacagaaccacttcagagatccccagatggcctcagaggattccagaagcagcagaattccagagaaggtgggctccatcacaccacccccagacagggccgtgcctaagccacagggtggacaaaagcctgcaggccaccgtatctgccatgacaagtgccttccaggtggtgcctacatggacacaagatggctcagcaggtccagacagaaagaggcagaaatgcggggccagctgcagctgaacccttggtcaacagacaacaattttgcccaaacctcctcagccaactctgcccaatcatggctggacctgggcacgtggccagccccagctgcaagggagcttgggaaagggtctctccacaagctcctggagccatctttcctgcacgtgcgcaaagccagaaatgcatgagtgacggactaatgtggggatatgaaggcccaggtcccctgctgggactcactggggtgcacttcacctgccagagctcccaggaa

SEQ ID NO: 476693 - DNA, 629 bp, Homo sapiens
ggattggaaacctgcagcgtacatgagcatggtgggtgcagagcaggcagggcactgtcagcgtctgctgcgtatatgtcaaccattcctgtaacgtacaagaggcatgagggcagacaggaacacccacttggctatgggagaggggagccaaggcaggacgggaatacatctggaaggagaggtgatacagtcagcctggaggcatcaggaaattctggatcaaggtatgaggacctgaactggtccctgatcagcaggggtagaaggagaaccatggagtctggcatcacacaggtcaaaggaagagagagcaatgacatggtggcattgcgttctcaagtcctgagtcctacccaaagtggaggccaaagccatctggaacactttccaggacaggtgagccctgaaccaccaggagactactgtgagcccaagaacatgagcttcgtgggaagaaggctgcagggaccctgggagtaagagtgagctgagggcaaggcactgtctgcaagccagaagggaggagggttccagaggttattaccggagctgtacaaatattgttgttttgactggtagtggagattgttttatttttttccccaggaaccacaagtgtgatgtgc

SEQ ID NO: 476694 - DNA, 700 bp, Homo sapiens
tttgatgctttagcctctaattcccccgcatcttcacagcttcttcaagatggggggctatgaatgcgagggctctgtccctatctccaagatgacaaatccgtgggcgtttctggcactggaaactcagcctcctcagacataacggagaaggaagtgactcgaggtggctttgcaattgggtccttgaaaaatggcacctgctgggcaaagccgcacattcacttgaggccaggtctagaggagaggggaatgagtgagttatcaaattccctttatgtggaaccaggggagctaattttgtctaacctgagtgtggacttgctggcagccaggttctcctggcagaaagtggattcctggcccactgctgaggtctctgccttctctcagcagcagatcttcagactgtctggcaagggccagcctgagggcgatggtgagcattagatgaaataacacatatacagctcctaaaacagtgcctggctcaaggcaaatgctcggtaaatattggttcttattactggacccattttataccaaggtttagtgctattaaggatacagagtaagtgactgagatggatttgactgtcagactctaaaaatctgtgtttaggggtacctaccctgcactggctgaatgcaaaaatgttctccaagtcagagaaagccccctggcagagaaaacatggcc

SEQ ID NO: 476695 - DNA, 640 bp, Homo sapiens
gtcactgaatacataggttcccatggagaatgttgcaacaattgctgattgtgccagtgtgattgaaggagtcagtcggagccgaaatgccttgctgaatggggacactaagaattatgactgggattctggctacacatgtcaccagctaggaagtggtgcgattgtggttcagttggcacaaccgtacatgattgggtcaatacggaaggcctcactgagaagggtgaagtgtgagcagatcccaaaggatggagacagtaagtcctctggggatgagcatcaccggcagtgccaagccctggagtggagcttgcctggcaggccacaggagcagctaggaggccagtcctatctgcatcactctaaagtcttcttttatcaccctcagacctcagagctctggttcccagaaaaatcatacagcaaataattttatctatggttcccaggtacatgtgcacaatgtgcagctttgttacatatgtatacatgtgccatgtcggtgtactgcacccattaactcgtcatttagcattaggtatatctcctaatgctatccctcccccctccccccaccccacaacagtccccggagtgtgatgttccccttcctgtgtccatgtgttccattgttcaa

SEQ ID NO: 476696 - DNA, 1108 bp, Homo sapiens
ccagccattttaaatgggttggatagtagctactcagtgtttgtgaacccagagactttgtgctagcttcaaaaactatcgatggatttggtctatggcatggaaaggtctgtctgtgtgtgtacaataaagggaaatctgcgtgaacacacgctttgccgaatggcccagaggagcatctgcatgggccgacagcagcaggacagaaagtctgcaagtggctacttgagctgccctccaggaccactcggctcagggcctggagtgaggcagaatttatttactggcttcggtcagaccagtctgattccactctctctggccccccgaggatttccccggcagcatcctccagaggaccatcgtctcagcccagaagcacctcaaagcagtcacatgctggccccagggccagaacccccagtgggcgctctctgtgctctgtggcagagcacagagagagcaaatggagaggcagccctctccttgcaaaagctcctggtctgcagagagcaccagttccagccttcagactccacttctgtgtgggagggaacctggccctccaggggcttcatgttccagcaactggaaatggatgcccacaaagaaaacctgcttgggaatagaaataatggaaacaaacttaggtttcagatggcagcacggaggccctgtatggtgcatgcgaggtactgggccagagaggaggcagtgcagggacagccgggatagtcaagcccagcgggcagcctggtacctgtgaatctgcattgtaccagtttaggaggcaagagtgaggatgctgtcaccgcagccttgttcatcctgaacccaacgggataccacgagcgtccatccacagaggatggaaccttccaagcatcagagttccaattatctgtggatatcctggcctatgtgaatatgagaaaatgatattgtaaagtttttttaaaagctgttgccgtacataagcattgtcacccagaaacttacctccatacttagtgcaaaaatatttgggtatcctatcaccctaagcaatactgaaaatttgttgctcgcaatttggaaatgtctccctatgaagtaattcctagttttg

SEQ ID NO: 476697 - DNA, 655 bp, Homo sapiens
gaggtgaagtgacttgcccaaggcctaatgatgggacatactccttgataccctccctccccaccaacatgcacacttaggaagtatggcctgctacccttgggggcatcccagccagttggaagtggattcacatgagggttatggaatagagtatggttaccatctccccagggaaacggcttggtcctgatgcggagatgggggtaggcgatgaactcgggtctctcgtgctctccgtggtgcgacttcaggtacacattcagcatgctgactgccaccccggggagcgcgacgaagaaggccgccccagctgtgggcgggaccgacccagcagccgagaaaccgagaacacaccaactgccgccatttttgatctggactgccgcagcgccgcaaagcattattttaaaataggggctgacatgccaattttcatgtttgccaatttccatggtggaaatactctcattgtggccatcttcaaaaagaagcaggtcctggtatcaagccatgagggcgggacaggcagtaaggagcactacgtgaggcaggtggacaaggaagcctgtccgagggccaatgaggcagagactggagagaagtgagggagtgcatcgggcggatttctggaggaacagcatccaggctgaac

SEQ ID NO: 476698 - DNA, 1450 bp, Homo sapiens
cgtggttcacagagcttctcccatttgagtgacctcacccactcctcacaggatagctctccaaggtgagtctcactgtcaccccgcataaggagactgatgctcagaaagctgttgggtacacctcccagaaggggtggcggcggggcagaggggctcctcacttcccagaaggggcggccgggcagaggcgccccccacctcccggatggggcggcggccgggcggaggcgccccccacctcccggacggggcggctggccgggcggtggctgccccccacctccctcccggacggggcggctggccgggcggagacgctcctcacttcccagacggggcggctgccgggcggaggggctcctcacttctcagacggggcggctgccgggcagagacgctcctcacctcccagacggggtcgtggctgggcagaggcgctcctcacatcccagactgggcggcggggcagaggcgctccccacatctcagacaatgggcggccgggcagagacgctcctcacttcctagacgggatggcggctgggaagaggcgctcctcacttcccagactgggcagccaggcagaggggctcctcacatcccagacgatggtccctggcacttcctggattgtcgagcggctccctgcctctgcccttttgtattcggagctacagccttgcctcccctgttcccaccaccctgaccacccctcaacaccatcccgctgtcagctccgccgccaactgaggcgacacctgttcatggaaaccctgatcactgctgagagcctggaggtgagcgatcctgtcagcaccaccatgcaagagactgatgactccatccgcaggaatagagctgccactccccttctgcaatgtgaggacacggtgaggagattgccatctatcaaccagaacgcaggccctcaccagacatcgcatctgctggtgcctggatctctggcctccagaactgtgagaaataaatttatgttgtttataagtaattagtttatggaattttgttatagcagcccaaacagacaagataccaacttattagaaggttgcctggtttttgctaacttggttctcagtaattttccttagtgggggtgaaaaataaggattaaaaaaaaaaaagtgaagatagaaaatggtaggtggttaagaaaatcttagctcctgattagcacagagtgaagaaagggaaagtcaactggaggtcaggaagggaagtacagtttcagttgtttacctgttgaggagatacctcagttacaacagagtaaagatgggggcgtttcatggcaagtactaaatgggttgcatgaagcaatgcttttaaaatacagtaaaatgttaacatttgttaaatctaagtagtggctacagatacttttggaattaataatgtactcatattttacagaagcaaacaaaac

SEQ ID NO: 476699 - DNA, 679 bp, Homo sapiens
atcgttagggggcaataattttttttctttaaatgtgtacttgggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataagggcaccctaatcacaatccagaataatcttcctagaacatcgagaaattcctgctcaaaagcctccaacaactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaaggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgcc

SEQ ID NO: 476700 - DNA, 690 bp, Homo sapiens
acgagtagactggctggcttggcggtgtccccttctgaaaagcctctgtgcccagcggaggctgtggccttgcatcatggcccatcgcctcctggcctcatattctacctccaccaaccctgaccctgtgctccagccacactacagcccccatgaggaagtgtttgcccctctggaggacacagcaacaaggaccatcttggaagcagagacctggccctcaccagacaccatacctgccggcaccttgatcttgaacttctcagcctccagaacagtgaaagtgcaacgactaaaagggaatggagtgacacagacaagtgtctacaagagaccctggggctgctactccaaatgctgtcactttgcaaggttactgggtagaacttcaatcttactactcacctgctcaacaacctgcaatggctccctattgttgcctttcccaacaaggcctcatttcatggatgattttccatcgtctggccctatcctaaaagagagtggagcctcttgctcagagtcaggctttggtctcaactgccttgtttcacattctcactatgccagtccccagctgggtgatgatgagtaagttacttagcctctctgggcactggcttccttacttattaaatgtagataatattaggttggtgcaaagtaactgcagcttttcccattaaaagt

SEQ ID NO: 476701 - DNA, 3814 bp, Homo sapiens
tgtgggctgcgggactggaggcagctgggaggagcaggcaggcactggtcgaggagcagcaagagccccttgcagagaagggaagggtgaaatagaaagcaaggccacctgctgtacatgggcttcaggcacctggggggctggggacccaccaccccttcagagacagtgcatcctgacatggcccccgttgtccccacctgcttggacccggctgacttccacgaatgcacatatgtttctgttccctgtggacgtggagacagcaatgacgcacagcctcctccatgcaaacacgccagccagaaatccgtgactatacccagcaaggccgtggaggagctgctaacctggaccccaaaggctgagcctggcagactggtctccacagctgacaagggctggctcgttggagctaaagaacccacttccaaactcacccttctggttgccagtgggtatcagttcttggtcaatgttgacaaaagctttagtgcctcatcaagtgggcctctctattgggagccaactttcttggcagctgactttcttcagtgagagatgaagagagagaaccagggagggagtgttccaggttgaagggactctttcccttccatgttttttatactttcagtatattaatatgtttcataaacaatatatactatcgttttataaatctttttaaaaatttcacataaacaaacacattgcctttattttgcaaattgctgtttttacttggtgttatgatccctggctccagtcttttccattttcctgctttctggtgacccattatgagaccatgggacaacatgtatcattctcttcctgatggacatttgggttgtttctagtgttttgctgtaaccagcaatgccacagtgaatccttttgtgtacatccttccttggccctgcataggaatttctcaggtcacaatgtgggtttatcaatggtacccacaggatttcagttgatggaggtgactgagttaccacatggagaggctagtgtcattgaagagatttctgttgcacatacttacatttccttgccatgcaggactgcatggggaagctccaggttcggtcatggggcagaagggacgaaaggagagcacagcccagagcctttacggtgttttccgtgggaaagggaagggaagcggggaagcagcttaggggcagggaagcagcttaggactggctgattcaaatcaaggtggcgggctctgggtcatagggttggtctctagttgactggtgcctggctctgggtgattttgcctcttggagtgtaaaagccagatagagagggtggatcagagcatgggctagtttacatatgagaggcgccgctgccccacccaccccagccctctgctatctctaagaatggggtagccctgggaggggcagccttgcccccatcagtgaggccacaaatgccagaacatcaaaaattcacaaaataagaaagcatggttaatacaatgggcatttctgcaactctgcaaggagttgctcgattgctctctagagtgggtgtgccagtttccactcccattgagtgtttataagagtcctaatcacgtcacttctcttattaccagatttaaaacgttttgccagtctgagggctatgaaatgctatctcactgttgtttaatttatattttccttattttttggtgaagctaggcatcatttcatttcattcattggttgttcctgtttccttttctctgaataccttgttcttagccttttccatttgggaatgcagggcagggggagtgttgtctttttgttaataacatgtagacgttggtactaatattggctccgctgaatgcattggaaatatcctctcccggtgtgcagttttttagtcaacattttaatggtgtcttcggtgatacaaaagatttaaattttaatgtaataaattgtgtcattcttttcttttatagtttatatttttttgtgtttatggtttatgttttaaaggcatcaggatgctctcccatataaaataaaatcttggttattttaaacgatttgaccatcaagcctaagctattcattcagtctcctttgaaaagctgcattttggtgggcaatttggcaccatctatttaaaaatcaatacttgcaggaatttatcctacagaaatactcataggagtcctccaaaaatatatgcaaagaatttttaaatacagcatcaattgtaatagcaaatatccagaaataacctaaaagtatatcaatggcaagctagttaaatgaatgatggtatagccacataatgcaattctctgcagctactgaaaagaataattgtggacctgggtgtgctcatagggaacgttctccaagatatattggtaagaaggaaaaataacgataaagaaacaaggattcaggcaatatagtatgctaccatttatgtctaaaaggtagaggaagagcttctgtatgtatatgcatgtaacatttcagaaataaaaccgctgaggatggttacttctgaggaagggactggggcttgcgggtggagggaaacccatttttcactgctagcctcttgtgttgttttcattgttacttccattacagtaaacaaagaagaattactgtggatggtcacattttctgtgcgctgctatttgttttggcatttggaatattctgaggtgaagagggccttttgttccaatagctatgaagaaattgaattattagaaatggggcaggaggtttcattacacgtgctgcgtagccccgtctggctgatgagatttaggcttgctgttgtctggggattcagggcagagtgggagagtggaggatgggagggttgtctgtgggacagaggtagggtgggacgaggtgggggacaggggaaagtggattgaaggtgggacaggtctgagccagaggatcagcctgggcttctgtagccctaggaccaactgtgtgaggtctgggtcacccccaggctctcagtctccttgcactgcctggctgcagggttggaagaacctctgcaccccctccccagtggagaaggagaatcccaatctcaaaggctctggcaggcgattctccccagaggataaaaagccgtgctcatcctaggaaaatgttcatccaataaaaaagaaataaaggcaccctgagtttaccctggttaaaagaagagaaagggatcagatcagcatccatggagcaaagacaagatgtgccgccagggttaagtccagccgcctttcttagggcggtacagtatggccacttagggagtccagctgtcttagttcaagacacagctatgttagttgcacctttgacaaattatttgacatctctgtgccttagctttctcatctagaaaatgggaaaataatcaaacttgcctcctagggttttctcctggcacatggcaagtgcttaccaagtgttaactgtttttattctttatttctcgcttttgtaagttcagcacagctgggccctaagactgtgatatggtcagtgcacgaagattggaaccacgtctgaggtgaacacacgttcaccaaactcacaagcctgatgaatgaattgtaacctaacttgttaatttacattgacctgaatacgtaggtaaacccatcaacactttcctcctcccttttcctcatgtgggagcccagactgtcctcagaggctctttaggggatgggagcacttctgtgccttatttacttccctggctgttcctgctgtttgactgtaagccccttaggggaagacacttc

SEQ ID NO: 476702 - DNA, 1627 bp, Homo sapiens
aggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacagagaggtacctggaaccattggagggatgggagcttggcagagaagcaagagatagggaagatttcctagcagagactcatctcaggggtggtgttcattaaacagtatacactgttagagcaggaaggagtcttggagactgttcatctga

SEQ ID NO: 476703 - DNA, 648 bp, Homo sapiens
aaaagggagctaggaaatgtctttttttttgtctttaggaaacagcaatggaaatgcagccttctactctcttaagcccccttctcttgtcttatcttagaacttgcccaagctcagacaggatggctagaaccttggctcaaagctggtggcccctcaggcttctggaacagggtggctggaaggctcaaggcaacagccacggtctggtgaatcacccttgggtggtagtgcccctgcattcagaaggccaacaagaagccttcaattctctagatcaggagttgagaataaaagctaaaatggctcttggctatagctctgggtatagcttaactaaggaaatcaatccagaaatgcacattgaacccaggtatcagcaggatgtgactccagactctctaagggatatgaaaacattttttaaaaaccaccttaatcaagttataattcacatacaataaaatgcaaccacttaaagcagcagtccccgacctttttggcaccagggaccagttttgtggaagagaatttttccatggaccaggaataggatgagaaaactgaaactccctgagattgagtaatttccctgaagtcacagaggtagaaagcaccagagctgagatttgaattgcaggtttgttt

SEQ ID NO: 476704 - DNA, 1350 bp, Homo sapiens
gctaagtgaaagaagacacaaaagtgtatatatgctttccgaagttcctccatccttagtgtgttgacttttgttcttaagtctgtcccttcaaaatcacacgttaatattgcatctgccttttcagcaggaaaatgggggtggcagcagtgccagccgaagcaaaatgtctgtcctatgatgaatgtgccctgatgtctcattggctatattggtcacatggcttcactggccacaaaggattctgggaagtagatactgctattgttatcatcatcatcatcatcatcatcatcatcatccccatatttaaaaggagaagaatggggcacagagagatttcacctccttggaaaacagaaccaatcagaaatgtgtttcaaaaagtcccaagttattgcaaggagaacattttggaagtcctgagggtgggtaagaacaacagctgtcctggtgatggtgatggtaatggtggtgatagtggtggtggttgtgatgtgttggtgatggtggtggtggtgatggtgatggtaatggtggtggtagtggtgatggttgtgatggtggtgatggtggctgtgatggtggtggtggtggtcgtgatggtggtggtggtggtcgtgattggtagtagtgatggtggttgtgatggtgatggtggtggtggtggtgatgatggggtggttgtggtggtggtgttggtaatgatagtggtgatagtgatggtggtgatgatggtgatgacagaagccagccctactgagccacaattctaagcacttatttaatcctcacaacaaccttacaaagttgattctgttacttcccatatattacccaagtgattttaaagccattttccagggcaaaacactcccatggaagcatcccacctgctctttgggaccttgagcaggtcaattcacctttctggtagactccccatcagcaagacaccagcccggcttgttgagttcctcctggtgttatgggactcaattgagaccaacaatgcaaatgtgctttgaaaaagttgtgaggactcatcagacttatgctcttatcctcccctcctcagccagtctggcctgtgtgtggacaccaaggcccaccaggcatcctccagggagggaacctgacccttccatgtttgcattgtcctttctatctttttcctccctgcccatctgccattctgtatagcacagggagggtctagccagtgtggacaagtgtcccaacactggttctgcacctcaccagctatgtgacctcaggaaagttacttcccctccctgggcctcagtttcctcatctgtgtataagggggttatactgagctatccctcc

SEQ ID NO: 476705 - DNA, 842 bp, Homo sapiens
tctctcagatcctccacatccctactggctggatgggcttgctgcctcctcccagcctggccagatggatccctccacgtaccaccaccaagggtgtggccttgaaatgggtagctacattcctgtcctcaaggggcttgcattgagtggggtgcacgaggggatagacaagtacacaggcaattccaccagcgtggtgagcaacgctagcttttggaagctggaaaagggactgccctgtggaggggccgggtccaggctgctggaccctcgataccccgctcgcccaaccccacagggacgcgcaggcccgacccgggagtgcgggcagcggccgcgtaccgtgagccggccgggggtgtgcgtgctgctgccggcgccgcgccagcccgggccccgcccccgcctgccacccggcccgccgcccagcgcaggggagggcggcccggcaggggcggggccacggcgggcagagggggcggagctcgggaatggcaaagaaactgagccttaggaggatgcacccttgtgagcctgctatagggaaagactgagggaaatgaagacagcgactgactcgggaacactgcattttcccattgccctttcagcccagaagttgcagtgtcttgtcatcactgccggtcccaatacccaggttgatccccttcaccctgcccccacccctgtcgtccttccattaaagcctcttgcaccctttggttggattccatttcctgcctgggccctgtttgctatacagcagggtgagcactaagtgaggcagcacaggacttagcatccattaagtgctcaataaatcacagctcttaccatcatca

SEQ ID NO: 476706 - DNA, 810 bp, Homo sapiens
ctgggatctgcttagctaggctccttctctgcttccttttctttccagcctgtcacttccagagttcctcaggtgctcacttgcacctgtgtttgctggttcaaattaaatatcatctcttgccatgtccccacactcctggcggtggctgctgccatcacgccagctgcagcagggaggagttgagagggattcgacttgcagcagtcagcagcgtggaggcacgggcgccgtgtgtgccgacttgggaagcggaagagtagtgcggctggtggcccgcgtgggcctgaccctgggagtctcgcgtggctgcctggcgccccctcgcggtcgtggcccgcttcgccgcgcctattcagcggagctgctggagggcgcggggacccggagtgtgactgtggaactgagacgagctcccgggccagccctcctcagcagtggggctcccatggctttggtggctcagtgccagcagccagcgtctatcttttgccttgagacacctccaagctggcaacatgattaaggcagccaaggccaacatgtaaacctagatactttaatcaggaaggttttgcacataaatgaatgaaaaagcggtcaatataaaaactgggtagaagcacagtttcctctggctggagggtaggtgatctctagggatctggggtggtgccagccagccctgttgtcaggtaggggcactgagtcctagggacacagggcagggggtggaggaggtcagagaccctgggattccaggcagggatggaaaacagtgccctcttgttgtcgctcccctgccctgcc

SEQ ID NO: 476707 - DNA, 1006 bp, Homo sapiens
gctttcttccctggacagcatgagcttcaccactcgctctaccaccttctccaccaactaccagtccctggactcaatgcagccgcccaggtacagcgcccagctgaaccagaaggagaccaatcaaggcttgaacggctgcctggcctcctacctggatagagtgaggagcctggagactgagaatcggaggctggagagcaaaatccaggagtatctggagaagaagggaccccaggtcagagattgggggcattacttcaagaccatggaggacctgagggctcagatcttcgcaaattctgtgaacaatgccagcatcattctgcagattgacaatccccatcttgccgctgatgagacagagctggccatgtgccagtctggagagcgacatctctctgggttaaccgtggaggtagatgcccccaaatcacaggatcttgccaagatcatggcagacatccaggcccaatatgacaagctgtctcagaagaatcgagagaagctgaaccagtactgctcccaccagactgaggagagcaccacagtggtcaccacgcagtctgccaagatcagagctgctgagatgacgctcatgaagctgagacgtacagtccagtccttggagatcaacctggactcacccagtggggtcctgctgcacctggagttggagctggcacagacccgggcagaggagcagcgccaggcccaggagtacaaggccctgctgaatatccaggtcaagctggaggccgagatggccacctaccaccacctgctggaagacggcaaggacttcaatcttgggatgccctggacagcagcaattccatgcaaacgaccaccatccaacagaccaccctccccccgccgccaggatagtggatggcaaagtggtgtacgagactaacaacaccaaagttcagaggcattgagccagcagaagcagggtaccctttggggagcagaaggccaataaaaagttccaaggtcattgtgg

SEQ ID NO: 476708 - DNA, 1220 bp, Homo sapiens
tgggtcacatgacccaagatagccaactggagtccttccctgggattttctgaattagagtgccagggtttgacatgctttttggggctctgcagttcctggcatctccaagcttctgggcgccaccatgttccctggtgcccacagtggaagctgcttgtggtacgtctggaccagctgcagcagggagccagtgcctgtgctggcgcctggagcggcctgcctcgccgcagctggtgtgcccggctgtgtacgcagtggccggaccctgtgcctgctcgctcacacaccccttgccactccgcacctggctcgcctttggcaggcatgggatccaggctggggtcaagctcagaccagggtcagatgacagcaaaaggtccttggagacccagaggagtaacacctgtgacaagagcagaggcagggggctctgccagggcagagaaacaagatggtggctctccctggtggcctgagcctaggcctggctgagggaacagggtcagagggcagcagtgtgggctgcttcaggccacagggccccagagagggcaagatgggtggaccaaggacaaacccatgccagagaccagctgaggaaaccaggcagggaaccaggatcccaaaggaaacaccagattccacaactatctacataaaaagcaccttaataagaaacaaaaatgaggatcccagatgacatttctaggcacactcagggctagaagggaatctgctgcgttgaagggaagggcccaggcctggcgggatccatcacttgctgactgtaagagcccttgggccctgaataaccagcagcaatacccagctcccagatggcacctctggacccacttggggcccaggagaactcaccaccctgaagggaaggacacagcctggctggcttcaccacctgctaatcgtagagccgtagggacttgagtgaacataagtggtagcgaggccgcagttacagcaggccttgggcaaggcccagagctgtgctggctttaagtctgacccagtccagtcccagccacaggagtgcttgtatcacccctccgccaggactgagaccaggaccaggtagctcaggagagagagggagagggagagggagagggagagggagagggagagggagactatttatttgggagaaagtaagggaagagaataagggtctttgcctgctgatccagagaattcttctg

SEQ ID NO: 476709 - DNA, 424 bp, Homo sapiens
aaggacagagtttgaggcactgatcagtgtgattatgaataaaggttatagtgtatttgccactggaattatgatatgtcccatgccaggtgaaaaggaggtgctaagatgtcccagggtttgtgtcatccacggaagctgcatcatccgggaccgtgggtcctgcaggcatatttttaaggctggagtgggcacgttctactatggcccgtccttgggggttatacgggatgcctatggaacgttggatattccacgtgtgacaaaattgttgaaattggctgaggaacttgcgggtggtaaaatacatgatggtgccttgtccttcccctttttaggctcttctgtgtataatgggaccaaagccgcccttactaaggcccatagcattaaagatgatactgggacccgttacccttgaaca

SEQ ID NO: 476710 - DNA, 473 bp, Homo sapiens
cgtgcatctgtgtctgtgcatgagcatggtgtgtgtctttgtgtgtgtgtgtgaatggagagcagaactaaagtcccataacacaggagctataaaagcagccaggaagcaggggatcccgcagaggagcagaagtcttttaggccttagtgcctgctctgtgaagcaaatagcaagctttgtgaatgccacgtgtccatcatcttggagatatccagaattgccagtcataataacggaattatatgaacaaactgaaaccaatgacatagacatagaaaaaatatggagaaaatcagtaaatccaaaagttggttttttgagaagatcaacaaaattggctaacctttttattattgaaaaagaggaagaggagacacagatcatcaaaattaataatgaaaaagtggtattactattgatctttcagaaagtagaggattaaaagggaatactaaaaataactttatgcc

SEQ ID NO: 476711 - DNA, 546 bp, Homo sapiens
cccacagtgggaatgtgctaccatgattgatccagccatctgcctactaaagggcaaaccccacactgggaatactcgccacaatgcctggtgtagggaagaggctggacagctccgagagaaggagctgggaattctgacatccgtccttgaatgggtggccaagggcggctctgaagaccgcgagagtgtctcctggaagagagaatatggagactgtgcagctcagggcgtcaccctccagactgaattgctctggcctccacacatccaggacacatctcccatggggactgtggtggtgacttgtatgtgtcaacttgcccaggccatcgagtgcccagacatttggtctatgattaggttgggtgttttagatatgattgaccttgacactggtggactgcaggcagcagattccctcccttatgtgaatggaggcctgaatggaacaaaatggtggattctgtccagagcaagagaattcttcctgcctgatggccttcaaacagaaaggtcagcttcttcctgccttcagacttgaac

SEQ ID NO: 476712 - DNA, 1013 bp, Homo sapiens
catcgtctttttattttattttttttaagggacaggatttacataatggacatttgtcaagggtttcaagtcacagcttttataggcttccatctttttttgaaagaagacagattttcagagtggtttgaatttcatgacaatgtgggccggccacatggacaattgtacaaaagctacacaaggagaaatgggttaaaaggcttgaattttcaagccaaggttctgctatataaaaataatgatgaaactctcagcctgaacaagatggcaaaggctcatttctctctgccacactctgccaagtccagaatcagccctggaaataaagcaagagtgccagaggagaactctgaaaggtggaaggagggaagtggcctgatttgggaccaagaactgaaaagcaatgcaatacgggggtcttataccccccatccaacagacgaaggtgatagaaggtggcccaggccacgagaagaggataaaaaggccagctatagactaggagaaaatattgcaaaccacatatctgacaaagaactggtatctagaatatatacattctcaaaactcaacagtaaagaaagagatgattcaactacaaaatgcacagaagctgtgaacatttttctgaagagcatatagagatggctataagcacaggagacagtgttcaacattattagccatcagaccgtataccctggtcccacttattggaccaaccttactgacaaaggaactgttagcctggtctttgggatcttgtggggtgtgaaggcttcacaatctagatgcttctgtgtcctgtctgtacctgtgacttcatagcttaatctgggaccaatgcagagttctaagatttgtactttacagaatgtattttttttttaatattaaccattctttttttcccaacatcctttattttagatctattgttccttagagatttccaacaggttcactggtcctgtttggaaaaacagtgggctacaattttaggatagatt

SEQ ID NO: 476713 - DNA, 558 bp, Homo sapiens
tggtgtctgtgatagtccctggcatgtggcctggctgtgtccccagcgatggtgacagtgttcctggcagcaaggccagagctgaagctgcatgtggttgatggtgggatccctgctcagacatagcacagagctcagcccacggaatgtatttggagactgcccggtgaaagggaaacctaaaaatatgtgcggacagcctcattactcaaatatcaacaaataccaagttgcagtcctggaagaagagaatctcataagcttgagcagtagtccaagaggcattttaataacacctcctgattttcccgcagcatatggtcctgctcacactggagacttggacctccacatctcattactctgctggaagaagcagccagctccaggactgcatgggccagagagaaaaagcaatacaaaaaagagagcagaggatatcacagaaaaatggcaaagttggggacttcagggctctgtccctccagaaaatcaactaatgagctagtcagaatgtcagaaacagtgttggcagaactctggaatctagtgaaaaaa

SEQ ID NO: 476714 - DNA, 637 bp, Homo sapiens
ttcaggaatgtgaccaaagaattctctctagagtaagacagggcaccccgatgtccagagtggagttggctgtaggtgagcaggtagttgtgagtgagcaggatgtggaaggctctgtagtggaagactccagtgccgacttcacaagaaaagcacatccaaaaggacagggtggacattcgtctaggctgattggcattttcagtgtgccctgctctgtaacgtgtaggactgggagcctgttggaaatgcagaatctcaagccctgttccagactccctggattagaatcaggcagagactggaagagtttggaggactcagaagacaggaagatgagggaaaatttggaagttcttgaagactggttaaatggttctgaccaaaatcatagaaatgtggacagtgaaggccaggctgatgaggtctcagatggaaatgaggaagttactggaaactagagattcaatgctataaatttctcttttggcactgttttatctgtgtctcacaaattttaagtcagttctaagtattttaaaaatttccctgaaacttcctttttgagtcatggattagttgtttaatttatcaggttgtggagattttccagttatctttctgttattgatttcca

SEQ ID NO: 476715 - DNA, 636 bp, Homo sapiens
tgcattaactcccaccctctagaatgatgctctctgcagatgtgctgcggccgtgctccactcagttattcccaacacctggaaccactctggcacacaacaggtgccctggaaaaagtcctatgcttagatctgacagccctggttccgcttccaggaggaagcccttttctacggcccactcagactccagggttgacctctggggatcccttggtgttatttatctttatcacctcaaggtgagggggcccagtgacaatgacctggtccagcactgcccagattttgtagccagaacatggagatgcagattgaggcaacaggtcttcttggagaattgtcttcctgtttgtgtaatgtcactctttatccctgatgatattcctgttctgtagtctgctttgtctgaaattaatatagtaactttacaccacatctgggatctttcttccatcttttgtgatactgtgctcattcatttctcttatctatatgctatgaccttccattagatttttcctattattaatttaaacgaagttattttatgtccattaaaaataagaaaactaaaatattttattttacctttatttattccttttctgatgttcttcctttttggtatggacc

SEQ ID NO: 476716 - DNA, 488 bp, Homo sapiens
tgctttctcatcccgtctccacgtggctggggaagcctcacaatcatggcagaaggcaaggaggagcaagtcacatcttacatggatggtggcaggcaaaaagagcttgtgcagagaaactcccattttttaaaaccatcagatcttgtgagagccatgcactattatgagaacagcacaggaaagacccatccccatgattcaatcatctcccactgggtccctcccacagcatgcgggaattatgggagctacaagatgaggtttgggtggggacacagagccaaaccatatcattctgccccaggcccctcccagatctcatatcttcacatttcaaaaccaatcatgccttcccaacagtcccccaaagtcacaactcatttcagcattaactcaaaagtccacagtccaaagtctcatctgagacagggcaagttgcttctgcctatgatcctgcaaaatcaaaagcaagttagttaattcct

SEQ ID NO: 476717 - DNA, 521 bp, Homo sapiens
gagtctacagaagcatctagcaggctctgctctctggtcgcacaagggtggagtttgagatgggccagagctgcggcaccatcagggacttcttcagcaggggcgccgccgatggcactccctggtcttgttttctcctgggtcagtgtcagcgctgagcacgtggacagcacatggccgactctctcctcaaagggctgccacggacttggctgcaccaggctacctccgcagaaaccaacaaacactggttacctttccgcagtacccatctgcttccaagccccgggagcctccgccttccgcccctctgctccttccctccaacctcctccacttgctagcaccctctcttccatggctctggggacaccctgctccccgtctcttcagcttcaggcccagaatagctactgctccagatggctggtgcacgcagcccagcgttcctccagcctcttcgccaatccttccatcttccaagtaactgagatacagcctcctgcgcgtagctagcaagc

SEQ ID NO: 476718 - DNA, 754 bp, Homo sapiens
tgcaactgctacccttgccataatggacaccatacggcacctgcttctcccagtgggcagtcccagggacccgtgtctattacccagctatagagggtctgtgctaggaggatgctgcatcagaaggggaggatcccccagccccatgaaggcactcagtaacactgcgtggcccactctcttcaaagccttcctttcatgtccagaacagcccagcctgagaaaggtggccaaggactgtgtggaggagggtggagtagagactttctcctcccaattccctggcattgcccttaggacctttgccctgattccttcttcttgtgagatctctgtgtctttggacaattggctgcctcccattgggaccaagaaggttctaagtgttcccatagctcaggatcaggatctcacttgtgtcctttcagatttcacagagaaaattggagcccccaaactcacactccattgctatggtcccagaattaccacagggaaggccgattatggccaggatggtgggagtctgtgagctgtcgtggaacatcaggagaaggggaatccagagccctggccactggggaatttctaatgatctataagctgataatacccttgtgctttctttcaattgtgttgaaagcaaacaattggaatttctatgatttgccaagggatttttaaggtctaggcattaggataggcaaaatgtgatttttctttacacctccacgtgaaagctgacagaagggag

SEQ ID NO: 476719 - DNA, 863 bp, Homo sapiens
cgcccctcggtcctgagaactgccctacagggggaggcgcgggagtcactgtgcttctgtgagatagtgatgagcaaagaagcaggaatagcaaggaaaacggaagggatcttcacctgggtccacagagtagcccctgcagctctagccatcatatcaccttcaaggcaagaacatagctcagacctctgcccaactctcagtgccctccagactctgccaagtggctctcacagcgggctgctgcagttttctgggggtcactccagaccttatttgcctgagtccctcctgaacccagaggtgtcaccagtggaggctgcagaacaggacctacttgatgaagcactctggctgcccctttgtggagggggtgcgctgtgctgggggaatcccactcgttggaactgcccagattcctcagagctagcaggggaaaatactaagtccaccgatctgtggagaccacggccgcccctcctggcagggacttcatttcagggagatcagatttctgtctgtaaactcctggctggagttcctgaaatccccatagggagaccctgcccggtgagtggggatgggcctaggtctggcctaaagaggcagtctggccaggatctgccacagccactgtgctgtgccgtggggaattcctcctgggtccaaactgcccagtctccccagcaccagcggcggaaaacagcagactggagccgcagtgatggcagccgcccctccccacgggaacttggtagtcttaggcagcctccagccaagtggccaccgagaatctccacagctctgggcttgggacccaaggccctggtggtgtgggctcatgaagggatctcctgattagc

SEQ ID NO: 476720 - DNA, 712 bp, Homo sapiens
agacagcagacggtctgcagggagacctggaacagacgttctacctgcatcctgcaggaagaatgcatgagattacattttaatgtgattaaagccctggaatgcagccagcagtttcttggagcccaattctgtgtcttgcagattattaatcatgtgtatccatatcactgtactttaatgctgagcatatacagtcaatcttccagtgtcagaagtggtaggaaggacaaccaccatagcagcagctatggtgacagcaagagcaacagggttcccaggtgtttaaaaccctacagaaagaaaactccctcccaaataagaggagctggtgtcccaagagagtggggcaaactcctgctacctcttctctctttggccttccaccacttgacccgagatgtcataagaagtgcgtggcagagcagagtaaccatagcaccaggttccaaagtgatatcaacagggaatcagaaagtaccagggagttcacaaataggtagggatccataaaattgtttgtgaattttgtgaactcctgtgtttactcccatgctgtgcatacatggacctgactctaaacaacatgctgaagattctgagacctgaaatatgggataaaccagtgcccagaacctagcctggccagtggatggcacacaggtgggacagatctaaatagcaccacagaagctttgaaaatgtaactgac

SEQ ID NO: 476721 - DNA, 682 bp, Homo sapiens
agcggaggccagcgggaaggaaaaaggactgagagatggaaatgaggaagaaggtcccttgggctctggctgcctcttcttgctggttacagtccatccccagtgcgttgctgagtgaccggggctacagtctagaccttaagagaggtagagagacctatgaattcctcctggacagcctgacaagctctcagcctctaccacaaggtggtaaagtaaggactcaggccactttgacagcaaaatgcgctggtttcttcctgcagccttcagtaaagcataatggagaagacaccaaccagctcaagggcaaagctgctcaattgaaggaagtcagaggaagcagagccatcaaacaagataataatagagaagagagacaagctaaggcaccaaatcctgctttagaaaggattattagatgcctaggttatctccattatattcatggtagtccataattgtcatttaagtgtgtgtgtgtgtatgtgtgtgtgtgtgtgtgtgtgtgtgtgagagagagagagagagagagagattgagagagagagagagaatgtcactttttccctctggctgcctattaatgattccagtctacatgaaatactattttctcacctactcaataaatgctactaaagtgaatttattattgattagaccaatttttagctttcaa

SEQ ID NO: 476722 - DNA, 782 bp, Homo sapiens
ccgagtgtgggtctcctgggggcagataactactctccttttgagagacagctcttggcctgttactgggctttggtggaaactgatcgtttgaccgtgggtcattaagtcaccacgcgacctcaattgcctatcatgaactgggtgctttttgacccatctagccataaagtgggtcatgcaaagcagcattccatcataaaatggaagtggcatatgtgtgactgggctcaagcgtgtcctgaaggcacaaataagttacatgaggaagtggctcaaatgcccatgttctccactcctgccaccctgccttctcttccccagcctgcaccaatggcctcatggggagttccctatgatcagttgacagaggaagagaagactagggcattgttcacagatggttctgcacaatatgcaggcaccacccaaaagcagacagctgtagcactacagcccctttctaggacattcctgaaggacagcagtgaagggaaaactttccagtggggagaacttcgagcagtgcgcctgactgtgcactttgcatggaaggagaaatggccagatgtgcgattatatactgattcatgggctgtagccaatggtttggctggatggtcagggacttggaagaagcatgattggaaaattggtgacaaagaaatttggggaggaggtatatagatggacctctctgagtggtcaaaaactgtgaagatatttgtatcccatgtgagtgctcagcaatgggtgacctcagcagaggaggattttaataa

SEQ ID NO: 476723 - DNA, 917 bp, Homo sapiens
ttcctgcagccttgggggtggattgaggccgagccctagggccatgaatggcagcaggaggcagattgattcttgggcagaaaaggacaggtccccagtaaggccccaccttcaggccagggagggcctaaagactgggggccaggctgccagtcccaccactggagtggggactcatggtgcctcttccgggtgcccatggctgcccatggaccaatcagccggcccttcctcccctctgaggtccataaagccctgggctcagccagagcagggtagaggatggccagaggaggaagaggacagagagagggtgggaggaccagctgcagagaggagtaccctctccactgagagctgcagagatgatctgctggcagagaggagccaccctctctggaagagcttcagagacctgcagagacattcaaatgacttgcctacggagggaagccaccatctccagggccttctctctgctgagagccgaacactcaatgagaagacctgcctacagagaggagctacccactcctctgaactattctaacactaaataaaactcttcttcttcacccttcacttgcctgcatacctcattcttcctggacacaggacaagaactcaggcaaaggcgcctcggccacagaggtttctgaccagaaaagttgacaccccagagatcctatttggggtcagtcaactgtagcctgcagagaaaattcagccactccctgtttcggtaaataaagttttcctagaacacagccatgcccattgtttacatattgtctgtggttgctttcccctacaacagcagagttagcagctgtgacagagcctaggtgtcccataaagctgaaaatatttaccatctggccctttacagaagaaatgtgccattccctgttctaggg

SEQ ID NO: 476724 - DNA, 557 bp, Homo sapiens
gcagctgacatctacttggcttctggaaaggcattatgaaacttacaatcctggcagaagggttaacagactcatcttacatgaccagagtgggagcaagagaggttggggggagtgttcatcagctctttggagatgaccatgccagacctctctccagcagttctccctgtgggtacatgtactgtgacttcttcctcacctctacatatctggcattcaccgccagcttcctgcccttccaggcagccttactggactggatccaagggcactgtctcctgcatggcccatatctgatccatgggaaacacaaatgcatcttgggacccctcggcatgtgtgggctgacagccgaccactgcatgcctttttcaggtgggaggagaaaaagagctaagagaatgacacagaaatggagctggagccttaatacacctcctaactgttaatctgtttgggtggggtttctgtcacttgtggcctacagcagtcttactgtccccccaacctcccacaaagttcttcaggttgaagagagtcactactttgtagaa

SEQ ID NO: 476725 - DNA, 1590 bp, Homo sapiens
ccacagtctgagaaccaatctgaggcagagcacaggtctctcagccatggataccagcacctgctccgatggagggtgtctgcgcttagactctccttgggcagtgcttgctgtggctgctgtggggctgtcccagggagcctgcagcagcagtccacctccttcaaatgatctgtggatcctcttcactttcctggtgttagacttactagcaaaaggtatgtctggtgagggcacaacagaacaaaatgtaacctttgcaggactggaattatttatggatggcttggaggagtcacttgggctagatgtgaaatatgagcaagtatcagacagcagtaaaccagactttgttggatatacaatacatcaaactacacaatttggagatgatggtagtaaacaacatggttatgaagataatagtcatcatgatataagaggaaattatgtttttcttgtttctatggtaaaatttatcaagctaaaagaaggacctaagaagtttaaaagagattctgcatacaataccatagttattgaacaaaagttgtattaactacattattaataatgctctcattaatttggatcatgtgatctttaaattacacttttggaaacagtgacaaggaaattaaccaaaaccaaccagacaaacaaaaaaagaggagcaacaatctgttgtttatatatcaagtatagtttaacatcttctctataaagttttctgaaacagatctaggcctcttttgactcccatatatctctggtaatactgcagttgtggcttttatcacactgtattataattacctttcactttaacatcttcctaactatattgtgccttgaatccaggtttatctttggaaatccagtacctagattaatgcataataaataattggtacaaactaaacagataattgattgccaataactacatattatactagaaagactaacaagaaagaaaaaaatagatacattaatgtatgaagataatgagtgtataaacagccccagagagatgaattggctttctttttactgttctgatggggaaaaatgtcaagaataatttttagaacaccgttgctatgtcattttatataatggcatatgctgttttagtatggtcaaaaagaatttgggatcaaattttaactgtctttagtgaaatgtcagtatcaggacacctatcaacttttcagaattacatgcttgaagcttcatcaatataattatgtgtggaatgaatgagtgaagatctacttttagataaatgacctgctgaatttccacagtgaataataccccaagaaagtatgaaaaaatgctttgcaataaaatgatatcttaagcccaatagaagtagtgcaaattcatttgtaaagtgtaatgtaattctgcaaacaggttaaccatttgcaaaataaacttttggttaaatgaaatatttcatatatccactttgcttaatggtaggcacacctctataaaaaggtgtagaatgacctagaactgacaataagatttaatgtggtttcactagatcagagatagtttagagataaggaagtctgc

SEQ ID NO: 476726 - DNA, 1106 bp, Homo sapiens
atctcccttcgctgactctcttttcggactcagcccaccggcacccaggtgaaataaacagctttattgctcacacaaggcctggggatgggttccaatggccagactccactggagctgcccagtgaacaaaggcccctggctccacactggctgaagccctatctctgcctaccttcatatgcggcagatctccctaacatgcaaatgtccatgggggatatggggtcctctgttgctaggatcccaggggtccatggcacgagtgggcagtcccacagtctcttcactcattcattccccaagagccatttggagccaggaactaacctcagtattagggtatgccacacagggctcccagcttctttagcctgtgtctgtgttgcatctccatccaccctcggtgttttctctctgaagatctattcaggttatgttggtttacttgaaattttggtctctttctgtgggagcagcactgcctggctctgtgctgttggccatcttgttctggtctcccaataagcattattaaatgtcagtttgtggaaatgaatctcttaataactattttgatttattacaaataaaaaataatatcatgtattgtaataataaactactgttcattaagagtagtgtttggtatatttgattttaaattatttttaattacaggataagtaatgtgtacatacagttctgttttatattagattttaaccaattttagaaatgcattatgataatttatgctacttattaacattatttgtcctgatccccaagtatagcatctttttgcatagccctctaataaaagacgttttcttcagattactatataagccattgaaaaactttactcattttcacctctttaactgtatgaattagtattaatttgattttatacaactcaaatatctatggaaaaacaaaggttgcttagattgatatgactgctacagtcaaccaaaatcttctttttcaattttaggtttagcaaaatagcttcattattcaccttggtagaaattataagttaatgtttaaatttataagataaatttattttaataatatactaccttttatagttt

SEQ ID NO: 476727 - DNA, 901 bp, Homo sapiens
tatagagcgtcagctgcaagctttctctgaaatgtttattgcaggcatacgttcagtacatcacaatgtttgctttatgaagacccctgaagtaggtctaacaccggcaccttgaagctcctatcccttggtgagctcggggatatttatcttcccattggacaggatgcaaagtatcgatcctgggtgtgtctgtgagggtgttgccaaaggagattaacatttgagtcagtggactgagaaaggcagacccaccctcaatctgggtgggcacaacctaataagctgccgacatggccagaataaaagcaggcagaagaacttttaaagattatactggtttagtcttctggcctacatctttctcctgtgctggatgcttcctgcccttgaacatcggactccaagttcttcagctttggtgcttggactggcttccttgcacctcagcttgcagaaggcctattgcaggacctcaacttgtgatcgtggttccctctcacattgcatcacttgcttattctaagggaagccctcggttctattgtgagctatcctgtgggaaggcccatagcaaggaattgatgccagcaaccaataaccagcaaggacctgtggccagtctacagccatgggtaggatatctgatctacacaagaagtgcatttgacggaccaaaagcaggggaggagtgttgttccggggcacctgaaaacctgctatttgtgtgttctgaatatgaccccttgagtctattgcccttagtcctaacattcacaggtaagccaagactgagcaattcggtctgttcccagtcattgaaaattatttcattttgtcccaggttcctgcatttggtaggtgaacaagacatcatacctgattctgcctacaaataaga

SEQ ID NO: 476728 - DNA, 928 bp, Homo sapiens
tgagggcatgttcatgatttctttccaaggtagtgatttcatttcatctggatatatatctgaaaaagggattgtgggtcatatagtagttctaattttaatttctttagaaatctccatactgttttccataatggctgtaccaatctacatttttcaccaacaacatacgagagttcccttttttctacacccttgcccacatttgttatctcttgactttttgataatagccatcctaacgagtttgagatggtgtgttatagtcgttctgatttgcattttcctgatttttaatgatgttaagcaacttttcattacacctgagcattgggaaagaagtcgagatacagccaggcaaatacattcctttatctttacttcttgaatcgactacttccagggacagtttctccttgcatggtgttcgaagaagggcccctcctaagtagccaggcctcttggacatgctgcattctcttcactctgtgccttgctctttgtgatgttagatagtgcacaaagcctccttccattgcattgatttatatcttttctttctttccttgcttccctttttctcattcttgctgctcttgctttgcaccttacaagtaaagcgtcattactttaatctttggctctggttccattttctggagaactcaagctaaaatgtgtgggaattataatggctctgtctttacagtggattataggcttttcatagcacttagggtgtttcctgatttatagcccatattaagcaaagtcaaaacttttgaatgtctatgtttgcctttgaataggcaaaaaattatatagggctaaatgtaatgcatgtatcatgtataaatggaatataaaaaatatataattatataatttatttctaggtacttcaatcagtagtaggtttggtcccctt

SEQ ID NO: 476729 - DNA, 864 bp, Homo sapiens
catgcaatgacatccatataaaccttgcaaaatgatggctgtgatgacacccagtgatggtctttctcaactctctgtacctcatctcactcatcagagactttggagcctcagttgccttgcaatgctgtttcaggctgtactcattctttctgcaccacaaatgtcatgccttctcaagtgtttttatgccctggacccattgcatccagtgatgtcagaggaattctcagctcaatatcgtcacatgatggatcagagatacagaactagaattcatgagggatacatatctcaagtgaaaggtgcatatctacggattgtccacaagaaaccaatcagttatgcaaaatcttttccaaaggaaatgggaaattaaggaaaaaatttcccatctcatcattgggatcctatccagggtcattcactggtactgcttctctttcagttggataaagttcaaccccttccctgatgctatatgttatacaaaactcatccccaaatctctctgctgcttgcagatcagcattcttctcagtgttcatcagggtctgattcaaaatgataacctagggtgtgatggagagaaagtgggcatcccccctttctcttccatctttttgtccccaagtcccagtaaccttggcaggtgccacccatgggtgcaaaagtggctttcatccacattaacgggaggtctgggggtggaagtgtccacccttatgcttgtatgccctatctccctggctgtcgacaacatttgagttccctgggccttgtctatgtcaaggagcatggcctgctttcatgaagcaagggtttaatcagcaagaattggtcctgcccatttacattgtgtcc

SEQ ID NO: 476730 - DNA, 1071 bp, Homo sapiens
gctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagatgaacttggtggggacaaggagcttgaaagaagggagagaaactgctggggctaaagggatgcattcatccccaggatgtgggcatcaaggtcctgtgggttccaacttaagctccagcacaggccaccagagcagccaaaagctattaccaaggggagccctagcctggcttgggagcagtgaattgtacctcacactggcctgcctttacctctggagtttgttacatctgtcacttctggatactgttcatccacagctggctactacgacacagagatctgtaagtgacagccaggttttcattgctgttttcattttagttttaggaaaccaattaatacaaattcagggaagatttttggcagttactcaactgctagcagtactggggaagtcagcccactcgtggtcgcgaggggcacctggcccttccaagcttccccaattcatctacactcagtctccctgctccaccattcatcaagggttgcaaactcaaatgcccttagggacacggagagcagtgaaaggaagcaggccaggagaggaccgtattgaactgggagaacattccccatccagagttccagctgatttttgcctttgaggaatgtatgacagtgttttcatatttgccagttttttggaagaagctggaaaccagatatgtgacatctcccttctcctaatctcaaaacattgacaattgcaagagggag

SEQ ID NO: 476731 - DNA, 2255 bp, Homo sapiens
gcacaggggctgcaggtggagctgcctgctagtcccgcgccgtgcgctcgcactcctcagcccttgggtggtcgatgggactgggcgccgtggagcagggggtggtgctcgttggggaggctcgggctgcacaggagaccatggagtgggtgggaggctcaggcatggcgggctgcaggtcccgagccctgccccgccgggaggcagctaaggctcgtacaccctccgcagccactggcccaggtgctaagtctctcattgcccagagccggcagggccggccggctgctccgagtgcagggcccgccaagcccacgcccacccggaactccagctggcctgcaagcgccgcacgcagccccggttcccgctcgcgcctctccctccacacctacctgcaagttgagggagtgggctccagccgtggccagcccagaaaggggctcccacagggcagtggtgggctgaagggctcctcaaatgccgccaaagtgggagcccaggcagaggaggtgccgagagaaagcgagggctctgaggactgccagcacgctgtcacctctcaatacgatcataatcaccacacacgcaaagccatgggcccccccatcaaagaagcacgcatacttttttctttaacaatttaggcatcatagagcaccttccaggcaaaagaagctgctctagaaattatagaacataagaagatgactaagaccctgtatcaactgcaagtcacagaaaaaccaacttacaatagggattattttgcctagcaacaaatctaaaagtaggatgtttccagaatttgttaattcagcagctcaggacctagtcttttccatatttccacactgtcatactcaggcgaatgcccctatggacacgagctggctgtcacacagttccagtcatcacgtgcagacttgctagcaaccaccaaaagaaaaaggactatttctcttctccacatgtctttttaaagaaagactgaacaaacttttttctctgaatgctccccccagcaaacttcccttcccagaatgagattacatgcccacccttgagccactcatggaccaggagaatggcaccaccaggcttggcttagaccaatcagaacttaaccgtaaatcatgtaagagagcaggaacaatggaacaaaatggaagaaaggaaaagaatcaacataggctacttcagaccctttctgtatctgaaggggtacaatcagagaaaagagacaaaaagacgctgaccctaagtggcatttctccaagccctttcgtctcttcctcaatcctctgacctgccagtcagtcttactaaccctggctgtagacccttccactaggacctggtttttatctctccacttctccttttgtgatttacactaattagtagcagagttagctctcagcctggtgttctcactgctaaatcaagatttgaacacgtgaaacttcatggtgacagagggccctaataaacaaagacaattagagacaacaggcccctgcaataaggcggcttgaggaacagcttgtgaaaaaggccgagctcagaagatgaaagaactggaaaacagtattgctcaggatcataaaatttttgtttaaaaaaaggatttcatgcattatccctttgtgcactgagtggaaatttgcaataagaaataacgagaaaggacaagtataatttatttataatgcatctttctcttgccaacttccctgggcctctccaataactgccagtctacatacaaaaaaggtcagctttctattttcatctgaggttttgttaaatttagatggcttctttgaaatgtcaattacaaataactcttgtctattcaccaagccaaaacccacccctgtgtaccaggcaacagttggttagcttgcttccactttttgtatttgaaaataataaacctgaagttcttttaaagtagtataatttaattcaagcttttcactaattgagacggtccatcctatagtgtggattgaccacccatttacttcggcctgcttacattccccacacctgggggccccacttaactagaaaacctagccccaactgtgcctggattgtgcctaacttgtgacaaagactctctgtttggccaaactttagtcaggctcctctgagccctcttctcaaataggcctcaatcttgactccattctgtctttgacctgcccaacccaattttggcaagaatcctactggataagtttatc

SEQ ID NO: 476732 - DNA, 3138 bp, Homo sapiens
tgcctgattgccctggccagaacttccaacactatgttgaataggagtggtgagagagggcatcttgtcttatgccagttttcaaagggaatgcttccagtttttgcccattcagtatgatattggctgtgggggatggaccccatgttcctgaggaacacgtgcttttccaagaagcacaagaaggtcctaaagaagatgcacgtgccaaggctatcaaggcccttgtaaagcccaaggaggttaagcccaagatcccaaagggcatcagctgcgagctcaatcgacttgcctacatctatcactacccaccccaaacttcttctgagggtagaggcaactgtgcaccacctgaccccagtggctgcaggctcgtgcaggatggatgggtgaatagcagctccctgctcccttcctggctggggctggggctcccaagggttctgcatggcaggctggccagccttccctgctacgcatccatggagtcttcctcttccctggccaaggggtccagctccatcagacagcaattaagtttctctccctgttgcaggaatccatttgcataagaataaaaggttcctcccaaggcatctttttcttttctccaccctgtcagcagttaacatagccctgcatttaagctttttttgttttgttttgttttgtttttctccaccaggtcaggagttaacttttaagtgaggcttttttattctttttagaggacattttactaggccaggaccccaactaacacagctaatattctctgtaaagttttaattatgaaaaaggatttgtgaggtttgtcttaagctgtagccaatttggtgtgctttgcatatctttctgtatggtcactagcaaactttgctgcaggtctccatcttgttttacatccttggaagtgtgacctgtaaccacaagacaatgctttattttagcatctgccattttacaatggcagcctaggttcaatcctggcttagggagtgagttctttctggtttgacgtctgcattacttttttgccatttgttgattctcttcccctccatgaactgccttggattttcctttctctgagcttttaataaagtttgaaagccagaaatattggctgcttggcatggctaaactgtatttgtttattaggccctaaaaatggcatattttcctagccttgttcttaaagggctccacccagaggccaataatctatttaggagatggcaaatgaaaaatcttatggctactggattttcttttacctctctgtttagtaatacaggtattgtgtatgtgatgtctacaaaaagagctctaatttattgacttaaagaaggataaagacttggatcaaatagtttttaaagggaagataaaagctgtagtaccttttagttcatgtgactttaatctttgagaaataaaaacagccttaaagattattggtaaaatgtagatattgtcaaaatgtaaatttttgcctggggttataggattgttttgaattaggtaagataaaactaaaagtttaaacaagttatggaaggtttctaaaaaattaatcttgcaaaataaattctgtgtgtgaacactgactacattcaaaagggttataaaaggtttttgattttttaaaaatttttgagtcaccattttgacaaaataaataacttatggtaatctggaattctgttttataacatcaagtgttttaaacctctaacatatttaacaggcttcccaaaatcaaacttcagtttcaaaattgtctttcctgatacctagcttttggatgctacagagggcccctggagcattcagaagagaggtaaacaggattagttgacatgtttaggtacatgggatttccaaattgatgttcaatcttcttcaagttatattttaggacataatattaatacatgttccaaaattatgtgggattttaaaaattctaatgtctgagtatatgctatcaatcacaattaaggttgttatgtattgtaaatcacggggataaccaaatttctttgtcaatcatgtttctgactgtaactaccctggacattttgttattcacagacgattttgtcttgttttgatcctcttcaaaagatgattataatcagctatagaattttgacaggtgctctcaaatggaggtttctgataactttggacattatgacattggaataaaggaaaaacatacaggactcatgaagagccgaaatgttcacgaatatcaagcaaaaaaagaattaaccaaattgactaaactaatagagaattaaaataatctttttgacttttgcttggaaaattgctgatccttgttttctcagagtcaaggaaacttattttgaactatttatggcctttaataattcagatgcgattggagaaactggttgttttaccaaagctttgattggatgagtatgcttccctttaaggaatcacgctcaacttgcagagctgataaaagccccttgggaaaactggcctcataccttgtctacacattccctgtacagggttcctaacctgtggtaattgtgtctctgtactacgatatactctccttggatacatcttccaaactggaaaaagttatttgccaaaccttaaactcattggcttaggactgggcttgggggatgagaacccagaagcctgacatgctggcaaaagggcttgtgtttcttccactgaaatctctcttcaaggccatctcagacatttcctctgccatccacaagtccagatgtagcatcctaaatctcggtttccccaagaggctcatatttggctccctgcttagaggatctctgccaggcaccatcctgcaaggttcaccattttcagcattgccctcatcaatcagttacctgcttagaaaccttccaaggctctccatatcatctggagaatgaaaaaccaagttaatccagtcattcttaaaatcagaaacactgtgtatatacctttccccttaaagcagatatttgagaatgcaaacccagagatttaaagtgtgtgctgataaatttgacacacaaaggacagacgaaaatttccttgctgcttgttgtggttgaggctttctaggcttaatataac

SEQ ID NO: 476733 - DNA, 2000 bp, Homo sapiens
tattctcattctcttaaaatttctagtttttcttccaagcaaaaatggtgtgcatagcaaaagttactggttcagcctgcaactcagcaatcacactaatacttttccttgagataaccctggtaatttggtatgtagcaaacgtgatgtatgtggactcctcacctcatcacacagaacattaaaaaaagcatgtacttacttcaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagatcatggtaacatcagtttgcaaaagaaacgaataccagcttgtgtggtttccatgatgggaaaccatccagtccctgctggtgtgacggtaggaatgggcttgtccatcaaaaatgcccatggcaagatcatcattctgtatgacgatgatgaaaggctggccagtcaggcggccaccaccatgtgcgagcgtggatttgaaaacctcttcatgctttccggagggctctgtcacaaagccctaatgctgaagactcgagcaaaaggatttcttgtggaattctcagaatcccatgtaacaacagatattttctggtataatttgcttaatgatgaaatagttaagaaagatttcatgtccttgtgttggcctcaacttgatgaccagagattagaagacatgcaggcttctttccaggttttggcctggccttgccatattaatgcagctttttctgatgattttccaaacctaggtctaaaagtcttagctcagaaattcccggaaggactgattactggttccctgccagcatcttgccagcaggcccttcctcctgggtctgcccggaaacgatccagccccaaagggccacccctaccagctgagaataaatggagatttaccccagaagacttaaaaaagatagaatattatctggaagaggagcaagggcctgcagatcatcctagccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcagaacccctgagcatttcccaagttgggtcatttccagaaacttctgcagaggaaagaccatgacatatgtatgggataggcctcttccctgtccctgtctccagttcctctcccctcaggaggccacctcaggaaggattttgacaggtgaccataaaaaccagaggtgtgacaggctctagtctcctccctgttgtttacagcatatttaagtcttgtgaaactgtataggaaaaaagtatctacgtttttagtttttttgttttgtttttttttaataaggtccagcttgttgggtctctctgtgttgttttgtaaatacttcagtcacatctgcccgtgtgcctgtccctgccaccttttcattcactgttcttgacttcatgaaggcttctccgggcagtcttggtgtgagaagctgtttccaagggtgcagatgagccttaggttccagccgcctgcagaccccaccccagcaggctcactcagcaaggagctctctgcccagcatattgcaggccctgttttgagtatggaagccagtgcctgtgtactcactgaaattgaagatgaggaaagtagctgtacactcactgaatgctccccctt

SEQ ID NO: 476734 - DNA, 1885 bp, Homo sapiens
tccttctaaaccagaaccagcattctaagtttatgtagtgttctaagtgtgcttttcttctgaaatgatcatctgcagtatattaccaacacaaaaggaaggaggcctgagattcagcgttcagttgaggacactgacagcttcttaaaacaacagatctttgatgtttgttgttccctcgtcttttatcatccaagttgcttccctctctgatcaaacactggaagtgacagctgaggagattcaaaggctggaagggactgaaaagtaccttcaggaaagatgcaggatgttgtgggagagttccaaggaaggaaagacacttccagttagaagaccaagatcccctgaaagggccttggggatgtttggggtccactacactttgggaacttacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagatcatggtaacatcagtttgcaaaagaaacgaataccagcttgtgtggtttccatgatgggaaaccatccagtccctgctggtgtgacggtaggaatgggcttgtccatcaaaaatgcccatggcaagatcatcattctgtatgacgatgatgaaaggctggccagtcaggcggccaccaccatgtgcgagcgtggatttgaaaacctcttcatgctttccggagggctctgtcacaaagccctaatgctgaagactcgagcaaaaggatttcttgtggaattctcagaatcccatgtaacaacagatattttctggtataatttgcttaatgatgaaatagttaagaaagatttcatgtccttgtgttggcctcaacttgatgaccagagattagaagacatgcaggcttctttccaggttttggcctggccttgccatattaatgcagctttttctgatgattttccaaacctaggtctaaaagtcttagctcagaaattcccggaaggactgattactggttccctgccagcatcttgccagcaggcccttcctcctgggtctgcccggaaacgatccagccccaaagggccacccctaccagctgagaataaatggagatttaccccagaagacttaaaaaagatagaatattatctggaagaggagcaagggcctgcagatcatcctagccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaaggtgcagatgagccttaggttccagccgcctgcagaccccaccccagcaggctcactcagcaaggagctctctgcccagcatattgcaggccctgttttgagtatggaagccagtgcctgtgtactcactgaaattgaagatgaggaaagtagctgtacactcactgaatgctcccccttactagatatttcctggagccagaaaggtatgcatgtgggtgtcttcacaccggggaggagggcctctcatgggaaagccctggccaccacaccggcctgtgccccttgaagcccaccaaagcggccctcacttgtgatggacaacaaatttcatgtctccatttcacaagcattt

SEQ ID NO: 476735 - DNA, 682 bp, Homo sapiens
aaagttcatccatgttatgaagatgctctgtgatagtcttccaggtgtctgcatcttggctgaaactgctttggaggttcggggaaaaagactcatcaacttcaaggatttagagttgctgattgggaagatggagcatttgcaaattaccaaatcctcaggtgatgccgatgctgcaggtcagaggccagcactgctgactgggaaccctgtgttggtccatagtcagcaattgtccagggaaccactattcagtgtggggctgataccaccctgttgctactcagctccaagcatggttcctgtgacccaggcctggtcattagagtcccagtgttcagggaaggttgatggatacttgtgtgaactcagtggatttgccttaaagtgcttgaacaactatgacaagcagagtgttgtacgatggagatagtggaaatgggggtgggaattgaacaatgagatcacatggacacaggaaggggaatatcacactctggggactgtggtggggtcgggggaggggggagggatagcatcgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaagaa

SEQ ID NO: 476736 - DNA, 1116 bp, Homo sapiens
ggcaattggagagggcagggtgcacaggatgacccccttcccctgtgggtcagaagacagaacccagaaaatgtggccaggccagcccctcaccctcaggcccacatgggattcttgtgcccttcagaataaggacctgcagacgagggtgaggcagctggagtcctgtgagtgccaccctgcatctccccagtgctgggggctggggcgtgcctggcccgagggggcacgctgggagcctgacgcctgcacagcctgcgtctgccaggatggggccgctcactgtggcccccaagcacacctgccccattgcaggggctgcagccaaaatggccagacctacggcaacggggagaccttctccccagatgcctgcaccacctgccgctgtctgggggcctttacagacaatgggtcctttgagctgggtcttcatgggaaagtggggttccacctgaaggagagggagtacgtgaggttcctctgggcacaaggacagggtggagagaggctgccccagggccacggggttggggaaacatggcatccagggccctgtgtcatctgcacctgccagacaggagccgtgcagtgccaggggccctcgtgttcagagctcaactgcttggagagctgcaccccacctggggagtgctgccccatctgccggcccggtgacctcctgccctgtcctgccctgccccgccatcccttcaaccccaagggctgtgattatgaggggcagctttatgaggagggggtcaccttcctgtccagctccaacccttgtctacagtgcacctgcctgaggagccgagttcgctgcatggccctgaagtgcccgcctagcccctgcccagagccagtgctgaggcctgggcactgctgcccaacctgccaaggctgcacagaaggtggctctcactgggaacatggccaagagtggacaacacctggggacccctgccgaatctgccggtgcctgggtacagaggtgcttaatcagaaagcatcggcatggcgagggccattcataactctgagttccaacaaaagttgatatctggaagattaataaaagtttaatttaagaaaacgttgagtaagcttatcctt

SEQ ID NO: 476737 - DNA, 925 bp, Homo sapiens
gtgacctttaattagataatatgtcttagatattacactaaaagcacagtcaataggaaataaatttgataaattggacttcatcaaaattaaaaacttcttttcctgaaaagatgccatgagaagaatgaaaagaccagccactgactgggagaaaatatttgcaaagcccatatctgataaaggatgtgtatccagaatatataaagaactttggaaatcaaataagagcaaagaattcaactttttttcaaaaagtgatttcacctgcaatgggttgatagccgtgattaagaatcagagtgacaaccagagaggaatgagtcctggaagttggagtcctggaagaacgctggaggacattgatgagggctttgagtttgttcagggaaagagcctctggggtctaaatgcagtggtgtggaaccagagcagtgcagtcagcatggctttgcctgaacttttactataatctgtgtaccaaagaagtctgatgttatcgtattctttcgggcaaggatgagggccttctactaactctccaaggccagtgggcataatgacagatgttatggactgagttgtgtccccccaaaattcatatgttgacaccctagcccccaatgtgactgtatccagacatagtgtctttaggagagaatccatatttagcttgcttgcagaaggaaggagtcagggctctttttgttgggggtgggtttggtctcatgaaactttgcattagagtccagttttcctagggttaccattgtgcctaatgacaaaagttatggggttttgatattttaaatattttatatatttctaatattttatttcaaatgtattttctaacaatattcgacatctctggtgcatttatttggtgcttaaagatgcgcgtctcaatcactcctttgtcttt

SEQ ID NO: 476738 - DNA, 990 bp, Homo sapiens
gctgcattacaagtcaaggaagactggggatagaaagaagtataggcaatggcatttcaggcagcaatctatgcacacctggagactggagaaagaaggatgttttcaaggacctcaagatttctctgggccagcaggcccgacctccgagaccatctttggacatcagtagactgggagctgtacgtggacgggagcagcttcatcaacccacaaggagagaggtgtgcgggatatgcggtggtaatcctggatgctgtcattgaagccaaatcattgccccagggcacttcagcccagaaggccgaactcattgctttaatttgggccttagagctgagtgaaggtccaaccgtcctgtctggcatacaagcttatggagaagccccctttgaagatctcaatatagacttcaccaagatgcccaaatgtggcagtaacaagtatttgctagttccagtgtgtacatactctgggtgggtggaggcctatccaacacgaaccaagaaagctcgtgttcttctccgagatctcatcgctaggtttggactgcccttatggatcggctcagaaaatgggccggcgtttgtggctgacttggtacagaagacagcaaaggtgatgagtgtggatcaaagactggaacgtagcccccttgcagccacggtggaaaggaccccagactgtcatcttgaccactcccacagctgtgaaggtagagggaatcccagcctgggtccaccacagctgcgtaaaacctgcagcaccggagacctggtaggtgagaccaagcctagacaacccctgcaaagtgactctgaagaagtcgacaagccctgctccagtcacacccggaagccgactggtccactcatggccgaagcatgaggaaactcactgcaggactcattttccttaaattttggacttgtacagtaaggacttcaactgaccttcctcagactgaggactgttcccagtgtatacatt

SEQ ID NO: 476739 - DNA, 673 bp, Homo sapiens
ctgttctcccgcaggctgcactatgcatgttacatgccgtgagcacaagcagacgctgcgtaaacaggctggctctgcagggcatgaagaaggctgctctgagctagggccacacggcacctgctgggacacagggaggggtggggagtcctggaagatgagtgaccctcagggagaggaggagactcctgttggagagcacacagatttcctggggtctatgccgggctggaaggctggccatcttaaggctgcatttgttcccgaacctaaggaccatgggagccacgcagccagagggggtgtgatcagatgtgtgttctggttggatggctcttgtggctgtgtgcagaatgaaaggaggagttggacttggccattaagtccacgatggcagaggaagcaggtgccatgggagaaggaccttggatacatgcccaggaaggagatgtgggctgaacggtttagtgtagtgatcaacagcagcataatcgcggtgcccaagtactgctaagtgctaagcatggagacctgcgactctaatagctccacccatctttgcagatcttagatggcccatggcgggaccactggggtggtggccaggggcagctgagcccgttgtatccttgtgctcccgtggttggcggttctcttgagaatgtggggttcc

SEQ ID NO: 476740 - DNA, 639 bp, Homo sapiens
agtgggagattggaggagagcattatggttgttacagcaggaatgcaaagaacacacttcgggtatgatggtgggaagttgccgtctaccgagggagaaagtaaagtgctcttccagttgaaagagccaaggacagggggcaggtttgaggggttgagactaactgatgcttggatccctgggaaggaacccctcagtcccttcagtctttgggccttggcccagaatgggaagatgggcatgacatcaggaaccccagataagttgaaggagaatctggaacttctggcctgtccttcacttgtactccatgttcagtgtgacactggggcaactccagactccagcagtgagtgtcagaaaggcatcaaaaacagcagacaggacctgttgcaattcactgggcacaagcacaatattcccagagacccctaaaatagccacacagcatagaaaatgacttaatcaaaccatcatcctttcttcagttttcacccttgtactgcttctattttgatttcaagatttaaatatatatatttgaaacaaatatggctcccattttatttcctgaatagaccctgattcctagggagagaaggattcaggcaaaagcctttttaatacttttcctgcctt

SEQ ID NO: 476741 - DNA, 528 bp, Homo sapiens
gtaaaatggaccaatcagcaggatgtgggtgggaccagataagggaataaaagcaggctgcccaagccagcagtggcaatctgctccagtccccttccacgctggaagctttgttctttcactctttgcaataaatcttgctgctgctcactctttggattcattcctgaagccagcaagaccacgaacccaccagaaggaagaaactctgaacacgtccgaacatcagaaggaacaaactctggatacaccatctttaagaactgtaacactcaccacgagggtccatgacttcattcttgaagtcatgacaaagcaaaaagggaaaaatgatcagttacaaactggacatgatcagagggtaaatttcagggaaaataaatttctcctggtactcaaatctaagaaatatttctctagtggatcattctatacatgatacactggggtcttcaataatgtccctgaaagatatgctgattcttattgcatatagcatatatagtaaaaacataatgctctctgata

SEQ ID NO: 476742 - DNA, 585 bp, Homo sapiens
aaaatgtctttaattctgtttatttaatgaccaaacctaccattaatgtctcggtcagtttctggaaaaagtccatccctcaagctcactattaccacaaatcagtccaaactggaacttaacttgttcacacataggactttccagagttccaagatacctggaccaagcccatgcagacatgctgattatgggaaagcacagcaagtgcataaccagaatttccaggcatgggagaacatcctagggccaaatcccgagaggatggggacagcagcgttccaatggcacatgaaaggatgctcacaaggccagcaggtcacacgggcacctagtaagggaggggaattgggcctgtgcaacagctcctccgttcatgaacagcatctcaatctgcatacgttactgagagggctcttcagtgtcatttatgtttatggggatggctcattatacagatcaaacttttattttctgtaactgagaatctaagaatctcaaaagatccttccgctgtcgatggccatgaccctcagagttacctgtgggatatggactcattatccagatttaataaataataac

SEQ ID NO: 476743 - DNA, 734 bp, Homo sapiens
aagctcctgggagcaggggctctttcctcaacctttcagctgctgcctgggatctgaagaacttgccccaggaaagccgagtgggtggggttcccccctggtggggtgggggtgatttgtgcaacacacgaaggagcctgcccttgcctcctgatccattttggttcccagtcagttttgttctgcagtcaccagcatggactgcgggagcactgtgaggagtgaggcacccggagatgaggcttccacctggcagatactggacacagagcggacaaaagaggatgtgccagagaggcctgggggacctgctgtggggtttggggtcctggatgaacctgctgactgggataccctgctgtgggccctgcaggcagctcagggtgagcacttccaggagacagagcctcactcccccaaagcccccttatcaccatcacagggagagcaccagagccgtgagagcagagagcagtccatcatccccccacctccacccccacctctcctgctctgggccctgtttatggtgctgatgagcagggcgggggagcttcctggctgggctgacatgatgataaagggcaaagccctgcacgccttgccagcccctggctgggggctgtggctggagccgcctcgtacccgagaccctgatgtttagagaaacttcaggcggacttgtgggctcccacgttcctggtacaacttgggaattatgttgaatcgtgttg

SEQ ID NO: 476744 - DNA, 678 bp, Homo sapiens
ggaaaattcactgaggtaccaggtatgctacagcactagcaagccgtcgtgccactgccctgctctggctgggttgtcttttcctggaaatgggcagtggtaagaggagggtggagacagagcctccggccatctcccctgctcctcgcccctgctgggactcccactgcgcagtgtttccctcttacctctggacaatcccacagactccttcctccaggcaaggcatccccaaggaagtgcaaataaaaatgctgttggtggtggaggcaacatattcagtgaaaatccaccaaggttactggctgaggctggagcaggatgggggtgaggggaatactgctcgaggaaggcaggagggaccagggaagaggtccttggacagcaccagccggagggtcctcgcatggggccttggaggcggcagggaaaggaagcttctctctgattttagaatgggcattatggatgctgagagtcccgtcctccacctgcagctctgagaataccacctaccatccagcaagctttctccaaaccctcatatctggactgagctcctcattctttggtgtcaagctgttcaggtgagcagctctagcctatttctccccctgttctcctgtccacagggacagagcatgctacagccgcaggtctccaaggctccatttggaa

SEQ ID NO: 476745 - DNA, 709 bp, Homo sapiens
aggttattgccaagcatgacaaatgcttttgtttgggatcatgagtggaaaaacaaaggcaagaagggctgccatgttttttagacgttgctctgaagacgccagcggtagcgccagtggcaatgctttgttatcagaggacgaaaatcctgatgcgaatggggtaactcgatcatggaagattattctaagtacaatgcttacactgacttttcttcttgtagaaagagactgcctctttattcatgggctgttgggtctgtctgccacttccatcatctactgtcctttgtcccagttgggcttcggcagtatgtctttgaagtctttcaatagatattgccacttcctagaaagctataggcgtggaataaacacaggactcctaaatcatcagtggcttaaagaaacagatgttcctcagaaatccagacaattatatgccataattgcagaatatggttcaaggctttataaatatcaggtgatattttgttaagtaattttgtatatcactcatttaaagtttaatatgctacaaggctagttcaactttcaatatgttatctttgttttatatgagaatatctaataaaattaatgtaggaaatggaattctattaagtggtttctgtggtttgaatgtgaccaccaaacctcatgctgaaatttaattgccattgtaacagtgttcagaggtaagaccttt

SEQ ID NO: 476746 - DNA, 1589 bp, Homo sapiens
aaaataataaattagacagctagtgatggtggtagtgaggatgatgatggtgaccattgtgatcattgtggtgatgatggtggtaataatggtggcagtggaggtgacagtgatggtggtggtggtagtggtgatggtgattgcaatggtggtcatggcaatggtatcacctaaaaaggtggtggtagaggtaatggtgatggtagtaatggtagtggtggttgtagtgatggtgataattgaagtggtagtggtgatggtgattgcaatagtggtcatggcaatggtatcacctaaaaaggtggtggtagaggtaatggtgatggtagtaatggtagtggtggtgatagtgatggtgataattgaagtggtagtggtgatggtggtgatgaaggtagtggtggtggtggcagtgatggtggtggtggtggtgacagtgatagtggtggtggtgatgatgatggacatgggggtggtgatgaagaaagatggtgaggtggtggtggtggtggcagtgatggtggctgtggtggcagtgatggtggtggcggtgatggtgatggacatggaggttgtgatgaagaaagatggtgctggtggtggtgatgaagatgagggttttgatggagatgggggtggtggtggtggttatggtggtagagaagaaaaatgaggtctactactttgtagatataaactacagcctggaataagatcagtgggttttacccctgaaagttctaaatttgcaactaacttcaggtgtatggatcaaagttgagaggtgctctgctgtctattgatggctactgcctttagactgtaactgaaaagtttggtggggatcttacttggagatttctcctgttataattagacttaagaacatgtggtctgaatagcacttaacatagtacagtactggcacttaggagacaagtactttcaacaaatgtttgttgaatgactgaagttttcaatggaaaaggatggtcacagaatcaacttacagaaaagacatggaatgtatatgttttacttgaaaataaaataatctagtttactaatcttaaaatgataaataagtaaataattaatcatagtttactgaccataaaataagacataattcatgcagtgtactgactataaaaatataatgagatgatttcagattctgtgacaagttcagacactcttatattgcctccatttttaaaattaacattttcatgataaataataagaacaaaattctaaaatagaaataagtgattcttaatttagctttacctgaagaataatatctggaggcatttcatgatttaggaaacctatcccatgccagtacaattttgctttattatttttataactttctgaggtcccagcttcaatgatggaggctcctaaaattataaattatcataaatgacatggaaagcacacctcagtgtgtattttgtcaaggaatgctccatagaagtagaaatatgtaaaaggacaagtaattttctaaagtactacaaatgttactgtttggtgtttaaaattttaaattatgtatatgcacaagtgagaggaggcaa

SEQ ID NO: 476747 - DNA, 1373 bp, Homo sapiens
gacgttttccagtttgcttggctgcatccacgtctcaccttaagcagcacacccctccgtcctcgggagggaagcagtgagtttggttctgtgttgtgctccctgttgtaccagtgcagtgctcggcaaaccccaggtggaggagtatggcccaagaatgtagatgaactgggaacccctcccttgtctggatgcagctgctctgaggaaacaatgctggccgcactgcccggaaaaaggcgaggctgcccagcccagcgctggccccgaggcactgctggcttcaaaaacatcacaaactttaaatgtaggccctgttctcaggatgtccagccccacaaggaaggaacaggcagcagcaaggtcagagcatccagaggatgtaggaagaagctggtctgctgactgtcatacttgtgaccagcttgcacaggacatggccgaggaggcagcccagaacatttctgatgaccaggaaaggtgtctccaggctgcctgctgcctttcctttggtggtgagctgtctgtgagcactgacaagagctggggtcttcatctgtgcagctgtagccctcctggaggtggattgtgggaggtctggggtgaggctgagatctgggggccacacttcgagaacaaccaagactgtggggagtgggggctgcccctcaagcggggagtgggggctatccccggggtggggagtgggtgctgtcccccaggtggggagtgggagctgccccgagatggctccagcacagacaaggcttccagcagccaaagcactgaaaccctgcttaacttgcgcagtgtggggagctcgttgaagacccctattaattaagactgggctacctggatgtttgtgaattcccttgcatctgtttatcagagtagctaacagggcttgggtctgaaggcctgggcaatgccctggagatggaggagaagcgtgagaggagtgactctcacatctgtgggtggggtccgagagaagagtgaaaacttctgagtgagacatgcttttcacccagaataagcattggttccaaagggacatgcacagacagcccagagttgtgcgtttctagttcaaatttaaagaagccagttctctttgaagctcccagaacctctgctgtccttggcaaagactctcctgcagttcatttttcagtattcctcatgcagagcagcgttattaaaccaccccctccgtagcacatccatctgagtttatattgaaatgaatttgatctcaacccacagtgtttgtgtttgggagcttttctctgctctgccatcacttttgtcagcgaaagttcaaggaggcatttttaggttcccaaggaaggatatttagtaagatgagc

SEQ ID NO: 476748 - DNA, 1039 bp, Homo sapiens
gcaagggcctggagcagtggtggccccaggttccatcacaggcggctgtgtgctactgggaccgcagacagcacattctctgctcttctccagcagctccctgcagcctgaagatggaggcttcctgctgtgtcctgagactgctgtgctgtgcggaggatgtggccacggggctgcttcctgggactgtcacgatggagacccccaccaaggtggccagacccactcagaccagctcccagcgagtgcccctctcccacggccttccgcctggcattcctcgcacccccagcttcacggcatcgcagtctggttctgagatcctctatccccctactcagcatcctcctgtggccatcctagctcgaaattctgataacttcatgaaccctgttcttaattgctccctggaagtggaagctcgggcacctccaaatctgggattccgtgttcatatggcttctggagaggctctctgtctgatgatggatttcggggacagttctggggttgaaatgaggctacacaacatgtctgaggcaatggcggtgactgcctaccaccagtactcaaaagcgttggacccattctactcagacaactactaaacccctagagatgatgattgggggtggagggacaatttcaaagtgtcaaatatattttggggtaaaatactttgatttctttcagggcctgctatctgtcatgttggtatcttattgctacaaaaagtctgttttgtcattcttaaggcctctgtttaaatgttaatgctggtcagttgtgcctcaattccaatgggaggagggtatcgtggggcatgtctgaccctcccttcccattatggcctgaactcatttttcaggttaactttggaatgcccttggccaaaaggaggggtccattcagtaggttggagagcttagaattttatttttcatttacaaatgtttaatatataaattaatttatgtagagtctttatatttacgagtctcccactgcatgaactgccctgttcctgtccattttttcc

SEQ ID NO: 476749 - DNA, 1424 bp, Homo sapiens
ggcactttgggaggccaaggcaggcggctcggaggtggagaaggagtctatatgctcaaggctgttatttataacgagtttcatggaaccgaagtggagcttgggccttattatgtggagattggccatgaggccgtgtctgcgttcatgaactccagcagtgtccatgaagatgaagtgcttgtctttgctgactcccaagtgaatcagaaaaccgtctctgtctacacaaatggaactgtgtttgccacagacacagacattacatttacagctgttaccaaggaaacaatacccctggaatttgagtggtattttggagaggatccaccagtgaggacaacttcaagaagcattaaaaaaagactcagcatcccccaatggtatcgtgtgatggttaaggcttccaacaggatgagcagtgtggtctctgagccccatgtcatcagggtgcagaagaaaattgtggccaatcggctcacgtccccctcctcagctctggtaaatgccagtgtggcctttgagtgctggatcaacttcggcacagatgttgcctacctgtgggactttggggatggcaccgtcagcctggggagcagctccagcagccatgtctacagtagggaaggagaatttacagtggaggtccttgccttcaataatgtcagtgcctccactctaagacagcaacttttcatcgtgtgcgagccctgccagccacccctggtgaagaacatggggcctgggaaagtccaggttcagattgaaggcagtgtggtgtacagcaactactgtgtgggcctggaggtgcgagcccaggcccctgtcagtgtgatctccgagggcacacacctattcttctccaggaccacctcatcccccattgtcctcagagggacccagtccttcgaccctgacgaccctggggcgactctcagccactccgatgacttctccaacaggtatcactgggaatgcgccaccgctggctccccagcacatccctgcttcgactcctccactgcacaccaactggatgccgcggctcccactgtttcctttgaggcacaatggctcagtgacagctatgatcagttccttgtgatgctgagggtctccagtggtggccggaactcttctgagacccgggtgttcctgtccccctaccctgactcggcgttcaggtacctgaccctgtattcagcacagctcagctcaccggtgtttgttcccacctggtgctagcatccgtgaaaggaatctgctgtgcacagcaagcagtttggagtttggccatgcaggattctcactgcaaaggaggaggagaagactgttcagaaagcggctggggaagcagtccccgctctcgggctgatgtctgggcagcatctgacagccaagcacactagctaaagctggcacag

SEQ ID NO: 476750 - DNA, 981 bp, Homo sapiens
ccttctgaccttaattagggggcttcacatgtcactctgcatgtcagtcacctttgacatgtcccatccaccctctgtgggccatcagtgccttgagggctggttcatcagccacgtgatggtgaaggagctgcacacgggacagggctggttcttccctgcccagtgctggctgtctgccggcaggcatgatggtcgcgtggagcgggagctcacctgtctgcaagggggactcggcttccggaagcttttctattgcaagttcacagagtacctggaggatttccatgtctggctgtcggtgtacagcaggccctcctccagccgctacctgcacacgccgcgcctcaccgtgtccttctccctgctgtgcgtctacgcgtgtctcactgccctggttgctgctggagggcaagagcaggtgagagccatcgcttttccttatagcagcttccagatccgactacactgtggcccctttttgcctaagaaatcaacaaagctcacagttctccgagaaaagtttaaaccaggggaagcaagcctggctgcctggggaccagagaaggaacaggagggctctgcccggtgtggcactgggtggccctgcacagctctgactctgctggctcggtggacagctgctgtgtgggagctcgtgcccaggcccagcagcagaacttttccagagaggctggcagccggttgtctttgagaacactcttgaatttttttttaagttggcaattcatttagattttaaataaatcctctggacaaaagaacgtagaaccattctgatggccacattttccctcaagatgccagtttgcactggcaactctggtctgattgttcctcatgagatgtagtaaattacttccaaatcagtgtcagcagttaaaatggagaccctctctttcctgaggaaaaaacaacacagcaggacgtggactgaggcaaaactgacttgtttactac

SEQ ID NO: 476751 - DNA, 682 bp, Homo sapiens
tttggtgttgtcactattttttattttagtctttctaagtttcatgttttgcataaaacattgttcatgatccattttgaattatttttgtatatggtatgaggtataggaccacatggtgttgattgctgtggctgcatagtatagtataaccaccttctgtgcaaggcatccagttcctcccctctccactctgacccaccatccaataaaccagctgtctatgagagttataaataatgtcacctgcagattttgaaaaaagatgctcaacttctgcagggtgcagggtgttgtaggtccttcaaagaagatgtatggaaatgcctggatacccaggcaaaagttttctgcaggggcggggcccttatggagaactgctagggcagtgtggaagggacctagtggagctgtgagaagagggccaccatcctccagactccagaatggtggatcctctgacaacttgcactgtgcacctggaaaagccacagacactcaatgccagcccatgaaagcagccaggaaggaggctgtaccctgcaaagctacaggggcagagctgcccaagaccatgggaacccacctctggcatcagcatcacctacatgtgagccctggaatcaaaggagatcattttggagctttaaaatttgattgacctgttggattttggactggt

SEQ ID NO: 476752 - DNA, 1493 bp, Homo sapiens
gcaagatgggcacagaagaccaaatgccattggctgtcttaggctaacatgggaattgactgtatggggaccacaaaactcaaagtcccttccacaaagcagtactccctacaggcagatccaagtgattccaccttcttccgcctgctttgttccggctgcgctggcagccgattggatggtgcccaccacattgaaggtggatcctcctctcccagtccacccactcaaatgtcagtctcctctggcagcacactcacagacacacccagagtccaccagccccagcaagtcacctggacagttccaactcaatggggtggggaagtgtgctccacccatgctgtgaggagcatcagagccacaggggaaagggtgtgggtgtgtaatctacgacagcgaaggtggaatgggacccgccgtcccgctggccacaggtgcatccccaggagtgtttctgccaggtcacagggtatgtgcaggtctacctgaccaagcagtgtcaaagcatacttcagaatggccactccagccatgcttccacctgtgctgcccacaagcctctcagccctcggcagctccaaatcactaacttttgccaatcaaaagtgtgtaaagtgatatcacaatgtttcagctcgtgtttctctgataattagttgtgtgcatgtttctttatttgccagatgtccttctgggagcttgtttggaggttgtagcaggggattgcagctattcatatacccttgaccgaagactggccctcctctgttggggatggtcgtcctcttcaacggagtgtgcagctttgggagggatgtacgtggagtgtttgccgatgatgtctttttttgaacagaaaccattattttttatgtaatcatatgcacgtatgtgcgtttatgtgtgtgcgtgtgccttacagtatttttgcttggaagttttgtttaagaaatccttccctcccttcaagatcatgaagatattctcctgaacttccctctgtgaactccgcattgctacctttcatgtgtagactttcccttcatctaagccccccttcacatattgggtgagatagttttaccactttcagtaaaaatactaatttttatttttttctatgtctcctttctctcttggtctcacatacaaacctcccccttttctctcttctaatttgtgtaattgtgaaaaatggagtattttgagcaagtaaatacatgagtaagagctttttacttttattttactaaatttgattgaagtataacacacacacacacagggaaaaatatgcaaatgacaagttcagctcaagtaatgtcacatggcgaataaaccaccacatgcccagctccagctcaagacacaagaagctctggcagctcagaagacgcattgcaacctttaggtaattgtcccttcccaagccagcctttgatggttaatactgagtgtcaacttgattgcattgaaggatgcaaagtatt

SEQ ID NO: 476753 - DNA, 2224 bp, Homo sapiens
aaggttaaatgaggtcataaggggcatgatggaagcccgcttttgtttcacgaacctcatgctgaccacagctagaggaagctgctatcgtaaaataccatggactgagtggtttagaagaggcagaagttcatttctcacagtcctggaggctgtgaagcccaagatcgtggtgccagcagatttagcatctgaacatgcccagcacgtccctgctgcagcctttgccggcttgaccaagttccttgttcttacaggccgtgtgactcccccaggtcagctgcatccttccctcttccaaatccctgtggtgcacatcatgcagagacttctaaagaactcaccattggtaggtgtagattggacatttttgccattctcttttgcggtggtggcagctgtgacagatgcaggatctgcatgtcactcaggaggggcccagggctggtgggaagaatggagcgggcagggctggtgacagtgttgtaggtgggggcagaagcacaggccctccaagcacaggtggtgtgagaaacactagcatccaggaggtgggggcagcccacccatcaccatcctgctgcagtaaggatatgggccagactccatgaccagcaagatcatggagaagtcattggaagggtttggtacaggtcctctctgtggtggggaggactcacccaaggaccagtgagataatggagaagtcactggaagggtttggtacaggtcctctctgtggtggggaggactcacccaaggaccagtaagataatggagaagtcattggaagggtttggtataagtcctctctgtggtggggaggactcaccacccaaggaccagtgagataatggagaagtcattggaagggtttggtacaggttctctctgtggtggggaggactcgccacccaaggaccagtgagataatggagaagtcattggaagggtttggtacaggttctctctgtggtggggaggactcacccaatgaccagtgagataatggagaaatcactggaagggtttggtacaggtcctctctgtggtggggaggactcacccaaggaccagtgagataatggagaaatcactggaagggtttggtacaggtcctctctgtggtggggaggactcacccaaggaccagtgagataatggagaagtcgttggaagggtttggtacaggtcctctctgtggtggggaggactcaccacccaaggaccagtgagataatggagaagtcattggaagggtttggtacaggtcctctcagtggtggggaggactcacccaaggaccagtgagatctttgtaaacgtttggtacaggtcccttctgtgatggtgaggactcacccaatgaccagtgagataatggagaagtcattggaagggtttggtacagcttcctttataaaattgtagcttagagatgagcaaaatttagtttgatgagagcttatcaaacataagaccataccagtaatttctaaaaataataatgagttagaaattattgaatgatctgatgaacatttttccttgaatattatattacactgtacacactgtgagtttcgtaatatatacttcagtttgtttatagaatagaaaaaactattttagatttttgcttatatactgatttatagaaatatatcacattattcatagaacatgtgctgggtggtcctcacagcaacctctagttctaactaatgtgtggcttaattggtgtgtgatgtgaaactactctgcttcacttgagggctttggagtgtggtgactaagatgatgtttcagactggaagacgcccatcctactgagggaatgacaaaggcagagcaaggacatttgaaaacgtgtgcttcgaactgtgagaacacaaaatgccctagcttccacgagtccagagcccttggatctccctaaagatgccacatcgggcttcttgcaccatttcatcattgtcatgtgtgggccgtctattccatgaactactggacgaaattcacccatgatatttcaagtaggttcttttctattttccctaagtgtcggctgttctgagaaataaagggacagagtacaaaagagagaaattttaaagctgggtgtccgggggagacatcacatgtcggcaggttccgtgttgccccttgagccataaaatcagcaagtttttattagtgattttccaaaggggagggagtgtac

SEQ ID NO: 476754 - DNA, 1723 bp, Homo sapiens
agcttccccttctgccatgagtatgctcttactcccaatgcctgggtgcttcctggacaccctcattttaatgtccctttcaggggtggatgcaggcatccaaaacacgtggcttgctagaggatgcctccagctctcctgctctggtggagatcctcagaaccagcatgtagctagctgcagccagcacctgccaggtggtcagaaggggctgagggtgcacgggcagccggacatctctcggggtctgcagaccgggagtccgtgcttcctgccagaactggggaggtccttcagcattcagcctgagacttggctctttcccccagtgtgctggggccctgctgaccctggggagctgctcctctcacaatcagccaattcccagatagtgaaccatcgcccaccccacacaggctttccatgtgcaaaccctgcaatccatgtgcaaaggaggagcccacacctgccacctcctctgtgggctcacactcccggccgctgtccacccacacttgttaccccagggcagggaccagacccagggcaactgctgtccccagagggctagaattattcaagctgggcagtcctgggcctgctgaccctgcctcagcctcccttatcgtggaaaccacaatagaagctccttctcactttccctgcccctcagcatcccgaccaaccctggcacatccccaggtggcccccatggcgtggccggacccctcctctagggatctgtgagtaacacaccagctttccaatggcagccgttcctagttctgacctgaataataataaagtctacatcaaacacttcctaaccacagtgaaacccaggccagtctcttgtccctacttccaagcctttttacacgagctagaggccggccagctcttcccagagtcctcagttacgggagtcataaactttcctcgcccttctgtgtgtgatgtcacctgaagcatgttttgggtggggtcgtctgcctctgcagaagactgtcccactgggctcaccatactgtgcccctacagcaaaacttccgtaagagccacacttcatttctgttacaatttttaagacaccagttaaaccgaccagccacatcatcttcgacaattactctgggtccaatcaataaaatgggaacaaattggcctctttctcagatgctttgtaaggaagtaaatggatattttgtgtaaaatatttagcataatgacaggcatcattcactcattcaattaataattcatccaatcacttgttttttattaagtaaaattgtaattcctagcacagctcttactgcgtgtctgtggggtcaatgaaaacacttagggctacaccaagtggattatatttgatgtaaaccaggtgaaatgtgcagaattttgaggggtcttttgctacaataaagtgagggtgaggaacaatttagaatttctgctgaatttctgtaacttgaggaggttttcttgttattaagacattgagccagagagcagctccaccaggctgatcagagagccctttccctactcctctgaccccaagggaagaaactgagccatggggctgtgacctgcccacagtggggttgtggatggtagtgcagaatgagaacccagcattctgactcttcctgtctgtgttgtgttattccatgaggaccattggtagaattactgcagttaatcagaagccctgcatcct

SEQ ID NO: 476755 - DNA, 484 bp, Homo sapiens
gaccctcctgtgtatgggtgcagcatggcaccagccactggcgcatggggtgcagcggggattggggcacatgggctgtgcgggggtgcagcatacagaggaagaaaatcttcaagccaagctgttcagcctcagtccaaaatcacattctacttacagatccggggacaaaaatgccaattctaccattcatgatagttctgaatttgagcccaccttctcgagggctcagttgacagatgttttatctgggtccaaagacattgaagctgaccgtcagctctgccagggaaatgagagagagaaactgtggctcctgccccgacagtctggggtcccaagtctgcaaagtttacccacctgtacaagatgtacaaaactaaaagggaacctgaatgtatactggactctgggtggcaatgatgtgtcaccgtagattaatcagttgtagcaaatgtaccctctggtgtggatgttgataatc

SEQ ID NO: 476756 - DNA, 1444 bp, Homo sapiens
gaccctaatggaatggccccaggggaccttggaaggcctggaaacattttttattgtcaaaattgagggcaagtggagggcagtgactggaagggaaggtgggtgtgcttcactgacgtctagtgggtgtaagccggggaaaccaaagaccattgcacagtgcacagtacagcccccagagcaaagaaccatctggccctataggtcagcagtgcagaggctgagaaaccctggcctaagtgtattggagacaaaacctccatcccaccccggaccctccccctttaggcatctcaatggtgtcctgcaatgcacaggtagggaaacgctgcctttgcactcagctctgaaggggatgagaacatgccagtgtagtgtgaaatatgtaaagtgtctgcgtgggcaaatcttccctcaagaccaccggggaatcaccttctccccagcaggctcctctctgggatcctcctccatgcttccgaaacatcatcaagcccctgtggtagcaccatttcctcagtccgtgagctttctcaaagacgtagctcctgccctctccatctcaccggcatgcagtgaagacttcacctccaaatatgtgaatgaggctctgagccctgaaggatttggagaaggcatagcaacgaattctgatgaaacctaacaactggttaagcaggtattaagggttgcagaacacaagatctcataactcaatgccccatatcctcaaaacaaaacaaaaccaactggtaggcgagggactgtgcttgaagaaggggaggagttctgtgtgtggaagagactggaagaagagaatgttcacagtaggtagctagtcgggtgggagcggggcaggagaggaggaagttcacctgagacacaggtgagtccacaaatcagcacctgtatgtgaaagatgcacttctcaggggagtctcagcagatacgactgggggaaaagacagcagagaacaaatatttagctctagttgcttgcaaacattattttcgcccaatacttttttaaacacaaatattcttgacttaagaaaatgaaaaaggggttaataggactttgctgtacaagactaaacctgtcctatgggctgacctgaattaatataaatagtagatcatagtgtcttgatactttatttctatcccaggttattttgaagccatttaagcgcagaaatatgaaaccacgctaagattctgaagaagcaactgtttccccaacatttttctccagaaattccaaatgtctctggggggcattcccataaggtgggtttacacttaataattcagttgaaaatgcagcctttattttaaatctttgtgatctatcttcctttttaagcttttaaatctgttctcagtcaactggttttgaaggcagagaaacaagtttacactggaattcatgtacagttaatga

SEQ ID NO: 476757 - DNA, 481 bp, Homo sapiens
ttttaggttcacagcaaaatggagacgaaggctgagctaactatgagaggagtttagtttatagtttgaagcaagaatgataacaggctatattagtccattttcatactgctatgaagaaatacccaagactgggcaatttataaagaaaaagaggtttaatggactcacagttccacatgtctggggaggcctcacaatcagggtggaaggtggaggaggagcaaaggcacgtcttgatgttgtcaggcaagagagcgtgtgcaggagaactgccctttataaaaccatagtatctcatgagacttattcactggcttgcttcgcaaccatgaggactgaggacttagcctgcactcagaagcctcccagaagcagggtggtgaggctgacgccttgggagcaaacatcaaccaatggggtgtaggagtcagcggctgcagaatatccacatcagctcactcatctgcgaagtaaaaat

SEQ ID NO: 476758 - DNA, 628 bp, Homo sapiens
tatggaatacagcaagctctggtatgaatggtaagagcgtttctgcaccaagcctcattccaactagacaggctatttatttatggctaaacatgacattggattctgggactgaggcaaattttacttctttttttttttttttttttttaaagacagagtttcgctcttgttgcccaggctgtagtgcaatggcgcgatattggctcactgcaacccctgcctcccaggttcaagtgattctcctgcctcaccaagtagctgtgattacaggtacccgccaccatggccagctaattttttctatttttagtagagccagggcgtcgtcgtggtgggcgcctgcagtcccagctactagggaggctgaggcaggagaatggcttgaacccaggaggcagaggttgtagtaagccaatggcaccactctactccagcctgagcaacagactgggtgagactctgtcttaaaaagaaaagaaagtaatattgaaaaatacagtaatacagctaagacgatcctgtcacagatgagacattgagattttggttttttcaaacagggttatgttaccttagtagtagcaatgtaaagactcaacctgaacattaaacttttcatggaagt

SEQ ID NO: 476759 - DNA, 1940 bp, Homo sapiens
gagttcacgtcagctgttcctaaataggagggaagctgtacaaaaacgtctctgctgtcaaagacaacacgctcagcattgacatgcggtcactgctggtcacaccaaccagcccttgtgcattgtggaaggggcctccacaagggtgagcaccaggagggggatctcagggcaccagcttggaggctggacaccacagggatcttgggccaaactacaggatagggctgaagttcaggactgactgttacaaggccaccaggtcatagccccccgtgcagtcgcaagccaatgcaccaagacagcagggtttgcagcagagaaagagtttagtggcggcagggctccaggacaggagctccagccactgcaggctccacaccgcagccctgctcctccctccatggggggagctcatggggctccacgtgctcccacctcatggggacccaaggagatgaccgctgctggctggggcagcctgcttttattccctaatctgaccccaccctcatcctgctgattggtccattttacattgagctgattggtctgtttttacagggtgctgattggtgcatttacagaccttgagctagacacagagtgctgattggtgcatttacaatccttgaactagacagagtgctgattgctgcatttacaatcctccagctagacataaaagttctccaagtccccactgaactcagaagcccagctggcttcgcctagtggatcccgtgctggggccgcgggtggagctgcccgccagtcccacgcagggcgcccacacctctcagcccttgggcagtcgatgggaccgggcccgcagagcagggggtggtgccggtaggggaggctccacccacaggggtggaggcggggaggctcgggcatgacgggctgcaggtccccagccctgccccgaggggaggcagctaaggcccagcaagaatttgagcgcagtgcgggcgggccggtagtgctgggggatccggcgcaccctctgctgctgctgctggcccgggtgctaagcccctcactgcccagccagcggcaccagctggttgctctgagtggagggcccacccagaactcgcgctggcccatgagtgctgcttgcagcccaggttcccgcccgcgctctccctccacacctccccgcaagcagagggagccggctccggcccggccagcccagagaggggctccttcagtgcagccgggggctgacgggctcctcaagtgcgccagagtggacgccgaggccgaggaggccgaggaggaggaccaaagacacagcaaggccctgtcccaagtccactcacggggccacctaccccatagccgcaagctgcctcagagacacaggccctcccgccccagctgctccttcctcctcccacccaggaggccctgctggaatactggcagtgaaatccgattgaacgaactacagtggataatcttgctcactgaccttgccggcctctgggtgagagtgggtctcaccaccactgacgacctacgtttcaccagctttgccccctgccatctcaggctaggacgctggccaccaagggctccttgccaagtgtgcctggactcaggctcccacacagctggaaattgactcctttgtgtgactggctcaggtcaaacagctgctcccgtggtgtctgctgctcacccagacacatgggaccatcctccacctcggagccctccacagcccccaggttccagccgtggtgactggcaggaggctgctgcagaccctgggctgcccaggtggccccagatctcagagcttctctggaccgactgcatggcgctccctctgggccacagagagtgcccccagcctcccaggccaagccagccctccctttgtctcccagaaaacgagttcttcagctcctgctggagagcctctc

SEQ ID NO: 476760 - DNA, 1929 bp, Homo sapiens
tctgtctttgctgaacaaagtggcaggctggtcagcagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggtaagacagcccctggttggaccttgttttcgtgactggttccctcttcttcttagaagcaatctgcctgccatttctcacattgcattttgttattctgtccctgttgtttgctctctctttttttttttttgagttggggtctccctctgttgcccaggctggagtgcagtggcacaatctcggctcactgcaagctccacctcctgggttcacgccattctcctgcctcagcctcctgagtagctgggactacaggtgcccgccaccacgcccggctaatttttttgtatttttagtagagacggggtttcaccgtgttagccaggatggtcttgatctcctgacctcgtgatccgcccgcctcagcctcccaaagtgctgggattacaggcgtgagccaccgcgcccggcctgccatggaagagctggtggatgaagggctggtgaaagctattggcatctccaacttcaaccatctccaggtggagatgatcttaaacaaacctggcttgaagtataagcctgcagttaaccaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaagcaagccaagactgagactgacacctcaccagtggagccgtgtgcaggggcaggccttgggcctccagggccccgtgctgtgcacgcatacacctacacctttgctcaggcccttcagccacaccgagagccaggatatgaccaccttactcagctacaacaggaactggagggtctgtgccttgttgaggtgagtgagccccagtgtgaggagcagttcccaggagatattcagatgctgcacagcaagagagtgatccctgcaggcctcagcgccaatgtgctctcgtcacagctgttcttgctttgcacattaccttgctttctcagccacgtgacttgcatcagctgaactgcatggagccaagatgccaagagatccgctcttgatatcttcttccagccctggggcattgttggcctggcctgaagtaactacatattttggctttccattcaatttttaaatcctagcagttcatctgaaactaggtgatcccaggtgaccctggatcaaactctggaagaatttgcctgtgactttttgtcttaatgaccctaatgaaaggggtttggtcgggagcccctggggctgaggtttgagacagtcccggctctgacctgctgtacctcccacaaggattaccccttccatgaagagttttgaagctgtggttgcctgctcgtccccaagtgacctatacctgtgtttcttgcctcatttttttccttgcaaatgtagtatggcctgtgt

SEQ ID NO: 476761 - DNA, 876 bp, Homo sapiens
gatcatgagagcagggaacgctgaccttgctgcagggcctcactcgctgcatcaatgggactgaacctggacctctcctatgcatgttgattcatgtactcccccagatctacatgtacagtgggccagaaggacaacttctcattgctccccctgaattgcatttcaggtttcaccgagctgccctactccttgtaccccttctagctggccttagcatagctacgtcagcagctattggcacgactgccctgattcaaggagaaactggactaatatcactatctcaacaggtagatgctgatttaagcaatctccaatcagccataaatatactacatgcccaggtagagtctctagctgaagtagttcttcaaaaccgccgaggcttagatctgctatttatctcccaaggaggtttatgcacagctctagaagaaagttgttgtttctatgccaatcagtctggagtcataaaaaatactcttcaaagagttcgagaaaatctagatagatgccagaaggaacaagaaagtaacaccacctttctcattcctggagtaccaaagtaccaaagcatgtttaactggaatccctggctaactactctaattactgggttggcgggacccccttctcctcctcttgttagggttagtcttcaggccttgtatattaaattggtttcttaattttgtaaagcaacgcatagcttctgtcaatcttatgtatcttagaacccaatataacacccttgttataaccgaggaatcaatgatctgattcccccaaacacgagtgggaaatgtgataccctaacttcttttaacctgattgactctctcttagctgagagagctggacagactccatttt

SEQ ID NO: 476762 - DNA, 562 bp, Homo sapiens
ttgtgctttcttttccctaaacatgggcatcctcccaggtccaggcttgatctctcccctagaaaccaataatacctacttcacaggacagaaccagaatttaaaaatgcaaacaaaatatgaaggtaccttgacaaaattatttatattcaacttgtacacaaacccagaaccaaatctgagaatgcaagttggtgcctggggaacgagaaacgtagagaatggaagtgggaggtggaaggagaacagtactgtgcactgcacaactccaggggtcgtcattcacattctagtctacgtaggctgtgctctccagagagaaggaagagtaaagactcagatgcattgccctggccttacaaatttagagttggtgattggtggcacctggcagagcaaagtttcctctgttccaaaggaagaaaaggaagaaaaagaaaaaatatttgcttaaaccattaaactctaaactagtcaactaattctgaccaaatttaagatgcctgatactgaattgggatggagaaaataagggaggtatttatttgattaactttttaaa

SEQ ID NO: 476763 - DNA, 1737 bp, Homo sapiens
atggctaagagcttctctgctggccattactctcaagcaccatctgtggagaccatctgtatgtaatgtgtctttttctctttggctgtcttcagcaattcgactatgcttacaaagagccctgttttgtgtattcccgagttgggggtaaccgaacacctttgaagcagcctgtggattaccgtgacaatactttgatgtttgaagcaaggtttgagagtggtaatctacagaaggtagtcaaagtggcagaatacgaataccaattgactgtacgccctgacctcttcacaaataaacacacccagtggtactatttccaagtcactaatatgcgagcaggaatagtctacagattcactattgtcaacttcaccaaacctgctagtctttacagtcggggaaactcaagtgatgcacagttgcttcgggacacttttgtcttcaaggtggtacccatgctcaatccagatggtgtgattgtgggaaattatcgctgttccttagctggacgggatttaaaccgtaattatacatctctcctgaaggaatcttttccttctgtatggtatacccggaacatggttcatagactgatggagaaacgagaggttattttatactgtgatcttcatggccatagtaggaaagagaacatcttcatgtatggctgtgatggtagtgacagatctaagacattatacttacagcaacgaatcttcccacttatgctaagcaaaaattgtccagataaagtaagcaccttttaaggtattaacttttcctttatcaaatgttgcccatgtgagatagcagaatggcccacgtggataatactattccaaactgctttttttttagttagtttgaccagtttatacaattgacaataagaaagcaactatatagaactacttagtgagcaataatttgaaaatatggggaaaaaaggcaaaaatgcccccaaacctaccaccataataccactgctcttttaccttttgaaagcttcctctattagtcatttttatcaatcaattttaggggtttttttattgtttaaatagtcattgagtgcctaaattatacagattaatttcttaagaaatgtatattcttaagaaatgtgtaacagtttcttcaaagtatttattagaattttgccaggaaaaaacttaatccaataaccaatatttttaaaatatatagaaattagaatgagaaaagaataaagtatattattattttcacaaactatggaaatattggagcctcatttaccaagatgtgaaaattatattttaatcattctttagggaaaagatgttaacatagcaaagaaaattcctgcagactttcctttaagttctcaaccaacaaattcaattataaaggacttactggagaagaactaattgtcttttggggataattggggcccaaagacataaaaaggaaaggatgatctgataaaaatagctatttaaagaaagaacaggtttgttcgccaaagaggattcatttcctcagcaagaaagacgggaaaacccaaacccatagctgaagctattgctatgtaaatttatactgtcaatactcttaggtatagtttattactcctataaaataattctgtgttactaagatattttgatgtttgtctattgacatgcttcttagggttttagatctctaacctgttgtgccttagatgaaatggaccaatttcttaaataa

SEQ ID NO: 476764 - DNA, 674 bp, Homo sapiens
gcgataggtaaaacactatcccaactcagatgatttgactgagtatctacggttgaaaatcactactctgttatcatcatgctgattccaaactggaaaacagtttgccaaaatgtaactactgccctaagctgctcctgctctgtagcagcaggtcttgcagccagctttggcatcttcctgattccagctcttcctgtatactctgcttgggtttccccatgctggttcaccaaggctcagagtggaaggtcgggctcccataagtcggacagagtaaagtcctgtgaaagtcagaatggattctcagaaagagatgtgtctggagggagaagtcctggaccaatagactacttcaccctgaaggtgcagccaatgggggtggaagtgggttcctatgagtggcagctctccaggaagcacatagaaagagcaaggggcagttcttccaaaggaaaggaaagaatggcaggaggaagacgcaaaaagagactgagaatttctaaaagaactgaccttcctcctggagagaaagaattttccctccggggaagttctgaagcacctgtcagggtccgccctctggggcaagaggctttctaccagagccagcagccctggctggcacttggcaggtgtcaccagccatcaggtgggggcacctctaactgagc

SEQ ID NO: 476765 - DNA, 505 bp, Homo sapiens
gggagaactatattggatatccagtaacccagggctagcagctcacacaggtaatggtaatgctccacctgtgtttcccaacccaaaaaggtctggagtcttcccagaaaggcccagctcagtgtaagatggaggctacagcccagggtcactccctggccgtggcttgcccacacccttccacacttcgccatggaaatagccagccagcagctggacatgcaggactccagcccatagggaaaaagtggctggatgtgggggaggactacacctcctccaacagcagctggcccagagaccagcattcacatgcagaccagggatctacaacccatggaggagcaggcccattttcccccatttctttttcctcttcacttttccccttttcccaaccacttgctcaactccctgacccctgccctacatgtccttccctttcttctaccgtcactgcactgagaaggcgattgcactttccttacttcatctaaaacctaac

SEQ ID NO: 476766 - DNA, 537 bp, Homo sapiens
ggtgtccagccagcacagctcactgaggaatcatcagtcacaaaagtcagtcaatgtactggtcgccccgtttgcatcccagaactctggtggaagtggcgctcgaagcagaaacacagctcttatatcacaggaaaaggaaagcctatggaggaaagagtcatgatctgactgacttcttgaaaagacaatgccacccaatgtccatcaatgggaaagttataaatttaatttcagtgcttccattttctggaatattacgtggctatatgaaaaaaagaaagggaaagaatgacatattgacctggaggaatgcccatgatatgtttatcagctttgtggagaatggattggagaaaggcaaaaatgaaaatggaacaactaatgaagagaatatttcagtcatccagatggtagttctgaatgtggtggtagcagtgatagactgcactcctgtgatgttttacctacttactgagaatgggaaatagggagtaggcaattatataacaatgagaacttcctggttgggaataa

SEQ ID NO: 476767 - DNA, 763 bp, Homo sapiens
agaagtcaagtgagagtttatttaaggcactgtgacaaattgatgtcattcatatcccacaccaatggtctctctatacctatgccttttgcccttttgggagttttgatgaaaggcaatggtctgaggagagatacaggaattctgggtcaagggttccaggtgggtaatgaaggggtacaattcaggggcacctatgtggagaggcaacatgacctgccagaggtcacacagcagactgcaggcgacatggcaaggacctcaggcttggagagagtcacagccgctggtgcctcaacacatgatggaccggagcagagcgagggttttgtcacagacttgcatctgcaaacctcgccagcctgttcagctgctgccacagggctcaggggctgtgggtggcatttctcttcacctccacctcttgcatttcctcaggctgaggggagtcaccggaaaggctcttactcgtggggaactggagctacatcttgaaatgattgctcagtgcatctcacactagggttctacagaccatcctgaaggcattgggtcaacaagtaactccatatagaagcctggcctactgctagttctcgggctatcatgagcaagaaggcaaccaaatctgtgtgaataatgggaaacccaattgaatggtgttttttgagatgtttctgtttgtgtttcaacaccaaatgttgaaagcagaaagttggttttgttttgctagagctgctgaagccaggagatgtggagttgc

SEQ ID NO: 476768 - DNA, 1535 bp, Homo sapiens
ttctgaggttttggagagtgtgataatgccgggagtatctgacccagctggcctgctctacagaaagcatggcaacatctgcttttggggaggtctcaagaaactttcaatcatggtggaaggcaaagggggagtgaggcgtcttacatggccagcgctggaagaagagattagagaaggtggagaagtgagggagagcatagttgagtgttggtgtggtgggagagacagaggatctaggagggcatggggaggaatctggacctttgacttggggcaatgggaagccattgagagtttccagcagaagagtgaggaacatgtgtcgtgtaggcgcagggccatgacacagagactgttgggaggagcagagtgtcagggatgggccaaggaagaagaggaaggaaactggaaaagagagcccaagaggtggggtctgctaggagaacacagggtcacaggagccaatgggattgagtggcaaatgctggagagaattaatacaataactttaaagtatccactagatttagcaacaaagagatatttgatttccacttttgggaattcattttttttttcaatgaacaaatacttcctgaacatctgctcatccatgccagacattactgttggcctgaagctgacatcctactaggggagacaaacagcaaacaagtaaaccaatcgctggacaaggttattctaggcagtgataagagcatttatgaaaatagaacagggtgatgtgactgtaggtgattgttagtgggtggggatgacagaggaggcctctctgaggaggtgacatttgatccaagtcttgaatatcaggaaaacacatttgcaataaagatccaggtgacaagaacgttccagaatataatttggtaccattgaaatttaaacatgcttattctttgactaagcaagactactttgaactattcagcctacattaaataactgttcaaagacataggtacaagatgtgcaaaatactgcgttgttggtaatgataaaaactccaaaataacacaaatattatgccacagaagttacctaaataaattgtaggccctaacatgtgataaaagaatatgcaactctttaaagaaatgatatcaatctgtatgtcctgatttgaaaaatcatacatggtgttgttaagaaaatcaagttgcagaacagtctgtataataggaccttattttgtaaaaaccactaaataaaatcatatattggtagatatggttatatgtgcttagaaaaagctctgaaaggcttatacaaaattattcagtgttatcttctccaggaggtaggattgtgggggattttcagttcctattttgtatctttttgtattgtttagctttcgtttcaaacatagtgacatttctaaatatgcttggtaatgtacattatgctggtaatataaattatacaaaacatattggcattttggcaaaggtagaattaacataattatgagtgtaaaatatattatgagtgtaaaattctaggcagatgtc

SEQ ID NO: 476769 - DNA, 511 bp, Homo sapiens
tgctgttatgcagtctccgctgaaggaaaactaacaaacagaaagtaatagcatcaacatgaacaaaaaggatgatcatgcaaaaacttcatctgaagatcaccaacagcaaagactaaaggtatataaatccttgaaggtgaggaaaaaccagaacaaaaaggctgaaaattccaaaaaccagagtgcctcttctccaaaggatcacaactcctcacaagcaagggaacaaaactggatggagaatgagtttgatgaattgacagaagtaggcttcagaagatgggtaataacaaactcctctgagctaaaggagcatgttctaacccaatgcaaggaaactaagaaccatgataaaaggttagaggaattgctaactagaatgaccagtttagagaagtacataaatgacctgatggagctgaaaaacagagcacgagaacttcatgaagcatatgcaagtatcatagccaaactgatcaagcagaagaagggatattagagataaagc

SEQ ID NO: 476770 - DNA, 1136 bp, Homo sapiens
taagggaagctgtctggtttgagctgatgtttgcgctgagtcctaaaggataaacagcagttaaccagatatgtggggaaagatggcaatgggaggaaagggcatttcaggactggatgacatcattggagcctcttttctccttattttttcttccctggctgatgggttggggtgcacttctatttggaaagagttcctggtcatggaagacctagaagatctgggtaataagagaggagtgggcctggtttatgagagttgcatctgtgctcagggggtcttatctcctagaaatccccaggccaggttgcagactgctaagcaacatgtagtgcaggccctgcaccaggtggacaatgctggcaccagtgttagcagatccaggcaggccaatccttgggcctatgggcagttttcttggatgccagtagtaccagcagatgaccaggctggtgggtgggtccacaggcccctgggcagcaggccagctgtgggatacagcagtagtggtgggataaccttctggcttccaagcagtccacactggtgttgccagcacatgaaaatgctcagcagctttgctgctgggggcatcagtgttactgccaatggcttgtgtttcagccctggcaagatcaaatatagacttcttcaacaaaataacagcagaaaatcatccagcatatccttaaacaactcccttgatgatggattgatcattcctaaagttaggatgtactcacatcccaacaaattgaaaatgctgaccaatcccagcacagccaactcgaatttgctccttcatcaaagtgaccagcacctcatttcttcctctttagaatttatagatgacaaatttaggggtggaagcttcctgaaaaaatctcccaaacaactcaagacagctgccaagaagccaggatagaaaaactctgggtttcaattctcagttgagtctctaatagatgatcataaaattgaaaaacaactgaaattatgtgtagcagcaagcttagttatattaagcatgtatgagaaacgtgccaacttacaaggactcaatgtgaggtgtttgtgtggcaattcaacaatatcgatttattctgaaggaattgaggtcagctatggaaaaa

SEQ ID NO: 476771 - DNA, 3339 bp, Homo sapiens
gatacctccaactcccctactgtcatcaacctttgggttccctgggcctcgtctatgccatggagcatggtgctgtccctggcttcaaagtggaacttcactggggacccacttctttctgcccaggagcctgtctgcctcctgccaccatcaatcatatcatctgtggcaacaaggttgttcctgctgaggggcacctgcaggactgcactaagctgccctcagccctacctcaggctccttcctgtgcttgttggcagccacagtccacatgggctgaaatggcagagggctgctgtgacagcattgccccaagcttgtgcacacccagctgggttgtgacagcacctgggcttggcctcaactttgctccagaattggagccattgccaggagtgaggagaggccaggcccaggagcaggagcagacatttctgagcctgcatgaggagcggggcttcctgggttcccaagagcacagggatgcctgggtccacagctgcagctgtgcccaggagagtggggatcctacactttcaactcagaagggggctgggctcctgcctattgccagctcctgccagatccatggagtattcatccccagctgcaattcccctgctgcagctggcatctttacagcagctgctccagatgggccaccactgccatcaatgaggggtgccttaaggggttcatgatggtttttaagatctgataatggttagtaaagaagaaatctgaaaaagcactaatggttctcatttaaaagacacaaaaaagaacatgggaagctgttattaaaatctttgttcaattgttaaatgaagtagaaggttaaatagaaaatctgctgggtttaaactattgggaagatatgcatttgtggtgtcattgaataattttatcttcacttttgaattctttattttaaaatgtctttttgaataagatatttgggctgataacactgagactagaaggagaggaaataactcttctatttgtaatgtggaagagagagctgatgttagttatctgggttcattggtgatatgaatccatatggattcatggagttctaaataagaagcagaaggaaaatccagtgggggaattattctgaagtttgtatttcattccagcctctaggaagtgaggctataaagtagttagggcaggctttatgaggaaaaggtgggcatgaggtctgctttactaatttgtattatattaaaggaatatctgtgtgctctggcaatgagttctatattatctctcagtttggtatattaatgtcaccctacttcatgctctgtgcctcagagtgcttctctggaggtttctgatactattgcaaagaggtgtctctgcttctgaatagttatttgtcttattctttatgtcataagccccatacacagtatcgctgattacaaaggactggagcaagccctgcgaatgcctgaatagaattttctaatgggtgagaggttgaatcaacatttcccctctcaactcagaaaacaagtgtgtaatggatagacaaattagcaccttccagaaatgtggtaataaagaatgtaatagaaggaaaataagctcaactctcaagaaaggtaataaaaataaagagaaagctaaattttccttatttactatgatagagctgaccttctgtaatgtcaacattaaaaaggtttaaaatgtcactattttacttggatttctgatgtcagctcaaattttaattctaacatacatttgcaatgcaagtttgaaacgagcaatgtatataccatttcattttaattaagccatcttagaatgatggcactaaataagcacctgctttaagacacagggttgtgcctatttccttccgttcctattcctgctcaagactgtcattctatgctgccttttgagtttctagctatttaaagtaaaagtttttatcaggcttgatgtcactgttgaacattcatagccatattttggcaaggaaaccagagcctggcagtctttttctataattttatataatgcaagagggcttaatgcccctattatagaactgattctattatactctcctttccagaactaatggagcacttgacttattcatgttaaagaaaatgattgaatatgaaaagcttccagaccctgtttcttgccaggattaaaactgctctgctctttatactgaccagaaaagtcaccccttaattaagtttattgtgatttttcacctgccaggaagtcctgtacaatgcacataaaagcccatttgttggaaactattttagatctctctttaaaacctttgtttgttttaaaatatacaatagtgatagctaacatttactgagtccttacaacattacaaatactcttccagttctttatattacttgattaaaatctcagaaaaccctaagaactaggtactgttattatcactattttatagacgaagaaagtaaggtttgaagaatttgagtagataatggagtagagatttaaatatataccttctgagttattaatgactctgctaagctctttttttcacttggctaaaaacctaaaaaagtgaattaagcttgtagatttggaaggaatacatttattaaaaatttactgagtggctaatgtttgcagcataattgtagtagcaaagtaggctagatactaatgcaggtaaaatatagttgcttagttaagtaaacttttcatccagcaaattagacaagaaagagctaagctaattaaaatgtaaggtagtgggtattgtgctatactacaagtacaaattgaatagcaggctcagaagtataaatttataatttttcttatagcatcagataaagcgttatggaaaaggtgacaatcgagcatgcccttgaagatttgtggaaggcttggacaagtacagtcatggagatgcagtttcagggtagaggaaaatgtatgcgtcacagaaaagaaaggccaggcttgtttctaaattgcttattttagtaagggagggagacagtttgaagttttcatagcgtgaaggtagcatagaatcatataatattagatttggatgagtctacagagattgtttcctctacagaattttcagtgatgtagaaatcaaatcccaaataaatattttgcatctattttatttgtatgagtgcttattgcagaaggaaagaaggttgcaagagaaacattaacttgaaaaaggaaaatgacattcatcttatggatgaaataattatttatagatgaaatttcatcttatataataattgaatgttcaatttgggaatttgcattccc

SEQ ID NO: 476772 - DNA, 758 bp, Homo sapiens
aagcaacaggggaaagagttgaagtaaaaatttgtgctgggaagcaaatctcacaattaagcagaagaaacggagggcaggaaagagcgagcgtctgaaagatgcaggaaacatgtcaatatttccctctactcaatttctccttgaacgcctgaagtacactgtggcgatgaagcagatttttattcctacttattgggaccaagtcctgcttgcggtatggtcagccttagaactgactgtgagccacagggaacaagggcttacactgtcttctggggacattggcatcagcccagaggcattctcaggctttgacttcaaagcaacagcaaaaccaaaatggataaagataggaaataacaaaataagaaaagcccagcaagttggcccccaggtccaagtactgcagattccagtgtatctttccatctcttcttccaacaacacaatgactgtgaaacataaggagggaagaggaaagagtcttcctttacgtgacaaacccccttttcagatgttcagtgggacagtctgagtagcagcatcttctttcaagagcataatatagcggagcatgtgattgcatttccaacctataaatatccagctcctgaacactcatctttgagttctaaatggaataagccattattgccatattgtaaactgtaacagactggaatgttgttcagcaaatactactctccaccccatgccccctgcagggaagcatcttaacctgtcccctgacacct

SEQ ID NO: 476773 - DNA, 523 bp, Homo sapiens
gatttctgatatttaggttagtatgggtgtgacagtagccctgtggactccccaccgtgccggactctcagaggcacctgcaggactgtgggcctcgaggacagaggggaggtggcagtgtgaggatggtgtggtctgccaaactccagaacgtggtttcctctggctgcgggcagcacacagtgtcaggggtcagaggcatcaggaattggatgcagacgagggagttaacaagggaagagacagagaaggccatagcatggagtgggcagaagtgaaagatcggagcaggcagagcggggcctaccagaagcagtatctgcttctatcagcttcttcagggcagatatccaaaggagaggggaaaggaggaacgcagctttgtgaagaaaggaagagggcttgccacagggatcctttctatcaagatgagaagatgtgggcaagtccctgcgtgtcagccccaccgaggaggatgcagggggagcatgtgcataggcaccagcgtgcacatcgatgacag

SEQ ID NO: 476774 - DNA, 709 bp, Homo sapiens
ttaatggaatctacacgtgggattaatgacccaaaatgatacacgcacacatgtagcattggcagaagctgagggaaggaaactggaaaataggacgtttgccacgctggaggccaatgcaaatcaacaaatcaaacccttgtgtgcctctttctggctcagatctttttcacaatttatcgcgtttggccaaaggttcagagagaaaatagatgcaatattatctatcaaagctagattaatttcatggaggaacctaaatcatcgcgtgctcatggatccagtggttctcaacctgtcctttgcatcacagtcacttggaggactcactggaaaacagcttgctgggaaccgcccccctgtttctgattcagaaaatctaggtctgattctaggatccaaaaatgtgtttctgattcccaaatgccaagttcaggccgctcgaactcatttttcttgtgctgaatgaggcttgaattaaattctctaaacacaaattaaagggtatctcggcattaccaggaagatttgtgtcttgtgaaataatgggatggtttgagtcaaacgagtttgcaagaactactcaaaccaaattggttttgcccatattttaaaatcttttcacatttcacttatatttccacacaaatgcataaatcttaaagcaactagagtcagctggaaaaaagaagtgttctaagcatttacc

SEQ ID NO: 476775 - DNA, 1450 bp, Homo sapiens
ccggtcggtgccattggttggcggcccaattggcttgaccagggcgggaagcaggccatgggctccagtttctctgcggtgtcagcaggatgcagagtaagcccacttccaccaggcatcgatgatacacaatgaggcaatgcaaggtagagtggtccgcgttctgctctcccttccctcccgtactggccctgggcccaaaggagactgaacagatacacagccctgggtacatggtggatccattgacactgaactcgcagtgctctgcatgtcgcatgtgcaatggggccagggagctgcagggctgccctggagcggatgaggggtggctggagcttcgcagaggaaatggggtagattatgtggggctgttgaatatcttcacaaacacaatgagaatctcagaagctatagaatgtctgacacatacaaaaagaaagaaagaaaagacagaaagaaaagaaagaaagagaaagaagaaagaaaaagaaagaaagaaagaaagaaagaaagaaaagaaagaaagaaaggaaagaaagaaagaaagagaaagaaagaaagacagagaaagaaagaaagaaatctgaattcaggactagatctaaaataataaaaatcaaaaatgaatatctgaccctatgaacttaatttttgcctatcaaagtatttttctgttagcttgttttctttaaaataaattgaataagttaaaagtcagcatgacctagtgaagactgtcaaccatagctgcatgttaaaataacctagagagctttagaaagaaaaaacagcaaggcctttaacctgctcccagaattaccgatttcatggtctggatgagcttagccattagaattttgacaaggaaatgagtctccattttctcctgtcagagagaaataatattttttatcctggatggtcattataatgatctaagcagctagaatactcttgcccatggcttgcttgctcatttctgccaaaaattttataaaatatttgcttctcaaaggtgccccacctgtcaccatagcaaaggttgtgagctcccccacgaccctcccgccttgtccctgctggattcctcaccagggcaccttaaaataccccatagaattagtatgttcactttgctcctggttcgtcttcccctcctggcatgtaagctccacaaaatagggaatttttgaccttttgttccacgctgcaatatctaggtcagaagctggcaaactacaggccgtgggctaaatatgctccagtgcctgtttttgcaaataaagttgtattggaatgcaatcacccattgtgtatgtattgtctataactgtttttgcaaataaagttgtattggaatgcaatcacccattgtgtatatattgcctataactgtttttgtactgccctcagttgcaacagagactgccttgtggcctgcaaaatc

SEQ ID NO: 476776 - DNA, 1164 bp, Homo sapiens
tgggcctgcctctgtatccctgcattacctcacagcatcttctttataacactgcgaatgaacttgtataaacacgagtcagaaccacagctgtcactctccttgtggacagaccatttgaatctctctctaacttgctgtaaagaagaactcacagataattttccttttagtgtaggttctatgcagtcatatacactgaaggatgagaatatgccactgacctggtgggatgtgaatcttaacaaaggaagtcattcttatctcagtgagtgcattgatgatcaagagatgtgggttcaaaacaagtccatccagaaggcagtttggtggaaactctttcaaagcatccccatattatataacattagatggctcttacttcatctaggtccaaagagaagcaacattgctttgcatttctctttacatcatggttctcaaactttttggttttgtgagccctttatactcttaaaatgtactgaggacaacaaagatctttttcttatgtggattatagcaaattgatatttaacacattagaattaaaattaagagtatttaaaaatatttctttattaagtcatttaaaatgataataatatcattctatgttaatacaaataaattgcattcacaagttatgatttatactttgaattatattgaaataatttcagtgtttattttctttctctgattgttcctggtttggtcattgggaactctttcaagttgggtactatcaccttttgacaagctcttatcccttttattttcttttcactttcttactttctgactttgcaaaaaatttcaggaccaacttctaatttttaagtagacattttaaagttgatatctgattggatattgagggtcacgtcctcaattccatgtcttggggggatattacattccagatcatagcaaataaaatggtataaagagtgtaaaatgccccccactttggtcttcttggtgttttcaattggaggtttaatttcaaaatggaggtttttaattctccaggtggagagcgggaaaggggaattagcggtagatcaccctaagttaactctagtgatagaatttcgtgactgaaatggcagtgatggaggggtaagaatgcctcagggaggaaaataggaagagtatttc

SEQ ID NO: 476777 - DNA, 608 bp, Homo sapiens
tgcctgctggcctttggaatggaactacaccatcagcaatcctgggtcagctcacttcgacagatcttgagacttgtcagctgccataatcatctactgataataataatcctctatatttgcatggtatttcagatttcgaaagtgctttcacattctttagctcatccgatttttaaaaatctttatgtaaataaaagattcatttgtcaaatcttaaacttagatatattgggtgaatttcccacagttaagctactagttggtcaagtccccggccaagccttacctaatgtcatatatattttggatgttgcatgtaccaataacaaaggagtccctgtgtttgttgttctctttgatgggtccactcttacccaagatattttcatgtataactcatgctcatcattcaagttctacatcaaagtcaccttctcagagtccttcccttaccgtccctataatgtcaaccctttactgtccttcctgtagccactagtccattcgtaactctctctcctctatattgactaaaggacagccttttgcagcgtgtatcctcatctgaaataatattaggcatttgtcgattgttgtcttctttc

SEQ ID NO: 476778 - DNA, 1973 bp, Homo sapiens
ctgagaggttttggtggcggtacagacacttttaactcacagtaaaagcaaaagcaacagctcaagcagcctccttggagaaaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaaaaagcatcccgggaatggcaggggagagaccttcttgttgtagacactccagggctctttgacaccaaggagagcctggacaccacctgcaaggaaatcagccgctgcatcatctcctcctgcccagggccccatgctattgtcctagttctgctgctgggccgctacacagaggaggagcagaaaaccgttgcattgatcaaggctgtctttgggaagtcagccatgaagcacatggtcatcttgttcactcgcaaagaagagttggagggccagagcttccatgacttcatagcagatgcggatgtgggcctaaaaagcatcgtcaaggagtgcgggaaccgctgctgtgcctttagcaacagcaagaaaaccagtaaggcagagaaggaaagtcaagtgcaggagttggtggagctgatagagaaaatggtgcagtgcaacgaaggggcttacttttctgatgacatatacaaggacacagaggaaaggctgaaacaacgggaagaggttttgaggaaaatctacactgaccaattaaatgaagaaattaaactagtagaagaggataagcataaatcagaggaagaaaaggagaaagaaattaaattactaaaattaaaatatgatgaaaaaataaaaaatataagggaagaagctgagagaaatatatttaaagatgtttttaataggatttggaagatgctttcagaaatatggcataggtttttgtcgaaatgtaagttttattcttcctaatttactgtgatttgttaatggatgaattgtattttgcaaagatagttagagaaatacctccttccccttagctttattaaggtatcattgataaataaaaataaaatatgtttaatgtatataatgtgatttttaaatatatatatatatatacacacattgtgaaataatgaaataaaggtaattaacacatctagcacctctcggttactattttctttggtgtggtgagaacatttaaggtctactctcttagcaaattgcaaaaatgcaatacagtattattaagtatagtcatcatgctgtatgttagatctccagaggaggttattcatcctgcataactaaagttttgtaccctttgaccaacatttccccatttcccccaacacccagtccctggcaatcaacattctattctttgcttctgtgcattctactttatcaaattccacatctctgtcagatgcattaggttcttttttatactggttattttgtccttcagctcctgtattgctttattgtgattcttattttccttggattgggttttgccatccttctgaatctcaaagatttttgtttctatccatattttgtcttctatttctgtcattccagccatttcagcctggttaagaacccttgttggagaactggtgtgccatttggaggacatatgacaatctggccacttgagttactggagttcttgcgttggttctttctcatctctgcatgtcggtgttcctttaactgcagtgtagattgaatacaatcaataaacttctttttatggatgttttcacagggccaagtctttgtgcagggtctctatttgaagctgacttcttgtctctggtttcagaggagggtatgttagtgaggtatttttggtgttgaagctttggggt

SEQ ID NO: 476779 - DNA, 1463 bp, Homo sapiens
tgacaagatgggggaggagccagtggccgaataggaacagctccagtctacagctcctagcatgagcgacgcagaagacgggtgatttctgcatttctaactgaggtactgggttcatctcactggggagtgcaggacagtgggtgcagcacactgtgcgtgagccaaagcagggcaaggcattgcctcacctgggaagtgcaaggggtcagggaattccctttcctagtcaaagaaaggggtgacagacagcacctggaaaatcgggtcactcccaccctaatactgagcttttccaatgggcttaacaaacagcacacgaggagattatatcccacgcctggctcggagggtcccacgcccacggagtctcgctcatttctagcacagcagtctgagatcaaactgcaaggcagcagcgaggctgggggaggggcgcccgccattgctgaggcttgagaaggtaaacaaagcagccagaaagctcaaactcggtggagcccaccacagctctaggaggcctgcctgcctctgtaggctccacctctgggagcagggcacagacaaacaaaaggcagcagtaacctctgcagacttaaatgtccctgtctgacagctttgaagagagtagtagttctcccagcacgcagcttgagatctgagaatgggcagactgcctcctcaagtgggtccctgacccccgagtagcctaactgggaggcataccccaggaggggcagactgacatcttacacggccgggtactcctctgcaacaaaacatccagaggaacgatcaggaagcagcaattgcggttcaccaatatccactgttctgcagccaccgctgctgatacccaggcaaagagggtctggagtggacctccagcaaactccaacagacctgcagctgagggtcctgactgttagaaggaaaactaacaaacagaaaggatatccacaccaaaaacccatctgtacgtcaccatcatcaaagaccaaaggaatgcagctcctcaccagcgacggaacaaagctggatggagaatgacttcgacgaatgaatggctaactagaataaccaatgcagagaaatccttaaaagacctgatggagctgaaagccaaggcacaagaactacatgatgaatgcacaagcctcagtggcctattcgataaactggaagaaagggtatcagtggtggaagatgaaatgaatgcaattaaaagttcatatccagccaaaataagcttcataagtgaaggagaaataaaatactttacagacaagcaaatgctgagattttgtcaccaccaggcctgccctaaaagaactcctgaaggaagcctgaaacatggaaaggaacaaccagtaccaaccactgcaaaaacatgccaaattgtaaagaccatcaaggctaggaagaaactgcatcaactaacgagcaaaataaccagctaacat

SEQ ID NO: 476780 - DNA, 645 bp, Homo sapiens
gacatcactaatgatcaggtaaatgcaaatcaaaaccactatgagataccacctcacatctgtcaaggaagttgtgcacgtgcctgagctcttcaaactagatgtagacaggaacgagctcaaggcgcagaggaaaccttgggggccatcagccctttacaggaggagaaacaagaagccaacaaaggcgacctggaagaatggtcggtgcagagaagaggaagggaatggaagtcagcttgcaagtcaggcggccactgactgctctcgtgaagctggaggaggtggcagtggaagacgtcgaagcctggagagaacacagattccaggtccaggggggcggaaatctggtgagaactgggatggagcccagggcaagcttctcatggaggaaaggaagaaagggttgacctgccagggacacttgagccaccctgcagaagtggcaggctgggggatggccgctgcccatttgctaattacaacacttcctccacctgtgaatgtgtggacttcgaaaaccatcactaaatagaccagtactccaaggcctaggagagcctgatcccacgagatacttaatgcattttgttaatgtaacaaatgaatacaatgggcacagaatgttcttcagcctcatgtctt

SEQ ID NO: 476781 - DNA, 777 bp, Homo sapiens
tggttgttcatttgtccttcgatggtcaaggctgagggaggttacaccgggggctttgcagttccagattcggctgcgctccgacaggcctgcagggagtccctggacacgcaccagacgggctgtgctgttatgatccccgggcccagcagaggcccagctgtttttcctgctcttcctctttcctacacaactgtttacatcacgctgctcttgaagctatcagcagtttgcccggacacattcataatttggcttctggtggttgccagcaattcttggcatcttgatgacatctgcaaaggccttatttctaaagaaagccacgtccacagggaccaggtggacatggattttgggggacatgatttaactcagtacaggggtcttaggttagtgtattttaacaacaacgacaacaacgacaatgacaatgaacaacagcagcaatcctattccaactcactatttctggacagtgttttatgtcttcagaacattagtagctgcttcacaatgaatatggagcagtctcttagctagttggcatggtcctatgaacgattattatgctctttgtctttctgtatcatttttaaaagatttgagcagcttctccaggaactttaattctactggacacacactgaagttgtgatatttgaggcccaagcttcttaataagtgtcttcttgaccatgacagtattacatacaaattacttctaaccaaggaagtgattttacttcaaaagagtgagatgctggagggacattc

SEQ ID NO: 476782 - DNA, 1781 bp, Homo sapiens
ctgagccgtcctctcctctctcacagctggagatctggccccagacctcagatggcagcaccatgctgcaggtcctgaagacagcattttccacactcgagaactccgttctgaccaataccccacatgacactaaggctaggacgtcagcagccctggggtatgatatgagcctccttaccactcaggtcatagaagccataagactctgtatcattagaggtgtctatggggctttttcaaactatttttgcaaaccttgtattccttgttcacatgtagtcactgaagtctttgctccattatttcagtggacagccaatgatctgacaaatatttccttaaacacctttagccaaaaagcaaaaacaaaaacgagaaagatactactctacaagactatgtatcttggccctgacttaagattcttctttaatatgaagccaggccacttatggctctgttttatccttcaccacctgcctgcctggagcccacagatctgccagaatgcaagtctagggttagctcaggtctttcctgagcatgcatctggttctgagcacatgtggctggttctgagctttgcccttcatcttctctggtaaaggtggtggcccttctgagtctttattctcccaagaaatttttcccttcagccttctcttccctgtgattttggtctcatctgtcatcccttgacccaggcagaaatgagcaatgcatgtctttaaatcttttgacagaggccccactgcctggaaagctgttcctgcccaagttagggagagcaaaacgagggttagtcgctgcatcaattctggcagagcactgccatactggacaaaacacaaaaccagagtatttaaagaacatggttttattagccccctggcaccaaaaagccacaccaggaacgtcggcctccatccccacagctgttgcctccactctgaggaatggggggaagcatggtagtaggcaggtgagccaaaacactgcaaatctctcttgcccaaattcagctccctgtctctttgttaggagtccgctcgttgctgtaagctctggattagattctggagttctgagacagtaaattccatcagtttttgtcagcttatcattgtttcagtgaggggccaattcttcaagtgccctactctgccattttctgtgatgtcacccaatatatgatttttgaattagaaaaaaattcttaaagatataaatgttggaggaaaggaaacaacacctttaaaaatgattatatgataatatataaagaattaatgtagaactctaggcacttttaaattataattatgttttaaaatgcttcatagaaaaaatgatcataagaaaataaaccacatattaagagtggttgctttcagaagaaatgattgtaggctatatttactttttaattttctcttatgtactttacgtatgtaaagaattatccatcataagtgttcattgcttttagaatcagcaaatgtatactgcctcgtttcatattatggcaaattgttcttaaaggccccaatcagtgaggattaaatcagataattttagatatagtttaatacttgtcttttagtttgagtttgaaaattctatatttaaaaaagatttatttatacaactcataaaatgaactatttttcttcttgcttctggttttttttaaaaaataggaatgacatttattttatagaatattacctagcatctcagaagagacaaaaggataaaagtacattcttgaattcaac

SEQ ID NO: 476783 - DNA, 643 bp, Homo sapiens
aaggttttcatccagtttgaggatttgcaataagaaaagacaccccctatttcctacagacatgagaacccatcttaaacagacaccacgttctcgatgtaaatccttgacatacattgccctaagacaggtccaggcaccccagccagaggcacatctgtgccccactgtgccccaagtccccaagataactcacggggaacccacccttagactctacacgagtgatggattcacagaggacagagtgactatcctagaactcacatgcaacagtcaagtgtctctcacactgatgggcgctctcagagtgaacacccacactgccggtacctgctggatgctgcagaatgagcatgtgcacaaggggccaggggaaaactgctctgatattgatgaaatccctcagcttttgtttgtccaagaaggcaaggagatgctacccttctccaacaaaaaggagagtgcaacttttgcgttttaaaaagaatttgtggtttaaagaatctcaggcttatctagtgtattagtttgttctcatgctgctgataaagacatacccaagactgggtaatttataaagagaaaggtttaatggacttacagttctacttggctggggaggcctcacaataatggtggt

SEQ ID NO: 476784 - DNA, 690 bp, Homo sapiens
cgtggggacctgggagtaaaattatgggagtgcaattcaagatgagatttgggtggggacacagagccaactcatatcacctggtgacctttcacagccaactcttccccaggagttgcccttggacagagaaggttaaccactggctggaggtggcttctaagatcgccaaagaaaggaaagagtggagaaggcagtcctccttcttcatcatgttggtcacaaaactaaatacatgtttctgctcacatttcattgcctataatgggacccatattacaatgcacagttcctggctgggcagctgctggctagagcactgcggtgctaccacacaaattgccattcctgccacgttgcagtgtaggaactatggacgcatcggtgtctcagacaagctccctggccttctctcagggggtctgagtggacctgttagggctgacgtccacaaaaaagcagagaagcatctgccagctccaggcttggcacctaaaatgggcacatctatgaaatatcaaaggaagaataatttcaaaccacatgagatattctcacaagttgggtaaattgcacatccttagggcacttggtcccttagatcggttatttatgttttacataatttatttcaagtacaggtttttagcatatactttcaagcattttggaaatattctttaacagtca

SEQ ID NO: 476785 - DNA, 500 bp, Homo sapiens
gcagcaaaccaccatgagcacttgtaaatgcacagcagccccactacagggggtgaaggggtcactgccaatgactcacacttcagctctgatggcaatagcctgtggcagcacccagctatgaacaagggatatccatggggctccaagggcgtggagatgcaggatctgttgggccctggagcagggcaggccaggtgtccaagctggcaagaggaggattacaagtccatggctcatgtggatgtgcacagacatgactgcatagacaaaaatgtcaagcaggaagcagatggggctggaggagccaggaacagggccgagaagccaggccatggagaagacagagaaaagcactttgaattacaatttcacaaaccaagttgtatatatgacttcacactgacagtgctcacaaaggagatgagacgagaattatcatccccatgccacagatgagaaaacaggtgctcaggggtgaagtacatttcccaggagct

SEQ ID NO: 476786 - DNA, 535 bp, Homo sapiens
atctctctctcccctctctctctctctctctctctcaacacagacaggcccttgagttgacttcacaacccaccgatgggtcagcttgcatttttaggctgtaacacagccacttttctgtgcaatgggtgcacggtgtggggttccacaccattcccacgtcccgtggactctgcagagcctggagacagcaagggtgagggcttcaagagagcaaagatggcaacctgccccttccacagggagctctgtcccagggagttgcagagctgctactggcttgatagtcccagttcaaaggcggcttgtgagagagggtacctggatacccaggccaattatagggactcaattttaaacttaaattctaatggaaatgaaatgtatagaatagtttaccagaattatttttatttgctaaatgaaacctgttcaaacaaaaatctccctgtggaaacatttatggtgcctatgagtgtttcctcatgttcccccaaaatatgctttactggtagccaagaatgaaaagtaaaat

SEQ ID NO: 476787 - DNA, 892 bp, Homo sapiens
tgggcaggctggcatgggggcacccgctgcccctgcctgggtgttgctgtgtattcccgccggccaggggccactgccaggaccacccctcccttttcatatcccgattcttaagttctgctattgtggtattttaacaacagtttcaggaaacttcctttctattattgtttatccttatgttagaagttggaagcaatataagaaaagactaatacatgaaattagtactgagaagtgggacattgatataaagatacctgaacatgtagaagcaactttggaagtggttaatgggaagaggttggaacagcttggaggactcagaagaagacaggaagatagggaaagtttcaaacttcctagagactttttaaattgttgtgatagtgatatgaacaatgcagttcaggctgaggtggtttcagatggagatgaggaacttagtgggaactcgagtaaaggtcaaccttgctatgctttagcaaagagactggatgcattgtgcccctgctctagggatctatgaaactttgaacttgagagtgatgattcagggtatatggcagaagaaatttctaaacagcaaagcattcaagatgtggcttggctgcttctaacagtgtacagtcatacacatgacagtataaccatatgtgtgagcaaagagatgatctgaaactggaacttatatttaaaagggaagcagagcataaaagcttagaaaattggcagcctggccttgtagtagaaaagaaaaactcattttctggggaagaattcaagctggctgcagaaagttgcataagtaaagtggatctttttaaacaaaataagctttctttttgttaatcctggaaaactgtcagtttactaaaacgcattttgggaa

SEQ ID NO: 476788 - DNA, 2191 bp, Homo sapiens
cgtctcaaactaataattaagacatctgaaacttggtgttcctatagattaagatattaggagttctttaggacagtatggtaatgaacacctttctgcccgtggacgccgccgaagaagcatcgttaaagtctctcttctccctgccgtcatgtctaagtcagagtctcctaaagagcccaaacagctgaggaagctcttcattggagggttgagctttgaaacaaccaatgagagtctgaggagccattttgagcaatggggaacgctcatggactgtgtggtaatgagagatccaaacaccaagtgctccaggggctttgggtttgtcacatatgccactgtggaggaggtggatgcagctatgaatgcaaggccacacaaggtggatggaagagttgtggaatcaaagagagctgtttcaagagaagattctcaaagaccaggtgcccacttaactgtgaaaaagatatttgttggtggcattaaagaagacaccaaagaacatcacctaagagattattttgaacagtatggaaaaattgaagtgattgaaatcatgactgaccgaggcagtggcaagaaaaggggctttgcctttgtaacctttgacgaccatgactctgtggataagattgtcattcagaaataccatactgtgaatggccacatctgtgaagttaggaaagccctgtcaaagcaagagatggcgagtacttcatccagccaaagaggtcaaagtggttctggaaactttagtggtggtcgtggaggtggtttcagtgggaatgacaactttggtcatggaggaaacttcagtggtcgtggtggctttggtggcagccgtggtgctggtggatatggtggcagtggggatggctataatggatttggtaatgatggaagcaattttggaggtggtggaagctacaatgattttggcaattacaacaatcagtcttcaaattttagacccatgaagggaggaaattttggaggcagaagctctggcccctatggcggtggaggcaatactttgcaaaaccaaggtggctatggcagttccagcagcagcagaccctcagctgcaggtctgttggagtttactggaggtccattccagaccctgtttgcctgggtatcagcagtggtggctgcagaacatcggatattggtgaaccacaaatgctgctgcctgatcattcctctggaagctttgtctcagaggagtacccggctgtgtgaggtgtcagtctgcccctactggggggtgcctcccagttaggctacttcaggctgaatgatatcaagttgttcttggaaattcaattatgataatgaaaacaagtgactactaataacttattgtttagctgagtctgtaaaattcagcaggaacaaaacatactagaatatgaagaaccaaaatatgaaccaaaagcaaaattcaagagtaagaccattttgtagccagcatattgtaaagagcattattttagccaacagaatgatgagactttatgaattttaattcttccactactgttgtggcttttgcaaattactaaatttctctgtgactacttttccatttcttaagtaatttggttggtttccaaaagtcaataatgtggatgtagtgttttgagctctttggaaaaaaggactctacataaattaattagacaattcatttctaaataaaatctcaaaatttacaataagttgaatgtaaatgaatgcagacatgcgggattctatttagcagcataaattgctgaaatgaaattcagaaaagaacacacaaggcagacaaagacaaaagtattagagacaagaaaaatacgaaaacatgagtaaacaggcattttaagatcccctccgcagagtcaatttcttagcatatttgaaaccattaactatacttttctttttcattattttaaggcaaatttgataaaatagtcagtggtgaggaagtatatagtgtgtttgtggatttaatatattcatactctttctctaaatgttctagacaactaaaaagctaagaaaaaaacacattttagatattctttatctttaaaaatacatataaatatgtgtactctatgttgttttttattgtgtgaaattttattttactaataatatttttaatatattttaactaattatcataaatcaagag

SEQ ID NO: 476789 - DNA, 489 bp, Homo sapiens
tacccttgttttgattggcgttccctccaggaaaccaagcacatgcacaatgagtaaacataactatgacatactttccatgttcactttggagcagagtgctggcataaaaatggatgaaatttgtctctttacgtcaaaaggtattcagtttctgataggaaaagtggtagaaaagaaggtcaatgaatggaatttgcttacaacagcaggcaggatatgtactaagttaaatagcttatttcaggctgaacgtctagaccattcactacctggagaaaaagtttatgtatacatgcaaatacaacgttataagagcatatctcaagaaatgtattttaaggttttcaatggtcaactcctctggcacgaattataccctctaatgatgtgcacttcctatgacagaagcctatgttccgagtatcatctctctgtaataatgtacatattaaggaaagtatattttatataaagcacaagatgtat

SEQ ID NO: 476790 - DNA, 602 bp, Homo sapiens
cagtgaatattttcctatgtcttctgagaaacaaaacaagacaaatgggcaccatttaatgattaggggatggaatataataataccaagtgctctcttgtcaattcagtgttcagagaaagtgacggtacaacgggtaccactattcctctgaagagagggcagtcaagctccaagccaaagattacaagctcgcattgtgcatctggaaaagccaaagccactcaacaccagcttgtgaaagtagccaggaagggggatgtaccctgcaaagctacagaagtggagatgcccaagactatgggaacccaactcttgtgtcagtgtgacttggatgagtgtgttctcaagagagctgatggttttataagcggcttccccctttgctctcattgtctttcctgccagcctgtgaagaggtgccttccaccattatttttcctgaactttaaaataattatgtccatggtgactgtgaggtctcctgctgcaggattccagggatccatggtgagagcaggccaatccttgcctgctcaactcaccccttccccaggagttaccggaggccaagaatgtattccagtgtgacacagccccat

SEQ ID NO: 476791 - DNA, 738 bp, Homo sapiens
ggctcaggcccggctggagctgccttcgctaccgaagccgtcccacatccaggtcacactgatgcaagatgtgggttggctcccatggccttgggcagctctgcccctgtgactttgaatggtatagctctgctcctggctactttcatgggctggcattgagtgcctgcagcttttccaggaacatggtgcaagctgttggtggatctaccatcctggggtctagaggacagcagccctcttcccagagctccactaaggctgggaagcagggcaccaagtccctaggctgcacagagcaggagggccctgggcccagaccaggaaactgtttttccctcctaggcctctgggcctatgaatggaggggctgttgtgaagttctctgccatgccctggacacatttttcccattgtcttggcgattagcatttggctccttgttacttatgcaaatttctatagccagcttgaatttctccctagaaaatcattttttatttactactgcattatcaggctgcaatttttttaacttttatgctttgtagcccatattttagacggataagaagagtggcaagaaccgcattcctttatagcagatttgggtttagcaatgtgctaggataaaagaaataaagcaagggaggagggaataagggaaggaaatctacattcatctttcatattccctgttccagtcctggaaacaacaatttatccaaagggctgtgg

SEQ ID NO: 476792 - DNA, 706 bp, Homo sapiens
ctttataggtttcagataggaggccgtgcatgctaattggtctatgggtggccatgggaaggcctggaaaaagcaccagaagttttcacttcaagccacagactccacctggaacttacagcctggtccccatgccataggccatttctcgcctgaaggtgctgggagcagaggaacccaggtaatggaagcagggaacctgcgggatacgggtggcttcccaggaccccaagggtgcagaggtgcccagctgtgcggggaaacacggggctccggcccagaggacctggaagtgggagaggcccccactggctccgcggagcacgcagcccctctgtaccgcccccatattagccgacatcttctcaggacatggatgaaattggaaatcatcattctcagtaaactatcgcaagaacaaaaaaccaaacaccgcatattctcactcataggtgggaactgaacaatgagatcacatggacacaggaaggggaatatcacactctggggactgttgtggggtggggggaggggggagggatagcattgggagatatacctaatgctagatgacgagttagtgggtgcagcgcaccagcacggcacatgtatacatatgtaactaacctgcacaatgtgcacatgtaccctaaaacttaaagtataattaaaaaaaaaaaaaagaaccatcaaaaaaaaaaaaaaa

SEQ ID NO: 476793 - DNA, 740 bp, Homo sapiens
ttaagaaacttactactgggtactatgctcagtacctgggtgatgggatcaatcactctccttatgttaaccttcctacgtttttgtgagaacctttaccccgaaaacgggagactagccttagtgactgtcagacctggatggaggagagaggtcttgcccatgaggcagggccagtctgatctgagtggccctcctctctcctggcctctcccaggaccccagcctggctacagcttcttgcagcgcagcctcgggggcccaaccggcgtgtttctgaaggaccctcattatagctcctttactggcagaccatgcctgaccattggagagctcctgcagattggcctctgccgtcatgcaccagcccaccagcactcttcccctactgcagcctcccctacattgctttgctggtatgcacttgcccacagccacctcccctgcccactgctttgccagcattcccatgggcagacttcacctcccctcctcttccagcacaggtactctactgtgtgtgtcactgctgccagccaagcacaccctgctgctcctcgcctgctgatggctgggtccatgatggcagacctggagcctgtatctgtggaagccagaatgaagcctggcctcacaggagctgacctagtattgggatgggacatgagcctgagtcagcaggagctaggcatgtgctgggatggaccggatcctgagtccataggactgtcctgaagcta

SEQ ID NO: 476794 - DNA, 813 bp, Homo sapiens
aagtaaagttaaataacactatgaagagaaattctgaacatcacaaagaacataagagctttctggattggaggtctaggaggaaaaaatggttttgtaggcagggcccatggtccccgtactgtgtgcagtccagggacttggtgcctggggtcctggccgctccagccatgactaaaatgggtgaaggtacagctcaggatgttgctttagatgatgcaagccctaagtcttggcagcttccacatggtgttaagcccatgggtgcacagaaatcaagaattgaggtttgggaacctctgcctagatttcagaagatgtatggaaatgtctggatacccaggcaaaagtttgcttcatgggaggagccctcatggagaatctctgctagggcaatgcagaaggaaaatgtgaagtgggagcccctacacagagtccctactgtggcactgcctagtgaagctgtgagaagagggccaccatcctccagactccagaatggtagatccactggcaacctgcactatgcacctggaaaagctgcagacaatcagcaccagcccatgaaaggagccagaagagagggctataccctgcaaagccccaggggagatgctacccaaggccatgggagcccacttcttgcatcggtgtgacctggatagctttctgagcttatttaatatctctattttgaattttttatctgggatttataatttttttttcattggaatctattgttggagaattattgtcttcctttgaaggtgtcatatattttcttggtttttcatgtttcttatgtattta

SEQ ID NO: 476795 - DNA, 694 bp, Homo sapiens
aaaaccactcagaggagtactcaccagaaaccaaacaggaaaatccaatggagccaggtctttatggaggtcgctgtcaccacactccggtgctcagagcttcttccactctcctgggaaagcaccatgtgagtgggtggattgttgtcaaaccctcggggactttctctgatgggaatactgtgtggcccaaaaggagccagcctattagaggactactccaagagcagatgacatgtcttccagggacctcattgtttacaatgaatgcagccatctcgagagacttgatgaatggctttaaccaaaatgcggataatgatatggacaatgaaatccaggctgaggtggtctcagatggagatgaggaacttgttgggaactggagcaaaggtggcttttgttatgttttatcaaagagactgccagtattttgcccccgccctagagatatgtggaactttgaacttgagagggatgatttagggtatctggcagaagaaatttctgagcagtatatcattcaagatgtgacttgggtggtgttaaaggcattcaattttataagggaagcacagtataaaagttcagaaaatttgcagcctggtgggttactgacacagtgcaggcccctcccactgcggcagctgagcctactggcagggcagccatagtgtcaccaccttatgtgaca

SEQ ID NO: 476796 - DNA, 1047 bp, Homo sapiens
cggcgttcaaacacatgcatgtccaagaaaaggccacagcagccaaaaggtggagaccacgctcatatgcgtcaacctgaagaacgaataaaccagtgtgctccatccatgcaatggaatattattcagcccatgaacaggaatgaagtgctgaaactatccacagtgcagggtgcccccaaacctctcccttcttgtagggagcaggaggaggagggatacccgaataaccccacaggctcagtcctgcttcagccccagaccgtcctcctggagcacgggcccgaagatggccaggctgtcgtggacggtggtgcagttccaccggcggccgcggaactggtgctggcactcctggatgccaatcttgatgccctcggccacgctgggcatgatctccacgtagttcctgcagaagcggagctgcttggggaccaggcccgggatgctggcacacaggatgggctgcgagcccagggaggaatactgtggcccaacagccagcgacctgcagagggcaagatccggtggccaccactcaagcctgcacccctgcagtctgtccttgcacagtcggctcccttgttcacttctttattcattcactacacgcagtcccggcaactggatgaccatccggggtccctggggtatggtctgcactgccactgcccagggccaagtggtggtgaccaaggtcagctgtctgtgacctggactgtggagcttgctgcttacaaaacagggactggcctgggggatgcggccatttccaaggctcatcccttctccgaggctagatgctggattcattttgggggctgtcactctgcccacccccagaacactatgaccagcatggagccgggaccacctcagctcgcaggctcggggctgggaggggcggccttgtccctggtctctagataaagcagagaggtggactcccaagtctgaagcctccattctcagggtgctgagtcagccagttctgtgcccctctcaccctcctcccgggtgggccctggcccaccaccttcctgagta

SEQ ID NO: 476797 - DNA, 3144 bp, Homo sapiens
tttgctgtgtgaggtagtgggttccctgtctacagcgggtctcaggcactgtgggaattacctcctccgcgttaatatcaccatgagagcccccgtggacattactgatgtgggtatgtcctggcagggctttgcagaggcagtgccccttctgggcaaggttgtgggtgacatgagcggcgcctcctccctagcccttggctgtcctgcagcccaagtgggattttacattgtgggtatgacctctctcatgggaatagtggtgaccacaacccctgctgaaacctgcatgacccagctgatccctgagaccacaggagatgcagtgtcaccatctttggagcataagccagagccaaggctcagaggccaagagcaagattcacagggctgctgttcacacatgggcctgggcctgggcagcttgacagtcacgctcctcctgtccacccccatcacccaggatcatgggtcttggactccctcatcactggagatgctctccttcactctggttcacccccaacttcacctttagggcctccccttggccttgaagatcctgagctccagggacatggtgggatttttagaacatgatacaagtaagggttgctgaggttgtcctccaacccaacgggtccagaagcttccttgctggttccttccttgctgttccttgctggttgtcctccagcccagtgggtccagaagcttcggcaaagcatttgttcctgttctgtccaggttcttctcatatcaggctcagcaaccacctccatactctcctaaatcttccacctgccccctctacctgcagcttcctcttagtccagaagctatcagctatttaaagtggtattatttctttccatttccatgttttgttgcaagtgctgacttttagtacattgatgttgtttcctgcaactgtcctaagttcacttattagttccagcagacttattcttttttgtagatttgttggcgttttccatataaacaattgtgttacctgtgaataaagacaggttacctcttcctttaaattctagatgcctttcatttctttttcttgtcttattgcactagctagaaactccaggacagtgtcaaataaaagtggtgagagtggatgtgcttgtgttgttcttgatgtttagggaggaaacacacagtgttttattaaagtgtgatgtgagctgaagtttttcatagatgccacttatcaggtttaggcagttcacagctagttctaatctgctgagagtttttatataaatattggaatttattaaatgatttttctgcatctattgagacaattatatgtttttatttagccaattaatatagtgaattgcattaatttatattcaaatattaaactaaccttgcattcctgggataaatcccacttgctcatggtgtatcatcctctttatatattgttggattggatatgctaaaacttggttaagaacttttgcatctatgttcctgagaagtactgatctagaattttttttccttataatgtctttgtctgatttgggcattaggggtgccttttcattctgcagtcaacacttgctgttttctatttttgttttcttcatagtgaccatactaaccgagggcatgccaacccttgcatggttgaaaatccatgtataacttctgactcccccaaatttaactacagaagccttgccaataacacaaacagtcagttaacacatattttgtatatgtattatatactgtattcttacaatatagtaaggaggaggaggaagagagggcttggtcttggtgtctcaggggtggcagaggcagaagaaaatctgagttcaagttatttggttgtgcttgttgttgaagagttgtaagagtttttagatatattgttgatattaatctttatcaaaatatatgtgttacaagtattctctcccattcttcatgttttttaacacattttgtgttttagaaatatccattttagttaggctattcaatttgttagtatacaattgttcatggcatttagtcattttttttatttctgtaaaatcagtagtaatgtccccactttcatttctgatgttattaacttgagtcttgtgtctctctttcttggctgttctattgaaagatttgtcattttttgctggccttttcaaagaaataacttttggttttattgatttttttctattgtgtttttattttctttttcatttatctttgatctgatttttattatttccattctcttggatggaagctttgggtttagtttgctcttttttcccctaatttttaaggtgtacaattattgatttgaaatattttttctattttaatgtaggtgtttacagctatgcatttctctattaccactgtttccatggtatcccagaagttttggtatgtttcttttttattttcatgtgtctcaaggttattttctaatttcctttgtggtttcttctttgacccttggttgtttaagggtgttttgtttaatttacacatatttctaaaatgttcagttttccttctggtattgatttctagtttcattccattctgatcagaaaaatacttcagattatttcaatctcttaacatttattaagaattgttttgtggcttaacatgtgatttatcctggagaatgttctatgtgccgttgaaaataatgtgcattctatagttgtttggtggtatgctctatatgtttttttaggtttaattggtttatagtattttctaaatcctctattttctgaatgttcttctgtctggtttttctatccattattgaggtgggatattgaagtttacaactactgttgtagaaccgttcgtcccttcaattccgtcaatgtttactttataaattttttgtgtctgttaggtgtttatatgtttatagccataatgtcttgctgtatgaagactttcctctctatatattgttcttccttgtctcttgtaaagtatatttttctgacaataatatagccatcccagctctttttcattactatttacatagaaagtctttttctattattttatattaaacctctttgcatccttctatgtaaagtgagccgcttgtagacagcatat

SEQ ID NO: 476798 - DNA, 638 bp, Homo sapiens
gagaagggcccaccgttgggggtgtgtgagcccagagccctccaagctcctcacaacccacaccacttccctgaggaatccagactgggcctggaaggggagtcgggatgagcctggcctcggggggtggctgcctttgcccagcagggtgtcccagcagcgcccagacaccacggcagctcaggcagcccctgtacatgctgtcttgtgtgggcatagtcagggtctgcggctgtgggggattcagcacttcacagggcaggggtctgcacgaagacggatgtttgcaagagcgcctggacgtgatgagcattcacaggcagcttacttttgggttttctctctatgtggacctccacaagcccctactgtgcctggggccactgcgacctgctggttctcctggaatcaatgtcggtgcagggctgtgtccagctatccctgaaaggtctgattatctcctctccccactgcatggtcaccctggtaaaaggccagaagtgcctttggggaaggctgggagaaagtgatggcttgtcctgcctacctggacaagccatcccttacctggagagcttcttaggcctgggaggccgtggggagttgtggggtacaatgcactttccagccagagaacc

SEQ ID NO: 476799 - DNA, 1955 bp, Homo sapiens
ccgcgacttccccacagcgtccaaatgcccctgtaccgatccagggatggagaatcaccgggcagtgggcgactcgggtctgaacttcccctggccatggggggctgccgtgcagtcttgtccctggctgcctgctgcactgtccctgcaaagaagccctcagcagcgcccgcagatcctcctggcgctgctccgcttcctgttcgccagctatgggagcaaagtcttcctgaaggaggaggcagctttgacttcatcagcggcttccactcctagggatgccaggagccccagaagacgtcacgttgacaccagcagcctctatgcgcttcgggtagccctgccccacctgccctggccctgtgcccttggcgctggactgacctcggcagccgcgatcttggtcaggaccagcgggcacagccctgggggctcgggacccactgcagcctgtgaaggccccatggctctgcacacagagaggcggagcagcagactttgggacttggcccttcacaaccaggacttcagagaggaatggggcggagggaccactgggatcctcacatctcagggcagcacatcgttggcagcaatggttggttctacgcaaacttttatgaaattaggtgtggtgtcagcacagcggcaggtcaccgttcaggaaggacccttgtaccgcacagagggctcccacatcactatctggtgcaatgtgagtggctaccagggacctcctgagcagaatttccagtggtccatttacctgccttcatcgccagagcgagaggtgcagatcatcagcaccatagactcttccttcccctatgccatctacacccagcgtgtccacggagggaagatcttcatagaaagagtccaggggaacccaaccctattgcacatcacagatcttcaggcccgggatgccggagaatatgaatgccacacacccagcaccgataagcaatactttgggagttacagtgcaaagatgaacctagtggcacagccaggtgctgtggcctggctctggcagaaagttggcgagaagcccgtggaggtcatctccctgagccgagatttcatgcttcactccggcagcgaatatgcctggaggcagagcctgggggaggtgcggctggacaagctggggaggaccaccttccgcctcaccatcttccacctgcagccttctgaccagggcgagttctactgcgaggccgccgagtggatccagaatccggatgggtcgtggtatgctatgacccgaaagcgttccgagggagccgtggtcaacgtccagccaactgacaaagaattcactgttcggttggaaacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaacgtggccaaagagagcgacagtgtctttgtgctgaagatctaccacctccgccaggaagatagcgggaaatacaactgccgggtgactgagcgagagaaaaccgtgacgggggaattcactgataaggagagcaagcgtcccaagaacatccccatcatagtcctccccctcatatcaagatattcttattaatctcattctcccatagttctgtttttagtaaagagaataaaaacctacgatgctctgattttaaacaagtggtaaagttttaagactaatctttaaccttttctcagctgctaaaactattctttctctgagccttgtaataatttcctttactttttatttatatgttttaatatttaaaatatttctcttcaagtgtgaagtaaaaagtagccataggggtcctcttgtt

SEQ ID NO: 476800 - DNA, 1454 bp, Homo sapiens
actctatattgaatacaatttgttgcacttcgaaatatctggatcagactatagttgttgtcgtcactgagaatgtaggagtgggaaagagaaaaatcatgcaaagtcttgctgatagcgttcacagtgacagcccgaaagatgatgtgtgtttgattgaatcagggatgactcagttacagagcctcacagttacagttccaagaagaaaactgtcaaaaccaaaactgaaattgaagattataaatcagaatagcgtggccgtccttcagacccctccagacatccaatcagaacattcaagggatggtgatatggatgatagtcgagaaggagaacttatggattgtgatggaaaatcagaatctagtcctgagcgggaagctgtgaatgatgaaactaagggagtggaaggaacagatggtgtcaaaaagagaaaaaggaaaccatacagaccaggtatagtgcctgaggtagacatttcaatatcatcaacactttgttaattaaagaaaaatacaatactgaagacttcaattaaaattaaatattcaggattaagaactgtctaaacaaaaatatgtgcacataaattaaagaactaaactatttgaatacgactttttagctctagagttctttattttgaatatgtgaatacttcacaatgaatcattattgaatgccttatcccaaatgttaaccattttattaaatgctttactagattggcttttgttcatacttggactttgaaggccatttatatagttcctctggatgtgtacttctgtaacgcttttaattttcagtattcactttctaatatctttttttgaaaaaacttatttcagtgtttatgcagtagtgccagctttccttagccagtttattaatgtctgtttaccaatgaggttttaaattggattcgtacaatctttatgcttcttattgcttatattttattggtaagagtgatctaaatcccttttgatatgtaaggaagaactttcttacttcattcgtattccatgagaccttaaaagataacctgtcttttaaataggtcatatctataataaggacctaagatctttatttagatgtgtctatgatgaagcctttcagggccgatctatttaacatttccctcaccacccctccactctgtagcccctttgccccttgtatttttctccatagtacttattataatatctaacacactataatatcaaatgttaactccatgaggataggcattttgatctatttggttccctgcggcatctccagcacctagaacaatgcctggtgtacatagtgggtgcttattaggatacatactgtaattatatgcttgtctatttttttgtgttttaatttatttaatgtctctgcttcctgtgaaaatacaagctccatgaggggaggaatccaatttgttttgtgcc

SEQ ID NO: 476801 - DNA, 893 bp, Homo sapiens
ccctgtgtttagctcaaagtttatgagtgtaccaatccatactctttatctagctgctctgttcagggattgtaaacgcaccaatcagcgccctgtcaaaacagaccacttggctctaccaatcagcaggacgtgggtggggccagataagaggataaaagcaggctgtctgagccagcagtggcaagccgctggggtccccttccatactgtgaaagctgtaacactcaccgccaaagtctgcagtttcactcctgaagccagcgagaccacgagcccaccaggaggaacgaacaactccagacgtgccgccttaagagctgttaacactcaccctgaagaaggaacaaactccagacgtgccaccttaagagctgtaacactcaccgcgagggtccgcggcttcattcttaaagtcagtgagactaagaacccaccacttccggacacactagctcccagagcttccaagatggcagagggccccttgcaagatggtggcaacccttgtgtggggttcttggcctcacggattccaaggaatggtatcttgggccatgcgcccaatctggagcagcaatgggtgccttgctggatcaggagcacagcagacaccctgccggatccggaggtatggaagtcagcgggggatctgcgacagccgcaaacagcagtggtggacaaatgtgctgttaaatcaagtgtccaggtgcaaaggtggtttctaaatgaagagttaggacatgaagtccttgcccatgcctatgtcctgaatggtatcgtctaggttctcttctagggtttttatggttttaggtctaacataataaaagtttatctgaatatgaagttcctttcaatttcattgtaagcttatatttgggtcagactct

SEQ ID NO: 476802 - DNA, 670 bp, Homo sapiens
ggagatctgcaacagatgattgtgatatgaatctatctgtggtttctatcatcaaaagcactgctaaattcttccatgatttactgtctccattcataaaggaaggagatactaattttcagtttgttcatgaaaataaagatgtcatttttcccctctcattcacaatcatggactccttgaattctaaccatggacccctttggggagggcaaaactcttcctattgtgtaaattccctgggaacctcaggttgccctagggaccacggaattgaattgcagacaccatggatccagacactcagtgaagtggcagctccttgtggcagtgtaggaaaagaatttgagaaagggcagacaaaggagggtgtgatacaagaaaggggctgtgctcagtcgaaggctctttgtaaggtgcacgacaagggcaaccacttagcttgcctgcaacacccctagtactgcccaaaagatttaaggatgaattaatcataattcatcaataagtgaatatttattgagcctttcctatgtgctgagcactgttttacaaacttttgaggtagccattattatgatgctcattttacgtattagaatattaggactttgaacagtttaactttctccaagtcccatggctgatcactactgataggattagagct

SEQ ID NO: 476803 - DNA, 939 bp, Homo sapiens
ctgcaacagcagagttgattagttgtcccttgctcgctctgggcgcctcctctgcctgggctcccactttggcggcacttgaggagcccttcagcccaccgctgcactgtgggagcccctttctgggctagccaaggccggagcccactccctcagcttgcagggaggtgtggagggagaggcacgagcgggaaccggggctgcatgtggcacttgcgggccagctggagtttcgggtgggcgtgggcttggcgggtcccgcactcggagcagccggccggccctgccggcccggggcaatgagggacttagcacccgggccagcggctgcggagggtgtactgggtcccccagcagtgccagcccaccggcgctgcgctcgatttctcgccgggccttagctgccttcccgcggggcaggcctcgggactgcagcacgccatgcctgagccttcccctgcctccgtgggctcctgtgcagccccagcctccccgatgagcgccacctcctgctccccagcacacagtcccatcgaccacccaagggccgaagagtgcaagcgcatggcgcgggactggctggcagctccacctgcatccctggtgggagatccactgggtgaagccagctgggctcctgagtctgcttcacttctgagccagcgagactatgaacccaccagaaggaagaaactccgaacacatccgaacatcagaaggaacaaactccagacgcgccaccttaagagctgtaacactcactgcgagggtaaaatgcacgcaagtttctcaagtttcacttcgaagggaaaatttggccggtttcggtcttccctttctatttatcaattcctcaatcatgcggaatctggtagttgatctttctggctgcttcacgtgaaggaagggcatcttgggatgatatggaatgaaaatatc

SEQ ID NO: 476804 - DNA, 848 bp, Homo sapiens
aggagataaacctaatgtaaatgaggagttaacgggtgcagcgcaccaacatggcacatgtatacatatggccgccagccccagtgagagcagaggagcttcccagaggcagtggctctaaaggctcctttgatggagctatgcttggcaggaaggggctggcgtcccatgggaccagctgcattggagcctgtagcttagaagccctggcaggcagctgtgggcacataggtaggatggtagttatggggctgacttatgagaagcagtcctgcttttattgcaaacttctagaagacaagaatgagctggatacggactgccaggagagactgagcaacattcaggggctctgcatgcctctggcagacacttgtttggtctttgttaaaatattggcctgtggaaaacaggtttgcagtactattttggccattttatacccatcaagaaaacttttggtttatttggaagcaaatggtttacgagagaaggtcaggctctgagtcaggcagccttgggttcccagtgcctccatttccaagctgtgttgttttgagcaagttactcaatcactttgttgctcagttttcttgtacattaaatacctggtgtcagagggctcttgcgaagatggaaagtgggagggtagctgtatacctggagcatcgtaggtgctctagaaatgttcctttaaatcacattctagaagtacagccacagtattatttctgttcggtttgaatttaacttgtattttttaaaagcaaatgccttcgtattaattagagagatttaagctgcaagtaaaggaaagtcatactgaaagtgttttaaataaaaagcaa

SEQ ID NO: 476805 - DNA, 446 bp, Homo sapiens
aaccagtagtttgcaacctcagcatggaaaagccacaagggtggattcttgggaatctaccaaggccttgggattctaccccttgcaccagtgtgcactggacatgggacatggagtctactccttgcatggaatctatcccaaggccttgttattcttccctgtacaccagtgtgccctggacatgggacatggagatgctgagttatctgctgtgtggggtagtcaaaccaggcatgtggggctctgtgagctctgtcaccctctgggttgatggcaagaacacagatctagctgcagtggccgtagacactgggtgtgggtccaggattcggtgttggaagctgctgatcaccagtttcaggtattttctatctattgggagactgcctttccctggagctggctgtgaccaattattaccttagagagacagttaactgctc

SEQ ID NO: 476806 - DNA, 651 bp, Homo sapiens
atcccacttatattccacttataatttgaagttggtgatatgggagtggggccagggaagtgctggatagagaagggcagcgtccctgtaaagggctccaccctcaggcccgtgcctgtggacctaactgaacatggagaggagcagactgtcagacctgcaatggtgaaacgctgtgacagagaaagagagaaaggaaggacgtctggataccaaggggatttcagctgcgggaagtcagagaagagtctggccgctgaacacctctatgcccacaaactagaaaacccacaagaaatggataaattcctggaaatatacaacctcccaagattgaaccgggaagaaatggaagtcctgaacagacaaataatgagttctgaaattgaatcaggaataaaaaacctaccaaccagaaaaagccctggaccaaatggattcacagccaaattctaccagacatacaaacaaagagctgataccaatcctattgaaattatccccaaaaacttgagaaggagggactcctccttaacttattctatgaggccagcctcattctgataccaaatgagacacataggaaaaaagagaacttcaggtcaatattcctgatgaacatagatgcaaaatgctcaataaaatattacc

SEQ ID NO: 476807 - DNA, 628 bp, Homo sapiens
attcagccatcatgcccgggaatccatatttgaccttttattttatttttagattccacatctgcaatttgggctccaagatacaacagggcacagtggtaactcgagcaacaggagaaattacaccacacagtggtgactctggacactggagtggtaggatacagcactggctcaaactttgtgatgccaagtgtgatgatagaaaggacccaggaatggcagggtacagcagtgacttgaactccagagggctctgtttccctgagtgtaaggcaccacatcactcaggtgccagggggtacctggtccagctcttctggaccaggctctggatatctgagaggtctgatgctatatgggctcaagcgccagtgtcacagctactcccctgggctgaagctctgattcagagaggcaaggaggttggaaaacaaggagcagggcacaatgtgggctcctcccctggagtaatgcagctgtatgaactccaggcagctccctaaactggactcagtgcctcacttttgtatttctgtgaaggatgccatcggtattttgttagagattgtgttaaattagtgtattgctttgaggtatatggtcattttaaaaatattaattcttc

SEQ ID NO: 476808 - DNA, 639 bp, Homo sapiens
ctcgctacctgggtgcaatataaccatatgcaccgaaatagagtcagaaatgaaaaggcaggtccttcaggaggtattccagaaaaaggcattgttatcacaggagatgacagctccatatgtgttattaatcctgaagacttttcagcgagacaagatgtggaggtggaagacagtgatattgatgatcctggccctgtagctgtgtggtatgtggacgctgactgggacaccaagcatgtcctcacccattcagctgacaaccatctttgggcctgtgaaacagggaaacagctggccctactcaagaccaattcaactgtgtggatctgcagttttgactttgggggcaatatcatcacgttctccatggagaagcagaaaagctatcagtgctttgtgagcttctttgacctgcaggatctgagccagattgacagcaatgagtgctacctgaagatcccttgcagtgactctaaaatcactagtgccatttggggctcctgtggggagtgcatcattgcaggccatgagagtggaaagctcaaccagtatagtgccaagcctggagaggtgttggtgaatattaaggagcactcctagcagattaatgacatccagttatccagggacatgatc

SEQ ID NO: 476809 - DNA, 728 bp, Homo sapiens
acatgcaacagagactgtatgatcgcatgtggcccgtggagcctggcaccttcactatctgggcctttggagaaagagcttgccaactccttcagcagcgaaaaggaaggaactactgaccccagccgcaccctggatgcatccccagagagttatgatgagcaagaaaagccaatcccaaagggctccctgttgtatgattcagttgacatgacattctggaaatgtcaggtttatggaaatggagaaggagtccccggtggctggggttacagagcgagtggtgagggaggaggcgatgaagatgctgggtacttaccgcatcttccctccctgactaggtatcaccatgccctgagtacagaatgtgacaccacaggatgctcccggactgtcctcatcagctggagcccccgggggacagcatgtcttcctgtgaccatggacccctacagcaagagtgctggccccagtcgagcacttacctcactgattatgactctccatggctccatgtccccatagattgtaggtgctaggacaacccctgatgcattctaggtaactgtttactaaatagcacattttataaatgtgtgcatcaacgtcacttcagtgttcactactaaatgaccacctagttccttagctactcaaggcaaaaaaaaaattattattgtttttcacacagtaaattttttattggaggaggagaacatctaaaatct

SEQ ID NO: 476810 - DNA, 530 bp, Homo sapiens
agatcaactcaacccctcataccagcagctgcaggcataccccctgagtttgcatttagcttccctatcttagtgcacccgaagggaaaggaatgtgcttattaaggcccactgttttactgggcctattgtatgagagtgaagtttggcagttacccaagagactttcccctactttcctctgcaggcaggaagacaaccagctggatggtatccacatcgtgtgccatcaccaccagctgagtcttcttgttctccaccaaggtggtgacggtgttaactcctgcttgaaggacaagtggtctcctagtggggatgtcccctttgctggcagctttcttctcagcccggaccaacagcctctgcttcttctcttgctttgtctctggtctgtagttgtgggccagctgaagcagctgagtagctgtttggaggtgcagggcttgggtgaactggttaatcgcacgcaggaggcactttcaagtcgcttacggagaatggctctctgccactgcaacctgatataacct

SEQ ID NO: 476811 - DNA, 1089 bp, Homo sapiens
ttaaacaactttcccaatgagctttctctcgcctccaggcctctgcccatgattttccggtgcatctaatgttcatccactggcctctctccttctcacacctattcattgtttgggcctcagctgaggaaaaatgtgtgatttttactggcctggcaggggtttgtggtacctcttgccaaagtgtcaagaaaactcagaattctcatcttgaatttggagattcccaaattattgtcacacttgagaacctgcgacagcgttgttcttactaccggataaatgagtgccgagagactccaagtccagtcccacaggatcctattgcatcaccccctgtctttggacatgcctgtgaacagcacctacagggcagacttcttactgctgctaattttactatcagcaaacaaaagggaaaggggaaacagtatcaaatgcggaaggagagtatctgtgagcacgaggtgaacacggataattggaagagggcgactttctgtgttctaaaactaaaaaggactaaatttgcacagaagtaaaacgggaaaaggtgtaatacagaaaaagctataagcagagatcctgtgctgacttctcaggacggcaatgatttatatattaagtcaggcaccagggacatgttaaaaactctacagggaaatttcccatatgatggatagaactttaatattaatggaggattcatcatggtaataatgaagataataatctccctctctggctctactacacttcagttctatgcccatgcatgacgaatgttaacactgtggtatatggcttcaggtatttggttggcatagatttggggaaatgtaaggactcaggccaagatgcagcttggctagaaggctacatttataacatccttttctacagttctgtgttctctttttgaagatggtttataaacttataacctggtaaggatattaagaagaatccatgtgtccaagaaaattaattatgtttctgtcgtacagactaggatggcaaattaggtagggataagtcaactctttctgtaggttgtcagaatgtaaaaaataggtagcatatctgatt

SEQ ID NO: 476812 - DNA, 726 bp, Homo sapiens
cggcggtcgggcggcggcggctgcggtcgggctccactgaactcttcactatgccactcacagccacctgccatgcacattatttcttccaatatgccagatacaaagatgtagtcctgggcacaaaggagagtgcggaacagtggggagcgactctgaagaggggagcagatgaaacccagcccatcctctttagagctgacgatgaaaaaggatggctgtttaaaaggcttgtcattctggaggtcatcagcacatgtcccctaaaggagcatgttctaacccatcgcaaggaagctaaaaaccttgaaaaaaggttagacgaatggctaactagaataaacagtgtagagaagacattaaatgacctgatggagctgaaagccacggcacaagaactttgtgatacaggcacaagcttcaatagcctattcgatcaaatggaagaaaggatatcagtgattgaagaacaaattaatgaaataaagtgggaagacaagattagagaaaaaagagtaaaaagaaatgaacaaagcctccaagaaatatgggactatgcgaaaagaccaaatctacatttgcttggtgtacctgaaagtgatggggagaatggaaccaagttagaaaacactcttcaggatattatccaggagaacttccccaaaccagcaaggtaggccaacattcaaattaggaaatacagagaacaccacaaagatactcctc

SEQ ID NO: 476813 - DNA, 543 bp, Homo sapiens
cggcgcttggagtccagacatctggaacacgagtgttgttttgtctcctgagagaggagaatgggtaaaacacaaagtaagcctaccccattaggaactatgttaaagaatttcaagaaaggattcagtggggtctatggaatcgctatgacacctggaaagtttaaggctctgtgtgagatagattggcgggcattagaggggaagaggaaggagacaggagaacagcagcataagcggctggcagaggcaaggaaagaccagcagagagaaaagggagagagagagaggagagaaagagagagagaggaaagagagagagagaagaaaagaggcaaagagagaaagcaagagagacaggaagagacaaagaggaagtcaaagagaaagaggcagagagagagaggaagagacagagacagaaggaagtcaaagagagaaagagagagatatacaagtagttaagaaaaaaacagtgtacactattcctttaaaagccaaggtaaatttagaacctataattgataattaaaggtcttctcc

SEQ ID NO: 476814 - DNA, 563 bp, Homo sapiens
gcaggtaaaatccagggtgatgtgtacaggaatgcctgtagcacttggcataccaaaccgtatcacagtggttctcagactatgggcccagaatgcaaattctcaggccctaccgcagacctactatatcaataactctggcaatctgccacaaatgtataaaatagatcacttattgtttgctacactgagtgatgtctacagactaggctatgctgctccttcacagatcacagagttgtctgtgaccttctttctagcagttcacaacatggttgtttgcttctttaagccagcaggagagtcttgcttgcccaatctgctaagaatgtcttctataatgcaacataatcacaggaatgacttccattacctttgttgcattctattgattagaagaaagccacaggtcccacctgctctcaagtggagggaattaatcaaagacactgacatcaggaggcaggaaatatgaggactaccctagggtctgtccacacaacatattattgtcttgatggcaggtgtggtgttttgtactgtatcaaccttgttacgctggg

SEQ ID NO: 476815 - DNA, 662 bp, Homo sapiens
accacttttcaaatttggtgtctccaggcctcagtcacccctggaggataaatgggacagaccagtacacactcagaccgaccttttgctggcccagtgcctctgcttgctctcacagcatctccagtccacctgacaacaactgggtgttcccagaaggtgttcctcatgtgtactattgcgctggtgaccattgtcccaccagccacagtgaatgtgccattgctttggattgctttgctgaacacaagtgtccactctgacagtggccaagtgccaaggtcacacagcgaccttcaggaatgtgggggaccccctgacaatggggcatctgtgcctaatgcccctgacagtttagagaagcagctctttttgtttctactcacagctttcttctctgcagatgcagacatgggtctgaagatcaatgaatgtgtctggaagggtctggaccctacagagaacagaaggctcaagccaagatctttcatatctatatcaaagcatctttgaattccttcccttctcttcatttccccttttctctttttctttctttctatatctttatcaaaattttaattcaaagggtacatctttttgagttttctttctttttaaccaaagaagaatgtcagaatgatcgtaagaaaaataaagtc

SEQ ID NO: 476816 - DNA, 510 bp, Homo sapiens
cttcaaaggaaccgaataactgatttaaggtgaagcaagtaaaaacaatttaggcagatccatggtgttccccaccctccctgggaatgtggcccccaaacagcaaaggttcttgagagcctgtgaggacacagaggagctcaggaaaagctgcacctgcaagggccttgtgcctgagcatgaaggaagctgccaatcacatggaccaatgaatgatcaaagattcgagggaaacccagcgtctctcccaggtcagaatgtagagtggccacaggtcctggcagacacctctgggaatcctcaaagggcttatgtatatcagttgcacaatggctcagaccttctccttccactgcaccctcagcctaaggtctgtttttccacggctgtgggaggaggcttctacttcctaccccatcaccttgtgtcacaggccactccatttcccacctctccccataatatcattgacacaggcaatgttcatagcagattttattgaagatttgc

SEQ ID NO: 476817 - DNA, 506 bp, Homo sapiens
tctttgaaatatggcacaattagaagcctgaaccttactctaatgggggtttggggagatctgcctggaggagaggatcatgtgttccccttggaagcctctggtgacagagccttgatcgttttagcacctggacaaagtgatcacagggggcttctgtcatgcacaatagagccagtgctgcagcctgagacaggcttggccacaggaggccactgcccaggccaggagagcaactgcattcctagaggaatgaaggcaagtggacagttacaagacagtaaccagctcttctcccatgctgctgaaaacaaggctaagaaagtaaactgccatgtgaggaattgcagaaagcgttctaaaatatcaccaaaacctattcatcaagacagttcagttctacgtcttctgagttaaacctaaagtgaactaatattatatttaagtacgtttgaagctctcccataggccctatatagattatttgtattatgtatgatgtcttt

SEQ ID NO: 476818 - DNA, 789 bp, Homo sapiens
cttatagaaggaataggaacagcatttgagagggaaatgaggtgggttgttcagaggaagtatggtagaaacaagtgctgcagtcatactgcctggactgaaaaccagtccttcgcccatatccttgggcaagctgttggcattgatcaatgtacttccggatggacacggccctggcttgtttggcatttacatccatgccttggctgaaagtttagagggcacagtgatttcatttgtggatgacaagagcctggaaaggatagcaaattcattggctgatagaattaagaccaaaaagactgacaggctggagcaatgggataaatctaacaagatggattttatcagcaatagaaagaagatcctgcacttagtggaatttggcaagaaaatcgaagttaaatctgtctgtttaagaagaagatctgtgtacagtttttattgcagcactttggaaaggcaaaaaactaaataccacaagaaggcacttcagttaaataaattttggaattcactgtggttcattccctaccttggagtactagacagtcgctagaatgaaggtgtaatatctataacagtttatttgaaggatttccatcatatattgttaggtggaaaatgaattttagaatctgcttgtaaagatctcagtggggtttataatcagtattttatttactttagtttgagagagaattgaaatctttacaatattttatgacagtgactgtttcctcatggcctcacccacactaaacattatttttttcacctttgccaatg

SEQ ID NO: 476819 - DNA, 580 bp, Homo sapiens
tccctgagagcagggatactctataattcccccgccccctcacccacgaccgccagctttgggatgccgcctttagcatatacatctgtggtttttgaaggaccaactagtgatgaccctaagcaggtagagcttgtcgtaggagttggctgcctttgctctgatgtggaatggagcttttggatgggctctactatctggcaaaaccactgggtgggctctgctatgagggtgctacagctggcagaacatagaagtaccaccaagatctgcatgctggtcactacaatctctgcctcctttctttgtttctatgtgacccaaggtggtctaaccatgccattatccccagttttccctgtgaggcacagttatgggctctgggtgtactgcaaagaacctaacaggcaagaccatttccctcatggaatttatattacaatggaggaggcacatgataaacaaacatgtgaaatataacttcaggtggataatttgtgcaatgaaaatacatgaaacaggattaaggggcaagatagcaagacaccctctgggtgtctctgaggatgcaatatttgag

SEQ ID NO: 476820 - DNA, 591 bp, Homo sapiens
ttaagaagtctattatttaaaaatgcacaaatatattcttcacttacaagtgtattcttctcataaaaattcaaacaccgttaaaatttttaagtccccgtttgccatcagctacaggctagtctcttgcctagtgaagattccatgtctgatctgcattttgtggaaggaacctgtagatgttcagatgtgtccggagtttcttccttccagtgggttggtggtcttgctgacttcaggagtgaagccacagaccttcacagtgagtgtcacagctcttaaaggtgccctccaaactcttccaatttctgccaattactcagttccaaagccacttccacattttcaggaagaagttccccctggatccaagctgatcctgaaggaaaagagagtgtggcagagggaggttgcctcactcccctctctatggtgctatcctgggtttcagtgctccacagagtttttgccattccgctggtgctctttacttcttcagtcactcttagtcgaaatataggtccctttttgtgggagggacaagcactaggtgcatgtctctgagacatactaataatgttcatcaagagg

SEQ ID NO: 476821 - DNA, 758 bp, Homo sapiens
aattcactctgccaaaggaaaaaatgaagctgaaagctgagtcatgcaagaagctgcatttccttttgttcctgagcagatagctacagacagatgctcatatgccttttggtttacactaataaagaactggaaacatccaacatccctccacaggggagtgactaagggaccacagagagccttctcagccagaacatcacatagttgctgtaaggaattggatagagctctggctcccgacacagagaatcctccaggcatactgttaaaggaaaaagaaagctgtagaatcagaaacaaagctatagaatcagaaaagaaagctgtggaatcagaaagctatagaatcatactacattgtatgatgtatttatgtaagacagccacaaacaaaactcatctggaaaaattgagcatagcagccagcataagggctcagagggaacctgaagaaaggaactgcatgtatcgattgggtgtactgagaatcagaacacacatagtacaatatcttaaatattacctgaaaagagaaactgacctgagctaactttaataagaaaagctaattgtagatagattcagcctagaccaagaaagggttggtcacttgcactttattttgtccatgggtattgtcatgtttccttgattgctctgtatccttgtgattgtacattaatgtctgtgcatttgaagaagtggatacttattccagtcttcacagattaactttgtctggaaaagccctccag

SEQ ID NO: 476822 - DNA, 1214 bp, Homo sapiens
gcaacattttctaaatcgtatctgagagcctggctgctgtgacgcattgattcattgtggttggcaccatatgcttccatctgctgtgagcagtataattgttctcagtcatcagcatcgagcacccatggctaattcatggggaaaaactccagtgctttgcaccaaagtccaactcgtctgtcagttcactcctgtggaagggggccaggctctcagcatgcctctccctcctgtcctgggcattggtctcaatcagaccaggtactcagctctagcttttcatggctaccaccatcaagttcgtggtaatctgttacagcagccacaggaagctaatacagggctcttcaaacggtactgtacacaggaatcccctagggaacaggatgcaactgggattcttattcagtgggtctggggtggtgccctagatgctgctgcatttccaatgctcctgggtgatgctggtgttggaggtccatggaccacgctttgaggaacaagtttaagaaggatgggttttaagagtcttgcttgtaaataatgtttctttttttcacgcaacttaagaaaggttggaagtctactctgaaattgtgctgttatgcctcagtcttaaataccatcctgtgcttcagtttttaaatcataataattataataaaaataatgggatagtgttaataaagcatatagtatgtgctagaatattttacatacatcatctcatttaatcctcacagcatgaagaagctgtgtagtttggtggcgagtcattctcagattgcttggggtcgagtcttagttctgttaagcaacttgactgctagcaaacttaggcaaattactgaacttccttccctcgttcactcatctgtaaagtggggataataatagattaataataataatactcagtgtatcctgtggggttagggaaaaatgaaataattaatatatgcaatgtgtttagagcagtgcctcgtctgtattaagccctatggtatggctagccattattgaaataaagtaacaccaccattagccccattgaacacattagaaaactaaagttcaaattaagtctcctgtccaaggtcacataccgaggaagtgacttctcccactgctacattgagatacgtgactgttgtctgatggcctgcaatacttctaggtgtggggaggtttgaaaaataagcaataccgac

SEQ ID NO: 476823 - DNA, 776 bp, Homo sapiens
acaactctcctcaaggtctgttaccatccgaggaatcctgggacagcctgcttagtaaggaaatgcggcagtccctgcaacaccccaattctaggagtacaaaaaccgaacagtcagtggagactagatcccacagaccacatgtcccaacttatgtggacggcttgccccaagggtttagggatagccctcatctgtttggtcaggcactagcccaagatctaggccacttctcaagtccaggcactctggtccttcagtatgtggatgatttacttttggctaccagttcggaagcctcatgccagcaggctactctagctctcttgaactttctagctaatcaagggtacaagcgtctagatcgaaggcccagctttgcctacagcagcgagatagccaggcctctctatactctaatcaagaagacccagagggcaaatactcatctagtggaatgggaaccagaggcagaaacagccttcaaaactttaaagcaggccctagtacaagctccagctttaagccttcccacaggacaaaacttctctttatatgtcacagagagagcagggatagctcttggagtcctttctcagactcgcgggacaactccacaaccagtgacataacctaactattgaagcttgtgcatgtgtcatgaagttttcgtgccatggttttcagctccatcaggtcatttaatgtcttctctacactgtttattctagttagccatttgtataatcttttttcaaggtttttagcttccttgc

SEQ ID NO: 476824 - DNA, 1465 bp, Homo sapiens
aaggtgcaggtcaggccggacggggccaccagctgccctcacagggcagtgctgccgggagtttgtgccgggcaggtcccctccaagctgaaggagtccagggcccatggcagttctggataaggataaaaaggactggaggaggcacctcaagaggcacccagtgtactggaattacccccagggaggcactcacaaggggccactccctcactgccccctcgctgggcactgagaaatactctcaatgatgaaaccgtgccttggcaagcccgcagcgggctgcctgccaaatgctctcccagcagaaggggccgttttgcaagaaagaggaaaaatgattgcaaatatgagcagacgtcagctttctctttggaggctaaagatgatgcacatgcagatacagagacctgcagatacagagatagatgcaaatacagatgtagatgcagatacagatacagatgcagacatagatacagagatagatacagatacagattcagatgcagatacagagatagatacagatacagaaatagatgcaaatacagatgcagatacagatacagatacagatgcaaacatagatacagagttagatacagatacagattcagatgcagatacagacatagatgcagatacagagatagatacagatacagagatagatgcaaatacagatgcaggcacagatacagatgcaaacatagatacagagatggatacagatgcagatacagatacagagatagatgcagatacagagatagatacagatacagagatagatgcaaatacagatgcaggcacagatacagatgcaaacatagatacagagatagatgcaaatacagatgcaggcacagatacagatgcaaacatagatacagagatagatacagatacagatgcagatacagatacagagatagatgcaaatacagatgcagatacagagacagatacagatgcagacatagatacagatacaaagatggatacagatatagatgcagatgcagatacagagatagatgcaaatacagatgcagatacagatacagatgcagacagagatacagagatagatacagatacagatgcagatacagatacagagatagatacatatgcagatgcagatacaattacagagacagagatatatatagatgcagatgcagatacagatagatacagtagagatgcagctacagatcgatgcaggtacagttacagacatagatacagacacagagattacaaatacagatgaagatacagatgcagagatagacctcttcagagaagtatggaaggactgtagctttacagtcacatggactgagttcacatccccactcctcctcatcctagctgtgtggctttgggtaaagttacttagtctctctgagcctcattttcctcaactatgaaataaagataacaataacccctt

SEQ ID NO: 476825 - DNA, 711 bp, Homo sapiens
ccgtgagctcccgggggtagacccggacttcctgctcagcaggaccagctctttcacaggaggatgatggcgcccgacgggtcctgcagcatctcttatcgggtctggcagcccggtcccctggggatgaaggctcctgactctcacctaggggcacagctccccggcacccctgattttcctgcttttcagaacagtcgccctcacatgcagcagaatgacattcctctgtgtgtggccgcattcttcgcccatgggtccctggatggacacctgggttgtttccccgccttggctgctgaggatgctgctgctctgagcactgggaaggctttaaagccacggaaacggaaaaacggagtgtgttcagggaagcgcggacagatcgcccgctggtctcgcgtgtccaccacggtcctggggtcctggctctcccaccgtcactccgagtccagggctctctgctgtctgtcagaaggatttatggttgtaggggtgaagggacagggtgtgacacggatgtagctaaaggggaggagatatgttgcaagtcccacagctgttcccaggggctgggagggcatatgcttcctttaacagtacttgcttccaaagtgtattactatacctctgatgtgtcttccacaggccccagttgagtaagtgtgcctgtatcacttgttactttaagggtctcaccccagcctctac

SEQ ID NO: 476826 - DNA, 700 bp, Homo sapiens
tgtccccaaacctcaccaatgaagacatcactggaacaccatgcttctctgaagtcagcagttctttacttactgtatcttgatgatggtaatctggatgaagctacgcaaatatgctaagcgaagtcattaattttggtgatctggagggctgtggccatctcggaaccattacctccggggactattacccagttcctgagaaagtccaagtctgtgctgttgtcagaactgagtgtgtttgttccacgcgggcacctgtccccatcgatacgaaggctggagcctcagagatggaacgtaactcacacggtcacttagctggctcagtcgtctccaggttttcttatgtcatctctggcaagctggcttctgggttacatggcattggagtgctgcctgcttggcctggtttcatcgaagaccagttcttggctttgtggactaagccctattcctccctgaaagtagtgaccaatttgtcactaaacagcattctgtttggtttgcatgaactggcagttaaactgtcctggtttttacagttttgtctcttaaggccgactgccaatgttttgctacccctttggttcagtgacagcccccagggctgtagcggctgagaaacaggagggtggaggctggagtgcagtggcatgatctcagctcaccgtaacctccaccttctggattcaagcaa

SEQ ID NO: 476827 - DNA, 576 bp, Homo sapiens
ctcttggctccgtcaaccctgaatgagaagtcggcgcctcgcaccttggggcttggtcaacgcctggcttctctctgatcgtctgggctgcacggccacattgccaggtctgtctacacagccagaggagctgctgtgcccggtgcttctgaggccctgcgccatccacctggtcacacaccctccacggaaggccactcaagggcagacccgtagcagagcagaccctcagggactgggcccaacctcgggagccagcccctgccaggtggggctgaagtctgttcactcctgttccctaagcctggaccaccttctacacaggctgcagctgctgggaggccccaagctcatgcagcgcaactcttccaaggcccagcctgctcagacgattcggcccaaagcacaaagcatggcagacaccttccgcagcatgaagcatggaaggaccttccccagcccagcgcccacagcagcatgctctctcaacagggatcaaagtccacgcccgaccgccatgtgacacagacaaccagtgtagcctgaggacctcaacagcagccccgacattccagc

SEQ ID NO: 476828 - DNA, 705 bp, Homo sapiens
taatttatggtctattttgaaaatgaagtctttaaaaagaaggcagctctgtttccagaaactactgtccaaaacattcaagaagataacccccatcacaccccctgctgtgccctgtgatgggccggcttcccctctcacccggatgctggtgttggtgtctgtgctggggttcgggggtcgctgcctgtgggtcagcggctgtgaaagccaaagcagattgggacatggtggcaccctttctgtcatccccctggtccaggccggtgtgcagggcttgacagagccacccggcaggaccctgggggagagcacagtggctgtggaagcactgttaggtatgcgggaagagcgcacatgcaaggttccagctgtgttcatccctgagagcgggtttcacaggctcactgcctcacggtggctgtccctccccagggccggaagcaggccatccaggcaggtgcgggagggccacacagccattcttcatgctcttcacctctgtgtaatgcacatgtgaattctagtgacgtagtttcaactacgtacatttcaagaaaatgtactgttgtgtgtttcatttgtgtgatttcataccaaaaactgaactacattgtatgtaatttggaagccatgttaataaaaccttgcagtttccactctggttccgtaacgcaaacggggggccttccacaagcagggtgg

SEQ ID NO: 476829 - DNA, 1904 bp, Homo sapiens
tgtgggaacccttggtggaacttggtagaacttgggcattcgggtctttgggtcacagttgggttggttttcagcagcatgactgtggagaatgttgtggagagcctggagtggggagagaagcctggaaaagaggcctgcagtcatccagaagagggaggaggatgggggtgaagaggaggtgcccctttcctgccctgtccctccttatgccaaaaggggaagatcactccttcaccttctcagttgaattcattctccagggctttgctattccatgggctccctccaagcctggcagtcacctgtgcaaatagggggtgggtaattgtgaggctgaggagtccccggaccagccatctgcatgctggagacccagggaagcccacggcacagctcaggccatgtctgaaggcctcagacccagggaagctgatggtatgattctcagtccaaggcccaaggcctgagagccctgagggctgctggtgggggtcccagagcccgagagccagagagcctggagtgtgagagcccaggagagggagcgcgagcaatatgcctgcgctcggccttgtgtgctgtgggcccgcagcggctgggtggcaccggcccaggctgggggctgagcatccttcctcagtcgctgattccaacgccagcctctcccggaaatgccctccagacacacccacacctgaagacacaccacaccagctacccgggcctgccttccccagtcaagtcatcacctaaagttcaccttcacatcctgttttacagattggggaaactgagtctcagaggggctaagtcacggacccagttggtccctaacaggagtaggcaggcctgtgtggccaggaggttggagccaggtgctgctcctccctccgtcctcactgcagcccgggagcaggtagagccaggtgctgctccccactccgtcctcactgcagcccgggagcaggtagagccaggtgctgctccccactccgtcctcactgcagcccgggagcaggtcagaaccaggtgctgctccccgctccatcctcactgcagcccgggagcaggtcagaggtgtcagaccagcctcgtcggggactggggctcatgcttgtcttgctggcaggtgggcttgaggggagggatgtcgaggggacaggccagcgttttcctcagagctgggtgccctgcccggccccaccaggccccggagtcactatcggcagacagaagggaccatggctatttaaactctacgctcatcccggcccaaacgatgctgcgctgatgctcaggtaaagggttggctaagaagggggacaggccacccacagtgccacatggtgtggcgtggatgcacctgtcattctgaggaccccgcccctcctcagccctgcacagcctcgtcatgctgccccaagcagaggaagcagcggccagagtcccgaaggagccgtccaggggcttcagtggatgctgggatggggtctgtctggtgctgggatggggtctgtctgggaagtacagaggttcccctggccttcctgtggtgtttcagcctggacctgcccagggggctgaagcttggaatggccaccagggtaggtgctccacagcgctgggcaggactgagcctgtctctgggggaggaccacagacaatcagaggacagcgcaggcctaaaagtctgggccagcagatggggaagagtcagtgacaccaatgccacacccaaggtgacaccagtgcctccaggtagcgtcaaccgtgtgactcacttgacacaggccatggacttggagtgcccgcccagggtgaccccggtgaatggcggagttttgtagaatgcaagcccagcccagcagtccacgccttcttgctaagctgctctgtacacc

SEQ ID NO: 476830 - DNA, 637 bp, Homo sapiens
gttttatttttagccggggcagcaatgtgctcagttcctggtcaccttgctcctgagaattcaccccacacatacactcgcacactcctgcgggaattcaccccacgcatacactcgcacgctcctgcgggaattcaccccacgcatacactcgcacgctcctgcgggaattcaccccacgcatacactcgcacgctcctgcgggaattcaccccacgcatacactcgcacgctcctgcgggaattcaccccacgcatacactcacacgctcctgcgggaattcaccccacgcatacactcgcacgctcctgcgggaattcaccccacgcatacactcgcacgctcctgcgggaattcaccccacgcatacactcgcacgctcctgcgggaattcaccccacgcatacactcgcacgctcctgcgggaattcaccccacgcatacactcgcacgctcttgcgggaattcaccctacgcatacactcgcacagtgggctgcgctgcccagcgatgttgccagctgtgggctgatgtgagtgttctgagcagggttaagataggcgaggctaagctgcgatgttcccttggttgggtgtattagatgcattttgacttaaaatacttccaacttatgac

SEQ ID NO: 476831 - DNA, 712 bp, Homo sapiens
cctccggtcttactcagttacctttgacgtgcaggagaatggcctttaatcatatgatcagcaaacactgggcagtcacgtctacagtgagccgggggaccaggggccctgaagcaatgaccacactttcctgggcgcagcgcttcccgcacgcacggcagacacctgctgagaatgccacgggtgccatggtgaaggagagtgtggtccgagagcagtgtggagacgtgtttctaaagccggagcgccccgggccaagctccgtgcacatcacagggcccctcattaccaaccaggaaagttttgttatagaaagaaccttacaccttggtatcctccatggaaagggccccacccgtagaaggatgatgggagaagccccctcccagcccccgtgccgctcacggctctgtggtgccaccgactctaacaagtgctgtacctctgacaacgtcctggtgcagaacccaggcaaggccagcgaggcacatggtgtctgctgcctgttcaggcaaatcactaatttccaggacatccccttacacaggaacctggggaatggcccagtcccccaacaacccccatctcagaggacaaaagaaacccaaagctgagccatggcattctttttaagcagggtaaataaccattatcctgtctccatgctttaaatgccgtctttatgcatctgagtatagatttgagtcacagc

SEQ ID NO: 476832 - DNA, 1428 bp, Homo sapiens
ccagccagaggtcacagccaaacacggggctccagccagccgtgtaggtcacagggagttaggggtctgcccatgaagccctcagcttgatggagccctgcaaatatgataccggagtgtgtggaaggagaccatcaggacggacaccaagggccctcgagcgcgcacacacaataccagtttatggaggtttcaaaacctaggaaatgtttccatgctgagtatctaattccttccacgagttcaacaggtgaggaactgaagcctggcccattggagggagtggcaggatgtggactccaggtctggttcatcgatagtctcagctcttcttttcaccgagtgaagcccattaaccaggaccaagggcagaccaaccaacacagagacaacaaaccattgaaggcacaggaaggattgttccagctccaaggacttctctctccagagctcatcttcctgctttcacgggccttccccacgcctgtgttgttcatatccactgttcttgccagaaccccgtggttctgaattctcctgattcgtgcttcctccagggctcaccaatgggccaatattttctcttgagggccacctggagacatgctgtgagcatcgcaaaatctccttcccagagccacgtctctcccttctgatttcatcttagatttttcattgctcccataatctagggttcttgactttggtttcacagtaacaaacacccaggaggcttttgaaaaatgcttagacctaggacatcccatgcctgcagatactgacacatttgatccagttgaggccttggcctctgtgttttttttaaattccagataattctaacatgcatatgagaacgagagacagttaatgtcattgcaggttctcagtttattccacttacatctttaaatgacagctgggtgatgtcgtccagaatttatcacatccaaattaaaggaaggaagcctcaggcacggactgcagtagtccttgctgccatttactgagcatctaatacacgccacacagcatgctgcgtggtttacagagaatcttatttaaaccctatgaagccctgcaagttactattgctttattcccccaacaggtgaggaaagtgaggctctccgtgcttaagcgcttcctctaatcacactgcttgtgtttggcagggccaaggctcctgctgtttgaatggatcaaaagactgtggtttccagcatacgtctgtgcctcacaatcacactgcactttccgtctgtttaaatgaatgtgcctttaagtcagatactcccagaggcgcctttcaaggggcccatcagaatcctagggaggcttttccaaactgtacatgctcaagctgctccttgccccatccttgacgccccctccttgacggtgaacccccttccaaattactgtcat

SEQ ID NO: 476833 - DNA, 793 bp, Homo sapiens
tgtatgagcctgttttcatgctgctgataaagacatacccgagatggggcaattgacaaaagaaagaggtttaattgaacttacagttctatgtggctggggaggcctcacaatcatggtggaaggcaaggaggagcaagccacatcttatatggatggcagcaggcaaagagagagagcttgtgcaggggaactcttctttataaaaccatcacatctcatgggacttattcactatcaagagaacagcacaggaaagacctgcccccatgattcaattacctcccaccgggtccctcccacaacacaaagcctggctggaaaacctcccggatttactgaaatatgtgagcaggaaaacctaccggatttactgaaatatgtgagcagaaaaacctaccggatttactgaaatattgacaactcccttcttctcatagtggctcttagggattctggatcaacaggcaaagtatgtatgattatcattgtcttccccactacttctcacgcctccttctatgcagcaaaaacactcaaagataatgccacgaattacaagtgaagacgagtgctcttctcatgatttataacaatggaggatgtgacagaacatctccttttgagaaaaatgaacaagcactctaagttttacaagctgaaatgtgtccatgaatcagccaacaaccactgctttatagagccagagagaaagggagagagagaaagagaaagaagagctagaatggtttaggatttagaagtctgagtcctctgctgtcccatccaaaat

SEQ ID NO: 476834 - DNA, 1015 bp, Homo sapiens
tcaatgtccttgccgtggcaccatcatgtctttgctccatggagaagagatgaaaacgggagcctctttgctgcaaagccgatgaggccaagctcccaaagcgagaagcaaaacataggcaaggagcagcatctctcaccccggtacgatgcccgccctgttgcagggtctgggtttgctcacgatatgtctgctcggggtggatgacagctggagactggcttgggctgagagtataaagatggtcatcgtcatggccatagacatctgtgatttctgtgatgaccggcaggacaacattcaggagcagggctcttttccttgttttggtcacaagtcacgttggtggaagaggcgatggttgtctcatggctatgtactgaaaaaacttccaggattgtgcccccggccctggaattatgagctctcattaccagacagcttggtgttcaacagagagattatcttccagggagctaaattcttgaccatggtcacttcttacctagacccttcctaccctattgagcgctctggtctaaatgatcctgcagttcccagggtcctggatccaccccagacctgacatcaatgtctgaaggagactttttcctgcagaaaagcttttaaagagtggagacactgtaaacattgtggaataaatgaaagattgaattaatgaattgtagaccacgttggatacattaaaaatttgtgtttttttattttaatgttttaaaaattcatccctatcacatgtcagactacacatgcagtatgaggtagctgaaaaaaatacagtttctcagataaaagttttggtttagttaacgatagagtgagggttggagaacaatgccggagagacagtaggtgcttggtaaatatttatcatatttgccaagtgaaaaaagcctcagacacaggcagaaaagatgatgggggaggttcatgtagacctggtggatctgtgatatttgggggcatccatggggctcaggaagggagtttattt

SEQ ID NO: 476835 - DNA, 925 bp, Homo sapiens
gagaagctccttggtgaccgttctcagtaggtctgccctggcggaaagaagcccatcacggagctagacatgctgatagcaacgacgcaaccagaagcgacagaagccaaacggcagcactcaggcatttttgttactagcggcccgtttggaggggattccaagaaggccatgccctctgcagcagagaattacatgcctgttgacaaacagttcctggtgttctactgggttccagtggaaacagagcacctggccattagacacagactgacctcgcagagacaactgcagtgtttttcagtgaatgtgaacaatgactttgccaaaaatctttcacgatatccttgcacatctaggttttatgtggccattatctctgatgctgcgttgtgggcacatgtgccctcgattgctgaagcaggagacacagccagtggggactttgtgtgttacgatgtcaacctttatgttttcttcactagactgtgagctagtcaaggcagggactcactcatgaggcttatgtctttcccagtggagagtccaagccagtgtagatactcagtaaatatttccatagtgtcttagtctatttgggcagctataacaaaatactgttagttgtgtagcttataagcaacagaaatttatttttcacagttctggaggcttggatgttcaaggtcaacgcagatgtggtgtctggtgagggcctgctttctggctcatagacagcaccttctccctgtgtccttacatgatggcaggggtgaggaatctccatggagtctttataaaggcactaatcacattcatgagggccccaccctcacgatctaatcttctctcaaaggtcccatctcctaacaccatcacattggtgattaggtgtcaacttaggaatttgggggagacaaaaaca

SEQ ID NO: 476836 - DNA, 493 bp, Homo sapiens
aaaaagaggcagtgtctggagaaatgaggagaaacagaaagcacgaaggcacaaattgctcacagcaatgccttcacagtctccaccaggacaccctccagcccgcagctgactccttgctctgcaccaagacaccctccagcccgcggccagctccttgctctgcaccaagacatcctcaagcctgcagccagctccttgctctggaaaaaaagcaccacttaatgagactgactcctgccactggactcatctgctccactttatgccatgcagccaccttcaataacacagataagacctggtttgggggtttagatcccataaagcattcaattaatgtgatgtcaacatcaacagaactgtttacacatctggttgttgatggagtcattacgttcttctgccttagcaaaggcaagacctaactactggctcattctgtccccctgaatgtgtctgactttaagagaaaatcactcatcatgataac

SEQ ID NO: 476837 - DNA, 582 bp, Homo sapiens
cggagcaggctgcctgtgcatgtgcacacgtatgcgagcatgtgtctccccgagaacaccaggcccaccagctatggcttctccctccttccacctttctttcatggaagggctgtagagacccaaagcccaccctggtcctggcctcggctcccagacactccacaaacatctcccaagcctgttggcctcactgaacgtgggcccaaaccagtcataagaacacagcaggacccgtgcttgtctggagggctgggcaggcagggcagaggtttgacggtgggcgcccaagacgatgtgcctggcgatatttctcacgtagctccttccacatctccctgccgtggggctccttctttccctggacttctaagcacttcaggccttccctggccacctttaggaaggatgcagaaagtactactgaagtcaactaaatatcacttccataaatgacggggcacaggtttcctgaggatccactttccacactgtgcttatcctgtttcccggttctctgctcctttccaaattttggagtgacagcagcttgtgaaaaaaacaagacggccgggatcaccc

SEQ ID NO: 476838 - DNA, 537 bp, Homo sapiens
cattccactatttccgatccgttcctttgagaacaggaggacaacgggctcgggttgaagcagctgacccggtgctgggaatgagtgagaggaggcgcggcacctgccccggcccgcatggacgcaggcacattagatgccaagcagaggaaacgcaactttgcacttacaacaccgacggtttctcagtgcaggcccgagcacacgcacgccctggtcctcatgccctggtcctccctgcatctgcatgggtcagtcactgaactgctctggacccggcttctctgtctgctccaggggccatgccggcaaatgctcccagcagccagggagggctcgtactgcatgaaaaaaggtctgtttcttgggtccctagtccagagccaactcacaaaatgcttggggtccttgccctgtgctgatgctggggatatcacagatctggtctatgacattgcctggggaacgtaaccctgttaccccttagaaacccaactacggacacctctgcaaacttccgaacctcaaaactttgga

SEQ ID NO: 476839 - DNA, 993 bp, Homo sapiens
gggtggaggaggaggatgcttgcttttggtctctggtcctctagtagctagcacattgacgtgcctccgtttacccatctgtaagatggcgaagctacaagcaggtgacccttccacttttcatctgggacccctcccctgctccaatccagtcgtgatgtcaccagcgtggatgccccagggactccacaggttcagatgcccaccagttatctttctgctgccggagcccccaagcctgtgttctctcttttggtcaaaagcacaacatttctcaagtgttcagaacgagaagccaagctctgaagaccccccggtgtctctccctctgtccctaccacggtggtcttccacaaggctccctgcccagctatccctctaccgccaccgtctgtggggctgcgggacagccctgtggaaacaggggtgggggtcaggtctgcaccatgggagaaaggccgcccacggcagtgccatctgccttctcccacccactggttccccagtatgtaccccccacggcaacacggcacccagggaccatcaccatggactcattgcatcctgtctgtctgtcacccggacccctccttcctcctgaccggtgtgggctgggcaccttctatgcactcagcatggatcgaggcaccaaggatgcaaagctgtccctgaaaccaaacacctgcctggggtctgctccgcagggacgccttctgggagccctggatgtctctattccacatgcagaggctgcaggaccccacatgcaggtgtccctgaaatgggcttccttctgcagccgtgggaggagaacccagcagcggggacaggaaatggattcatcgctgagcagtcaaggatgctgatcttctgcccctggttctgatcctgacccaaattcccttgggacccccagagttgagttatgtgactgtttttggatgcataagaggggctaagaccaccagccaggccgtagagcactccgggtgt

SEQ ID NO: 476840 - DNA, 681 bp, Homo sapiens
acagcctctcctcttccagaaaattcacattttaatttgcagccatgagaataaggatagaatttctgggagcgtctcagtctctaagggagagggtccctctgcctgggtacctcaccctaggaactagaggaaaaatggccaccaacacagtgacacagcttgaagacataagcgctccagtgacaaaaattataaacacactcacaaataactcagtaagattaggaagcaatgatcccagtggaagacacaaatataaagtgaaaaatgggaggctggactttcaaaatgccatcagcccttctacaccacagcaaataaaaactctgagtgtctcaataatgaagaatcacagtatccaaaaacgaaaggcaattaaaataacaacggaagagaaaaagaaagttacaccagatgtgaagaaccgattctacaaaactgtcacacgaagagggcggaaagcgcgggaagaagtgtcaggaaggtgtgctgccgagggtgatgatagtgctcaaaaggtgattgtggtgatggctgcataactctgtgaatgttctagaaaccgctgaattgtacatcttaaaccaataagttgtgtggtgtgtgaattgtatctcaagaaagctgaatttttttttttttttttttttttactttttaaatgtttttgtttcaaac

SEQ ID NO: 476841 - DNA, 3050 bp, Homo sapiens
tggctgtgtcaggaaaggagaagtaggaagcagggagccctgttctgcctggctccacacaggtgaatgcagctgaggagcagctccacggctgcctctggccatccctgtggtccaagcagaccactcactggggaagcagcagcaatgtctgaaggaggcatgggtgcaaaggtgtcaacccctacgcatgacatctaccttatccatgagtgtccacttatatccatgagggtccaccccatctaccaggatgggggggcagcagccctgagaagagggggttcccaggcaacacagggctccctggattgccatgggccccctcaaagagtgaaggatgttgttgcctttaaggagctgtttcctcccctctgcaagccatggattcggcatggagccaagctggcggcactggagctgcttccaggtaccccctccacacccccaccatccatgggggagaggggtctccagtcccctcggggcatcctgggcccaccagcccccagagcattttgtgaggccgaccccaagcccacactgttgcttgatgcctacagctacaagccggtgctgtcatccctgttttactgacaaggagactgaggccagccagagagcagcagagctgggagccccacccagcctcacccctgagccagtgcactgacagggtgtcctcacccacaccaaggacagacaccggggtgccccgagaaacgaagtcacggataagtttttcttcttttttgattgttttaattttctaacttttctacagtgaaatcatcttatttctaagtaagaaaaatggcattttacatattttttaaattaaaagtggttttaatgacctggcgtaaaaccttttatcagacacataaatatgaagaaaaaaaaagagtccaaaatacaatgatgcatgtaatctaaactacgcaaaacaaatgctatatgtatatttaacacatacctgaacacacagctatcagaagataatatttcaaaatattaatgatgattttcttgggtgctgggatcatggttgtttgtttttccttttcatctttctgcagtttgtaaagattatgcaatgaacatttgttgctttaaaatcaggaagcaattatttctgttttgtgtgtggtagaatatgcagtacgtaacataaaactgtgtccaccgtttttaaatgtccgtcacagtggcactaagcacatcacactgtcgtgctctcatcaccaccatccctctccagaaattttctgtcaccccaaaccgaaactctgcacccactaagcaagaactcccctttcccctcctgctgtccgtggtaactacctttcttccacctgtctctctgcatttgactactctagggacctcttacacatggactcacacagcatttgcccttttgtgactggcttattgcatttatagtaatgtcctcaaggttcatccatgttgtagcctgtgtcagaatccccttcctttttaagggtgaataatattcctctgtgtgtgtgtgtgtgagtgagagacattttgtgtgtccattcttctgtgggtggacccgtgggttgtttccacctcttggctattgtgaacaatgctgctaggcacgtgggtgtgttacagaccctgctttcacttcttctcggtttatacccccagttggaattactgtattggatggtaattctgtgtttactgtttgaggaaccgcagctgttcccttttgtattctcaccagcaatgcatgaagtttccagtctctcctcaaaccttatcaacacttgttattctctggtgtttcgatcatagccatcttaatagatgtgagtggcagctcactgtggttttgatttgcgtttctccaatgactggtgatattgacatcttttcttgagtttattggccgtttgtattttttgttgttgttgagaaatgcctattcaagctctttgcccatttttaaaccggttctttgtttttgttgctgttgttgagtcccagagttctttacatatcttggatatttgtccctcatcaaatatatgatttgcaaatactttctgccatcccgtgggttcaaatttatctattttttcttgtgttgcctgcacttttggtgtgatatccaagaaattattgccaggcctagtgtcataaagctttttccctgttttcctctaacagttttatacttttagctcttacgttttggtcttcactccataacagttttgttggttaaacccccttccttcatttctgtctgtacctgacttttttctgtcaccaatacttagaagaatgaatgggctaattccccagtatctccgagcttgcgaatgaagaagcaaggtgtggctgcatttggtcttgccagggctgtggactgtcagacatagctggggtcctgtccctccgccctcacccacagccccagggccacatgctgtcaccacccctgggagtccacctgcatttccccacagctggacagggtcctattctctgcctcctctgccccacacttcagccttggtgcttctcttcagaggtcagttctaggcatttcacactgaagagggagtaaaacaatgctggtcagaaaggcagattcttcctaactcttcacttctggttaatatgataacatagagcccatcagaagcttggggacctggagcgctaatggaggtgagcgtgggcagtgtggcagacaaggaggggggtgtccttgaggccagagcagcccaggtgcaggcagaggagggaagcaagaagaacatgagcacaaaggccctcgctggctgcctggcagagagcaccggacatggcggcgcccacccaaagccacgcccctaccactggacgtgttgctgtagaagaggctgctgccccgggctttccagaccccctgccctgtggggcgtgtgccggcgggtgtgacatggtttggatctatgtccctgccccaatctcatgtggcgttgtgaccccagtgttggaggcggggcctggtgggagtgactgga

SEQ ID NO: 476842 - DNA, 1339 bp, Homo sapiens
tgtcataaccagcatgcacctggtggcccagcaggctctcacagccttccgtccctgggtggactctttcagacggctcctggtatgtggctcactcatgggacacagggaggcagctggggccgtgctgggtctctggttggtcctagctcaaggcacccatcgtagccatcaggtaacccctagacttgcaagccagtccagcccagctgacagccccctaagtaaccttcggcagatgcaccagagccctgaaaaggacttttgtgcttccatcagctctgaacctccaatcacagggaagcaggcactaatcaagtctttcagaagggaggtgctacacggagctagggaggagttgaacctagaggaacagctgaagagctgctggccctggaggagcagctggggaggagctggccctggaggagcagctggggaggagctggccctggagaagcagctggggaggagctggccctggaggagcaactggggagaagctggtccctggaggagcagctggggaggagctgtccctggaggagcagctggggaggagctgccctggaggagcagctggggaggagctgtccctggaggagcagctggggaggagctgtccctggaggagcagctggggaggagctgtccctggaggagcagctggggaggagctgtccctggaggagcagctggggaggagctgtccctggaggagcagctggggaggagctgccctggaggagcagctggggagaagctggtccctggaggagcagctggggagaagatgtccctggaggagcagctggggagaagatgtccctggaggagcagctggggaagggctggtcctggaggagcagctggggagaagccgcccctggaggagctgacctcggaggagggcatgggctgaggtagggaagaggagagttggggagatgatgggagcaatgttgggactgagctcaggtggaagctctggagctggggaaaagggtggactcctggaaggcctgctagctacagccattctctgagaagccccctcacaggtcgtgggggaaggagggaggaacatggcctcttgcctttaatggctctcccaggtcagtatgagcacacaggggggtgttgagtagcatggactggcagtacaataggaatcagaagggaaactgaggtctgaggctgtggagctgtggggcaagggtgggggagaagaaggggcattctgagcaatctgggggtgaggcttctgggtggggtctttggggtggggagggcacctgccctggctccactgtgtcctgaaaaccactgagagcaattt

SEQ ID NO: 476843 - DNA, 940 bp, Homo sapiens
agaccagcacagcgtgatcaatactttgagtgatcccaggtcaccctgcagaggagtgggctatgagaggagtaacagcatcagcccagctctggatgagcccagcccggtaccttcagagaggaacacgttcatccccaccaccaccaccaagtgctggtgaaaatggagagccctgggatgaaaagtccatgactcaagtccgccgcggcgtactgccttctgggtgctcagagctctccaagccttatctcctccaaccgtcacagcacacttggagcagcgccactttacagacggcatccgagagctttagaaaagttaactcaccccttgtcaaatggctcttcattgtggagcccggctttgcactgggacagtcggactgcagagctgctcctctaaaccctagaggaggaacgttaagcagagaggacttgggtgtgcagccaccattccaggggtgcagagagaatgtggaatactcatctctagtcacgagaagcttaactacctggtggaattaccagccaggcacgcacgaaacagttaagccataatgtaaggtggcaggtaacaaaatgtgaacatgaacgataaagtgggtccgaccagacacctccagcccaggatcaacttctgctatgatgccagtcctcagcgagagctctgtgatgggccgccttctggctcccatccttccccacctgcatccgtgccttctgccatggaactctgcatccctctttctaaaatggttgagccaatttcctttactcttgggtctgaaatcagtgataggatgtgttttggatcatacagcagttcacagaaacatggcctgtggatccccgagggtccccaagcattctctggggatccatgatgtaaaaattatttttgcaataacacctagatgtcgtgtacctttttcactgtt

SEQ ID NO: 476844 - DNA, 662 bp, Homo sapiens
tgctcacctctccctggacaccagcatcccatctgagcctggggtactggaaggtgccattttactggtcagagcttgtaggagcagaacgggcccaggtgtggtcttcatggagcttgagaactgggtgctgctagtgtttacttcatccagggcagcttctgcaggaatgaagatgggaaactggctgtccccaacaaatcaggctgactgccggtccagtctttgtttgcaactttgtaacttcactctagcctctgaatggttgctatccacagcctgtcagactgatggctggttaccacctcatttacatgagctggcgcacggcaagaacactatcgccagcgcgattccaaactcgtggttccgatcaaaacgctcttctgctaacatgggccgctttgatcttcctgaaaagaagggctctaagattttcgtaaaatgtcctgtcctctaacaaaatgaaacttccccactgcttgttagtatctttccttgatctaatcagtaaggaaacgaagagcttgtttttcatggcttgctttctaaattttcttgttttagcacattcagaattcctgtagaatagaatagcttcaaaaaccttttaattatttggaaaagaatctatgcttataattgaatattttaaaaatata

SEQ ID NO: 476845 - DNA, 1857 bp, Homo sapiens
atggggaatgggtggagagagttggctaagcctgatatgaaacctctctctctttaaaaaatcgatatgacttcataccttaccacacgcacgtattactttcctgtcatgaaaatgggaacattcagcggccagctgggagtgctgctcctggcaatggaagatgaagtcgtcaaacagaccacagtcacactgccgctgagcacagaacgtgatggctgtgactgcggccccagaacatatgaagggagcaatggagctggaaaatcacctgatgctctgtgctctggcagccaaagagcatcagaggatcaaggtgggaaagcaagaccgagggtttcgcccccgggtgcttctgtgctgaagcactgtcccctgtcctgccacaatgaagacatcgccttagaaggaaacgcggcgtggtccatctgcctcagaggcttagcaaatgcaaatgatggtgatgatcattgctgtgactactggcgtagtgctaattgccattgtcatcgtcaccatcatcaccaccatcatcatcatcaccatcatcattgccacctcctcatcatcattatcaccatcatcaccatcatcatcatcatcaccatcatcaccaccatcatcatcatcatcaccatcatcattgccacctcctcatcatcattatcaccatcatcaccaccatcatcatcattatcaccatcatcaccaccatcatcatcattatcaccatcatcaccaccatcatcatcattatcaccatcatcaccaccatcatcattatcaccatcatcattgccacctcctcatcatcactgtgtagtcctcctcctcatcatcatcactgtgtagtcctcctcatcatcactgtgtagtcctcctcctcctcatcatcactgtgtagtcctcctccctctcctcctcctcgtcatcactgtgtactcctcctcctcatcatcataatcactgtgtagtcctcctccttctcctcctcctcatcatcactgtgtagtcctcctcctcctcatcgtcactgtgtagtcctcctcctcctcatcatcactgtgtagtcctcctcctcctcatcactgtgtactcctcctcatcatcatcataatcactgtgtagtcctcctccttctcctcctcctcatcatcactgtgtagtcctcctcctcatcatcatcactgtgtagtcctcctccctctcctcctcctcgtcatcactgtgtactcctcctcataatcatcataatcactgtgtagtcctcctccttctcctcctcctcatcactgtgtagtcctcctcctcatcactgtgtagtcctcctccttctcctcctcctcatcactgtgtagtcctcctccttctcctcctcctcatcactgtgtagtcctcctccttctcctcctcatgatcatcaccgtgtagtcctcctcctcctcatcactgtgtagtcctcctcatcactgtgtagtcctcctcctcctcactgtgtagtcctcctcctcatcgtcactgtgtactcctcctcatcatcatcataattgccgtgtagtcctcgtccttctcctcctcctcatcactgtgtagtcctcctcctcctcatcactgtgtagccctcctcctcatcatcacttgtgtagtgctcctactcctcttcctccttctcctcatcatgatgacttgcatagtgctcctccttatcatcactactgttgtcatcatcagcagcatggtacccctcctcctcctcttcctcacggagtgctcatcatcatcatcattgttgtcatcagtatcatcatgctgccccttcttctcctcttcctcacttatggagtgcttctcatcatc

SEQ ID NO: 476846 - DNA, 623 bp, Homo sapiens
aagtttgaagctcctgtgagccatgaacatgcctaggggacagagtgagatcctgtctgaaaaacaaacaaaaagccaaacagaacttgggaccttccagattcgattccctcccatttggtgctctctgtctgctccctcctcttccaaatccactgaatccaaaacttataatgttgtaattattgatctgggtggtggttatacaagagtatgggatgaggctctggcaaattccctcccctgcagagaactatcttgtgatggagaagcatgtgaggataattcacaacgaagagaatctttcctggatctttgctatgagaacctgatgaagttctggagtgacatgcaattagaggaggaagaatgcatgtcagatattgggcagccagtggcacggacaggattgacatttgacagcctgaccaatcataaatgcaaagatgatagtttctagagctgctatccattgctgcctatttatgctcaatttagcagtgttgacaaataataattgtttatatttattgggtaaatatttttatgtcaacttttattttagattcagagggtatattgcaggtttttcatgagcactaatggtctatagatttagcctc

SEQ ID NO: 476847 - DNA, 856 bp, Homo sapiens
acctgggtgatggaatcatttcctactacacatctaggttatatggtacagcctactgctcctaggctgcaaacctgtgcagcgtattactgtactgaatactgcaggcaattgcaagacaatgagacgatatggaggggaaacacctggcttcagtacactgacaccaggacccatgacagaattcatatactccacgtggggcagaaaaagagccccccttctctctgtgaggagaaattggagatgaatgataaagaagagaaagaggaaagtgacatgggagcccaggaatcctcaaccttggataaggatggtgtaactaccgccctaagaagagggggagaccaggccacttgcacagatttaaatttcaagctggccagggcttccagtacgttattgaatagaagtgatgagagcgggtatccttgcttcataccaggtcttacaggaaaaactttcaatttttacctgttgatatagctatctcattctctttcagtttccatttgcatggaatatccttttccatcccttcactttcaatctatgtatgtccttataggtaaggtgagtcttttataggcagcatatattttgattttaaaaatttaacctatttacattcaagataattattgatagaaatgatttttctcaaaatacacaaatgtatttttatttatagttcttttactgtaaagaaaaaaagacttttagactcttgatgataattcacccgatttaacatgattctctatgaccttatttatatttgacaagttagaatgttaagaaaatatttgaacagttcagcaatttatctccatcaacatgagccttttataggtgc

SEQ ID NO: 476848 - DNA, 948 bp, Homo sapiens
tgtggtgtttggttttctgtccctggagcaaaatcaacatgtaactcagagcagcagtcaccgaaatgtccctggccagcatccttccacctgtccacaagcatggggagcatctttgtcaacctcttcgaaagcatttttggcaaaaaagaaatgcacatcctcatcgtggtcctcagtgctgcagggaaaacaacaatcctatataagctgaagctgagtgacatcatgaccaccatccctaccataggcttcaatgtggaaaccatggagtacaggaacatcagcttaaccatgtggaacatgggcagccaagaaaacatctggcctctgtggcaccactacttccagaatacacaaggactgatcttcgtagtggacagcaatgatagaaagtgtggaaaggaggcctgggaggagctctttaggatgctggctgaggatgagctctgggtgcagtcctcctggtgtttgccaacaagcagggcctccccaatgccaggaatgcagccaagatcacagacaagctggggctgcattacctgtgccacaggaactggtgcatttaggccacctatgccattagtggagacaggctctgtgaaggactggactggctgtccaatcaactctggaaccagaagtgaatgcaacaccctctcgctctcattgctcctcttccccttcactttatcctcatgtggcaaatgtgcagctctgtggtgtgagtgccagaacctgcttccctggttctttgtagtcaagcccctggtttgtgccacttaagagtggaccctttgggaaatgtgtgtgcatatttgggggtgtctcctctatgcctctttcttttctgaaatatcatctctcagtttccagctactctacaacctggaacttcatgctttgatcctgaaaaccaataagactgcttaattttttagccacctt

SEQ ID NO: 476849 - DNA, 1661 bp, Homo sapiens
ctcctcacttccaagacggtggggtggccgggcagaggcactgctcacttcccagaccatggggcggccgggccaaaggggagtggccagagaggacagcatgagtgggaagtgtgcaaaggaccttcagagtggggaatggggagaaacaggtcaacctcccaggacaggcaaggcaagacatccctggtttgaggggttgaggcttccgggacaggcaaggcaagacaccgctggagcagaagtcactggaaaagatcctataggcttctttaaggtgtgctttgttctcccttctccacctcctacagctgccccttttccaaacctacgaagtcaaactatgactcgccttatgccaagtgacaaaagcaaggtctcagtagtaaaaataggaaacctaaggcaaaccatagccattgaaacggggtataaagccgtaaatgcctggttaaaatggattaaatattccgtccatacgttaaacaaaggcaattgttatgcttgtgtgcacagcaggccagaggcccagattgtcccctttccactagggtggtcctccagtcgaccgggtgtgggctgcatggtagctcttttccaggattctgcagcctgaggaattttatagtttcagatctgatattaagatctttaatccattttgagttaatttttataggtggtatcagatgcaaatttttgacatatttatttaaaaatcactcacattgcctgacatatacttatttatgcgtagaaaaaattttgactatgaggcatctgagaaaataaagaaaacaccaaacaaataaaaccaggtatccacagaggttatctatccatgaatacctcacatattcccttctaaatttttagatgtgtcaaatcagcagtgttatttatttatatattaatttatattccctgtattccaaaaaggattttaagcaagctattttacagctctctgaattatagagagctgataacaatgcaaaataattcccacgtatagacctgtaaattctgtcagttggaggtttccttgccttcccaccttcactgaggaagacgccatttttgctttcatttacaccttcagttcagtattcctgactataactgtgtcttttttttttttttacgacgtccattgatctggttgtaataccttgccagtttcctaattaatgagttaaataaaattgttagcctgttttcattttatatatgtatgagagtcatgatcttacctgttttgttagaatgatattttagcaacatgctcaatattcgactgactccataatttctttttctgctggaaatagaatttcagtgactctgagaaatatccaccagttctaaacatttctgaaatctcaacagaggtagctaatatactacagtacttacatatttaaataaattctaactaagagactaacatttttctgaatagtcttgaagttagaggaaagttttgaacagtggaactcaagaagacttctcagttcttggaaatgaacttccattagtacacaaccagctaggtatcttcctgttagaaatgaaagtgtgatgggcagtctttagtaccagcttagccagttttccctagtcttaaaatttgattcaggcttagtttgggcttaatttca

SEQ ID NO: 476850 - DNA, 686 bp, Homo sapiens
aaccaccactctaccctttgctctatgaattcgagtgttttagaatccacatatatgtgtttattgttacaagcgtcttcctcagaactacttttgcagcatccaataagtttaggaaggtgtgggaacgccagttgggtggggtacagcagctctggtttcagagagtgtgctgtggtgtactcttcatgcagctctatcattgaggtcagcactggggacaactctaggagtcctagacagccaaggctacagatatctgaagttatggcagcagcagcaaaggctgttgggatccttggcggcaaagacttctgggatctccctgttagctctttttcctctagggaaagaagtcctaaccgaggggatccttcttggtgccaggtctggtatggcctgcaggcagttgcagcagcactgggttctggggaggtggacgttgcagtgagcaaagattgcaccactgccatctatcctgggtgacagagcaagactccgtctaaaaaaaaaaaaaaaaaaaaaaaaaatttgtctattaagccactatgatttgggggtttttacttcggcatagcctgggctaccttgattaatgtgtacaccatgaaatactatcatttgttagcagcaacagattagaaacatacatagcctcatggatagatcttaaaaccacagtgctt

SEQ ID NO: 476851 - DNA, 860 bp, Homo sapiens
aggggtggaaccactgggaaatgtgtatgaacagcactcatcaaccatcacgtttttatttggcattagctccatgccccgtgaagtgccaggtacagactgagattcatttaaaaaatagaaagcatggtcctgtaaataatttgcaactaaccagggagatacacttacactggagaactgaagaacagctacaagtacgcactgtaagtaggaaagttctacagcttccctggcttcctcccactctcagccctgcaagctcacccaagccgagcagcccactggctgtacctcaaacgtgccaagcgactcctacctcaggggcttctcctggttattcctgtgtcctggaaaaaccttctgccagaccttcccaatactccctgcctctcttccacccattctctgcttcaattccccttcgcagagaggcctccccagtcactgtctctaaaacactcagcaaacttgcatgcaatgtgagccgtgtggcaatccaatacaggggcatagccggtgcttatttggcctggatggttcaggataatcacctgagcagtgaagcccgctgcttccattggtgggtcatttttgctgtcaccagcgacgttgccacgacgaacatccttgacagacacattcttgacattgaagcccacattgtccccaggaagagcttcactcaaagcttcatggtgcatttcgacagattttacttccgttcttcaacctcacacaaatcatattgatccggtatcccatgtttatgttcacactctggaaacatgtactactactgccacctatatctacgatacttagtgtaattgctggtttatatgtctgtctccttgagg

SEQ ID NO: 476852 - DNA, 931 bp, Homo sapiens
cttaaggttgtggtagattattaagtttgtgctcagcatgaggacacgggagagaccagcatgctaaaaagacctgtgcttttgcatttgcagcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcaggaaaccagtcctgtgggcttggggcacaccctgatgacttcaggtgaacttgatcatctgcaaagaccctatctcccagtaaggtcacagtcacagggttagacctgtgatcatggtgacattttagaaaactctccagtgaatcagatgtaaatttctgagagcagagatcatgtcctcatctttatgtttttattgtttagaaacagggtcttgg

SEQ ID NO: 476853 - DNA, 806 bp, Homo sapiens
gaggatgagaaccactgaagtcagggtctttactgctttatcatctctagcatgtaggcctgaagttaaatgatcatgggacatctatacatatttgaatgtaaatatatagcctcggggatgggcactagtcagtcccaggcaggtttttggcagcggaacgggactttactttcctgctggatcctgtctgccatcaccaccatcacagctccagactgcaactcctggtgtgatctagcctacagaggcactcgggagtctgtggaacctctagcctggagtgatgcaggaactatcaccatgggtcccagccctaacttcacaatcatctatggagcaaaaatataccatcttaaaacagaatccagtcttccagaactaccaggctggtgtgagttgcagtttcttctccttgcaaaacatctgaagaaaatctcagtgttcctgctccattataatctcatggtactgccatcatatatgcagtccattgttgtctgaacatcattatgcaatgcgtgactgtatttattcctctcaggtatacaaataatttccaaatttttaacctaagcccctgtgaggatacatatttatcagctagaatatagtgtttgtgtgcaggtctttgtctttagcctcatcgtatcaaatcaaaacacttccaaaagtgttttgataggtgataaatggtaggcagtgtcttatgttaggtgtatattcaactttttaaaaagctgccaaatgattttccaaagtggctgtaccattttgcatttccaccagcagtatatgagaattcc

SEQ ID NO: 476854 - DNA, 731 bp, Homo sapiens
gtttgtcgtcttgacttcttgcatctggcagttggagaagcagtgcgtatgactttgttggccatgggagagctcaggatgctgttccttgggaagggaacccaacaacaacaagggaagaaaacgtgggggagtttctcgggacaggaaatacctgagcagaaccttaaaagatgggttgaaaattgtcaggtgtcctatccttcccaaggaaggcggtacagacacggaaagccggcttcctgtccccttcctgtccctggaggggccctctgccagaaccctgggatgcttatctgggctctgcagatctttggaatgaggtcatccaggaagttgaatccctttgatgcaattatctctgcatccttggccttttgttctcatggagattctagaggcttggaagttcaaaatcaaggcacaagcagatttggtgtctggcgaggatctacttctcatagacagccatcttctcactctaaccttacatggcagaagggttttgaatgaggtaatcacattctttaagcagcaggaaacagctttcttcacgttccttgagaaaaacgtggctgttgagagaagctctcaagtcctcaaggatccaggtatgcctacaagccatgcaagagcatgaaggaaaaatcaatcttatgtgaagaactgagagcagaagccatgatatgccgggaaagttttaataaccagctctctggaagaacaaagcc

SEQ ID NO: 476855 - DNA, 648 bp, Homo sapiens
aaacaaacaaacaaaaaagaaagaatgtcagagagcaggggtccccaacccggtactagtccatggcgtgttaggaaccggccgcacagcaggagaatggttaaaatgacaaatagtgacaacactgaatgcaggagaggacgcatttggagaaggacattgggatcccggagactggatcactcatatattttagttggaatgaaggaggaagggatgtgggaggaaggtggatgtggctatagagggcaacagggggaacttcatgtcctccttgcggtggtgcatggacaaacctacacaggtggtgcccacgacagacaagtaaaactggagaaatctgactcaagtgatgtggatgctgctgatcttgccacactttgcaagccactgagctgtactagagcaatgattcttgaatatgcctgcccattagaatctgctggaagcttaaaggactaaataaacccataactgcctcacttccataggtgttctgttatcacaaatgggatccagccttatgactcgtgtacaaacacttgattattgcaaataaagaaggataagtctgtaacaactttggaaattctgcaaagcctggaaagttgtgtttttcttctctcaggaatatgatattactatatt

SEQ ID NO: 476856 - DNA, 626 bp, Homo sapiens
gctttaattgttttaaattgtggccccctctacattcagagccatgtttccagatagacctctcatgctgggagtggacagtgccttatgtggcaaaagccctggtaccttgacaatcccagcccagtgcttgttgaaccaggacacccagaaattacgcgtgacacttccaagcgaaacctttaaaagccagtacacaatttacaacactcccttttctcctacttccgtaattgaggaagtcagtgttgagatggtcccctgtcatcctggatccctgatggctacaatgagtgacgtttccctgctgacccgtgccaggcagctctctgacagcagttcagaggtggatttggaatgtgggggcacagggcagaaaaccagttacaggagcaattgtgaagtaggcccagcagggataaggtgtgaccgagacagtagcggcaatggagagagggtcagagcctgagacatttaagagagaaactttttgaaggatcatcccattcttatatatgagtataatctaacctttctgaggatacaaaacaaagattttaaaaatgtttcttctactgtctgttatttccttttttggtgagcttatttttcctattggtttggtc

SEQ ID NO: 476857 - DNA, 801 bp, Homo sapiens
gtcaagtgccgccaaagtgggagcccaggcagaggaggcaccaagagtgagagagggctgcaatctgcgtgatacgcagtaaatcctcctgctctggcagctccactagtgtggtgggagaacaagatcaattctcccccggcctcacaaaagatccttcattgctgattgctacgaaaccagaggagaagcttaatgaaggagacgctggaacctgacagcagtattggaaatgaatatggagaaaatgaaaatattatgcaccaaattggcagaaccgaagacggagtgactattagtggacacaaacatagagtgtgcctgagtgttttctcaggccagctggtgactgcagaatatccgcgtgaggaagtagcattcttgcaaatggacagtaaggcgtccactgcaaataagaagttcctacaaaatgatgaaatacgatcccttcaaccatacctccacctatgccccactggagcaggtagcagacccaaatttggaaattggaagaagtttcatacagggactgtttacaaagatatcatcaaagtaaaggacaccacaagactagtgaccctagaactgttaccaccccttggcttcaaccagcaaggggaggaaggggtttactgccagagggagctgtgtggaaaaggtagcctgatgggagccatgaccaaggcactgtgccagggaggggccaggaactaaatacttcaattactctccactctccctccattctcttattggtgcttcccactgggcaaacccaactagacccagagagtaaggaag

SEQ ID NO: 476858 - DNA, 593 bp, Homo sapiens
tgatgcgggatgggtggatggagattttctgcagcattcctgataggaggctgtctagcaactgcttcagagtctctggcccagcatttgctgaggttctattatgcctgcatcatggtcctggcaatagccttaaagtttgcaatatacttatttttactaatctatatccactttcacatgacaccgtacctcttggatgctttgcaattttcttcctgcaaaatgaatataatgtaccagacagtagaaactggtaaacatataagtcagagtcttctgaaagaaatatcatcttgtggctctttcagccataagccagatattatccttcagccctgctggaaaccatcagatcacgtgaaacttattcactattatgagaaaaacatgagaaaatccaacccccttgattcaattacctttcatccggtccccccacccatgacatatggaaattattacaattcaagctccacctgggtacatttcagagatgcagactctgagaccccacttcagacctattgaattggactctgcattttaatgagaacgtctagtaatttgtatgcatattaaggttcaagaag

SEQ ID NO: 476859 - DNA, 892 bp, Homo sapiens
ggaagttgcgcccttttagttgttgttgaaaattgccctcttccctaaatcgatatgacctttcagctctagtgctcaccacccctgttggcaaaaacttctatgccttttagctcaaattctgactctaaatatttactgacctcaaaagcaaatccaacaaaaacaaaacttgacaactgggacctaattaaactaaaaagcttctgcacagcacaagaaactatcaacagcgtaaacagacagctgacagaatgggagacaatatttgcaaactatgcatctgacaaaggactgatattcagattctatgtggaacttaaacaaatcaacaagaaaaaacccccagataaccccattaaaaagggggcaaaggacataaacaggaactttttgaaagaagacatacaaagtcatcaagacaaagagtattggagatttgtccttgtgcaagaaatgtctccaaatcttacagttatcaaataaattaactttataaacataatatcactattaacaagttataatgctcaaataaacattagcaaaccctcaataatatgaacctagttttagtcagccatgcttgctatcaaaaatgatattacaaatttaaaaatcatttcaaaaggcaatcaagatttatgtggccaaaaaattggaggttaaaaatgtattacaaaggggtgtcaggtagttaagaaataaacatatctgttcttttcctggttttgttatatttgtctatttttaaaatttgtaattggtagtgtgctcttccttcattctaaataaataatcactttgtactgaatctggtgtttataattttagattatttttcttaaagaaggcttttcaaattgtataagctacaggatccacaaaacct

SEQ ID NO: 476860 - DNA, 1879 bp, Homo sapiens
tagttcatgatacttaatttagcagttgtggcccattggaggtcatgccctgccatacggagactggagactgtggaggggtggctgtctggtcagaaactgaagtaactcaagaatggaaaaccaaacatcgtatgttctcactcataagaccgggttgtggagagaggaatttgtctttccttgtggctgtggaaatggctgctaagttcacgtcggaaactgtgatgcctttgtgcaaagaactggttctccgtaccatgcagggctggggcaacctctgcattgttgacttaaggttcacagaattcgctgcctgccagggctgtgtcctggctgcctcccaggtcattgaaatgcccagcagagataccaccataagcttcctgacttaaacactttaccttcctagaagcaaccaatacacttttagggactgagctcttagtaaactcatcattacccatcatgccccagttgagaaaattccagggaaatgtagaaaattctaggaaaataaaaaaaaaatgcgaaaaagtgggaaaaaactaacatttgttgagtttctcttcagtgcctgggattaaacatatgtcattctactaaaggtttacaactaccttctgaaaaagatatgtattttatatatattttatatagtatatatattttatatagtatatatattttatatataatatatatattttatatatattatatgtattttatatatattatatatattttatatatattatatatattttttatatatttattttatgtatattatatatattttatatatattatatgtattttatatatataatatatgtattttatatataatatatgttttatatattatgtatgttttatatatattttatatgtattatatatgatatatatattatatattatatattatatattatatatattttatataatatatattttatatataatatatataataaatataatatatattatatatattattattataaatataatatatattaattatattattattataaatataatatatattatatattattattataaatataatatatattatatattattataaatataatatatattatattataaatataatatatattatatatattattataaatataatatatattatatatattattataaatataatatatattatatatattattataaatataatatatattttatatatattattattataaatataatatatattttatatatattattattataaatataatatatattttatatatataattattataaatatatatattttataatgtataatatatattatatataaaatatatataatatatattttatatatattatatatattttatatataatatatataatatatattttatatttattatatagataatatatattttatatattttatatattttatatataatatatattttatatatatttatatgtaatatatattttatatatattttatatatattttatatataatacatattttatacatattttatatattatatattttttatatattttatatatataatatatattttatatatataatatatatattatatatataatatatataatatatattttatatatattatatatattatatgtatatattatatatataggttctaagacttatccagatgttagttttcaatgtctcatttgccactagtttcactgtgtttgcacgcttcttgtaacatttttgaaaattttgaaaactttctgtaaatgtcttggcactaaaaaaaggtaatagtaaaataaaataaaatgtata

SEQ ID NO: 476861 - DNA, 708 bp, Homo sapiens
gaaaattcagagacaccagcaaccacagaggcctaagtgcatgttacagcttgtcacagctctggatcaggaaatcccaagacctgggcccccagaaggtttaccgctcttccactgtagtccagcaaatgagagcgtgtcaccacctgcttcttggcgagccagccaggaacttgttacagcccttttcactcttgtcattcagcaggctgtgggttcttgtcccgtgaccaagaataaggttatgtggacaaccagagaagaagagataaataaatcctatcagttctctttctctggagaactgattgacacaggagaggaagtggccccagtggtaaacaactttgcattaaaggaactctcagagatatttcccaagattgaaagcacaaagaatagaacattggaagctgattcaatcttactcagcagtatgacagttcaccaaaatgttcactctgttgttcacatagttgtacaaacaggagaaggcaagcactgctaaaactactcttgatacatatttcacaaagaaagattttagttcccaatatttcaattacttaaaatttcagtgtatgaaatattttcttatttttaaatttttctatacatttataattgacaaaaagaaagttagttcaaccattgtggaagacagtgtggtaattcctcaaggatctacagaatcagaaataccatttg

SEQ ID NO: 476862 - DNA, 1461 bp, Homo sapiens
gacaaacaaagctgagggcattcaggaccactaggcctgcgtccagcgaggcctcccgtggcgtcagcatgttcatgtggaggaatgtggaacctcgctctgtggctgtgttcccctggtactctgtccccttcctgacccctccctgcagccacacgaggcccggcaacctgccagtcactcagtggcctccaaccagagcaaacaacctgccaagttggcagctgttgctcatgagcgtccaccaggcccagtccctcagtgcactgcgcaaggaacaggactcatcttctaagaaggatggacacagccccaacaaatgggacaaggaccacatccggtggcccatgagtggtggtcatgagcttcagcaagcggcaccaggctctggcagagcgcaccagggtcaccccaaccaggataactggaccgtcagccagatcctgagcaagcggtggtacaccctggggcccaatgagacacagaagtaccacgacctggccttccaagtgaagcacatggccagtgaggacacagcgagtgacgaggagcccatggtcatccatgaggaggagggggtgacgatgtcattgctgatgatggctttagcaccactgacactgatctcaagttcaaggagtgggagccttcaaagcccaggagtctggtcagggcagcagagccggccccctgtggcccctacccctggggacgggggcccagggatgccttccaaggcgacctgtttcctcccaatggatcctgccaccttctggtgcaagagacctgaaagtgtgggcgacctggagctaccaggcccctcagtcatcacggtgggagaagctgaggacgggctcagggaactggagaccgagaaggcggtgtcctcttcactgcatgtgccctggaccagtgccggccctgatcatgcagctcttccaggcccactgcttcttcctgtccactaggccacagccgccctccaggcccactatgcacacatcctcccctccaaggtttcttctgcccctgccctgactcccagccctgtgggggtcctgaccccacctcacctggctcagactctgacgctgccctggatgccccaccactgcctctgcccgagagtcacccctgtctgaccccacctcaccctgctcaggctctggtgcaaccctggctgccctgccactgcctctgccccagagttgggaccttgacagcctggctggaaggggacaccccagccctgcctcaacacctgggggtctccataactacgacaggcagcccctgtacataccatgaagtgtgggaccttcagagcttttcactttttggaaaatagctcctgctggggctacaagatggagtgtgaggagggccttgggccacagggaggtgcctgtggactagggggagttcatgtaccccttctttccccagaggggctggactcag

SEQ ID NO: 476863 - DNA, 710 bp, Homo sapiens
aggcttccagaataacccactgggaactgctggtgtccaaattaaagccactgccagcagacacgcccaagtccctggtgctccacgtgccacggcatgcatgtgtccacagtcttgctcatgggcacttgggcaggaggctctgcgcccgctatgaagcgcaccacggtcactcagtacagcacgtgtgcgctgcttactgccctgtgcctgctgctgcctgtgctgcaggaaacagcccagagtcgaaggatggtcaccagccacccggaagaccgtcctgctctggcacgcaaacacggagcatcgcaaccggccggcctcggctttccaagaactcagactgtcactcccgccttcacattccagaccccaacagcagctgagcccgcacttctgagcgcgtggctgggtagagctccagaaactgagacaatcacagacatggcagaaaccgtggatggtgcggaaccccgtatatgctatgctttttcctgcccatacgtgccacacagcttggacatgctggacaaaggaatgactcacgtcccaggctggacacagcaggacgatcagacttcatcatgctactacccagaagagtatgcaatctgaaacttacaaattgtttatttctggagtttctcatctaatattttcagatcacagttgactatgggtaattaaaacctaggaaagtggaagcatgg

SEQ ID NO: 476864 - DNA, 470 bp, Homo sapiens
agacaagctaagaatgggtgtgctccagagtgcaccttccaaccacaagggctccgaggaagctcctgcacaccagcgcagccagcaaaacactctgcttcacacaatgttacaccaccgtctactactgtgcaaatgttctgagtctacatttccagctatgaaatttcagctcattaaatttaccctttcaagattctggtatcctaatgacgcaggccaacatatctggcagtctctgttccagcctttgaactgggatttacaccaccacctcccctggttctcaggccttcagagtcagactggaattataccactggttttcctgggtccccagttgtactctgcaaatcatgtgaccctgactaatgtattttataaactactttttgtgcatataatattcatgtccccaaggtcaatattagctctgtggggcagacagtatatttcagatacataggctg

SEQ ID NO: 476865 - DNA, 1302 bp, Homo sapiens
acagctccggtctacagctcccagcatgatcaatgcggaagacgggtgatttctgaatttccaactgaggtacttggtttatctcactgggactggttggacagtgggtgcagctcacggagtgtgagccaaagcagggcagggcatcacgtcacctgggaagcgcaaggggttgggggatttccctttcctagccaagggaagccgtgacagatggacagacggtacctggaatatcgggacactcccgccataacactgtgcttttccaacagtcttagcaaacggcacaccaggagattatatcccacacatggctcagtaggtcccatgcccacggagcattgctcactgctagcacagcagtccgagatcaaactgtgaggtggcagccaagctgcaggaggggcgtctgccattgctgaggcttgaccaggtaaacaaagcggctgggaagtttgaactgggtggagcccaccacagctcgaggcctgcctgcctctgtagactccacctctgggggcaaggcttagctgaacaaaaggcagtagaaacttctgcagacttaaatgtccctgtctgacagctctgaagagagcagtggttctcccagcatggagtttgagctctaaaaatggacagactgcctcctcaagtgggtctctgacctcctcagtagcctaactgggagacatctcccagtaggggcctacagacacctcatatagcagggtgcccctctgagatgaagcttccagaggaaggatcaggcagcaatatttgctgttctgcaatatttgctgttctgcagcctccgctggtgacacgcaggcaaacagggtctggagaggacctccagcaaactccaacagacctgcagctgagggtcctaactgttagaaggaaaactaacaaacagaaaggaatagcatcaacatcaacaaaaaggacatccacaccaaaaccccatctgtatgtcaccatcatcaaagaccaaagctcctcgccagcaacggaacaaagctggacggagaatgactttgacgagatgacagaagtaggcttcaaaaacttggtaataacaaacttctccgagctaaaggaggacattcgaacccatcgcaaggaagctaaaaaccttgaaaaaagattagatgaatggctaactagaataaacagtgtagagaccttaaatgacctgatggagctgaaaaccatggcacgagaactacgtgacacatgcacaagcttcagtagctgaattcgttcaagtggaagaaagggtatcagtgattgagtatc

SEQ ID NO: 476866 - DNA, 641 bp, Homo sapiens
ctcggaaggggcagggctcccacttgtccccatcctgccaactctagggagcatacaaccccggccacatctctcccctgcagctggcatgatggcagcagccgctgccatcacaatcatagcttattgtagcctcaaactcctgggcccaaggagctactttgccccttttgcccttatgccatgtgaagatgcagcagtaagtttgagaaacaaacctcaccagacatgtgttgctcctggggctctcctgccccacgttcagtcagcactgagccagcaggaaggatctcacaggtcatatcctgagatcaaccctccaccccttcagagcagagccttggtcaccatttggacaaacacagtttgcactttgaaatggacccagggaagaggccatgcaggctcaggcacatttagccaggggcctgagtgcccagcgtgtgtcctagaagagagggtgagagctctgggtgggccagggtacagtcagtggagggccagagaggcactttctcaagcccaggattcagggcaggggtcctcttgccaagatcgatggctatgattcctccgtgaaatgacgactgtgtcatgtcttctcagcacacctttcattcactctcagccaccgtggggag

SEQ ID NO: 476867 - DNA, 908 bp, Homo sapiens
tgatggatattggcggacactgatggtccctgccacactcaccctcacagtgctgagcatggagttatttctgcccagtcagaatgtgagctccctaaggacaggaacctcccggtgcctggggggcagcaacacttgtctggcctggcagtgtcccaaaaaacaccgagttgggggctgcaagtccccacctggtggggcagctgcagaaacagagcagaatccacagtcagaacaagaggcgccacaagggcctgcagaagcaggacactccctttatgtcaggccaaagcccccccacccctggggaaggagaggaatgccacctgtcatcaccggatgggtgagtcacctcctgcaggctggaggccatagccagcccaacctctctctttggccccccagctctcccctgtgggtgaggaagctgatggatgttgagaatatcaccctaaaaatcatgacagcaacagctgccatctctgcggcatggaacctgtcactggaagcttaagtacacagccctgggttccaagcccagatcccatgttctaacctggtaatttgtggggagtcaccccttcctgatctccatttatgcatttggcaaacatttattatgcaagcactctgaactgggtaaggggtgctgaggatgccacaacgaacaccccaaaaccatcctgccccgtggaacccattgggtagagatgttcaaaacttacaataataataatgttaataaattttaaaattctgagtgtcgattggtgatgatgtcacagagagaaggggcctcatgacacttagatcacagagaggattcaggggtttgagtgacattctcaaaaggcacaggaaaaccaaacaggatttttgggttaaccagaacctgccagaagatggac

SEQ ID NO: 476868 - DNA, 1425 bp, Homo sapiens
ccgcgagggtccacagcttcattcttgaagtcaacatttgagagactgacgacacgtctcagactcctccaggtgacccagagcttgaagttgaaccagactaatttctccctgcaacggaaaggatgactgaccatctttatttaggtccctctgctgcagatctgctgccgtttgctggcagtccactccagaccctgtttgactgggtatcaccagcggaggctgcagaacagcaaagattgctggctgttccttcctctggaagttttgtcccagtggggcacctgccagatgcaagccagagctctcctgaaatcaaacagggctttaccagtgtgattctgaagatagagcacaatcaaagcaatgtctaccaagaggtgaaggtggtccaggcaaagcaaaagcaggctggtccagagcaaagtccaagttcctatgccatccaaagtgacaatgaaggtgttctaaatggatgggaaaatgctagagaatatttatccaaccagtgtattctgaggacctaccagttgccaggcactgtaacaggttttgtggaaatcagtgatgaatgagatggatgcggcatttgtctccagaggccttacagtgaagaggagaagatgtagactaatgaagtactttttagttggtttaaaatagaatgtttctcagttgaatatttatgagaatctattttttcatgtacatacaatttgaattggttttaaaattgtaacagagagcaaatctttctcagtaagactcactacggtagaaaatgtgtttctctcttctttttttttttcttcctgaaaatgacagtttttttatgcccatgatggaaacacaaagcactggagctcatgcactacagacaatgctcaagaccttccaggcataacaaataatagcaccacagagaacacaggttctttctgcatcgagaaactcagttgcattttatctagaagcattgatggcaataattgttccaaatttccaatgctctgtgggtgtatcaggactatctaaaaataggaacacttgtttctttgaattataaattctaggatgcacgactattttctctactatattacctaccaactttcttatttttaatggtagctaaaaagttactaccataagactatcttttctagttaaaagtcaacaagccactagattaaaaatatgaaaaggatgtttcacaataaatcattttaaaatataaatcagaaagtatcaataaaaatgtactattaattatagacatttaaatctaaaccttgtgtgtaattaaaaatagtatacacttttgcactgggttaaatttaaaagccatttttaatgcatgttaggcatagcaaaaaaatctataaaaagaaaactagatttatgttcagtttgcaagtctgt

SEQ ID NO: 476869 - DNA, 1261 bp, Homo sapiens
ctctctctctctctctctccctctctctctctcccccccaacccccctgctgccggccatgtgaatatgtgcttgcttcccattcaccttctgccatgcttaaacttgctgcttgaccacatggtagaaaagaaaaacccattttctgtggagaaattcaagctggcagcagaaatttacataaataatgaggagctgaatgttagcagccaagacaatggggaaaatgccttaaagacattggggagtacaagggggaaatgtggagttggggccccacacagaatcctcattggggcactgcctaatggaattgtgagaagtggactattgtcctgcagactccaaaatggtagatccaccagcagcttgcgccctgtaactggaaaagctgcaggcactcaacaccagctcatgaaagcagccgcagggcctgtaccttgcagagccacagggccagagctctccaagcccttgggaggccacctcttgtgtcagtgcagtctggatgtaagacatggagtcaaaggagattattttggagctttaagatttaatgactgccctgctagatttcagacttgcatgggacctgtagctcctttgttttggccaacttttcccttttggataggagcatttacccaatacctagaattcaaaatggccatgtttagaaaatgcagagaaattcaagataaaacagagaatgaattcagaagtctcactgataaacttcacaaagagactgaaatacttaaaaagaatcaagcagaaattctggagttgaaaaatgcaatttgcatactaaagaatgcatcagagttctgtaatagcagaatgattcaagcagaagaaagaattagagagttcgaaggcagacaatttgaaaataaactgtcagaggaggcaaaagaaaaaagagtaaaaaacaatgaagcatgcctactggatccagataattgcctggaaagggcaaatctaagagttattggccataaagaggagatagacaaagaaatagtggtagaaagtttattcaaagggataacaacagaaaacttccaaaacctagagaaagatatcaaaatccaagtacaagacagttatagaacaccaagaagatttaacccaaagaagactacctcaaaatattcaataatcacactccccaaggtcaaggataaagaaaggatctgaaaagcagcaagagaaaagaaacaaataacatacaatggagctcaaatacatctggcagcac

SEQ ID NO: 476870 - DNA, 1844 bp, Homo sapiens
cgacctgtctgcagaaaggagcacggttgttcatgtacctcattcttcctggacacaggacaagaacatgggacccaccaaatggtaggaccgaaagaactgtaacacaaacaggcctgaaacacatcccccctgctcactgcattgcaagtaacaagaaggagagaggaggccagaccttaggcctcctgagccagagctgtgacgccctctttggggctctatggttcctggtgtctccaagcattcaggtgccactgtgctccctggagcccacagtggaagccacttgtggtacacatggggcagctgcagccttgcacagagctggcacctgtgccagatcctggagctgcccaccccaccacagccggcatgcctggctgtgggcagcagccagaccctgtgcttgctcgctcatgcaccccttgccactccaatcctggctcacccttggcaggtgtgggatccaggctgacagcacaagctgagtgtagctggccagattgagtgggcagagcccaacaggcctgagggaaacttgggcaaaggtatactggtcacaaatttttctagctagtgaagtaacaccccaaggatcatgtggtatttctgaaataaatatttatagaacaccagaagttctttgtatactttttcattcattccttcaagttaactattattttggtgattaatttgactgttttaattttgaactttatataaatagaatgaatcaaatagtaggatactcttttgtgtttggcatctttcactcactactataattatgaagtttatccgtatttttttgtggcagtggattttaaattttcatttgctgtaaagtattccagtgcctgaacatatacatttatttaccaattttaatattgagtgttttgagggttgcttctagttttttgctgacactaataatgctgccatgaaatttgttatatgtctttgtttgcatatgtgtgtgcatttctgttgaagaaaaattactggaacatagggaaacatatgttcaacttcccttacattgccaaaaagtttccaaaagtgattattccaatttacacttacataaaatgtttgagaatatcaattgctctatatctttgccaatatttgatattgctatcctttttcattttagtcattaaggtggatgtgtggttgtattttactgtgctgttaatttgcatgtccctgacaactaataatagtgagtaccttttcaaatgcttattggctatttgttgttgttttgaagtcccttttcaagtattttgtctcttctaatgattaatttgtttttaattattggtttgtcaaagttctatatatgttctggatacaagtcctttatcagataaatatgttacaaatatattctcttagttagtggcttaccttttaactcttaagtgtaggtctgtttctggactgtctcttctgtgctgttgatcgttttgcctattcttgctccaataccacagtgccttaattactatagttttaaaataagtcttgatatctagtttatcctccagttttgttctatttattatttaagatcgtcttggttattcttacctgtttacatttccaaccaacattttaaattatcttgccaattaaaaaaatttgctaggattttgattggaatatcactacatttatagatcagtttgggaatacttgaaatctttacaatattgagttttaaaattaatggatatgacatattcctcaatttatttaggtctttaaaagtatgactcggttggtggtcttcacattccatgattcacctgcaaaacagagattggact

SEQ ID NO: 476871 - DNA, 2682 bp, Homo sapiens
tgaagagagggtgatcagtgggtacccagtatgcatctttcatacattcggggagtttccctgcacacgctctctatttactgctgccatgttagacatgactttgtttctcattcgccttctgccatgattgtgaggcctctcagccatgtggaactgtgtgccagacccattgcacagaccgatggcacttgttatgtcatctcagatgtgaccaaaggaccaagaccaattcatggccatgtgacaaggtctccagtatatgttttcagtactccccggggacatctgaattcccttgtggtttgtgactacgtgatgaagcctgagaaaattcagggatcttcttgccaagtcgtttatggagacactaagctgcaactcaatattgtccactgggctgctgtggctgttcctgtccaatctcagtggctgctaaaagtgaatgtagttgttccactaagcgggtagaactcagggtgattcttatcacactggcccacattaccctgagaagccttgttacatatttacggattcatcagctgccttcagtggactagttatttggtcttctttccctctttgttgtcatgtgtttgtacatctttcagtgagacagtgactatccttttctcccagactatattttcatggatgtttatatagcaaacatctttggaaggcagagatattgtcttcctctggaacaaagttcacattttctacttgtactactatttcacattcactacttctactgcatactatatatgcaagtataataacagtcatatctccctccagagccatgagttagcctgctttgcaacccttagataagtttcaggttccctaagctagggtttcattccttatacctcacggcatacacaggtattatttgactgtctttatatgttctgtgggaattggtcactcaagaaaccggtgcaagaaaataatgatgctttggctaccactattgctatgagcaatgaactgtcccttgtctctgactcaggagtctcatgtcttttgccaacatttatgaaactctggcaggctaactaattagcttgttaatagggtaagagctcagatacttgagagttcatgacaattatgttttttcattttttaaaatttcttttcatgtcaattttgttgattaaaattttctagaaaataataaagttgacttacaatttcaatttttacataaaatatttcatagtattagtctcatatttaatcactactgcatgtgtaattattttcttttatgtttttaatattagttatttatgacatttaaattcattaatctgtcagagctcatctcatcatttcaaaactccgttgcttaaaaattactcaactgctttactaagagttggcttgattttctttactcactgagatctgaagaactgccaagttgaaattttatagctttagaagttattttatatatatgtatgaaatgatatatgtatataaaagacatattacaaataaaatatacatatttatatataaaaacatacatatattatatagagtatataaaaatatacatatatataaaataacttctaaagctataaaatttagttgtgtgtatagccatataatttttaatatatataaaataatatatatatatacactcacacaaatacatatatatggcaagctggcaaaaaagttggtgttctttcctgagctcatacttatttcatagtcagttaaatagcttccaaactatagataaacataggttaactacaccaaactgtgataatcacattagccaatatttggaaaaaacaaatctgagcatcaagctgtttagctttaactattatcatcaattttccatatcacataattatgggggggagcattagtaaataagaaaataattggattccatcttacaatgtgacctcagaaagatattgagaatacacattttatacactaacatatgtgtgtttataaacaactttataatattaaagtgatttgctttcttttatactttttcatgaatgttactagtggtgtgctagtaaatgtttaatatctggctctcagggtggagaaaattctgatttgtagcatatgacaattttgctccgctatggctgatgttaaccagcatgcaaaagttcttaaaatttaacaatcgtctctcagaagctaaacacatcactaaagtatttggtttacttctgtgaggtgataaaagtttatgaagacatcttatttgataatgtttttaataactatatgtgtgtatataaaaataaatttgaagtattgagttttatattttaatgtatgtttttattatattttatatttatatttaatattcatatattcatttagatgcctaaaacccaaagtctaaattgtatctcaatatatcattatcttattttttcattgctaaatagtgacaaagagaatatgtttgtcatgttttttttccttgtaatggactcttttattctggaaatgattttagcatgccgatcaatttttttttaaacttaagatacttaatttttaaaatttgatagcttccctacaagtctgtgattccaaatattagggaagaaaagaggcttcgtcctgtcttctgagagctatcgaggtttgaaatgccac

SEQ ID NO: 476872 - DNA, 703 bp, Homo sapiens
cgcaccgggactgcaggtggagctgcctgcctgtcccgcgccatgcgctcacactcctcagccgttgggtggtcgatgggattgggcgccgtggagcagggggcggcgctcctcggggaagttcgggctgcacaggaacccgcggaggcgggggaaggctcaggcatggctggctgcgtccctcacggcccggggccagcagggccggccggctgctccgagtgcgggcccgccaagcccacgcccacccggaactccagctggcccgcaagcgccgcgcgcagccccggttcccgctcgcgcctctccctccacacctccctgcaagctgagggagtgggctccggccttggccagcccagaaaggggctcccacagtgcagcggtgggctgaagggctcctcgagtgccgccaaagtgggagcccaggcagaggaggcgccgagagctgccagtacgctgtcacctctcaattgtcccctgctagaataacagagtaattgataatcatggccataagaggggtgggggggcagagtcaggaatttctgcactatgtggcacaaggaggcatgtatgctgattagagcatcttattttcataagctttcaatccagacttcaactgtttgccatagcaaatgcatatgatctgagttgttagcttagatgatctacaattaagtttcgtaaaaattacctt

SEQ ID NO: 476873 - DNA, 1062 bp, Homo sapiens
acagtgactttcagtcattcaggattttataaagatgatacacacagcaagatcagtgcagaattccaatgggtccacaagtgtgggcatgcaacaagactcaaagcaagtacaagctgacacagaaatatcagacaccctcctagtgcttttcctggatatccataacttgacatgtggggcttgtgtgctgagcaagttaagtgaaacagtgcatctcacggaaaacgctgtgggtggatgtgaaatgggttcaggatggtcaaaaaaaggcaaactcagcaaacctaaggcattagacagagaagacattcttatgaagactatttttaacattctcttagtttacatcttcctcatctttgaagctgacagtatgtatagggtaaaagttcctgagtacagaacaacacacagagtgtatcctgaagtggcagtttctagccaaggaaaggcttctgagacaaagacagaggccgtgggcagatttgctagtcgtttgtctaccaaagggtctagcccttctatgctgaaacgttcttcaaagaataagtgaatgcattactgttaggggaaaatatgcattcacagttataattaagataatcttttaaatcattttctgatgtgcaagcttgttctttcccaccttctcacacacacatctatttatatatggcttagtgcttatgccatcatatatgtgtgctgaagggtgatgcaggtattatatcttggaattgaatagttcaggtccaagcctcagttttatcatttagtattcagaaataaatatatgcacatatgtgagcatacatatgtttacttagtattttgtaactgtcccctagttattaatttgcttttctacatgtagagtacttttagaaaatatgaactcgtgcatttcctacaacagttgagtatattattatatactgttatatataatatttatattggttgagtatataataatgtataaacattattatggactcaactgttgtagtttcctacaagagttgtagcaaataagagttcatattttcaaaactgtct

SEQ ID NO: 476874 - DNA, 589 bp, Homo sapiens
tatgaaggattatgcagtgattgctaagcgagacttgttgaatagttttgaccaaaatgctgatcgtgatatggacgatgaaatccaggctgaggtagtatcagatggagatgaacttagtgggaactggagcaaaagtccctcttgctatactttagcagagagactggcagcattttgccccagccctagagatctgtggaagtttgaactcgagagacatgatttagaatacctggaagaagaaatttctaagcagcaaaggattcaagaggtgacagaacataaaagtttggaaaatgtgcagcctgatgatgcaatagaaaagaaaaacctattttctggaaagaaattcaaaccagctgcagaaatttgcataagtagcaaggagccaaatgttaagagccaaaacaatggggaaaatgtctccaggtctgaggacttggtgccctgcatcccagccatggctaaaaggggtcaaggtacagattaggccattgcttcagagggtacaagcctcaagccttggcagcttccacgtggtgttggtcctgcggatgcacagaagtcaagaactgaggtttgggaa

SEQ ID NO: 476875 - DNA, 606 bp, Homo sapiens
ctccagcaagggtttggaactaggctgacactgagatggctgcaataacagaaatataattcagaatatggatagaaatgaagttcactgagctacaggagtacactataacccaatgcaaggaagaaatatgggattatgtaaagagacttaatctgcgactgactggtgtgcctgaaagagatagggataatggaaccaacttggaaaacatattgcagaatatcttccatgagaacttcttcaacctagttagaaaagccaatattcaaattcaggaaatgcagagagccccaagagacttagactctcacataataatagtgggagacttcaacactccactgatagcactggacagatcatcaaggcagaaaaataacaaagatattcaggacctgaactcagcactagatcaaatagacctgataattagctacagaagtcgccacacaaaatcaacagaatttacattcttcttgtcaacacatggcacatatttaaaatcaatatcataatcaggagcaaaacactccttagcaaatgcaaaagaattgaaatatcaacaaacaatcttttggacaacagtgcaataaaattagaaat

SEQ ID NO: 476876 - DNA, 516 bp, Homo sapiens
ccagactattcctgttatgacgagtaaagacctcttagtatttgtttctgatattcatgcaccatggcaaaggtgagaatttgggccctgcaccaggaagaggactgcactggcgtgaccctggatgttcagggatcagagcacctgctgcataccctcctgcagcagggagcaccggcccagatgagcaagtgtcacacacagggaagaagacatcagccatctctgagactggccatccatccaggagcatttcttgggctcagagcaatggtgacaggggtctcagtcacttggaaagacagtacccgggataccttgagacacctagcagaggctgctgtgaggcgaggcaggagtggcagacacaccacaagtggccatgggcttgtggcaagaagtggactgccaggcccgtgtggcctggcttgctggtcgaaagtattcagggcatgctgggggactctgggaataatcgtggagctttggagaactgggatcccaaaccattgagtt

SEQ ID NO: 476877 - DNA, 734 bp, Homo sapiens
tattttctaaagttgttctccttgctttctctgtgggtgttctagttgagaatattagcttctcgtgggaacctaagtggcctttagttccttgttaccgctgagggctgcaatgcatgctgtcatgggtgtgtgcgagggcttctgtgtgacctataatgaggagtgggatggctggttgtgcggcagatgcatctgtaaactcaccaagtatagccccgctgttgtgcagagcagcatgccactccacactcacaccagcagagcacagggacctgtctactcacgtcttctctatactttacacaaagtagagacccagttccagctgcaaacagccggcctctggggctctgtgggtgatgagtcacttagcccacaggaccctggaaacaccctcctcagcagtctcctgggagacagaggctctctcagagcctgtgtccctgccgggaatgagtgtttctcaccaggaggcaggccaggggacagttgtggagaaacagcagtgggggaccctcccccgcaaggaaagaggaagctggaggactggactggtgtggagccagggcaattctgatcagagtatggtgtcctctctagaatcgatcccccagctcaggtcctgaggacatctggcaggatcctgggaatgggagggtcatgaggagaaactgagaatgtgtgttcacaaacactttgcaagacacaggggaccgtgcacccatgtgtaa

SEQ ID NO: 476878 - DNA, 804 bp, Homo sapiens
ttcatctcagaagataaaatgtcaaactcagagctatcccacgcttgtcaaaatgcgtcgcaaagaaaactcacggagacaagcacctaggcatttgctagtaaaaacaacaaaaaaaaggcgctgtgtccttggttactgtgacagctgtgactgggatcgtcaggtgggaaaggggtcaggttactttccacagaaaaaacagaaaacatctggtgctgacatgctgatgaatcttccttcagctgctatggaaaatctgggactggggtgggggtgtggaggcattctgctggctcatgcagagggggaagctgagaggaactgggctcatctgcaggtagcagggcctggccccctcctctcctcaccctcctccccttctctttctccttctgcactcacacatgcatattctatctttcactttttctatctggatgcaggggtagccagccaagtggattccttgtcctggtggagtttataactaatatcaacagggaaataggattttgaggcatagaatgctcagttacatcatctgtttcccccacagttggagttgacatgctctgcggtctatgcagaatttcactgaccattagtcttttaactgccctatttcatcctgtttacaatgagctgttacgtaacagatcaaaatggcagcgttccaagaacttaactgctactcaaatgtcagttggggtacgtagtgtttgaaatatttttcacttgctgttaatagctgttatgtggttcctgtgtccaaatactaagtgcatttgctcatagatgttc

SEQ ID NO: 476879 - DNA, 1508 bp, Homo sapiens
ttctctctatgaatgtcagcatgttatgaaggaccatcttctgtgttgctctcacccgactgccctggtgcagtcctccactgaggagggcccacatcagcagcagagttgcggcaggggcactttgccctcacagtggagcctgtgacttccctgtgtctgcaagtgtcaggggtggtggagaagagaggatgaggcagcccccgacacagcagcccctccccagcactgagtgtcaggagcggccgaatgggtcagctggtaataatagtgcagtcattccatctgtaagcctgtcttgaaaggcaagtaacagaagagttaattaagtgcctggatcaattaagatcttgatctcctcgctcagcagtgctgaggcgagtgaggccaggggagctcgaagctccactcctggggctccacttggccctgcaagcggctcgaggcacaggcagggagggtccccattcatgcaggggctggaccatggaaggagagagaaagagagagagaagaagaagaagaggaggaggaggagaagaagaagaggaggaggagggagaggaggagaggagtaaggagaagagaagtagaggaggaggaggaggtggagggagaggaggagtagaggaggaggaggaggagaaggaaaactccaagagtaaagaaagagggtctccactcacagacaaaagaggaacaaccagagatatagaaggtagacaagcggaaatgttgtgccgtgaagtgcaagagaagcctcagagaaatccaagagaatgctctgagaaagtgctattggacaactgtgtcaaattctgccaggaagacagtggacacaaaaagattaaaaggatgaacattgtgcaaagatatggtagactggacatgtgaaaacactgctagtacagaatacctaaaatacttgtgaaatacacatgcttattttaaaataatgtctgaataggtgggaatgttaagtaaatcctcagatgctaaaggcgatgagaaaaataagatctagggtggtgaaatgtgaacagtgctgggagtttactttagtaagaactcttgattctgggttaacttgctatacacatggccctatctccaaagccatgagaaggaatataatcattcaagaatgggggggtggagagagagagagagagaaagagagacagagagagagagaagaagaagcagacgaagaggtggaggaggaagaggaggagaggagggagaggaggaggagaggagtaaagagaggagaagtagaggaggaggaggtggaggaagaggaggagtagagggggaggaggagggggagggagaggaggagtagaggaggaggaggaggtggagggagagaaggagtagaggaggaggaggaggtggagggaaaggaggagtagaggaggaggaggaagaggtggagggagaggaggagtagaggaagaggaggaggaggtggagggagaggaggagggggagggaggcaagaaaaa

SEQ ID NO: 476880 - DNA, 634 bp, Homo sapiens
gaagatcctggctttatacctgggcaacatcctaacctaatcagcgcccagctaatgaccatccttttggggtcctgctcttgcggttgcgtaagtactcattctgctcatctttgcatgacttaagatggtgctgttgtttttgcctgtgaccgagagcctaatagaagaacttctggaaccatcagcgtggctttctgggccctgggaaatctggatgttagaattaacaggttcagatcggcatagtagaggagctaagtgtgcaaaacttgtcagacacaggccctgtgagaaatcagcacaaaacaaaatgggagacaaagatgcagaacccatcttgcaccaagtacgaggtggaattcagaatccaaacttgggtgcagaagtcagagctgtgctcggaagctgtgtctgcctggattccattttctatcctactaacaatcagcaagcacttcgagggctctggcatgtcagggccctgtgtcatggtgcatggataaacagaagccctagtaaatgctgcaccattgcatccacttagataatacgatgccctacttgtaatatataattgaggtttattcctcacaggaattgaaggaaaagggacagagataatgtgatttta

SEQ ID NO: 476881 - DNA, 2592 bp, Homo sapiens
agctgtgtcacgagttaacaagatctgctatgtcttggaggagaaagtgctttgtgagtaggacttattgcggtgtttgcgacccggacttaagagcatctgaagaaatctggagagatgaaggaatcttgagaggcacagctaaaatctgcttgcctggaaccaaagctgctggagccatgaactgcaaggaacacttcagtggtgatttggaccaactgcctgagtgttggctagtatccaagatctccacatgcctcaggcagagaggagaacactattgtgaaatctgcaaaggatcctccacagcaaaagcctactctgcaggggaaaacacttttatccggggcttatcttatggatcaggggcaggggaggagatttttcagactccagcctcttctagcttttctgcatcaactaacggcatgagagagtgttggggtgggagaatattacagcccaggagcacgttaaagattggaaattaatcacaatattatagaatgtttccttcccttcagtccacatcaagagggccccagtataacaacagtggattgcagctgaaggagctgaaattcagtcttttcctgaggaaaaatctaagggaaacgcaatgataacttaggaaaaaaaaaaaaaaaagacactggaggaatttgaatcctctgatgcctactgatgcagcaaacattaaagacagcctaacgtctagcccagtaaacataaaaactcacaccaaaggccttattaggggttgaatgcttgtgtctcccttcacccccaaattcacatgttaaagtctaatccccaacatggtggtggtataaggacatcgggcatttgggaggttgttagttcaggggggtagagcctttgtatgaatgacaatagtttcactgtaagaagagacacaagacagatgatctctctctttattatgtgaagacaaaaagagaaaatggccattttcaaaccaggaagggagccctcaccagacactaaaactgatgctgccatgatcttggacttaccaggctccagaaccctgagaaataaatgctggttgtttaagccacccaatctatgaaattctgttataacagcccaagctgactaaggcatacctatcaactccagatcttattagccaataaatcatgtctgggtttcagtaaaaaattataaggcatgctaaaaggcgaaaaaaagcctcatagtctcaagaaacaaggcaagcatcagaaccagaatcagatatgacacagatattgaattatgagacaaggaatttaaaataattatgattaatatgttaagggttctattggaaataatcaacaacatgcaagaacagattgggtgtgttgaagagcttgcagaatctctgtgccacgcttgccaaggttcttgcatccctcatctgtcatagagaaagtggtggagataaaattgtgccagcagcaccttgtcaaacccctgctacaggcatccattgtgagtcatgggataaaggataagagagcagccagaggcttcagcatcatatgtctgagttctgcagaaaggaccaggcccagaagactcctggcttccacacatacccatgaatcacctgattaaggcccactctcaggattattcccctatcaatgcactgaatctactttcaaccaaggtaccaaaaacttcattgctcaatctaataaactcctttcaatgaagtcctacttgtcctgtgtcttctgacagtgttgtcaataccgttttaaagcccatgttctagttttccttattttctgtctctggatgacgctgaaataaggttttgcttcttgatattaagaaaaatttctaagcatatgattatggaggtagaagattgggatacctagaaaatgttacaatggagaatttttacttttattattatgcctttgaaaatatgaccaaattaaactgtcactagaagcataagtatatattcctatcatcacatgttgccagcatttaagtactattataaacgatcattttttgtaattaatccttacaaagttcacataattaaaaaataaaatttactaatttgaaatatattattagtgagaatagagagttccaaatagtttaacattgtttgctgatttgatatcttctgtcatcttgtctaacagggtatacatttttcttcatttcaatgtggttatctaaatgttgtagtaagtaatattttatctgctatatttgatgtaaatatttctacttagttatatttttacacattttagtgtaatttatactggaactggaactttaagcggtaaatattcaaaactgaattataaaggtcatatttttatgttttatggcatacatttttaaagaaaagaaactttctaaatggacaattttaaaataagcatcttacatacttccaataggaaaaaatatttcaaaactttggagacaattttcaaaacctattagagagaatttgacatttgtatacacattttcaaagaaacattgacatcatttaatttagcagttctactctagtcttaataaagtaacaggggtgcacac

SEQ ID NO: 476882 - DNA, 536 bp, Homo sapiens
agttgctacatacttttaaacaaccagatctgaaatttaattgatgtttctgtttatcttgtatgctgtaaactttctggattcactcattagctccaaaaatttttttagactccttggaattttctatacagacaattttatctataaagcaccctggttgggaggagcagggtgcctttgtactgctccatacctgatctccactgatagaagtggtgggaaaggactcattgcttctcagcggggaagagtcctggctctctactcagccttctctgacaccacaggggaggctcgaagcacctctctaccgctggatacaatgggatacaatggtctagctacaatggcattggataaatacacccattccaaatgggataaattagccaaaataaaggtgctaaaggccccatgcaagtctgaaatccagcagggcaattaaatcttaaagctccgaaacaatctcatttgactccatgtctcacatccaggtcacactgatgcaagaggtgagttcccatggtctttgg

SEQ ID NO: 476883 - DNA, 716 bp, Homo sapiens
caaagaataatactatgagtagcaatagtagcagtagcagcatcagcagtagtagtaatagcagtaggaacaatggcagtattagcagcagcagtagtagtaatagtgatagtgatggtagcgtcagcagccatagctgtagtagcagtggcagtagtagcagtgatattagtgctagcattagtagcagcattagtagcaatagcactagtagtagttgtggtggcagtggcagtattagctgcagtagcagtagtattagcagtagcaatagtaggagcaggaatggcaatagcagaagcagcagttctagtagtactggtggtagcaggagcaggaacagcagcactattagtggtagcattagcagcagcaatagcaatagtattacagtagtgatagcggcagtattagtagtactagtagcagtggtggtattagcagcaatagtagcactgagccacgtggccaaggaagggctgagatgtgaggtctcgtgcacacagcttgggccccatgtcatttccattgaaatatgtggctcaaggtcactggcactgttgagggttcacggaacttctgcggaaaagcccgtggatattactggctaccatgtggcatttgcttttgctgatgagaaatctgatgccattctaaatgccattattattgatacttattaacgaggcttagaaaaatgtcgttaaaatgtgacc

SEQ ID NO: 476884 - DNA, 943 bp, Homo sapiens
tgatgtggtagataaaaacagaaagaccagactatctttttccacttacaggatgccctgtccagagaggagaaagctggcagtctggccacagcagccttgctgagcagcagtgggctccacccagttcaaacttcccagaggctttgtttacactgtgaccataaaacctcctactcaagcctcagcaatggcagatgcccctacccccaccaagctcgaatatcccaggtggatctcagattgttgctgtgctggcagcgagaatttcaagccagtggatcttagtttcctgggctccgtgggagtgggagccaccaagccagaccacttggctccctggcttcagcacccctttccagggaagtgaacagttctgtctcactggcattccaggcaccactgggaacctacggaggagtcctggaacagattatctctcactaccttcggatggaaccaaccctgctaacatcttgtcttgtacttctacccttcacaactgtgaaagaataaaatttctgctgtgtaaactgcccggttatactgccttggctctgacaactcagtgtcctgagaccatgattcaacaggttctttatctgtgactgtcgttaagctgcaggatgacgggtatgatggctctttatttcaataatttatttcagaatctgtcacaggagtcattcagtaaaaataaacaaacttgaataaatgaatggatttattgaagtgattaattctgtaatctgctctaattgaaactacagagtaccagaaaaatccaaaaacacacaaatattctgatattgacacagaatttcagagttagaagagagtgtagtgaaaatatttaagcactcatcgggaaatgggacttaagatccttaaggtgagcatttctgctcctgaccaagatgaattaacaagaagcatatttata

SEQ ID NO: 476885 - DNA, 511 bp, Homo sapiens
cagaaagaccccagggagggcggatgtcaggaatccaaatgaagggagcgtgcacagaggaggggccacaactgggtttacaagccttgctaccacaggctggcagatggagtttcacttccctcctgttcaaggagactttctcattcacctttcaggagtctcagtgcttggtggcccctcgtgccttctgtttcacgtgggcactcaacaccagatcccccacgtttcactctgctcccctgtgctgttgtgagagtaataccttccatgacaaaccacaaagagatgacaatgtagagacccctgacccaaaagaaatagactgcagcaccaattggctggctttgtggctaaggagctggaagaagctcctagctaacagccaggaatgtgggaacctcagtcctacagccacaggagactgaaatcagcaacggcctgaataagcttggaagtggattcttgccaaagcgtccaaaagggaatgtgatgcagccaacacctttgg

SEQ ID NO: 476886 - DNA, 587 bp, Homo sapiens
cagctcagggcagggcagcagcatgggaactgtagatggctaccacagtcaaaaactcaagtgtcgacaggcaaagactagtaggaaaggcctgagtaaaagctgtaatataggacaaatgtatagggagaaagacctgctatctgacttaccagtaactcggggtctgcaacgtacctggagaaaaagtgaaaactttagtcaaatgcctagaggaagttggcatcggcatgtggatggggagaaccaagaagacatgttcaccacttactgtcaaagcagcagcttccctaagctcagggttcccagctgcaggggaaccccctgcgggagggacatccacctgagacccacatttcccacaggatatcaattatatcatatttatgttttggaaaatacaggaaagcaaaaacagaaaaataaaattaccccaaataccatcaatccttaaaattatacagattagctgttgaaagctctttctctatacttctgtattctactcccaagtggccaaagagaggtgaggccaggatagggaaggaaaaaagaaagtggagaggagagagagaggagttggggag

SEQ ID NO: 476887 - DNA, 494 bp, Homo sapiens
tccttccctgtcattgcgcaccatttttaagtcattcactgtattaaaaggcagtttcatgctatgccaattcctggagatatgtaaaggcattatctccactgtcatgagaggagggcggcgcaaaagccccgcagaactccacgtgctcaggtgtctaccaggaaagtacggctcatcagctgcacaggggcttagggaggggatggaacaagatcacaacatggagagaggcctttgggtgggcgatggctgtgggacatacgaacgaggggtggatgtggctgagaacgtgaaagacagggaaaaggagagcagctgcaccgccctgggttctggccctggagactcccagccttttgtggcctggaggcttccactgccagctcagctaagcaggaccggagccacactccgctgggcatttcagaggggcagtgggggctgcacgaaggaaattgagctcctgtctatggagcatggctgttaagaaa

SEQ ID NO: 476888 - DNA, 1475 bp, Homo sapiens
ttccaacaccactgagtcaaccctcttgactaagccgtctgagcagggttgcctgcagatctctgttctctcacggctcccggggggtcagctactgatgttaagcgagagaccctttcaaagcacagagaccgttcttcctacagaaccctctcagggccactgcacagcaagtgggatgaagcagactgcccctgcaggcgaccaaccatcaagaagggctggcacagaacatttaacagaaggctttctgtatgagtctgttctcatgctgctaataacaacatacccgagagtgggagtcggtgcttgcacgatcgctcacatgtggagcctggagcctcactgtgactcacaggttcaccttctgacaatgcatgtggaaccggcaggtgttcttgatcagggagaggaaccagattttcccagaagcgctaagcttctagctggccacgtgaggctgtggataacacacgcatcactcagagcagtaaggcatggctgtgtgtcatagctaactgaggctaagagaaaacatacaagtttcaacaatggagctatgtaaattggaaaatacctctgactctcccattaattcttctctttgcatttcatggaatgttataagacttcagaaagaacagaaatttttccacagactcccttattgaactaggagtaaataaaaacaattgtactgctttagatagaaataatacaaatacaattttgggggtggatgtttgtataagtgtgcagatgatatttattcagagtcaatagaaagcaaaaatgattctgtggtcgagttggctgtcctgcccgtgctccatgcaatgctgttcaacagcagctggtgttcattcctattgacatcaaagttattcgtatgaaattgttctcaaactttagctattcaaactgagcaattaaaggacttttgtgatttcgttcaactagtgatgttcaattatctcactgtcaaaaactcattatattctttcatacatttcatttaaaaaaatcttctgtttatttgaagcagtgaaatcatacttcaattttgaaaaaagaaagcccccaaaatccatgttgactttttatatgattcattgagtaaagcctttacgcttctgactacttttaaaaatatcttcagttatagaattatttaaattgaaaaaaggtatcatttttatacttaagcttgttgaaggtattaaagaaataattgaagaataatgtatcactctaagtatcaacaatagtagtaaaagggacaacattacctataaacagaaaaagaaattttgacacaaagtggacaattattacagcatttgctgagcctacctttgaaatggatttcacaccttaagaattctttgctttttcatggatgtgactaatactcttccagcctggaaataaggagactatcatgtgcaatgttgaggataaagtgaattaaagtc

SEQ ID NO: 476889 - DNA, 626 bp, Homo sapiens
gcagcacgagcagggccacagctctgggtgcctgagtcatcaagggaaaagaaatgtcccttaaggagatggcatttgggctgaaatatgaatgtgagaaggagccaacaactcaccttgcaaacattctaggaacagccttaggcggagggacaggtgcaaaagcccagaggcagggatgcttgcactggggcgggacagaggtcagcacagcagggatgacatggttccctagggggatgccttctgctctgcaggctcgacatcaacttgtgacactgtggaaggagcgggcacctcaccctccacagtgtgtggctagaacagtcatccagtccacacagcactttctgttccacaaccagcccaaactgcctttacaatgcattagaaaagccacccttcctccagcaagtagttgctatctgctgcaacatagttgtcagaaacatgtagatctacaagatctgtttgtgtagagagccccaggatttgatgccctaaatggtgggtggaccagggaacatgacactccttcacagctgtgggacctcagtgtcagaagcatcaaatgatgtgtctcacattgcactacctaaaatgagttagatttagttctgtgggct

SEQ ID NO: 476890 - DNA, 596 bp, Homo sapiens
cagtggtgtcatttcctttctaactaatttccttgttatttcttgtaaggaggatgcagcaacaaggtgtcatcttagaagaagaaagccaccctcaccagacaaccaagcctgatggaactttgatttcagatttccaacctccagaactcaaggcatctgcaccctgggatgcatcagcccctggacttctgcacaacagtgtctttgtctccttggccccgggaagttgccccttttctctggaggacaccaggaaggagagggtccatagcatatccctgacagctgcaggagctgccagcctggccactcagggtcctttaaagaatttatattcgggaggcatcacatcctccaggttcagctgtgttgtcacaaatggcaaattcactttgtttttaagggcaaataatatttcattgtacgtatatgctacaatttctttatccattcatccagtgacggacatttaggacatttctacatctaggctattgtgaattataaagtatgtcttttctgtttatagatttactagttatccttttacacaagtctggatcaccacagaaaatggacaagaaaatttggac

SEQ ID NO: 476891 - DNA, 827 bp, Homo sapiens
tttaaggtgcggtgagctgtcgctccggtgaccctttgacctggatttgagcccctcagaatggacgccgcttgccgagaccagctcagtcggggagaccctaacccagcggtgctagaggaattaaagacacacacacagaaatatagagtgaaaagaagatcatttctgtttgaatatgttgaccagaggtcctgcaagatgtgctttgctgagcagaaaagtgctctcaatgaccagattgtggatgtcgattctcaaactgtttcaccaaagaacttcatcaacagagcagaatcccatggggagtctagggctagcctggaacctctcagatttgccattatgaataagggttttctgcttggagatatggaccagacctgcatcccgctctatggggctattcaggcaactgtaccaggggaggtggctgtggttgatgaaaacacccatgtgctgggaagctggtgcaccccaaatccatggggacagaagctcctgtgcccaggagccttctggaccatgccctgtgcattttatttgataaagaaactagattgtcctatagaattccccacactggactttgctgattgtatctccttgcttatttatctagaggaactgaaaacttatgtccacacaaaagcctacattggacgttcacagcagctttattcataattgccaacacttagaagcaaccaagaagtcctttgttctgaagatattttggatagagctagtacttaggggagtctcttcagtatagatcattaaagccaaatcaagcaggaagtaattgtaaactttcataggtttgc

SEQ ID NO: 476892 - DNA, 3385 bp, Homo sapiens
gctgttcatccttcctttccagaccacagtgggaaccacccacggcacagggagtacatgtggcatgagaaggactttctaatccacgtggggtgtccctggggcagtgcctgaccacaggccacataacaaggtatgtgatggaatgcagccaacatttgttccttactgttccagaggctggaagtccaagatcagggaaccagccaactggttccctagtgggggctcctttcctggtttgcacacagccacctgctacctctgtcctcacagacgatgccacggacttgttcctggaaaagttccagagccagccttaccgtggcggctttcatgaggaccagtgggaagaggaatttgaaaaggtccccctgtttatgaagaaagcgccatcagaaattgatcccagggagaatcctgacttggcttgtctccagtcaattatttttgatggggagcattctccagaacaggccaagacctataaagatgagggcaatgattattttaaagaaaaagactacaagaaagctgtaatttcctacactgagggattaaagaagaaatgtgcaaatcctgatttgagtgctgtcctttataccaaccgggcagcagcacaatactatctgggcaattttcattctgctctccgtgatgtgacagctgccaaaaagttaaaaccgtgctacctcaaagcaataataagagatgccaaagagaagaagcttctggaaatgagggctaaagtagacaagctgaagctaattgaacagagggatgtgaggaaagccaacttgaaagaaaaggagaggaatcagaatgaagttttactccaggataccaaggctaggaatatcaggctctctgaagctgcctgtgaggatgaagtttcagcctcagaaggtctaggtgagcttttcctggatggactcagctctgagaacccccatggagccagactgagtctagatgaccagggcaggctgagctggcctgtgctctttctgtacccagagtatgcccaatcggatttcatctctgcttttcatgaggactccagatttattgatcatctaatggtgatgtttggtgaaacaccctcttgggacctagagcaaaaatattgccctgataatttggaggtctatattgaggatgaggacagggcagaactgtactgggtgcctgccaagagcaccttgctgcaggatctacagcaccacaggcactttgtaaaagccctgacaccagcatttttggccattttggatcttcatgccctcagttctggctacacagatccccatctctgtgacttcctggagagtcacttcctagatgaggaagttaaactcatcaagaagatgggtgaccacctgaccaacctccacaggctgcacaggctggctggcctggaggctgggctggcgagtatctctttgaaaggctcaccttcaagtacaactaggagcctactgagcccagggacttctggggggccccttgcaaagtaacagggcttctgcctaagcctctccctccagccactgggcagctttttaactaccctggagcactctcccaagccttggatcaaattaaaataaagcttttggaagcaaaaaaacgaaatttaaagtctattttgtctaataatagtggagacgttccagatctcttttgattagtagttgcatgaagtatcttatctgtccttttattttcagcatttttgtgtctttatagctaaaataagtcccttttagatagtatatagttggatcacgttttttaatacatactgaaaatctctgccatttaattgaatagtttgattcatttatatttaaagtaattactgtcaaggaaaggcctccttctctcattttgctatttatattccatagattttgtatatgtttttctcaattccttcattatggatttgttttttgtgtaattgattttttctagtccatttttgttcaattcctattttcttttctgcatagtttttaattattttcttcacttttttattttctttattttctaccgcacaatctggagattgtaattaacatattaaatttataacaatgtagcttgaatcaataccctcttagcctgaattgtgtacaaaacctctgctattatacagcctcatccatctctttatgttattattgtcacagattttgtctttacacattgagtgcccattaacacaaatttatattatttttggcatttgaattttaaaccatataggggaaaaaagaaaaagaaaagagaagttacaaaccagaaatacaataatattagcttgtatatttatctctgtagctgcctttactggtcttctttaattcttcatacagctttgagttactgtctggtgtccttttatttcaacctcaaggaataccttcagcatttcttgtaggacaggcctactagtgatgaacttcttcaaagtttatttatctgggaatgtctttatttcttcttcattgattagttttgccagacagaattcttggttaacagttttttttctatcagcactttaaatatattgtcccacttccttctgcccttcatgcttgctgatgagatgttgactcttattcttatttaagattccttgtacaaaaacatgacaagttgcttcttacttcctgctttcaagattcttttttggcttttccttttgaaagtctaattataacgcgtaatggagtctttgtgcttttttggttaaaagtccattgagattccctgatatgctgatttatgttatttctcacatttgaaaaatttggaccattatttcttgaaataacttttctgcttctttctctccttcttctaggatttccattatgcatataatggtacacttcacagtgtcccacaggtctcttaaggtatgtccatttttcttcatttctttccacttctgcttctcaaattgaataatctacattgagctatcttaagtttagtttgaaattttgaggatgctttcttctttctgttcaaattttatgctgaatctctctagtgaagctttaatttcagattgcattttttagctccagaatttctgtttggtctattcttatattttctatctttgttggtaatctctatttgtctaggcatcatatttatggtctcctttgtctatggtttttctttatctctctaagcatatttaagatggttgatttaaagtctttttatagtaaatccaatgtctgtgttttcttagggacagttttggttcatttattttttcctgtgagtgggtcatacattcttgtttctttgcatgtgttgtaaatttttgataattgaacatttttaatatcataat

SEQ ID NO: 476893 - DNA, 5960 bp, Homo sapiens
cctgagcaggaccccacctcagacgatgccacggacttgttcctggaaaagttccagagccagccttaccaaagcgccatcagaaattgatcccagggagaatcctgacttggcttgtctccagtcaattatttttgatggggagcattctccagaacaggccaagacctataaagatgagggcaatgattattttaaagaaaaagactacaagaaagctgtaatttcctacactgagggattaaagaagaaatgtgcaaatcctgatttgagtgctgtcctttataccaaccgggcagcagcacaatactatctgggcaattttcattctgctctccgtgatgtgacagctgccaaaaagttaaaaccgtgctacctcaaagcaataataagaggtgccttatgccatctggaactgaaacactttgccaaggctatagatgccaaagagaagaagcttctggaaatgagggctaaagtagacaagctgaagctaattgaacagagggatgtgaggaaagccaacttgaaagaaaaggagaggaatcagaatgaagttttactccaggataccaaggctaggaatatcaggctctctgaagctgcctgtgaggatgaagtttcagcctcagaaggtctaggtgagcttttcctggatggactcagctctgagaacccccatggagccagactgagtctagatgaccagggcaggctgagctggcctgtgctctttctgtacccagagtatgcccaatcggatttcatctctgcttttcatgaggactccagatttattgatcatctaatggtgatgtttggtgaaacaccctcttgggacctagagcaaaaatattgccctgataatttggaggtctatattgaggatgaggacagggcagaactgtactgggtgcctgccaagagcaccttgctgcaggatctacagcaccacaggcactttgtaaaagccctgacaccagcatttttggtctgtgtaggatccaaacttttttgaaagaattatctctgggggagaaaggtgcaccaggtaagatgactgagccaggccccctggatctcctccctcaccctcctctgctgggaacctagcatgcctgaatcagtccagtgccttatttctgtcaccctggggatagaccttcctagtatcatggtgggggaggagcctctggattccctgaactgcagcctctctggctggtcttcactttcttcagttgatataaaactctgtgccttggccatgacatccctggactccatctctaaagggaccatctgctgcagttaccacagcaactgacctgactggcaccctggtctgtggagacggactagggatccagtgacatgattctgaactttcgtggagttcaacaccttgttacagaagctacccttcaaactgcatatctacacacaaacaaactatgcgtaggattccaaggctttaaagctgagagaccctgacctcaagttatttcatgagcacagaggggagccatgtggggttgctgtagatgccttgaggtgaaattggggcaggaaagccacatcctgctctgcatttataaagaccatacaaacggagatccttggtacccctaaaaagattgccagttttcttcatctttgccatatggaggactgtgacagacttggacagtggcctctgagttcctctgcagtttcacattttaggattctgtgtcttttaaactggaaaatcttctagtatgttgggttgttgttataaggtatacttttgtctgcagctgtttgttgcctgcttcctaagaggggtttatccatcctgaaaaaaaaaaacagtattttctaaattcttctttgacttagagcttatttatgagtatgttgtttaatttccacatatttctgagttttccagctatccttctgttactggtttctggtttcattccttcgtagtcagagaaaatactttgtatgagttcaaccttttaatatttactgtgacttgttttgtggcctaatataagatttagcttggagaatgttacatgtgcacttgagaagaatgcatattctggtgtttgtggtagtggagtgttatttatatgtctactaattccaattgtttatagtgttgtttaagtcctctatttccttactgacattttgtctatttgttctattcattattgaaatttggatattaaagtctccaaatattattgtagaattttttttctcagtttatttctgttaatttttgtttcatgtgtcttgggggttctgtttgatgttcaggtatgttcatcattgtcatatattcttgatggattaaccttttttgaatacacaattttcttgtcttctatgatacattttaaagtctaggcagcacattcagcagtcctgtggatctgtctcttgcttcaacagtgtttggatggaacagatccaggaactctctttcttccagtctccagctaccttccaatcttctctccattttcaaccttcgggaacatcttctcggtcatctcctgcttctgggaccagccaacaccatttttgtagttagctccttcttgctaaccatgagctcccagatttatcagaattattccattgaggtggaggcagccatcaaccacctggtcaatttgtacttgtggatcttctaaacctatttctctctgggcttctattttgaccatgatgatgtggctctggaaggcatgggccacttctgcaaatcagctgaggagaagcatgagagcaccgagcatcgctcaaagatacaaaaccagtgtggcagcatgctgtcttccaggacatccagaaaccggctcaagataagtggggtacaactttggatgccatggaagccacaatgcccttggagaaaaatctgaactaggccattttggatcttcatgccctcagttctggctacacagatccccatctctgtgacttcctggagagtcacttcctagatgaggaagttaaactcatcaagaagatgggtgaccacctgaccaacctccacaggctgcacaggctggctggcctggaggctgggctggcgagtatctctttgaaaggctcaccttcaagtacaactaggagcctactgagcccagggacttctggggggccccttgcaaagtaacagggcttctgcctaagcctctccctccagccactgggcagctttttaactaccctggagcactctcccaagccttggatcaaattaaaataaagcttttggaagcaaaaaaacgaaatttaaagtctattttgtctaataatagtggagacgttccagatctcttttgattagtagttgcatgaagtatcttatctgtccttttattttcagcatttttgtgtctttatagctaaaataagtcccttttagatagtatatagttggatcacgttttttaatacatactgaaaatctctgccatttaattgaatagtttgattcatttatatttaaagtaattactgtcaaggaaaggcctccttctctcattttgctatttatattccatagattttgtatatgtttttctcaattccttcattatggatttgttttttgtgtaattgattttttctagtccatttttgttcaattcctattttcttttctgcatagtttttaattattttcttcacttttttattttctttattttctaccgcacaatctggagattgtaattaacatattaaatttataacaatgtagcttgaatcaataccctcttagcctgaattgtgtacaaaacctctgctattatacagcctcatccatctctttatgttattattgtcacagattttgtctttacacattgagtgcccattaacacaaatttatattatttttggcatttgaattttaaaccatataggggaaaaaagaaaaagaaaagagaagttacaaaccagaaatacaataatattagcttgtatatttatctctgtagctgcctttactggtcttctttaattcttcatacagctttgagttactgtctggtgtccttttatttcaacctcaaggaataccttcagcatttcttgtaggacaggcctactagtgatgaacttcttcaaagtttatttatctgggaatgtctttatttcttcttcattgattagttttgccagacagaattcttggttaacagttttttttctatcagcactttaaatatattgtcccacttccttctgcccttcatgcttgctgatgagatgttgactcttattcttatttaagattccttgtacaaaaacatgacaagttgcttcttacttcctgctttcaagattcttttttggcttttccttttgaaagtctaattataacgcgtaatggagtctttgtgcttttttggttaaaagtccattgagattccctgatatgctgatttatgttatttctcacatttgaaaaatttggaccattatttcttgaaataacttttctgcttctttctctccttcttctaggatttccattatgcatataatggtacacttcacagtgtcccacaggtctcttaaggtatgtccatttttcttcatttctttccacttctgcttctcaaattgaataatctacattgagctatcttaagtttagtttgaaattttgaggatgctttcttctttctgttcaaattttatgctgaatctctctagtgaagctttaatttcagattgcattttttagctccagaatttctgtttggtctattcttatattttctatctttgttggtaatctctatttgtctaggcatcatatttatggtctcctttgtctatggtttttctttatctctctaagcatatttaagatggttgatttaaagtctttttatagtaaatccaatgtctgtgttttcttagggacagttttggttcatttattttttcctgtgagtgggtcatacattcttgtttctttgcatgtgttgtaaatttttgataattgaacatttttaatatcataatctgtaactctagaaatcataatcttcttctccccaggatttgctgttgctacttgtaggttgtagttgtttagtgactcttctaaattctttttataagactgttttctctgttatgtgtagtcaccaaagttccagttctgttaacttactggtcagctggtgatttaacagaggttttcttaaatgcctaaacccaatgtaacaaaaaatacttcaagtctttgtggactggctacgtgtttgagcattcctttaatgcttagctaggccatttacatttgcttaatgtccactttcagcttcacgggagcctaaagacaggagccagagatgaaagttcatggtgttctccagtcttttctgagcatgtctagtcctgggcatttgtgtggacttccaggttatccaattatgtggaatctattaaaatacttattctcacatttatattctttccctgacttttcctaacctttctagtctgtctgctgcttttgctatctgttataaccttccccaggcagcagcagtgagtatgtttgccttaaatgatttctttaaatgccactcaggaggctgcttcaggcctgagaaagttcagaggcatgtgaaacatagggaattccctcaccaatcactcggggagccaccagacagacatacaatcataattgtttgagactaagtgcctcctctggggccatcaagttatgtcaataacatgggcagccagccccacagctaccaccaagctggaaagtggtaaattgtataggtaagttaaagcaccacaatactcttttgctgaaatttaggagcttctttctttgtgaaacacttcttttattgttgtatattttttattagattccttagttttaaaaagttaacctaatagtttat

SEQ ID NO: 476894 - DNA, 839 bp, Homo sapiens
ccacacaggcaccttcccttccaggctgcagggtcccccattggcagtggcctcgtctccaggactttcctgctctagaactcagagaagaagctgccacaccaatactagcatgtgacaaatagcagcagacaggctgagcaattaaacagaccccaaatgcttgtcagtggggctgggcctcaccgaggaccaggacctttgattcccatctgattaataaggttaaattagctggttctctaaggggactcctgaaaccccatcctgctgggaaatccagatgtagaacccagggcactgcatgggcagcaccagtgcctatctccacctcccagccctggtgaggatggcaggggaggtgctggaacatcctcctggggccatcgagcctgtcatgctgaggctgggcactgccctgctgaacattcccagtgccctcagtgccaagttcttgggggccctggtggatgctccactccacactgatgggcctcgaggagagggaagcatcctgcagaagggacacaaccaggcgccagtgggcacagaggaggtgctggaagcccatggaaatctgccagtgcattcaaggacagcagaagctgcagttggtgtttctcaaggcccctcgggaccgtctgctgtgggtggcatccacgtctatgctcttttccgaatgagaaaagcgcaggtggaaatgggaaaggtgcaggaagacaccgatattctcactctcattcgtgcactcaacaagcagtttctggagcccacccatgccaaacgctagggatacagtgtcctggacagatgggctccccgtggtgctgaactctttg

SEQ ID NO: 476895 - DNA, 1211 bp, Homo sapiens
tgtgcctggggtcagagtttagtgcctgtctcaaggctccccaggactttctaggactcaaaactctgtttttactttgcaggatctaggattgagctcctctgaggatgagagcccctctctagcaatcaggagccccaccttgagaaagcccctgaaacacagcacccctgaggaggcagccctgggttggagcccaaggccatcgggaggtgcctcctatctcagtgggtccccaatgcctgcacacttctctcaggaccttgcatcccacccagcaggggtcagccctccagccactgttaggaaaaggaggctttctactctctgggcctccaaggagtccagcttggatctctcagctcctggggaggagccgcccacatcagcctccttaacccagcggcagcggcagcggcagcagcagcagcagcagcaagagtccctccgggcaaagagctgggcacaaaaccctggattgcctgggatcctgaacacaacagggaggaagagacgagacccgaagaagcgggcagctgcgggtagcagccagttgggaggtgccctggccctctcctggcagaattctgcctcctcgcccatttcctggtttatcctctggccttgttctagtagcttcctgagaaggggcacttttccggccagcagtcttggagccctttctcagaactggaaggccctgtgtgcccctgtccctgactcccacctgcccaagcctctccaggtcccttttgtggttcttggtggtgctgagtttcattttggggacttgagcaatgaagccagcaaccggctgtctcctgtggcctgcagagaactgggtaaatacacgagcatctgccaatggttccgactggagagagggcgggtgctcatcatggatgatgaagctctcggggtgctccgatcacatataacaaaggaggctgcagaaggggcctgaggagggctgtcagggggtcctaaggtagtaccttgtgtctgctgtccccatctttatgtccatatgtacccaatgtatgtccatatgtcccacttgtaagtaagaacatgcagcatttggttttctgtttctatgttaattctcttaggatcacggcctctagctgcgtccatgttgctgcaaaagtcacattctttcttatggctgtgtagtattttacagtgtatatgtaccacattttctttat

SEQ ID NO: 476896 - DNA, 989 bp, Homo sapiens
tccagcaaggggcggcaggagtaaaggaatgacaggtgcaaataccttcccaccaaagcccttgttgccctctggctcctccccagagtcgtccccactctcagtcggtcacccactccttgaacttgagatcagtgtcagtggtgctaaagccgtcatcagcaatgacatcatcacgccctcctcctcatggatgaccatgggctcctcaagctgctccttggtatccgagctctggagtgtctgggccgcaactgacaggcgttcagaggacaccccaggggcagtggcagtgcccgtctctgatatgctccgctcccacgagcccttgtacactcctgctagcccctggcttgtgggcttggcctctgagctggacttctttcggtccttgttgcaagtgggccaccttcacttggaaggccaggtcgtagcacttctgcgtctcattgggccccagggtgtaccaccgcttgctcaggatctggctgacggtccagttatcctggttggggtgaccctggtgcgccctgccagagcctggtgccgcttgctgaagatcatgaccaccactcatgggccaccggatgtggtccttgtcccatttgttggggctgcatccatccttctcagaagatgagtcctgttccttgcgcagggcactgagggactgggcctgacatcatctgagtggtagaggcaactgggtgtcaggggacatgacggagaggaaagcttcatcgtggtcattctctgtctcactgtccagcagggactcccctgaggggcccagggctcctcctccatggtgggaggtgggcttttaccaggttccaccacccccaaagtgtgtggggttccgggccctgggctttcagggcaggtggctccagggggccgcgcagggtcaacactccctgtcccacctgaagatctatattcaagtttacagattatctctcctgttgaagtttactattgtgttatat

SEQ ID NO: 476897 - DNA, 1496 bp, Homo sapiens
gtgacaggacccagtgtgagaagtgagggtggttcaggcaggctggcagggagcccccaacgtgctgtagatgtggggcaggagcacctgcatgttccagcggcgggctcctcagggctgggccagggcctgtgccgtgacacacgtgtccttgcagcagcgtggcatgaagggcagggcccacaagctcttctacaaggccatcgtgtgcggcaaggagataatccgtactggggactgtgccgtgttcctctctgccggccgccccaacctgccctacatcggctgcatccagagcatgtgggagtcgtggggcaacaacatggtggtccgcgtcaagtggttctaccaccccgaggagaccagcccaggcaagcagttccaccagggccagcactgggaccagaagtccagccgcagcctcccggcggccctgcaggtctccagccagaggaaggacttcatggagtccctggcgctccctctgcttctgtctctgtccctgtggctccctggggctccctcggcctttgtgccccctacctgccatcctgatgtccccgcgtgcccgcagcgcgtgctataccagtcctcgcatgtggacgaaaatgacgtgcagacggtgttgcacaagtgcctggtggtgggcctggagcagtatgcgcagatgctgaagaccaagaagtaccaggacagcgagggcctgtactacctcgcgcgcacctacgagcccaccacaggcatgatcttttccacggacggcatgcccgtgctctgctgagcccgccgggctctgctggccaccggccacctgtgccccgagggcggccagggacccctctccatcactgccatggtttggagaccatgtgcgttgtgtgcatgcgagcgctcctgcaggcgtgagcatggggccaggtgtgcacgtggacgcccgggtgagcatgtttgtgcatgtgtgtgcccgtgtgcatgcacgtgtgtgcatgcacgtgtgtgcatgcatgtgcacatgcttccagccccaccttccaacccctcagtgcccccaggacaggggcccctcttagctatcagggtatggccctgctgtccccctcagggcagtctcagccgggaccggcccttcctgcccagcacattgcaagcacttggccaggccggccctccagcctgctgctgcatgggggcccgggtgcccccaggcccatgcagactggggattcagtggggaggggcgcttctaaggaaccaaactgacgctcactctgggcttcccgggcacccttagcatggagcccaccccaaggcctcccactgtgcatgggatggggtggcccgatgccagctggcctactgactgtgccaggggccttgcccccaccctctcaggatggcctagacttggggaacacagcagggtggggttgcagcccggggtatcaaaggcaccaggtggagagggcccggcacaggcccaccctggtccaaaccct

SEQ ID NO: 476898 - DNA, 1384 bp, Homo sapiens
gctccccaggcactgcgggcgtgatgatctctctgagccgcatcctcacggagctactgctgcccgacgagcgcgccagcatgctcatcttcttcctggtgtcggtggcgctggagctgctgtgcttcctgctgcacctgttagtgcggtgcagtggcttcgtgctcttctataccacacggccgcgcgacagccgccggggcaggccaggcctgggcaggggctctggctaccgcgtgcaccacgacgtcgtcgccggggacgtccacttcgagcacccagccccggccctggcccccaacgggtccccaaaggacagcccagcccatgaggtgaccggcagcggcggggcctacatgtgctttgacgtactgtggccaagggtccagcgcagctggcccaccttcagagccgtgttactgcaccgctacgtggtggcaggggtgatctgggccgacatgctctccatcgccgtgacctacttcatcacgctgtgcctgttccccgaccttgagtctgagatctgccactgcatcctgggcgagtggctgcccatcctcatcatggctgtgttcaacctgtcagacttcgtgggcaagggcggccacgtgcctggctctctgcagatcctggtagccctgcccgtgtactggcggggcacccacctgctggcctgctcctgcctgcgtgtggtcttcatccccctcttcaccctgtgcgtctaccccagcggcatgcccgccctccgccaccccgcctggccctgcattttctcactgctcatgggcatcagcaacggctccttcggcagcgtgcccatgatcctggcagcaggcaaagtgagccccaagcagcgggagccggcagagactgcttctcccaaacaaaacgcgttagccatgaaggagtcggagccctgggtccgaatggacccgcctgcagtctgcgtcagcctctgggaaaccacagcggtgatgccagctgggcacgtcaggacctccccacacacccacgtgatgccacaggtcgggggatgtgccggactagggagccctcctattgccttcctggcccaggatagaagaggggagccattaaaagatgaaggcagacggctgcaccgccgcctgcaagcagagtttgtgcatggacgggagctgggactgccatctcgggatcccggtggaacttgggctgccccggataagccggtcctcagtcttcccatctgtgagagcccacgccgggcccttcccttgcccgaggccggctgactgccctccctgggttaccctctttgcaaagccccgaatgtcctctgcaggccacccacactaaccaggcatcagccaccacacccagccaacttaacttttaatttttt

SEQ ID NO: 476899 - DNA, 621 bp, Homo sapiens
gcaggagattttattgaccccatgacatccagtgacagtgtgggagcaggctactctccagggacatgtttctggaggcatatggagaagggggcccaggtggacaagaagtacccctggaaggacctgggaggggaaaataatgccaccttcagtttcggttttcagaaaggggttcgcaaggaaagtacatttgtccaggaatcaggtctgagtgccatagcccagtacacaggctatggaaccagcaaatttgagttccaatccaaaactctgtctccgaaccagattaagagacagggtcctaggccatgtcaacatgtcatacatcagaaatgtggtgtctgttctggacttctgctttgctggtttgcccttaacatggctgtcagtaaaacttttgaggagtcaaaagttgtacttggatttttcactgtgtgagggtcagtacctctaacccctgtgttgttcaaaggtcaactatatatgattcttctggacagtgaaaatcactaaaactcgagtgaaaagaaaggcaattaactgacaggtaaagtaatcataaatatttgtgatataggaacaactgttctttactgttgctctaaatatctaagaacc

SEQ ID NO: 476900 - DNA, 735 bp, Homo sapiens
gtgtgtgttgcccaggatggtcttactcctgggctcaagtgatcctcccacctcagcctcccaaattgttggaattaccgttgtgagccactgcatccagcccttcatcacatatctaaaaacaatcaccagagaaagccaaacatcaggagccagaagagaaagcttcctaaagaagccagagaagtcaagactagccccacctggctggaatttccagagacaaacgttaaaccacagcctgaaaatgcagttgcatgtttcaacccggtcttatcctctagaagctgaaaagggcaaggaaatagatgatcccctagggcaggggtcctcaacccccaggctatggcctattaggaactggaccgagcagcaggaagtgagtggagggcaagcaagcgaagcttcatctgaatttacacatgctccccatcactcacactcctgcctgagctccacctcctgttacaccagctgtggcattaaattctcacaggaatgtgaaccctattgtgaactgtgcatgaatgaaagaaaaggatcagaggctctgagtgtcacaaagggtgcacattcactacttgtagtttatgtaactggtaaggcttccggtcactaacaggctgtcagtaaaacttttgaggagtcaaaagttgtacttggatttttcactgtgtgaggatttgtgatataggaacaactgttctttactgttgctctaaatatctaagaacc

SEQ ID NO: 476901 - DNA, 609 bp, Homo sapiens
ttggttgtcacagctggggaggagagaggctaactggcatctaatggatttaaaattacctgcaaaattatgctgtaaaatcttgatcctacctgcttatttattttgcctgacgtgcctgaagtggagtggtagagctttagaagtaactgttgtggctataagagaacatgaatttatcaagggacagagtctgggagatgagatttttggaaaacccagacttaggactaaagggagtgaactatcagagaattgcatggaaatgtcagtacgatatgaatcagaaacacacatgcaggacttgaaagatgttactaacaatgtccactacgagaactatggaagcagaaaactggcagctgtgacttacaatggagttgataacaacaagaataaagggcagctgactaaaaagtacacacatttagcaggtttagaactttgaacagactttcagaagacaatcgcacaacatatttattttcatagtgatttagtgtaatgattatgaaagtaatttgggaaataaattagctttagcaaattttactgtaattttttttatttagggcacataccttagtaatttaattgtgaaagctatgc

SEQ ID NO: 476902 - DNA, 988 bp, Homo sapiens
aaatcattttgcatgctttcacacctaaatcaacatcaggtaattcatactagggagaagtcctacaaatgcaaagaatgtggcaaatcctttaactgctcctcaaaccatactacacataaaataattcatactggagagaaaccatatagatgtgaggaatgtggcaaagcctttagctggtccgcaaacctcactagacataagagaactcatactggagagaaaccctacacatgtgaagaatgtggccaagcctttaggcgctcctcagcacttactaaccacaagagaattcatactggagggagaccctacaaatgtgaagaatgtggcaaagcctttagcgtatcctcaaccctcactgaccacaagagaattcatactggagagaaaccctgcaggtgtgaggaatgtggcaaagcctttagctggtcctcaaaccttagtagacataagagaattcatactagagagaaaccctatgcctgtgaagaatgtggccaagcctttagcttatcctcgaaccttactagacataagagaattcatactggagagaaaccctacacatgtgaagaatgtggccaagactttaggcgctcctcagcacttactatccacaagagaattcatactggagagagaccctacaaatgtgaagagtgtggcaaagtctttagcttatcctcaaccctcactgaccacaagagaattcatactggagagagaccctacaaatgtgaagaatgtggcaaagcctttagcttatcctcaaccctcactgaccacaagagaattcacactggagagagaccctacacatgtgaagaatgtggcaaagcctttaattgctcctcaacccttatgcaacataagagaattcatactggagagaaaccctacaaatgtgaagaatgtgaccaagcttataaagagaaactctacaaaagcaaagaatgtggtaaagctgttaactagtcttgaa

SEQ ID NO: 476903 - DNA, 607 bp, Homo sapiens
tagagggtcagcctcagagacccccttcccacgctgcctctttttgcttgcccctgcttgagcagctgctgtcccttagagttctctcaatcatgtccccatagttgccaccatgacggccttgcagaagaaggaggagggggaggagaagaaaggagaaggagaagaagagatagagaagaagaaggagaaggagaagaaggagaaggaggaggaggaggagcaggaggaggagaagaagaagaagaagaagaaggaggaggaggaggaggaggaggagaaggaggaagaggaggaagaggaggaggaggagaaggaggaagaaggggcgaagggaagagaagaggaagaagaaggaggaggagcaggagaaagaaagaggaggagggagaagaagagaaaaagtagaaaaaataagaaagaagaaggaggaggaggagtgggggaagggggagtaggagggggatttggggaagggggaggaggagaaggagaagaagagaagctgcagctggtaacctgcccaaagacaagaactcaactctcctggggcccctagggtcctgtgggctggtaagatgtccacagcatccatcaccagggagta

SEQ ID NO: 476904 - DNA, 807 bp, Homo sapiens
ggccaacatgcctagctggggtctggcaggccttcagtgggctccaaggacgggccagggctgctctggcatggcacccccctgccgtgtggacattgcaaaccgccttctcagccccaccagcaggattggggacctctttggcagctccagggaaagggcttggaactgcccaggaacgcaggctgtctcagacacatctgaggtgtgcgtgacccagtgctgctctccttgtatcttagacctgctgcagggcctgccactgttctctggggacagcccagtgggacagggcgttcattacttgaagctggcctctttcagctgcccctctctctgtgtctggtgggtgcctgatcaagcctgctctccaggtctcatcacccctgatggtctccctcctcccagtggagacaccacagtcatctcttagacctcctagcctagggcagcttctccaggcactgcctggggctcctctattctttgcatgattctcagagcagagatcccacagatgatgaattgagagctgaattgaggccttccaattccctaacaacctacactaaccaagttctaaaaatattagtaaaacgtacggacatttacctaacacacctaacacaattagataacaagctgtgctggtattccatttaattctcccaaagcaaagttttttagttgcccatgaatatatatatatatatatattttttggttgtgaattcactacatctaaaattagacttggaatattgtttcttcttgatatactaatgtggtttaataaatgacaaatac

SEQ ID NO: 476905 - DNA, 559 bp, Homo sapiens
tctgcggttgcccccatctgctgctccataacctcaatgcaaaaccatgccttgcgttgatatggagaccgtcatatcaacaatcacagagccagttcaaggcttcatgaggctcctagtctggaggtcaagtctgtgctctccttttaccttaggcttgcagcttgccaggaggccaagcgacaaaacctggcagatgggaatggtatttcaggacctccaaggattctcagggagaagctatggaatctacatcacagaggactttagtctgtttctacttgacagcagaaaagataaattgaagcaatctgctaagccgatttgccgatcgttggttacacagagggccaatgtggtgtttgccctggaatctgtaggaagagctagtcgtttggatgttagacactctggtttccctggaaggccttgtggatgggtttaactctggatccagatgctgtgtcaccaaccttcccatggacattgtgttgttacttttctgatcttagtctcagtatctttggttctaaaaccaggctcatgagaccaggtcaac

SEQ ID NO: 476906 - DNA, 1077 bp, Homo sapiens
tatacgtgcaggtttgttacatgagtatattgtgtgatgctaaggtttggggtacggattctgtcacccagatttgcgcttctctggtgattactgatgctgagcatattttgatatgcttgttggtcatttgtatatcatcttgtgtccggaattggtgggttcttggtctcactgacttcaagaacgaagctgtgaaccctcccggagtgaagctgcagaccttcgcggtgagtattttagctcataaaggcagttcggacccgaagagtgggcagcaacgaaagctaccgcaaagacagaaagaacataccttccacagagtagaaggtgaccccagcgggttgccgctgctggctcggcagcctgcttttattcccttgtctggccccacccacatcctgctgattggcccactttacagaaagctgattggtctgttttgacagggtgccgattgttttatagttttagatcttacatttaggtctttaatccatttttaatttttgtgtattgttaagataagggtccaatttcattatttttcatgtatatgttcagtttttctcacatcatttgttgagaagagtaacctttccccattgaatggtcttaatggccttgtcatagatcatttgaccacacatgaagggtttatttcttttttttttatatactttaagtcctagagtacatgtgcacaacgtgcaggtttgttacatatgtatacatgcgccatgttggtgtgctgcacccattaactcgtcatttacattaggtatatctcctaatgctgttcctcccctctccacccaccccatgacaggccccagtgtgtgatgttcccctcacacatgaagggtttatttctggtctttctattccatcgttctatatgtctgtctgcatgccagtatcacactgttttgattactgtaattttgtaatatgtttgaaaaccaggaagtgtgattcctccaaatttgttcctcttttccaaaattattttgggtattcgggatcccctgacattccattggaatgttaagattatttgttttatttctgcaaaaa

SEQ ID NO: 476907 - DNA, 553 bp, Homo sapiens
ggatcctatccctgaatggttaaagcccttctgtggcttcctcacgtgctggaagaatgttctttatcatctggcctctgcttcaatcttcaacttcactacatgccactcttccagccactggttatactggtcctcttttccaccttgaggtcctcaaaggttctattccatgggcttaggactccctgccatttctggtgtacaggacctttatctaatattggactcagccagtacatctgctgtggtgcccttggaggaccgttgaatcatacggtgaaaacgctggagcctgcaagtattacagccttttctgcttctactgccgttaccaccatcctcaacaccaataccataacctcggccactattccaactaccactactatcactagccactctttagtgtcattgaattatttggcaggtaccattataggtgatctgatgtttatttttcattaatgcatataacaggaattattatctttaataatgaggaaaccaaggtttagagaggccaggcaagctgaccaaggcatacttctaa

SEQ ID NO: 476908 - DNA, 541 bp, Homo sapiens
agaaacctttgatgccacattgcccaattgcttgtgatgatcaatagattttgggccctttgtgaagtgaataaacaactacccacaaaagatgttcagatgtgtccagagtttcttccttccagtgggttcgtggtctcgctgacttcaggagcaaagctgcagaccttcacaaaagaaggtagtgtgcttgctgtcctgtttgcctcaagtggacagttggtatctcaagatccttcagattgcataatattcagttcaatagactgtgctcaccaagaaccctcaacccctactatacgaattccttcaaaggatctgaatcttgacatgagcatttgcctggctgggtgggagtggggacattccatagaggagatgcaagaaatcaaaagaaatgagtcttgggagaaggacaagggggacaaggagaaagtttagtgaggccagcaggtgactttacatgctgggacatcttgtaggtatttgggagacactgaaggattttaagcaaagaagtgacactctgacttacgttttt

SEQ ID NO: 476909 - DNA, 636 bp, Homo sapiens
gatgatatttccccaggcatgactggcctcacaaagaaacttcccttgagatatgtgctgtattcacatgcaaactttgatgtgtgcatctcaaccaagcagaggccttgaagcggaaattgagaaactggttctgaaaaacaagaagcacagtctggctggaacagagggaacttggagaggagaagtcacagatgagagtggccatagggtggtgctgggtgaaggagagtttgaaggcaatggtcagaagtttatatttggtccagatgggtttggacattcacttactgagggcagaagcctggacctgctgatttctcatgctcgattccaagctctagattatgacagttctataagaacactggttgacacgcatgaggaggaagcagctgtttcagtggaattccctctggagaggaaggaagggagcttgttagaaatgcagaaactcagaccataccccagacttactaaataagaatctgatttaacaatatttcccaagtgtttcataagtaactaaagtttgagaagcactgtgttagagtttggagcaaactaaataaaataaaactcaaggtgagaaaaagttagagaattataatcccacaggacagaaaacagtgtaaa

SEQ ID NO: 476910 - DNA, 791 bp, Homo sapiens
ttatcatctcactcttgcacgatggcagtagtgtctttttccaaagaagccaaaaagacgctaatggatgaaatgctttgcacatatgggatggaaaattgtgctcggctaagtcaaaaagcagctcctgaagaacgtaatgtggctgcggcttcacaggtgcctgacccgctgccctgcgacagtgctgctctgtgtgtttggccctgctcctccactccagccggcaaagggggaagaatggattcagtcaggcagaaacttctagaaccgcttcgaattgctgcttgtgccaaagaagatctcctccttctcacccttttatccacacacaggagcattgaagaactaaacagctctcatctcaacttcctcccaacctcactcttggctcgtcctcctctgaggagcagctgtttttcagctgatgtttaagctcacacactctaagttaaattactccatttcttaaaaaaaaaaaaaaacaaaaaaaaacggagctcctttttcccagtttgctttaattccccctaaatatcattcctacaggggtgcctcactttacacatttttaactctcctccagaacatatggtttatacacagcagtataaatccaatatttgcaaattgaatcaggattgaaattcaccaagaaaggataccatttaaagaaaccatgtggggaattctttttttctcttttacatttcttttctttctttttattccccttgaagccaagaatcctttgataatgcaaatgattgattcttttcactctttttttc

SEQ ID NO: 476911 - DNA, 704 bp, Homo sapiens
acaggacaagaactcaggatctgccgaatggcaggacaaaaagagctggcctccctgagccagggctgtcacgccctctttgaagttcctggtgtctccaaccttttgggtgccaatgccttcccctcctccagacgcgggtgcctgcagcataagccacgtgccttacatatggtccagctgcagccttgcatggagccagcacctgtgccagggcctggagctgcctgctccactacagcagctgatgtgcctggctgcgtgcagaggctggaccctgtgcttgcttgtccacacacccctcaccactctgcacctggctggcccttggcaggtgtgggatctgggtcagcagcgcaagctgagcacagcctaccaggcggagtgggcagaccaagcccagcaggcatgagcaatattcaggcagaaggtgctgctggccacagaggtttctggctggtgaaaaacagcaccaccaggagcagggactttcgcatatacagtaaaaatgtacagtatcttcaatgcaaaaacaatctccccagatgcatctgatgctcacactagattcagtacttctgaattggctaagctcttgtgtcccattcatctccagcactaggtgttgattgaaaagttctcaaaggttgtgctcaccattcatttgcaccttgactgtgctctgaacattgaaaaaaaaaaaa

SEQ ID NO: 476912 - DNA, 807 bp, Homo sapiens
gcggtgatccctgttctgggacctaactggaagttccagttgtgtaggtgaagggaggggaatgaggaagaagaggttcccagcggaaacagtagcatgtgtggacttgagctgtgtggtccagaagataagtatccttggagcaaacagcggcaaagggaaaactgagatggaaagatggagagatttaggcctgaaatatgaacttacagcaatcagcataagaatgccacggaacctgaaaatcactgtccctggaggagctgagagagcacagttagcaggtgggaagtgcggggagggacaggagtggcaggcagaacacccaccgggaggacactctaaaggaagggatcgtcactgtctaaggctgtggatgcagaccatgctgatagagagaaggatagacatcctccacaggcgagtgtgcaggtgtaaaaggaaagaagctaatgaacttcccgacagaaagtgtctacttttcagcaaagcaggggtacaactttctgcgggacatgaaggcccatgcatggaagtggagcctagaagcttcctgaatgtcttcctgctgcacttttcacctccatttctatccctgctagcaaaagaagagcctaatggtgacatcccatacctaggggagcttttgaggtcacaggcccatggcaggggccatccatttactctcttgaaaatgatcaaagagaacacctacttcactgggttactgtaaagaagatgatgagttcatctctgtaaagcgtttttcacattgtgtggcactccattcactcatttgttcaacac

SEQ ID NO: 476913 - DNA, 631 bp, Homo sapiens
cgggtggtacaggtggctacgttgtcttccccacagagctcctccacaccacttcctggagccattcctagcagaatgtacctagctgtgatggtagacagtggtgttgttaaaatggaagatgaagcatttcaggaagtcacaaaaagcaactggtgttcactgagcatcaatcacattgagcttgacaggcaatgcgtagccatgactcagccatcccctcaaccagaactctccaatactgtgtatcattgcctccattttcatagaggcagtgaccgatggttagagagacacctcaaagaggagatgcaggaggatgagcagtctgcagtgcaggaggttggagacaaagagaaggtgatgtcacagaaacctacgggcacatggtcccttctccaaggtactcattacaccaaagtgagcatgcatgtgaccgagggtgccctggagaggggacattcacttccgaaaagggtgattaccaaaggccacgtgacagaaggagacctttggtttgggctggaaggattgttcaggattttgctggacaaggccaggtggaaggaggatgtgatgagaccctgtttcctggtagttgcccgtgtatgagggggtcattcctacattc

SEQ ID NO: 476914 - DNA, 638 bp, Homo sapiens
ttgacagcatctctgtggtgtattccttaataaaatgaccatacttcatgtcatgaatagtgaaagaattggacatcgtgggtctcctggaagaattgaatatgaagaatacaacctcacctatggactattatcatccagagtgactctgaagaccttcctgtgctcagatacggtacagggagatgcagaggtgcccatggcaccagctggacaggactttctgacttcagagctgaccaacagaggtcatcacccatcccaagatgctggcctatggacacacagaggcagtggcatagtgactggtattgaagacagtgaagaacaaaatagtgacataggattgctgagggacaagccaaccagtagagttgagaagcaacaaaaagggccaccagcaacctggtgtttcaggaaaagcttcctgcaagtgaagatgactgatcccaatctgaaggatgattcagagttaaatgggagaagggaggatagcatgagcagaggcagaaaagtgaccaatagtgtgaagatgtgaataaggattgagacagaaaatataaatcacattccagcattttcatctcagatactcacaagctcagaaaaattactgcaaaatggtactgttttcatac

SEQ ID NO: 476915 - DNA, 1498 bp, Homo sapiens
gagtaactgacaccttctgcatctcgttgaggtgctctgcaaatgcggcaaagacaccactgctctctgaacatggctcgttctaaggggcgtggctttggggtggactcaatgcagattctggggctgcttcttagttctggggctccatggggtctgggaaccatctcattcttgtcagtaccagggggctttggagctgatgaagtggccttgctcttgcttaaagtgggcaagccatttggtgtgattcaaggtccaaggaggaatttgaatattccattattacatgagaattatggtataatgcaaagactgctacaagaggaggggcaaacaagagctaagaaagccaagacctcccgggtgttgtgctttcgcaagaccaatgtttccaggtgtcctgaggagaggctctgtgccaattttgcatccacatcagaactacattatccattgctgtgttctgtagttgtcgcttataatattagtctcacaaaactacatatgtgtctttatttggatcttgcacatctttccaacatggaattctaatcttgactttcatcccaccctgatccagacctataaagaatgctgcaagagaactttacagtgagtgcacatctgaccagactttttcgtatctcatacctagatctcttacttttgagttctgcctactattgagacaccctcccaaataagacattttctttctcacttggatgaagatttcccattaggcaagaccaccctcggcatccttttcaaattactgtgacatatttctttacccaatggaaccaatggtgccggggggaatgagttccttatcctcaaatgcacaaaatgtacaagcacagaatcatctttagttatgcaggatgaaagaaacttatgagcttattctatgttctttctctgtttacctgtcagggctggaaggtaataaaaggtttgagtgtcctgtggcatctaattacctctcttcttcaagagtccatccctgaaactctctccttgcaggatgagtctttcctgttaggaatgctgctgacgagataaagagatggctgtttgccctatggcctcttagaataggtgctggagaggagcatgtgagcctttcccatgaagctgacctacctatagattaatattgcagattagctctaggctttacctagtcttctaggaacatctgggttgacctaaatataaagggccagaccgtggagaactctaaccggccccctgtttgtttgcccatcctaacatgttttcttagacatagataataatttttgagttttaaaaattatatgcgaatgatatacctgtgtacttacatagatcatcagaaaataagatgtcttcactttttattgctagcaagagctggaagaaaaatataatcaaattctcctgcaatttctgacgttacatggagatccaacagaaagaagccagcaactatagtgtagaaaggattctg

SEQ ID NO: 476916 - DNA, 879 bp, Homo sapiens
ggcatactaacaaaagtggaaagaaccatcttgggaaaccatccaggtcccattgccttttcttgctcatgaataactcacagtgtggaaatgcttccatatgctacaagttgttctcatcatttgctgaagggaaaacaaaaagaagagaactgtagtcaagtttgtgacttgcagaaagcacgaagctacagcaagtgcacacttagtggcagccttcggtgggtccaacaccagccacttggagcctcactccctgccaaagtctggctcaggctttggtgttctatatgttttgtttctattacaaataagacttccatactaccaattacattactcattggtccaggaattggagagaaacctatagactggccagcagcctatgaggaggcaagcattggaagagcctttgagtcagcggagtggctttggaaccactatactacggttggaactgttgagcaaaatggccatcatggccccatctcccaatatggtagtgagaggtgaagccggctgggcttctgggtcggatagggacttcaagaactcttctgtctagctaacgaattgtaaacgcagcagtcagccctctgtaaaaacgcaccaatcagcactctgtgtctagctaaaggtttgtaaatgcaccaatcagcactctgtaaaagcagaccaatcagcactctgtaaaatggaccaatcagcaggaagtgggcgggaccaaataagggaataaaagcttgccaccagagcacgtgtggcaatccgctggggtcaccttccatgttgtggaagctttattcttttgctcttcgcaataaatcttgctgctgctcaccctttgggtccacactacctttatgagctgtaaca

SEQ ID NO: 476917 - DNA, 524 bp, Homo sapiens
ggtacagacctgctggagccagaaaaggaaaacaaataaacagaaagtctctctcttcagagcagatgactttcaagctacctcgtgagctgacctcaggagtaataatgatgacagttggatactctgcccctactagttttgttatggtacagacactcactctcttccctcttcctgccactgtggctatgaaaccaagtgtggctggagcctggtcagcctgggcctgcctggcagtgatgggcagagttcttcctttacctatgatgggtggacagcaggaggcttctggctcccaggagctgtccctcttcctgcatattgtgggccttctttcctgcaattcagtcctgtgcagtccctgtcagggtgagggaaaagaacgaacaacaacacaaactttcactgaacacttactgggtgctgaatatgctcggcattttatatcgacaatctcaagtcctcttttccagatgagaactttgaagctacaaggaatgaatacattgaacatctagtta

SEQ ID NO: 476918 - DNA, 647 bp, Homo sapiens
aaaggaagaccgtgaccacagaggtgggatgctggggagaactggggccaagaagcaggacttgccatcaccagctcttcaccaagtaaggagggaactgtatgtggaattccccgtacctcgacttcccaccctgccgcggctctgtggggctcagctcacacttccctcttgctcctggtttcccttctcctacttgagacttcccagcctgtggctgagaagtggcctggcaagtctgctaacccgactagaaggagcactgcagtgccgaagagctggccagcctcaccctggggccctccgtttggaaccgaggcttgctgttaacttcaggaagcatttagcatgcctggataggagaatgtgcatggatggattggctttgctctcttcctgcgccgcttcggcctttgtcctcctaccccatctaaagaaagaccctctagtcactccaattggaagaagctaaaacctgatcacatccctacctttgaaaaagatccagttttagaatgcatgcttctacgccagcggtagaagggacatctcagcagttacctcccttctgtatgcctgttcctgaactattgaaataaaaactccaaatacgcatttggtcatacgtgggacatggtgcaaccgtc

SEQ ID NO: 476919 - DNA, 756 bp, Homo sapiens
gacccataccctatactcagatccttgcctgctcttctggaaactcgctcacagcgggcatgaggaggagctctgagatcagagggagaggttaacatgaatgataacaggaaaaatgatcaccttccagaaaaaactacagcaaagccagtcaagaccaggtgaactggagccttcacaaaaggctgtactggtttatgctggactgggccttcccattcttatcccatttgcagaagatctcagtgatggcgatagtggaaggaaagtatttagtccatccaccttgctgtcaagtcagtgtggaagctccctggcccttaagattcagctcagtgttgacaacaaagcctgtaatcacagtattacagtacagcctgtaatcacagaatcacaggaaggtagatgtagcatctggtcaggagccctagctctggctccttgtacaaggagtttctctttgcaaactattctacagtcactccaactccatctgaactgcgtgagcaacacagtggcaatgcagaataaaatgagctcgtcctaggccatacagtatccacatgaactattgcgctctgccattgtatcacaaaagcagtcatagagcatacacgaaagaatgggaggggctgtgttcctgtaatctctaccgatggacactacaatttgaatttcatatagttttcataatttttatgtgtcacaaaatgttattccttatctgattttttcccctcaaccattaaaaaatat

SEQ ID NO: 476920 - DNA, 1043 bp, Homo sapiens
gttcttaagcatgaagtctctggagccagactgcttaggtttgaatcccagtttctcctcttcccactctgtgtcttttgggagtgggcaggaagctccgcccatgaaacagatctgcttctccattgaactggaacctctaaacaaatgtaaaaagggaatgccgataactcgtggagcactgaatggatctgatgagcataaatatgtgtgtcagaaatcagtgcctcggcaagcccaactagaagcaattccccttacccacaaaacagatcttttgctggaggtgttaaaaagtggattaaaccacctgctaagtggactatccagggaagatcttcaagagattcagcaggggcctcgggaggtgtccacaacacagtccctgaatcaaccagcaagccaaccaaccaaccaaccgaacctaccaaccaaccaaccgaccaaaaaaccaacctcagctttcaattccaaatgcaacatttctcttaaccagtgcctaaaaggctgaagctttgctcaagctttgcttgaacaccgaatttgaatgacatactatctgtctttactaaatatctctcagagtcctgtgactatctgaattaaaatgtcagcaaagtcatccactacttctaggtcaaggcaaagccagagatatgtgaacctccagatatatgatttagaatattttgtttcattctgtgggttatttagctttgtaatgtcctttaaagcacgaaagtctttaattttgatgaagtccagtttatcatttttttcatgttgcttgtgcttttgttgtcatgtctaagaagggaaatctgccgggtctcagacctgttctaagaatttctccattcagtgttgaactcatttttggaagattgtgtgatttaatttttatcactgttaacatcataatgcactttatttatttaatttttcagacttcctttgttgctactgtagaaaaatggtggaagaaaaacatctgaaaagcctcttctccataaaagcaatgagaacgctggaaaaacatggtc

SEQ ID NO: 476921 - DNA, 1302 bp, Homo sapiens
gcctgttacccagttccaaagtcgcttccacattttcagatagggacgtttatgtctgcagaagttgtctgctgccttttgttcagctatgccctgcccacagaggtggagtctagagaggcggtaggccttgctgagctgtggtcaatctcagactgcttcactagcagtgagcaaggatccatgggcatgggacccaccgagcccggcgagggagggaatctcctggcctaccagttgctaagaccatgggaaaagtgcagtatttggacggaagtgtaccattgctccagagctgttcctatttggccatcttggaagcgactccaaaacttccattttttaaaccatgagatctcatgggactcattcactggcgtgagaatagcacaggaaagacccacccccatgactcaaacatctccaatgggtccctccctcaacacatgggaattatgggagctacaagatgagatttaggtaaattttgaaataacattttaaaatttcactaagattttgattagaaaggcattactcatttatactgtaatttagggactggcagcattttagctgttaggaacaaggctaatgtatttagaaaagtctgtattcaggacttagttatttttatttacttgtctttatattttttattagctactcttacatattttagttattttctatctttgaatcaaaccccctcacttttaaaagtatataaacgtattttaaatttcagaaaaattttaaataaaaagttatcaatgattctgtgctatgaggctgtggaaaaaactataactgagaaaggtttgggaagatttgaaaaatgaagtcctctaaaataataaatgactccaatgagacatctgtttgaataggcaactggctagcagcctgcagtgtattctcccttgatgggtccctaaaatatctatgaagacacaggaaagctaagacagtcagctgacctaatgttagattctgagaggaattgacactaattacatgtcagatgacacaggactgagaaaaaggcaagcagggcttatctcatggaaaatcttggctttgtttaatgaagcggaaactgtctgagcaaagagtggagggtgctttgcatctcctccaccatgcataccaggaagcaaggatttagggcttgtgctaaaaagggaaatggtgcattcattcttctgcctctaagatgctgattgcggggttgacaagcatgctatctgccccgttgcttctttctctctcatctttgtttatctactcattcaaagacct

SEQ ID NO: 476922 - DNA, 954 bp, Homo sapiens
taacgtaactacttcagaagtgggcaatagtaagctttggacaaaatcaactacttggcttgaatcttaagggagtcagcagtctccctgagatggagcagcccctctggtgtagaccaggtgcatttagcctgaagacacattgtacttgcaagctcgctaagaagataagtaaccccattaagcccatgcagattcccaatgactcctttactactcagagatctgtgcctacgctggtggttaattcagctatgcgaagtgagaagtccacatgtcagtggacctcagaatcattagttcggtgccttatttacagtaaggatgaaagaggggtcacattaggcccaagctctatctcttgtcagattggacactgtcctctaggttgtagtacatgcagtaaaccaatggctgatctaaggtgctataatcctattagaacacaggagctcaggaacctagaggtggaagtgggattggctccccaacttgcaggatattatattgctagattagatattctggatgcccagcctgatgagaccctccagtgtcctcagggctggggctgcggcacctttcccagtggcttgtgatttcatgtttaattatctattttcttcacactctgtcttagatttaagtctttgattcatcttgagttgattcttgtataaggtgagagatgaggatccagttttattcttctacttttggctcgtcaattatactagcaccatttgttgaataaggtgtcctttccccactttatgtttttgcttgctttgccaaagatccattggctgttgatgttcatttagcctttgaagttgctgttctttggatgtggcttttgcttttatgttctttgatgctcttgagagtttctctgtgatataagttggctttagtcgactggtttcacttctggatgatttcaggggccaagga

SEQ ID NO: 476923 - DNA, 559 bp, Homo sapiens
agagtacttccaagcttctaaacctatcgggccttggagagcgtggtgaagcgctatgagaatatggctcagtgcatctgcggtcaggaccaggcctgtgtctctctggaggccggcacacatgtgtcctgggagagcagtgctgtggattctgcagggtgggaggaaggctgggggcacaggccatttgccaaaagatgagacacatcagaaaaatgccttcaaatacagcaagattttgggctggggacccataggtcatcaatctagcattttctgtcaacatactgtggcacagcctctaattggggaaaaagtatgctcaacacatggtgcatggccacctgggaaagagacagttgtcatggagcctgcagcccatcagggcagaacactcagcttccctgaaaatggactgactgtggaagatccatcctcccccaatgtgggtgggtaccacctaatcggctgaggatccagatagaagaaaaagacagaaggaaggtgaattctctcccttctggaactgggatacccatcttctctcattcttggacat

SEQ ID NO: 476924 - DNA, 1021 bp, Homo sapiens
gccaccagcatcaaagaacaaaggcagataaatccaggaagatggggagaaaccagcgcaaaaagggtgaaaattccaaaaaccagaatgctgcttctcctccaaaggatcacaactcctcaccagcaggggaacataacctgatggagaatgagtttgacaaattgacagaagtaggcttcagaaggtgggtaataacaaactcctccgagctaaaggaacatgttctaacccaatgcaaggaagctgaaaaacagcacgagaactttgtgaagcatacacaactatcaatagccgaactgatcagcggaagaaagagaatcctaagcaaaaagaacacagctggaggcatcacgctacctgacttcaaactatactacaaggctacacttaagaagctgagtagctgtttggcggtccaaggcctgggtgaactggttaatcgccggaggcgctttcagccacttacagaggatggctctctggtgctgcaacctgatacaatggggccatttcataaagtccctcagctgcaggtctgttggagtgagctgcagacactctttgcctgggtatcaccagcagaggatgcagaacagcaaatattgcagaacagcaaatattgctgcctgatccttcctctggaagctttgtcccagaggggcagccacctatatgaggtgtctgttggcccctactgggaggtgtctcccaactgctgcactagcagtgagcaaggctccatgggcgtggcagacaccgagccaggcacaggagagaatcaccttgtctgccagttgctaagaccttgagaaaagcacagtatttgggcagcagtgtcctgtttttccagtttatgtgtccttaaaactgatatcaattccttgaatgcagcatatagttgggtcttgctgtttgtctattcagtcattatgactttttattggataattttatctatttacattcaagataattattgatagaatctcaggattcagctcaagcttttttccttttt

SEQ ID NO: 476925 - DNA, 1093 bp, Homo sapiens
gcggcagagtgctgccagccttgcaacccctgtgaacagcgttccccaatacaccagcagcaaacaaagcctcagcagacttctctgccatccaccgaaccatggctgtgctctttctaatgggggacggatctctggaaggagtctttcccagatctgtctcttctttaaatgctatatacttccctgtctgtcccagactatggaggactccctcccttctggaaggctctcaaggaaacacaaagtaccagagcacgttcctggtgcagaagatgcaacagaaagtgggatctggatttgaacttgctactgagttttgtaaactaaaacaacccaaaagctactctgtaattcctgcttctaaactcagcactggccacttttggctttcaggggaagatcagaacagaagaaatgaattccctgtcaagaactgtgaaggctctgagattccactctacttgcaggctaataagtcagccatatacaattttatgtatgctgacagaacacatgagactcctgggtcagagactgaggagatacatcttcagagatagtttattactcaaatcatagcagtaaacagagtatcagcattatttgtgctggtttccaagatccaatttccgcaaagtgatgcaaagaggaccagatgacatctgcacatgttgtgttgcaggagagaaaccttgaggtagggaacccaaatctttaataatgtgcaaattctgtttcaactaagactctatgagggttgaagaagccatttcttttcttcccctacactttctattgaaatatacacatggaaaactgctcaagatataatttcacacttgatgaattttcatgatgggaatagacccatgtaaccagcatccagataataaaatgggtaattaccagcatctgaaagcctccttatacccttctcatttatttacaccgtcattcctcaaagggaaattatttagactctgtatgtcacagttgatgcatctgtaaagcagacataataatagtatctctcatagggttgctggtgctattaaatgtgacaaagtatatgaattgcctagcaaagtgt

SEQ ID NO: 476926 - DNA, 2097 bp, Homo sapiens
gccatgacttcagacgggcagtgtggaagggaaatatggggttggagcccccacacagagtccctactgaggcaccacctagtggagctgtgagaagaggaccactgtcctccagaccccagaatggtagatccaccgacagcttgcactgtgcacctgggaaagctgcagacactcaactccagtccatgaaagcagctgggagggaggatgtactctgcaaagccacaggggctgagctgtccaagaccatgggaacccacctcttgcatcagcataacctgaatgtgagacatggagtcaaaggagatcattttggaactttaagatttgactaccctgctggattttggacttgcatgcagcctgtagcccttttgttttggccaatttctctcatttggaatggctgtgtttacctaatgcctgtacccacattgtatctaggaagtaactaacctgcttttgattttacatgctcatagtggaagaggctttccttgtctcagatgagactttgaactgtggacttttgagttaatgctggaatgagttaagactttgggggactgttgggaaggcatgattttgaaatggtcaattttttatggtatactttgctcagaaagtctattgtgtctaaattttccagtttatttgcttaatgtttttcatactattatatcattatttgatgatataataatgtatctgtgtatctgtgattatttacctttttaacatccaataatgcatggtttaatcttcttttgtcttcattaattttcccagttttgatgatgatttattcttttaatgaaccagttgttggctacattattcttggacctttatgattgttcttaatttccttttgttgtcattatctttattaaattcacatttttgcttttatttttcagatgttaatttaactacatcaaacttttgcggttagtgtgtacctgatttatcctttcttattctataaaacaaaacaaagcaaacaaacaacaaacaaaaaccttagtctttatattttgggatttttgttcttacaatatgtgaatttcctacagaaatctattgatttctgtttaccatggatttgtttttactttttttacctttccaaaatttatccagactaaccaagtctttacctttcccattgccccgttagtgggtagtatcatagattctatttttagtttttagtgattactcttaaaatttttttgtagagttaccttagagtctaaacattattaatatatttactctcattcaaaaacatataaggaccttagagctttaacttagatcattcccttgactattatgtcattatttattgtttagtatttaattctaccctgcttgatattcctataattagtcatccttattatggctgttttattctattgatgcttattttactcacagatatactaatttattttctaaacattctcccttgcattttaatatttattttagaaacttttattttttctttctaaaatacatacttgagtttttcctttattaaaggcatacagttgataaatgttttgttttattttgtctgaaagtatccttattttgcctttattctataataatgttttagctgaatatagagttttaacttaaattttatgttctgattgctacttttgtgatcaatctcctacaatggtaagacattagaaatatttcatttcaaatcagagggatacttgctgcacaacttctattcaacattttttatctactatcataagaactaaaagatttaagaattgggaaaaaaggtgtcccaactttattactcataaatgatacaattgcttatatagtacatctaagaatttatagaagaaaatgctaaaaaaagtaaaaatgcaataaacatgatagatattagattaatgtgtgagagtaaattacatctctatatctaagaaataaaacatttgacacatttgctgttgttgtttttactctcaagtaataataacttttatcaccccaataaaatgagttatcttattatatatctgttggcagtatgtctttgtcttccaaaac

SEQ ID NO: 476927 - DNA, 702 bp, Homo sapiens
tgggagaagcatgggtttccagggtcgcacattcactcaccacttccctaggggcaggggaggttcccctggctccgtattgctcctggtgcctctctcctcctgctccctcctgcaccctcctgccctatggtgtgcttttccttctaacacccagcttttaacccctaactgctgccaggctgctggagcaaatttgctgttaaacagagacctggaaggagtggttctaaagacagaaaagtttgacagtggggatggggaaaggaaaggtgttgctggaggaattggcaagggagcaaatgagtcagaatttaggatggtactgtggagggaagacctggggagatcaagggaatcatgtgggagttggagaggagaagagaaggcaggagatggaagagagtgtgtaggcttagtgaatgtcaatgaaagaaacaacacatcacatattcctatctacattgaagattcctcagagttcacatatcacagctgtggagtgtgttacaaacattttccagagctctagcgtcccagtggttgtggaatttaggcctctccaaggcacattacagccttctcacacttaggaacattagacagcacttcagcaccatgcatggtcgggggtgggggtcattttaatgagcaaaatcatctataaaaatggaaaacaaaccatggcactaaatagatcac

SEQ ID NO: 476928 - DNA, 839 bp, Homo sapiens
gtgtttatgagctgtaacactcatgtcaaaggtctgcagcttggctcctgaagccagcaagacgacgaaccagatgggaggaaggaacaactccagatgtgctgcctttaagagctgtaacactcatcgagagattttagctccagagaaggatgtagcagtaatggttgattgttctttgcaggcactggcaagatacattctggaatacagacaacaaatgatgcagtccaaatggaaggaatcatcaaaaagcttggagaagtttgttactactgaccttctgaagcctacttctgtcaagtcgttgaagtcattctccatccagctttgttccattgctgacatcaaggataccatcttcacaagtgaggatggatacataaaaaatgctgctttctgtgtcaaagatcaacacattttgtttgacagcaaccatcctgatcaagccttaagcagtagcagtggcatttgggtaactggcaatacagagaccatatctagaaaagttaaagagaagaatacccctgacacagtacctccactgctgagaatatatcctagagaaactcttatccagaggatgtttgttttctatttaccaaatgcagtatcctatatatatgagacaaaccaatttttctattccacgtattcatcaaattggtgaacatttccctctcagttggcaaatttgattttaatctgataagcttgatttcagaatctgcagtgttcatctcatcaaatctgccaataggatggaaacattgcagccaagcaatgaataattattaatcattttgtgtgaagttttgggaaaagtaacctaagcttat

SEQ ID NO: 476929 - DNA, 759 bp, Homo sapiens
cggcagaccaaaggaagcagcttctgcgggtttttggagtggccacactgccagtgttacacaatgtctgatggatttggatacatcacaatatctctgagtctcagtttcattcctggctatcctctgtttaatccaggatggcatcagcctgccaagaaagattctaaggctgttctgggcttggcagccatcttttgggactcccagatgcctgtcataggaatgaggcctgcaggtattctcacctcttctgtaagcggctttcacatcctcattatagttccctacctattgccccttggccagcccctccatttcagtagaagccagtatgtaacaacactttcacacaaaatggcctgccagaagtccagaggcgggaacctcggtgagctgcttttcaaaggtctccgacccttaaatgaaacctctttggtgcttttagggattctgttgttggagccacaaggacccttaagaaaaatacttggagccagctggtccctgccatcattgaaacccaaagggaggagctccacggcctaaacacccagatttagttctcagtaagagctatcttcagtgcagtttaagagagtaattgttgtaattgcataattatgtatattttgataagtttgcaataaagtatttatgaaatgtactaattcattcattaagccattcaacaaccacttgttgaatatggataaaaccacacattcttgtttaaagaagcttataattttgtgtgtg

SEQ ID NO: 476930 - DNA, 832 bp, Homo sapiens
tctttttccatcactttcattttaaatgaaacaattcaaatctgtagaaaagttgacagagtatgccccttactttaatgcttcagttgttaacagtttgccacatctgctatatctatctatctatgtgcaccacctgaaaggatgtgaagcatttcccaataatatcccacagaaacttcaacttaccaagtttgtggtaaatttcaggatattaagacaccctgaaatgggtcactgttcttggataccagattctaagctacccattgcaaaatgtcttgttaaagccatggtgaccactgtctctgtgtccttgtcaaactttttgtcccctaacggcatcctctccttcaaatattgtgcagcagatctagggtcccaggtgagtggacctccgtaagcagatcacaaggtgactaatgaaacaccaagtcatataattatgacttaatggatactttctgttgttgctgatgatgaaatgtcctttcatattcagactgtatcttcctgtaaatcaggtacagaaaattcattgccttcaggcacaggtcttccttcccaaaatagttcaaagtgtacatctcttttccaaaattatgtaaatcttaatttgtaataaaatcacatgaatgagttgtgggaaattaaagtttgaaagacaacatgattggcaacctgtatagtaatttttatttctgttttccaaataaaagaaattagaagactgtacctttttattctctgccctctgacactgatcttttctttcttctgttgcaaattaacttctcgcccactctatcccctcccgtactgttttaactaa

SEQ ID NO: 476931 - DNA, 747 bp, Homo sapiens
agccaaggacaccttctgcagagcccagactgagctggagccttcctgtctccttggtgaaaactctcccgcggcagactcagcgttgcattatgtacgcatgcacgctgccatcaggggtgtcggtggagcaggggcggggtgcttctctggtttatactgcagtagggagggaaggcttgggcaccagccaaaccttctttcagcctcagaggaaacctccaccaaggagtcaaaggaaagagctttcaatggccaagctggaacaatttgtgcaacgacaacaactaaaagaaataacattggactatcactcaaaatataaaataaatatttatgagtctatactgatgcatgagtttttttcaccccttcactggacatgcggcaggggcaccacgtctacttggcccactgtgctcagccccatgtggagggagcttgtgagtgggcgagtgcgggatccagatggctgctctgggtgccaacacagaagcaagctccatgtggggcctgcagtcagaccaggtgtgttgcctcaaagggaacgtggtggcacccaggtgagggtgcctatgaccctgaaggcccagagcaggtgtcacagtgctgtttaattccatcatctgcagtctgatggacggcagtgtgttagcagctcagctggccccttgcctcattgtgtggggtgactgccctctgccagagagggcaaagggccagtgtgacaaccttttcagggtaccc

SEQ ID NO: 476932 - DNA, 1868 bp, Homo sapiens
tcagacttatacctgagaatagatggctcttttctctatagttgcttcctggatcccctttgaaaagatctcttccacagcttcaggcttcctgaccgctggaacacagctgcaaagctgcactcttgaactcacggctctagtagcagtctcaggaagagtacctccccagggtgtcagatccatacgttcttggacctttaaagcaacccaagcctttaatgttgcactaacaggattgtctgccacaggaagggcacactctccagcacccccccggagtgctacccctattgtgaactgtgcatgcgagggatgtaggttgcaagttccttatgagaatctaatgcctgatgatctgtcactgtctcccatcaccccagatggaactaagtgtgatactcataagtgtatggttttaaaagatctgaacaagaagttgcttttagcagtcaaaaatttcactttgtcccctgctaattctattctacctactccacataaatttatccaaatgtagtatcattctatgcttaaaaatcttttatagatcaccacatcatatgatctgcacaattgtgtatatacattgaacactttttactttatgtgctcataatgctctaattaacattttctgccattacaattgctaatacacagttgatcaaaacagatcaacatgctgacacttttgatagaaaattattaaacataaaagaaaatttttgttgggagtgcatctctttatgagatgaatgtgctttgtttttaaaattagttcatatgtctatccatgaatagtatttattaataatatgaaaatgatttgacatcatttttgttttcattttataaatgtaagggctaagaaatcttgcttatgtgaataaatggggacagaaaaggtttgctgaaacaaaaatcagtcaatcctttcaactcgttctaaattttatgtcaaaaatcacctagcgatctatcataacattatttttcatgttctagcaaatgacagcttgattaagcttgtcttcaattttgttagatgaaaagagttggaaaccacctggcttgcaaagaggtttttatccaggtatcagggttttctccaagaaaggcttgccaagacttatcaaatggttattaaatatatatgttatttttggctcaaaggcattttctaaagtaagagatattcaaaggggttgggaaaataaaatttctttcttttaatgtaccttagccaattcagaatttttaataaaattatttttatcttctcacatgttttcaatatattttatgtcaaaactttgatgacctaagacaacagatttagctcactgaatctgtggaaaatgtttgccatccaacctgattggcaaaggcaacgttaggcttacattcttcagaaggacttcagtttccattcaaataaatatgttgatatggattttaaggaacattgcaaaaaccattaaatttaaatttaataaattaaatttattaaattatgaagaacatttcataaagtagattgctaaaagtcataaagtcattatgtagagattcccttagtctcagagtataaagtgggaataataaaaacagtatcattattaatacatacctcattggatgatgtaaagattaaataagataatgtttgtgcattgaaagtacatgttttaaaagagctgtaggcttccatggctagatggtctgttagagtcagaaatctgaacactgtccttttattcacacagcatgcttggagaggttttaagaattccagccccacaacagatgcttgcaataccttttggtggctactctagcaatagagtatgaattatctacatctc

SEQ ID NO: 476933 - DNA, 536 bp, Homo sapiens
actctcgcttcatcggttatgaagctgctgatggaaggattccatggaaaagcagcagagctgcagagtggacagggagaaatcagagctataattaactttgtatttcattgtgttctacagcaggagaaatgcctgctgcctctccagttggctttggaatccaagaatgtgaagctggcccaacatgctttggcagggatgcagaagcttctgtcggaagagaggtttgtatccatggaaacagattctgatgagaagcagctgctcaatcagatactgaatgccgtgaaagtgacgccttcgctcaacgaggacctgcaggtggaagtgatgaaggttggtttgacgtggccaagagtgtgcgtcactgggacaggaacacatcctgatcccctgcacttgttatctgaaaatgcctctgcgttgtggtcatgctagctcatcttcatttggaacggatgcttgttattcttgctcatggtccccctaaattaccctgatggtttaacatcaaaagggacaatttcaatcaa

SEQ ID NO: 476934 - DNA, 723 bp, Homo sapiens
catacacataggattacaagcaaactccaacagacctgcagctgagggtcctgactgttagaaggaaaaataacaaacagaaaggacgttcacaccaaaaccccatctgtatgtcaccatcatcaaagaccaaaggtagataaaatctcaaagatggggagaaaccagagcagaaaagctgaaaattctaaaaatcagagtgcctcttctcctccaaaagaacgctgttcctcaccagcaacggaacaaagctggatggagaatgactttgacgagttgagacaagaaggcttcagacgatcagtaataatgaacttctctgagctgaaggaggatgttcaaacctattgcaaagaagctaaaaaccttgaaaaaagattagatgaatggctaaccagaataaacagcgtagagaagaccttaaatgacctgatggagctgaaaaccatggcacgagaactacgtgacacatgcacaagcttcagtagccgattcaatcaagtggaagaaagggtatcagtgattgaagatcaaatgaatgaaatgaagaaatatggagaacgccacaaagatactcctcgagaagagcaactccaagacacataattgtcagattcaccaaggttgaaatgaaggaaaaaatattaagggcagccagagagaaaggttgggttacccacaaagggaagcccatcagactaatagcatatctttcagcagaag

SEQ ID NO: 476935 - DNA, 1095 bp, Homo sapiens
tgatcggcccccagcattcagctcctcagaccacacaagtgtctttttaaatcttttttttttttttttctgagtaaagcatggcctctgcagaacagtggtgtatgcttgcaggctttagtctacctggaccaaagctgaacccaagaggctctggaggagcaactggatggaaagagcgagtcccagaggtccatcctggaaggaaggaactggtgaatattcagggagatttgaatggagacttagaaagcctgagaaagttagagctgggattcaatgtctttggacacggttatcctttccacttggataacccatcgcaagcagcaagaagtgaaagatttcacagcgacttcctggagggccatatcatgataaccatccagacccttgctagactggccttctgccaaaggaaaggaaagcaggagattcctgaaggccaaagaacgcccgccaggaactgggcttttgagaagccgagaggtcagatcagcctatcctcacattattcagtgacgtcagcaacaattcactggggatttttccaaggttacaagcttcctatgatccctgtcttggagaccttgaaggcagcttttgaccttggcagccacgtagtggtggaaagtattggagggatcagtgtcaaggctttgcgtttggcttgtggtagcaaaaatcaaatagggtccaccgggtctcccagccaaggcagcttggaaggaaagagcccagaacaaaaacagtaaggttctgacatatttaaagtacaggatgttcaggcaagggagtgaaagtacattaggtttgttttcaattcataaatcatctagttccaaaagataattctgtacgttttggttagtttaagaaagacaaatgcttgactatgggcagcatataatcttttggaaaaaaacgtttcatttgattgttcccaggctttcagttgagaattttccaaggtgaagtcaccttcttgctgtggtctgcagctgtagaaagtctgaagttagagtctttgaccaaactcattatttttcctgccaatgatcctttagaggatttaacaaaacttcaaatttcact

SEQ ID NO: 476936 - DNA, 840 bp, Homo sapiens
aacctaactgcttgtagctcatgccatggaagtgacaagggttgtcatgacaaaacaaacaggctttgctggctggcagaggcttttgtacacgagtaaacgggacatcaactggattttcctgctgagctttccgggcagactcagtgactttgccagctctggcaggcttcttgggcactgcttcgatgatacccacagcaactgtgtgtctcacatcatgaacagcaaaacaactcggaggagaatagtcagagaagctctcagcacacgtgagcttgctaggaaccacatcagcgatggcgcattagctgagttcaagaatttggggccatcttccagcttcttaccagaacagcaatcagtctcctttaagctcagcaaacctgagatcgtgccactgcactccagcctgggtgacagagcaagactctgtctcaaaaaaaaaaaatggtttttactgtagatttttgtaaatagcctttatcagataaagaaaattcttttctagttccagtctcctaagagtttctatgatgaatcgatggtgcattattttaagagcctggaagacacagggcttgtactcataaagatctatgaaagtaaaacagaggcctgtgattcttgaatctacatttatgagtaaaatgagcctatagctttttactctgataatgtcttttcctggtttggtaacaaagttatgctaacctttaaaaaggactgggatgtattcccctttatagtacagcaataaatatgtatttgtgtattacatatatgttacttccagtgttcatgttgacaatattgttatcaatttgattcttgtcccat

SEQ ID NO: 476937 - DNA, 488 bp, Homo sapiens
aatcagaggtaacacctgccattaacaatgaatggaagccatctgaaagtgccccctgccaggcatcaggcagaacaccacttaagtgtcattgtctccgagtgctacacactacagattcacacattgctgtttgcctctggggaaattgatggaaagggtaggagatctgcagagacagaagccatatcccagcaagaagcaccaagactcatgaataataaggcagcccatttcctggactttacagccttccttgcccgatgtgctccctcgcccacagccctttggcctgctgacgggaatctggattctcttctcccaaactgtgaatgtgagattgctccagatggcaaagctgaatcaacagaccccagcaggaaggttgggtttatttcacagcagatgaaacctcaagcccgataactctatggttcttgcagactcatagagagtctttctctcttgcgtgtatgtgcagacttggc

SEQ ID NO: 476938 - DNA, 914 bp, Homo sapiens
cctgagcgagactgggcgagaggcagggagagaatatatgaaggcacatcaatggaagacttgcagaaaatgatggttgtggctcttatatacagattattagtttgtttctatgagataatttgcatttggggagcaggtggagctaccccagggaagttcctgctggggcttcgagttgtgacatcagtgcttattgcactaagttgggttttagtgattccttcctcaaatgttagtattacaacgtccactatacgagctttgatcaagaattttttgattgcttcttttttcactgctttcatcacactgctgttttttcagcataatcgaaaaacctatgacattgtagcaggaaccattgtggtaaaaagaaatgggttcacacttcctggggagccaccaaagaaggtccacacaggagttaggggacccttaccctcaggaacagttgatctattacgtggaaggtctagtctaaatttaaaaggtgtcactgtacatatgagaataattgactgtgattataccggagaaattcaattagttattagttcctcgactccatggtctgcctccccaggagaaagaattgctcagttgttgctgttaccttacctaaaactaggaagcagcacagtgaaaagaacaggaggctttggtaatactaatccagcaggaaaggctgtgtattgggttaatcaggtgtcggacaaaagacctatttgcacagtagctattcagggaaaagattttgaaggactagtagatactgaagctgatgtctctattattgctataaatcaatggccccagcactggcctaagcaaaaggcatccattggtattgttggagtaggagctgcctaggaagtttttcagagttccttgattttaccatgttaagggcc

SEQ ID NO: 476939 - DNA, 612 bp, Homo sapiens
caataaggccaattcaaattctgaaatgtttgtttcaccagaatgatatttactagtacagtaaacagaactacaaaacaactatgtcaaatagtgcaaacaacaatcaagatttcaaaattgcctaaggtggaagtaagagggagcttattaaacacctgcatcattgggtatttaaggagtggagattcagactgtccttggattaatgtagaaagtgaagtgtatcagagaccatctatgtggttcacctgcctcgctgcattcggttttgcttgtacaacagagcatgtgctgcatgaagcagcaagatggctgctcagttccgcaggctggatacagcagaaagatgaagagttcaagctgtatgacctgtgggtcccttacagccctaagctctacactgtattgcctgtgggtatgccacattagaaaaataaatatcaggctcatctcaggaccctatttactctctgacatcagtgccttttttgggaccacagtgtttctactgagagtggctttaactaacctgacttgaggaaaaagatcttcttcccatgattgtgcctctgaatagccactgcatctaacctgagcaacacagaaaga

SEQ ID NO: 476940 - DNA, 553 bp, Homo sapiens
gttacccagttccaaagtcacttccacattttcagggtcatggaggggcagggctaccagatcctggacacagcattatcgtttccagaccccctgaagcgactggccattgccattgctgttgtactaccagccaggacaggaggcagcctctatgtgcaggagataaacagcaagagattgaagtcggaatgtctgccaagatggctcctgaaatggcatttgcctccttctgtaaacagtgctaggtattttgtacatagtggggaagacccaccttccatgcgggccggcaccatccaatctgctgggggcccagaaagaacaaaacagggaaaggttctctggcctttggatttcaggacttataccagtgacccccacaaccctcaggttctcaggcctttggccttggacagaaagttacactatcagcttcttatttttgaggcctttgaacttggactgagccatattatcagagtctggagactctgagcatcccagagtctccagattgcagatggcctgcagttggacttacactccataa

SEQ ID NO: 476941 - DNA, 618 bp, Homo sapiens
gacagctcggagctgtaatgatgtgtcacccagagagagcagagaggttgccacagaccccctcccaggctctgaagcagcagcagacacacgctgcaggaagcctgccctgccagggcctggcagagccagaccaagccagcctgagagcagccggccaagaggccacctgtccattatcaacatgataacggtgagcttaacccttagtgttcaggtggccattcaggttccctccctctttaccatctatcatcgaaagtctccacaaaaatgcagacagaagtgcaaaatcaccacagcattgaaagcccgaatatttgtcaatgagttaggatttaacaactgccgctgtgcatcctcatttgacagagatggaaccttcaccaagcaaggaagggaaagagctcctcagaccctcagagctgctttctctgaggggactccaatttccatgatttcaacaactctgggctggataggcaagacagtgactcactgcattttgaaatatgaaactagtgttaagaagagacaaagcctttcagagccactggagcaatgcactctagaagtttgttttgcacccactgtttttgacaagtaaagaaatacaga

SEQ ID NO: 476942 - DNA, 588 bp, Homo sapiens
ggagtcttgctctgttttccacatggctggggacgcctcacaatcatgacagagggcaaggaggagcaagtcacatcttacatggatggcagcagacaaagaaggagaaagagcttgtttgataatggcaagtgtgatgacagagatgtgccagaagattatacaactcaaaacagtgagccaggctggaccacagggaagctcggaggaaagaagcaaaagtgcaggttccttgagaatgaccttgaggaggtggatggaagtaaagaggctgtgcctgttgacttaaaggtaggaggagcccaaactatccaggtggcaatcttaacttccagttcaatggaatcgttgtgtcccctggtggcagcgttcctccctctggaactaaaacctctagaccagcagaagctgtttcgggatgatggggaccatggtaagaccagtgaatcccatgagcaggagctcactgccgcatttctttagccataaaatgagtgcctttgtcagaggcaatgctgtgtggaataccatgacagtggataaggcattccatgagtccacagacggtggtcttggcagaagcattgc

SEQ ID NO: 476943 - DNA, 641 bp, Homo sapiens
tcttcttaaagattaatttatttgaagagcttgccctccaggctctaggtgccaataatcacctgacagcaaattccacgaatgcttcgccttgtgtattcatcatcaagttgcccaagtcagaaacctgggaaccatctcacaacatccctttttaatgttgatgaagagctcttgacaattcttcctcctaatctaatctcagtttttcccaccctctttaatccagctgtcaatgctcctgcctggtcctcaccagctctcacatgctgtgttacagcagaccctaattgtccccctttcaggcctcacctctcccaacccacagtttttacggctgccagtgttggttctctgagtcagcccagatattgcttccttcaggcctctctgctgcaggtctgctggagtttgctggagttccactctagatcctgtttgcgtcagtatcaccagcagaggctccagaacagcaaagattgctgcctgttcctttctctggaagcttcatcccagagaggcacctgccagatgccagccggagctctcctatatgaggtgtctgtcaatccctgctgggaggtgtctcccagtcaggaagcacaggggtcaaggaccaactgagtcccttagcagagctc

SEQ ID NO: 476944 - DNA, 793 bp, Homo sapiens
ggcagacccacagaagaggggcctgtctgttagaaggaaaactaacaaacagaaggcataaatccacaaagatgaggaaaaaccagtgcaaaaatgctgaaaattccaaaaaccagaatgcttcttctcctccaaaggatcacaactcctctccagcaagggaacaaaactggatgaaggatgagtttgacgaattgaaagaagtaggcttcagaaggtgggtaataacaaactcctccaagcttaaggagcatgttctaaccccacgcaaggaagctaaaaaccttgataaaaggttacaggaactgctaactagaatgaccagtttagagaagaatataaatgacctgatggagctgaaaaacacagcacgagaacttcgtgaagcatacacaagtatcaatagccaaatcaatcaagcagaagaaaggatatcagagattgaatatcaacttaatgaaataaagcatgaagacaagattagagaaaaaagaatgaaaaggaacaaacaaatcctccaagaaatatgggactatgtgaaaagaccaaacctacgattgattggggtacctgaaagcgatgaggagaatggagccaagttggaaaatacacttcaggatattatccaggagaacttccctaacctagcaagacaggccaacattcaaattcaggaaatacagagaacaccacaaagatactcctcaagaagagcaaccctaagacaaataatcatcagatccagagttgaaacgacgaaaaaaatgttcagggcacccagaaaggtctgatt

SEQ ID NO: 476945 - DNA, 751 bp, Homo sapiens
ccaaaaggctttttttttttttttttaaatgtgttatcgccagatctctcttctattattcaggtctttaaaaaagagagaaagggagggagggcggctggcccgtccagtggcttgtttctcacactgtgggctcccaggcagtttagggcctttctctgaaacatgcttctctcagaggcctccgaattcctcagacattcaaccagccccagccccggggcccaacactcgcagaccagctgttacaactttccaggacgctcctaaattttctaaatgtgtgccatataaaaataaaattgaggacggtgagtgttcaggagccctgtgtgtgaagaatataactcatccggcggcttgggcccattatttccacattcttccgcagctctcagtttcacctcgggcctcagagcagttcagcgggaagctcaaggcctgagatttgggtcaagtgatcattttttttttttttttttttactttttctgccttagttttcttttaaagtcccccttttatttggaaacttttttttaaatacaaaaatattgaaagaaaagtagaaggttttatatttatgtgtgtgatctattttaaattaacttttgtgtgttgtgccaggtataaataggagttcatttttaaaactatattgatattaaattgacccagcactatttgttgaaaatattatcccttctctactgaattgttcttgtcactttatcagaaatcaatattccaa

SEQ ID NO: 476946 - DNA, 655 bp, Homo sapiens
aggaaaaggactttcacaagccaatgacaaatagcatatctttcagtggccaatgctcagaaactgtattagtcagggttatccagacaaacagaaacaataaatggaatgtatgtatgtatatatgtgcatgtgtatgtgtgtgtagtgtgcgtatatatgcatataaagatttactatataaaaaattggctcattcagttgtggaggctgagaaatcccaagatctccagttggccatctggagaatcaggagggccagcgatataaattccagtctgaatgtcgacaggctcaagactcaagaagaatgtaaaagcaacagcataaaaaaaggcctggtgactcagactcagaaccttcaaggtcttggtctgaacatgccatcaagtaagccacttagataaacagaggtggcctctgaagatgaagattttggaggattggtagaggaaggatatgatgattgtcagtgaaatcagcaccgacaggaagggctgttaaccattttacatattccatatttcttggagacttcattcatttcttttaagcctttcttctttttgtcttattgggttagtttgaaagccttttcttcaagctctaaaatctttcttctacttggtctagcttattgttaaaatcttctacc

SEQ ID NO: 476947 - DNA, 612 bp, Homo sapiens
atatccagtgttttttgggccaccaatgtacctaggaaaagacagtacaaataccttctctgttctgtcaattaccttgcctgtggtacccttccttgatcaaaaatctttgattgggcaaagtagcagaagtaccattaggcccttatttagcatttactgtgtgctagccattgctttaaacatttttcatatattaaatcatttaatacctgttgcaaatatgaggaaattgagtcacagagaagttaaaggattgtccaagttcactcagctagtagaatgtgagatgacaggtcgttgtgaatatgacttttccaaaagaggagagtttctaacttttcaaggccatgttcattctcctaattcattaggtggtcgaaaagctctgtcaggcagaattgtcaataggctaagatgtatttcaaacacgacgtccaaagatgttaatctttcttttcggattctgcctgtgtgaacagtgctttactcagggagatttagtaaaatagctcttttactctcacaaaatcaattctgtgtaaaaggtatgaatgaaatctttcagaaattctaaattgtagtttagtttatatgaaataggtatatttt

SEQ ID NO: 476948 - DNA, 1014 bp, Homo sapiens
tgaggatttatatttgatgtaggccagcagccagaggcaccagcatttggtgatcatcttaatccagttacctggattgatatggttcaaagctgggcttctatctctatcattgcttgtctgcacgcaaagaagcaccttgcccagaaaataagggaagagattctaaaagaattcactagtatcaatgggttgaaggccaaattcattactttaacactaagacagcaatgtgtgatccttctagagtcctgtgaggaccctattattgtttgccttaagtgcctagatcccatagcacttgctcacagtgtatccttggaactacccctgctaaataatgcctgtgataataaacacaaaatggtgatctttgatgcagaaggaagtttcgggtttggtagactattaattgctgcctcaatttcagaacttgttattggtttattcaggattcgacttcttcctggtttagtcttgggaatatgtatatattcaggaatgtaaccatttcttctggattttctaggttatttttgtagaggtgtttatagtattctctgatgatgtttttagccttatgttctaaataatgtttccctgaacatgatatgatatatttataactgttttaatttttgaatcttgggcccctcattttttgttttgcatttggccacccaaattatgcagcaagatctgagttctaatgaagcaaaggtttattgttgagttataaattccatgatctttgagctattaaagtctttatttattgaatatctcataacatttttccacttcaattttcttaagcttggccatttatctgcaacttagtatttacctggcaagcactattttctgtaacaattttcgcagtcaaagcttctataccctctgattcacaacgggatagaaaataatttcctatattcccccttcactgtattcctcaagcaaatatacaacattttgaatgttttattacaatgttattactattaatgaagg

SEQ ID NO: 476949 - DNA, 1146 bp, Homo sapiens
tttagaagcagcctctgcctgcatggctatatgtgtctagaaatttatttatacaccaaaatcaaatcaaaatggagtaaagatttaaatgtaagacctgcaagtatgaaacaactagatgtaaacattggaaaatttctccaggacattagtggtcagagaaaagaatccttgagtaagacctcaaaggccttgccgcatgtcttgggctgtttacagcgtggtgttctcagccatgtcgaggctgacactgaggaggaccccaactgtcacgagcaacacccgtcaaacacagccacccacctggggacagatcaagaagctgtcacagatggtggaagaaaacctgaggaaagcgggacaaccagtcaaaatgagttgtggttttacgggaatgagggcaaggaacacctggcccgcacagggcggaaaaccgcttaaaggcattcttaagccacaaacaatagcattagcgatttatgccttaagggcatgttcctgctgcagtacacatgtgttaggctgtttggtgctgcccacagcttactgatgctgcattcattttttaaaaaattatgttttgtctttgtttcattttggataggtcttattgtggtgtcctcagatcactaatcattttttctgcgctgtttaatctgctgttaatctgatctgatatatttttaatttcaggtattagagttttcacatctaaaattttcatgagtctttttttattgtccatgtcgcaacttaagtttttggactacaaaatgttaagtagagacacagacaatagaaatatggactacagttgtaatagctgttataatgtcattgtctgctgtttctaacatctatttcaattctaggttgttttcaactgattattttttttctcattatacatcctgcaatcctgtttctttgcattcctcacattttctgattgaatgccaaacattgtgaactttcttggtaaggttgtgaatatttttgtattcctatgagtatctttgagttttgttctggaacacaattaagttatctgagaatagtctatttttttcagttcttggttttaagatttttgagagggaccagatctgtatttagtctaattttcccctattactgaaacaaaac

SEQ ID NO: 476950 - DNA, 549 bp, Homo sapiens
gacctacagaaaccattatagacaataacatcactgctgttttgagccattgagagcagcttggaggatgagttatagggaagtccagaatgaaagcagcgaaaaaagcagttggaaaaactgtaagaataatccacttgacaggcttcagccttgccttagcaccaggacagctccaggatccaggccagtcacagtggttccagggtccagtgggcctagggtctgggactaccccagtagattccagttccagaacaaccccaataggctaagtttttggggctacccctgcagaaccaggctcaaagcccacaccagcaccaagttaacccctgtagagacaaactttagactacatgctgtggatacaggctccaggcctgcccttatagacccaatcaacaagtccatcccagtagatccaggctccaggctcaatcccacggacccagatgccaggcttatgcacctgctcacccaggcaccagccagcctgcccaaggactctagcagaaagcctgcccatgaagaatactagaagtctgg

SEQ ID NO: 476951 - DNA, 960 bp, Homo sapiens
ttatagaatttcagttttacaagatggaaagagttctgaaggttcatcagtatcatccatatccctgtcttctacctcaacatcttgtcctgctggaaggtcttcaggggcaagcacgcacggagctgttatcttctacgataacaatgccttcttctggaattcttcctgaagaacttgcctgtggttattttacagtcattgataagaatgcaacaaagattcatgaaacacaatcacatcaaaccacatccaagtccttcatacatgtagatgcttggtgccacaaaggaatgatgcagatagttttaaatattagttccattagatcatgttctacattatttttctatcagtacgatatcttgagagacaaactatctagtcaaaatgttcaatccatcaaagcctccaggttgcaagtgttggtatttctaagggaagaaataagaccatttggagatagtcatgcaagcctataacacctcaggtattacaggaaatattcacaacaaaagaacaaagaatagctgattataaaatataatgtgcattcttgaaatacattaaaatattaataatgaaattatgagaatattgcactctgtgtgaataaaagcaccagatctgattttcctgattcatccatatggttgagaaataatgaaataaactactttttacttctttcgaaactgtatgattcaagatgatgtgtcgctgtgttgcctagtaagacaacaaataaccacatatgattattgagtgtttggaatgtgtctatcctcagttgtgatgcattcttagtgtaaaatacacacagagttttaaagaaagacttagtgttaagaaaggaatataaaatatcgccttactactttaatatattaatgatatgttgaaatgataatatttgcaatccgttgggttaaagaaaatatattataaaaattattttta

SEQ ID NO: 476952 - DNA, 646 bp, Homo sapiens
tttgagtgaagagcatagaagttgtcattggactatctttgaaactcttctgcagccaagaaggctatggactctgagaaaactgaaaataatttgaattttattcaccttttaaccatgaaatctagccggggaaataacttaggagataagaaacagacaaaggagctgaatttctctgagtcgtactgtgagctggagctgaatgtacatgaatctgatgtgtcaaaaatatttataatagatgacttggggccccgatgctgcagccctcaggcagtcaaaactccaattgacttcagtgggaactttacctgtccaaggtccagctgccttgtgcctgtggcagtgtcccgattttccccgtatagtctgtcatggattcccttggctaggaaagggaaatcccccaaccccttgtgcttccgagaacaagtaggaatggctgagaacactgggggcatggaccccaccctgggcacagagccatacaaccaggaaagaaatctcaaacactcagcttctccctgtggagaggagggtttggatttcacatatactgccctaactctaaggtcctcatagttttgcttttatgtaatcaatttggaaaggacagaggattaggtatattcttgtctaagat

SEQ ID NO: 476953 - DNA, 694 bp, Homo sapiens
caaattgactcagctccagagcccataacctatatcccccttctcaattactgctgaataccatctgtataaattaagatggtccagaaaaacagaccaatagggtagatagataatagaaagatagataggtaagagaaaatttattatggaaactggcttatatgatcttggaggcactggactcccaaggcacaccctctgcaagctggagaaccaagaaagccagtggtataattcagggatgacaggtgtaagacagagaccgtatggcaaagaaaaatatattagaagtatccttcttgcatttcaacaatttaatcccaatgatgttaacactgagcaaaatcctaaagttggcaaatttatgtttggcttgcttctactgctgtttcacaagctctcagttctcaagataaatgctgctcacaaagtgagtgaaggggccttctttgtttctaaggatattgaattagcaacagacatagtttctgatcaaaacgagagttgttttggctcttcaatcaaagttgttgaccataaggagacaatagagaaattaaatttagaggaagggaaaggctttgctttaatgatctcaaagtgatatttagtttagctgagaagatgatatcaggatacttttccggcttagaaaaaaagactgcatcagactgaggatgacaggtcactg

SEQ ID NO: 476954 - DNA, 718 bp, Homo sapiens
ataaaaccataaagtctcctaccttcctcttatactcttttttcctcctatagtattctttctctttattctttttctcatcatcctttgacgaacttttgctgactggagagtctgaggactgactatagggatggaaaagaatccatggaagccaaaatactttatttcctgtggtagttttggcaagccctgcatccaaacagtacatgaaagtcccagaattaactatcagagcttccacatcatgttcatctttgagtgtatccacttaaccttcattgaccttattgtgcaaaaccttcaaaaagcccgtgggccaaaaggaggtcagaataacacgctgctggatactttcttgcagggaggtgtggagggagaggcactggcgggaactggggctgcgcacggaacttgcgggccagcgcgagttctgggtgggcgtgggctcagcggcctgcactcggagcggctggctggcgccgtgagcctggggcagaggccgccccctactccacagccccgggtcccatcgaccgcccaagggctgagtacagccgcacagtgtgggactggtgggcagctccacctgcagcccagtgcgggatccactaggtgaagccagctgggacttggagaacttttatgactagctagaggattgtaaatacaccaatcagcaccctgtgtctagctcaaggtttgaaaatgcaccaat

SEQ ID NO: 476955 - DNA, 650 bp, Homo sapiens
aataagggaactttcccattcaccgaccacgtaactgcaagcaggggtgggagctcagaaatcagcatccgatgctgccacaaaacagcgcgtatctcagcagagaccaacaggaactgaagagcccttctcagttcaaacacccatctgctaaggctagggagacttgtatgtctgccaaagaagttgaaatacctccaaggagaaagagaagcaagacacctaaatcgaattcaatatttaaaccatttcatgaagagactgtcctttcctcaatatatgttcttgacacctttgtcaaaaatcagttcactgtagatagtatggatttatttctgggctctccattctgttccatgggtctatgtgtctgtttttataaaaatgtcccagaagagacaacaagaccgagaggtattcataaagagagcttccaggagataaacagggcaccagaagagattggcagcagccataaatttaacactgaagaagcgtaagtctacatatgcctgtcatcctccaactacttctgcacatatgctattttaataaacgataaatttgttcatagaagtgtaaatattatttttctgtgatagatacaagttcccccatgtagcatctttgcttcaaaatcttaatgagaa

SEQ ID NO: 476956 - DNA, 637 bp, Homo sapiens
tgacagctgcagcagcataaaatgtctgattgctctcccggatgaacagtgcttccttgttcttaatgacaccagatggcacagcctacccggggatactcaggatgctgggaattgttttcaaatatctgtctggaaaagaaaaatggcttgttagaaggagaataaaacgttatctgtatcctgaaagtaatacagataaacaagatatagactatattgactatattgatatagactatatagactgtatcactcaaatagcaaataacctgaaatttttccaaatagttttcatgtgtgtatctatagaaatatatgaagaggactcaattctgatgaataaaactctaaagatttcaaactcagaaacaattactctaagaagttcctctagaatctttcaaccttgcatctctgaattagctatttcacttaaatatcaaatgcaggcacattgccaatctacgtatgaaagtgaggtcacactgaatatctaaccactcgtaaaagtttcttcctcatttactattttaattcattgcatcattctatgatctgtcttctatatcagctcacaaatttattggaggtacaggtcatcttttgtgcctggaaccaaatatattttcaaata

SEQ ID NO: 476957 - DNA, 725 bp, Homo sapiens
tgggaactcacttctggcatcagcatgacctggatagtcccactggaatgcagtggtatgatcacagttcgctgcaacctctgctttccgggtttaattgactcacagttctgcacagctggggaggcctcaggaaacttacaatcatggcagaagtcacctcttcacagggtggcaggacggagtgaatgcaagcaggggaaatgccagatgctcgtaaaaccatcagatcttgtgattgtcatgagaacagaatggggcacatggtacaagctgttggtggatctaccattctggggtctggagaatggtggctcttctcttatagctccactaggcagtaccccagtgggtactctgtctgagggctccaaccccacatttccctttcacactgtcctggaagatgttttccaccaggtctctgcccctgcagcaaacttctgtctggacatccaggtgtttccatacatcctccgaaatctaagcagaggagaattagacctgacctcttacctgaggtaagaggtcaggtctatttctgtcagaaatagaaatgttttttattctgtcaagtgattcaagttttattcatgaattatataactgctaaatacctacttttgcaaaaactattcagcatatttcttgtaagtacatagaaattcatagaatatattttgtgtacaatattttgtaagagaaccaacatatttttgaaacac

SEQ ID NO: 476958 - DNA, 610 bp, Homo sapiens
aaggaaaaaaatgagaaggtggatgctggatacttggtcttctcatagatctaggaggtactactgctcagatgtcatgattgctctggagtgtttgcaacaaaggacactgttgatttcttttatgatgtttctttataatttgagggaatggcaggactcggaagtctcttttttgctttttctttcttgttttctctctatgaatgatttttttttttctggtaaaggtagttttatttggttgaggtcttttgctactaactcttcattcagtgctgtagatccattccaatgtccatttagtgagaatcactgggagcgatttgtgcaattgattggtgacatcgagcacagaattgatgcttcattgctttgggagtccttcctagaggagacagaattgtcaaacaaaatgcaggagagtatttcatctgggtgaaactggatatcacaattgttagaactcagcttctgaaaatcctgcttattttctctctgctttttgacaccaagccgtgcctaactcccctgaatactagagtggtttgtatttgtattcatggtagctgtgcactaaaactactgcagataatttagtcttgatagc

SEQ ID NO: 476959 - DNA, 721 bp, Homo sapiens
tgtcccttcaccccaatgggatgcggcctcaggccgatgggaagacagatgtggagccaaaactgatccatctgtgtaagcaaggagcttacaagagccatggcctgagctctaagttggaccctttcagccaagattggagcagctgggacacaaggcagtatcttttcagcaatgccccactctactggtaccaatttacagcattagtccattttcacaatgctgataaagacatacctgagaccgggcaatttacaaaagaaagagctttaattggacttatagttccacatggctggggaagccccacaatcatggtggaaggcaaggaggagcaagtcacatcttacatggatggcagcaggcaaagagagagcttgtgcagaaatccgtgttctaaatggcatcagtgggtcctggctgttcctgaactctctatcagagtgtactgtgaggtttcctatatcatagaagtaatgtgattgatcaagaatcttttgcctttttaatataaattacatttctgtgattttcatgatgtaattgcttcagtgtatagttctttttcatgctaaatttcacatttccttgatgtggtcagtttccacaaattcaaaccagtgaaattcaaataggattacatttctttcatctaaataatttatcttaaaaaaatgaatgtgaatatggtggattagaaatagaaagcattggatac

SEQ ID NO: 476960 - DNA, 1570 bp, Homo sapiens
ctgctcacaagtgtgcacatctctcccaggtgattctgatgcaagtgatccacacaccacatgttgacaaatactgctctagaagtttactgaaagaactcctcagagggctgctcatccagactcagcaggagaaatactggggccactgtgcgctgtccactcggcagctgaccacagggcctcatgctacgccgcttcctctttttggcagagggcgtttcggccaggttcacaagtgtgaggagacggccacaggtctgaagctggcagccaaaatcatcaagaccagaggcatgaaggacaaggaggaggtgaagaacgagatcagcgtcatgaaccagctggaccacgcgaacctcatccagctgtacgatgccttcgagtctaagaacgacattgtcctggtcatggagtatagcctgatgaaatctcccaccgtcccgctcggtcccacccaggacgtgaatcatccctttgtccagcgtctccaccactccctgcgtgtggatggtggggagctgtttgaccgcatcatcgatgagagctacaatttgacggagcttgataccatcctgttcatgaagcagatatgtgaggggataaggcacatgcatcagatgtacattctccacttggacctgaagaatgaaaacagtcaccaccaccacagcggtatccacgtggtagccctctcatcaggacaagtaggtctccaagaatcgccggcagctcctcgagtcactcaggaagctccagactttgggacttgtttttctgtgggtttgctgccctgtggaatagaatcctatggagaatgcagcagaggacagtcggaaggatggggccaaagtgctaaggagaagagagggtggggcattgagaccaaactcagcaaaaccttggaactgctgagactgaagaacgactggagagaaaagccctcctctgccgtgcgactttcccataggcgcctctgcctgaactcaggcattatggtgaactgtgaagccgtgcagaggacaggctggataatgcagggttggcaggatacccgcaacctcatccaccacataattaaaggagaaagtacccacacggacaagcccgccccgaaatacaaacccagagagaagctgaaggtgaactttggaaccccagaatttctcgcccctgaagttgtgaactatgattttgtttcatttcccactgacatgtggagtgtgggggtcatcgcctatatgctcggtttgtcgcctttcctgggtgacaatgatgctgagacgctgaacaacatcctggcctgcaggtgggacttagaggatgaagaatttcaggacatctcggaggaggccaaggagttcatctctaagcttctgattaaggagaagagggaaggatgcccatggagcggccccagccagcccccgtacatcttctttgcttccttcctctccctcgagcccccatctcatgtttaatttacctccatgttgtgtacatgatatcccctaattacctctggaagctgtctgtttctctccattcccatggtgaccgtggcctggga

SEQ ID NO: 476961 - DNA, 824 bp, Homo sapiens
ttggggtgaggggctgtggtctccgtggcccctaatccctctctctcccacaacccctcccacccataaggccgatccacaggcccatgaaccaacatgagagttgtgccagttatgaaatatgtccatgccaattatacacccagggacagcgaagatgactacggggtgggtctgtgggtcctgtggactcctgtagcccagacctgtgccaggactccacttattaactggcctctacatgccctgctccatcaaggtagcagtggggacataatgacattcgggatccctggctcacactggctgggtcctgcagctgtcctcagaataggccctaacctgctccccaagaccagcacacctccagccagattaggctgtgacttaaccccagaaaatgtcttgttcctctactttatgcaaagcgtgtgccaggcagtcaacgagcatgcacttttgcacatttttcagacacccttgttggctccagccttggtagcacatggctgggctatggcaataaaagtctggcaagttagcaacccgtgctctcctcagacccagggaaaagcatagctttatggtcaccagcaatggtctggagactgtagttttaaaacattgtacagtcaattctccacatgcataggagtagaacaaatcatctgaaaggctttgatatttggctccacaggcattgtgcatggggagtaaaagggattgatttttgttttgagttgttttaatttttgtcttttgcaggtttaccttctcaattatattttgattagataaattgtaaaactgggcttcattccctc

SEQ ID NO: 476962 - DNA, 795 bp, Homo sapiens
cctggggctagagagtcgcggcgatgcctgcagagtcacttggccgtcctcgtttcctgcatcttcgtgactcccggccatcagtgcagatggggctccccgccactgtccccaagatatcccggggctcagcatttcatgtagttatttccggaccccaggcattcggaggcccatatggctttggctaccaggcagagccgtcgactgggaatgcagggaggtggttagaagctgggatgaagaacgacctgcgcctacctttaggaacacacatcgcttcaactgctcctcagaaatttctcatggttgaagtaaacacacaagacagcttggcaatggggttccccttccctgaggagttctccctgacagagccgctccgaattcctccggcagcacgcaggtccacacagtcagtgtgtgcaggggccatgagtaaagcacagaaggcaaggcacgctgcgggagaattcagagggcgtccgtgtgggagctgtctaaacggtgtgacttttggatcttctgcctttcgaaattctttccccttggctcactgaggcctgaaattccacagtcacaccctcccatgcctttgatgtctgccagacaaggactttgtcctccacgagaataccctgcaacagggagagcacacgcgaagcttctctggacatttttgtttcctcagtacgtttatcagattcttcctgagaggagagattccattgggtggatttggaaaatgaaaacaaagcaagagaatgttgggtgcctgcctagtatgtggaagat

SEQ ID NO: 476963 - DNA, 555 bp, Homo sapiens
aaatgactgtatgggcaccaggttcaggtggagcaagctgattataatctggttggctgaaaaacttgttggcagtttctttcttaactctctcgtgccaatggaaaacaagcccgctgccaaaccccattcagtaagaggcactaatgaacctccagcaatcagaccgttgatgtcagacttgttagctggggccaacatttatacacacgggaatgatcagtctcttgagatggacaatatttatcaagcatcttctcatgtagcacactttaataaaagtccaagccaaaaggggccaacctatgccctctatggcaatataaatctccagaagttgctgacctatttacagtttgtgacccaagattctttatgcaatagaaatagggttttgtgaaattttaggatttggaaaagacctcacggattatctattccagtgactttatcagactcaagatcccactcttccccactttatggaggaataatggaagtatgtttttgaggtgtacaatctgatcagttttgtgtatgtatacaactttggaa

SEQ ID NO: 476964 - DNA, 1044 bp, Homo sapiens
ccgcgagggtccatggcttcattcttgaagtcaaaatccgaaaactccctgcccccaggacctcctctgaatccactgcgaaatcctccagggatggttaaagtaccacatctgctaccaccatgccctctgccaccacagaaaccgaagatccctctgcctctgcgtctcccacagccacgatttggacaaagtgggattccaaatgtttcagcatttaatcttctttcttcagcccaggttgatatccgtggtattggacgatctatcttctgtaccagaaaattgaattttagcgagggctacggtggggttctacgtgtcgatggtgcagaggatgccctcgtagcagatctgtgccttggagatgtggctgatcttgctgtggaggaaaggggtgaccccgctcatggtgccaccgcagctcccggcgctcgcagagcggcggaccccaggcggctgtcaggcgatccacagtatccgtcgcgcctgtggcagccgcctcagacctaacatggcggcgccggcgccagctccgctaaatcagctttattttcacttcattaaaagaaaaattgaaaactccaaagaacgatcttgacttctaaaatctgaaaaacgatatcctttaggacttaaatcttggattgttttctaagatgcctcaaataactgctgagcaaacttatgtctaaattattgctgtcttcacaattcagtaaaaccaatagtaattaaagcatctattactgcgtaggcccctgcggtgtgctacatcaaagacaaatatgaataagccagtccctccctcagagaccttacactgtaatagatgcatttcattttattttacatatgagtgactaaaaaaatgtgttgaattgaaataaacacatcctcaaatagctaaagtgcaaagtggaacaaggttggtaccactagaaacatacaagcacaatgctatgggaagataaagataaaagaaacagaggaattctgcctggctagaagttgaaggaaggctttatgtgtaaggtagcattc

SEQ ID NO: 476965 - DNA, 849 bp, Homo sapiens
tatcatcaagtttctgctgaccgctgagtctgccatgaagaagacagaagacaacaacacacttgtgttcattgtggatgttaaagccaacaagcaccggatcaaacaggctatgaagaagctctatgacattgatgtggccaaggaagtcaacccagcaatggcagtgatagtctttgcgatcatccggttgatgatgatgttactgcgccagaaggacaggactccctgctccttgagaatacggacctatatggtctataatgcccttgtattgcttatctgcggtgatctgcttgctggcacactgtacctgcagcagcagctcgatccgcttgatgggagcaacctccgtcttggagatggccgtggccactctacctgccaggaagtccttgaaaggaaagaggaggcaggttgctgccagaagggactgggccgggaaccagctttgactccggggctgcgggtccatttgaaactcttaaattgaactaggaaaaaaaaaggtaattttatgcttcctatcaggaaggtagtgtttctcacttccaagaacttagcactaggtagatcttggttatgactgataattaataagttacagtaaagagtataagttatattctttcctgactttagctttcttgggaaaaacgcatactgactagcactgtgtctgtttactcatttatctttcctatgttaataaaatttagcacagacccttctctaaacttatggaatggttattgcttgtacaactttagggtatttcttataagctgctttattttgtcaagtttttatgtgtgtttttttatatgtacacatgtatatttgtgctat

SEQ ID NO: 476966 - DNA, 986 bp, Homo sapiens
tccgagtcacggcgccaaatttcatgcacgtctgtgtgaagagaccaccaaacaggctttgtgtgagcaacatggctatttatttcacctgggtgcaggcaggtgaaaataagagagtcagcgaaagggagataagggtggggctgttttataggatttgggtgggtaaaggaaaattacagtcaaagggggtttgttctctcgcgggcaggagtagggacacttactttggatatgggtttgcctatcctgcatgcaatgcttcttccaagactatcatctgtggactcatggaatgccttatccaccatcatggtattccacacagcatgtactctgaccaaggcactcactttacagctaaagaagtgcagcagtgggctcatgctcatggaattcactggtcttaccacattccccgtcatcctgaagaggctggattgatagaatggtggaatggacttttaaagtcacaattacaatatcagctaggtgacaacactttgcaagcctggggcaaagttttcccgaaggccatgtatgctctgagtcagtgtccaacatatggtactgtttctcccaaagccaggattcacaggttcagaaatcaaggggtgcaagtggaagtggaaccactcaccatcacccctagtgatccactagcaaaatttttgcttcttgttcccatgacattaaattctgctggcctgaaggtcttaaatccagaggaaggaatgctgccaccaggagacacaacaacaattccatcaaactagaagttaagatcgccacctggacactttgggcttctcctatctttaagtcaacaggctaagaaggtagttacagtgttggctggggtgattgacccagactatcaagatgaaatcagtctactactccatccagagcatgtaagtgttgttaactttatgtaatattatttgggttggggattggtgcatttccagttgtatgaaggatag

SEQ ID NO: 476967 - DNA, 600 bp, Homo sapiens
catagtccacaagcaggtttagcgatggtgaaaaaggaccatcagtctgtcctgaaagctcccaggacgccaaaccttgaaaatgtggcagatttctttgatggggccacgtgtgtgttttcctttctatttaagcatgctctcatggaaaacgattttgtatggacacaggaggaaatttcgaccatgagtgccttcgcctgtgagccctacggtctgccgggactctgtgtgcaggagttagatcctccaacagaatctcccttccgaaggcttctgacccagagggaagagatgcagcgaggccatcaaggcaaagatgtagcgttccagggtcctgaagacatctcgcagcacttcattggctgcatagcattcggcacagagcatgcagaccctttggctgcttaggttatgtgtgtcctggtggccaacgccgtgtttgttacacttgactgcacgtaattcttgagaatatgttcatagcctcatctgaaaagcactgaacttctgcaaacgccttttaaaaaaaaactttattgagatataattcatatatcatacaattcaccatttaagtgtcttatgatagaagattag

SEQ ID NO: 476968 - DNA, 481 bp, Homo sapiens
gattaagtcagtctctggaatagagtatatggttctgggggagagcctatatgaagatgtacatttgggaatcatgaatatagagttggtatgtcagaccataataatggaagatatcatcagagaagtgaatgtagatggagaagagaaggatccaaacactgagccctgcaagattccaacacgaagagcctggagaaatgagaaaggagcaagcaaaagaaatcagagggtaggagatttagtgcatgagggaggccgtggcctaagaggacgcacatactttccatctattgcaacaggaaggaagacagaatacaaaggtttgaatgctggggtgggtggatgtggaggtgggagcttgcagaaggtctcttcccatggcttccaatttccccaagatatggaagctgagtgggaggacagaggaggtgggtgtggtcatgaactgggagagtaggaggcctggggaatggagcac

SEQ ID NO: 476969 - DNA, 734 bp, Homo sapiens
gcctaaaatttaaagaaactgtagatgtttgctgagggctgccccaaatgcccccatcaaaaggcatcagcctaaatgggaaaaaatgtgtcttcttcaatccccctgaagttcccctcaatgattttctgttctgcaatgacatttccagtcaaagaggccaaagagataaaactgctgacctaaagactttttcttctgctcctgggggcagtctgggcacaaattcacagagtgcgcagtggggaagtgaaattgatggtgccaaacagcatcatctaaacaagcagaacccagagggggacatgaaaacgtccagcttcctttatggctgtgagacatggaccagtcgagacattatggaagacagtcagaggatcacagtccccacagatgaactgaacaataccaccagggtttcagctccaaaccctccataccagagagccctagctcaaagcagtgcttaccaagcttcagacctggggtgccacctttgtgatatttgccatgtccgatacctcctctgatgtttaattttatgtttcaactagattgggccgtgggtgcccagttatttggttaaacattattctaagtgtttctgtgagggtgtttttggaagagattaatatttgaactggtggactgagtaaagcagatggcaacccacacgtggggggacttcacccaatccatcgaaggcctgaaaagaacaaaaaggctgaccctcc

SEQ ID NO: 476970 - DNA, 697 bp, Homo sapiens
tctttgaacgaccccacggtccagcggcagctgtggctggggtctatcccagagctgctaagaaggggagtgatatgatcaaaatgatgcttgaggacaacggttcttgctgttctggctgctgtgagcagagtggattagatgaaggagatcctcaggctgggggtgctgatctgaggctgtttcacaaaccaggtgtgaggggacgtggcctagaacaggattctggggatggggtagaaggagcagagctcgaatatgttatgtgggataaacattcattcattcttagaaccgggcactgggaaacaaatgttactggaaaggggtctggatccagactccaagagagggttcttggatcttgcgaaagaaagtatttggggagagaatcaacaaatatttacaatctcttctctctgaatactgctacctggaagcctcatctccataataagaaccttggtctctacaaccccttgtcttaacctaggcatttcctttcttttgatcccaggtccttagataaactctttaaccaattgccaatcagcaaatttttaaatctatggcctggaagctcacctgacccagctgttttgagttgtcccacctttctggacccaactgaaccaacaagaaggaaaaacacctaggatgggtgaaatgcattgtcgtagtcagcttgggctgctat

SEQ ID NO: 476971 - DNA, 556 bp, Homo sapiens
ctgagggtgacctgtacgaccctcctctcaggaagcctttctcagtcctagtcagcatgaaccagcagcagcctcaggaatgggatctgggctttattcttcactgtgtcccacctatgctgggtccgaatgggtatctgcaaattatagagcttattggctgttcacaggcagttcgtgaagccagtgtcatggagcagctgagctttgctcaccctggcaatgttttctggaatgagcacttggagaaagtttggtggttcaaaggaaaggaacctaaggaacagaatgaaagtgaaggcatgtcattggtcaaaacaactttgcaacaagggaggcactggcggaggcaccttctagaagtacactggaagcctgaagaaggctacagtccaatgcacagcccagctgctggcttgcagcacaacttgctgcctcccgccatgtggctgaatgcacacaggggtgccctgacactggccattttgcaaagatccaggggacaatggcagctggtagcagcaggagtggggagcccacagcaaagggattaatg

SEQ ID NO: 476972 - DNA, 1074 bp, Homo sapiens
cgtagaggcacaggagggtggtgatggcggccaccggggctgtggaagtggggtccccggggtcagccgttgccccctcgcccgccctggacttgctgcctgccctgggtcatctgttctggcccatcagcgccgaggacaaggagcagcagcccacccagatcaagtcactgtgcatgaactgttaccgcaatggcatgacgcgcctcctgctcaccaagattcccttcttcagagaaataatcgtgagctccttttcctgccaccactgtggctggaacaacacggagatccaatcggcaggcaggatccaggaccagggagtgcgctacactttgagcatcagggctctggaggacatgaacagagaagtggtgaagactgactctgctaccacaaggattcctgagctagattttcaaattcctgcctttagccagaaaggagggaacagctttgtggaaaacccacaggctgctcagaaagatgatgccctggtgatcacacactacaaccagacccgacagcaggaagagatgctggggctccaagcagaagcaccaacagagaagccagaagaggaagatctcagaaatgaagtgctccagtttaacacaaacggcccagaatgcaatgcccccactcagaccaacatgaagctagtacaaatccctcactttaaggagggaccaagtacaagaactgcgtgcaagttcaccacactagaagggctgctgaaagatatctgggaactggtgaccaaaaaccctttcacactgggcgacagttccaatcctggccagacggagagactgcaggagtttagccagaagatggaccagatcatcgaagatcttcctggttatggttcacatatatgaaggggggagagagaggcctcctaaaccaggtgtccgaatattacaacatctagaaagactcttgaacttacacttcataaaagataaaaggagtgtttttttaaagagcaactgagctactaatgagaatttggcactatttatgtttttatgtataaagaaccctaaaggacattcgatggattctggtatc

SEQ ID NO: 476973 - DNA, 558 bp, Homo sapiens
tgccaaggttttgctttttctgagtctattaatgtttccatggttgaaataccactctctgattagctcaataagtcattttaaaaacagcaattttttttattatactttaagttttagggtacatgtgcacaacgtgcagattaaacacaccactctccagcagataatcctgcagtggcttccccttactgcaaaattgagaaccagtgcctttgtcctgaattcaaggatctctatgttgggtctcaacagcttcattgttctgtctcactgttctccttttgaaaataacaaccttgccaaacgctgcttctcccaagaagactgcaccaatctcagctcccaaaccagaccctctcctcttctgcattcacaagagttcgtctgccttccgggcatccctctcattttgtcttgcaatatatgcatttacttatctttcaatccaccttccaaccctcacagtctaggcccttggagcatgagaactgatgttactttacttttttttttttttttttgagacagagtctttctctgtcacctaggctggaa

SEQ ID NO: 476974 - DNA, 1199 bp, Homo sapiens
tgcagcagggtcctagcagagccagggctctccactcccgatagaaaatgagctgctgtggatactgccagcgaggccaagaactcctgcctttgacccatgggtccccagactgcctagggggttccttctaaaggaaactcacttctgtcaacacccaagagaaccaggaggcatgtctctcccagagtcgcaatccctgggggtcactgccttctctgtggggtggcgcatgcaggtctttctgtacacaggtgttgttagcacagcacaaggggcttgaggtaccaactactgacagttcaggctttctctcctcctatcccctctctgtgagtgcctcatctggcctcttgggacctctgaccaccccgactttctccaggacagtaaccagccaggccacttcttgaactttatcatctggctctcccatctgagccacctccaaaatctctaaccctcagccccctgacaacaacctcctcctgtggaatcccagagctcagcagtatcttaagggtcatttggttcaacttccacatctcaaagaaaagacagctgcagctattaagtgacgtgaccacagacacacagctgagggtgtgtgcctgtatgacctggcctacatctttctcctgtgctgggtgcttcctgccctggaacatcggactccaggttcttcagttttggaactcggattggctctccttgctcctcagcctgcagacagcctatggcagctctgcctcttgctgggttgtggctgaggttctcaggcaggggagctctggcttcaccagggctgaggttctccaggctggctgtgcacaccacagtcacctcagcagctctaaaaggctggctccactctcccatactcccacctatcccaggcagcgaatcagttcatctgggtgggttctgggccgagatggtgctgaagctctccaggtgactccgctgtgcagccaggatggagccacagtgagaccagggaccaggcgtcacctgagagttagtaccaagatagagcaccctgccttgtgttacacctccagctctctccaggtgggacaagcaactgccacaatctcttgattctcaggactactctctattacagtatcaagagattgtgacagttgcccattcagactggagagacctgtcaccagaccactgtggcggtcttccag

SEQ ID NO: 476975 - DNA, 1314 bp, Homo sapiens
gcacctctggcatcagcgtgacctggataaacaagttggctacattatgcaggagtacaatgacacccttcagagagctgaaagattgtctgttgctcgagaaaacttcctcatgggaaaaaacaatcctcctaacttggtgacacaggaagatctgactatttacacaaagtggttagtgtgccacctgcactctcttgggactgttcaccagtacctgcaggccctccagtatttgcccatctccaaagtgctgagtgtagctttcaaccgagtcgctgaagctggtcagaaaaatgaaaatgtctgtgtcaatgacattgaccctgacattcagggttctgcatctcctgaccctgtggataccagcatttctgtgatgaaggtgccaccacaggggcccacactggagggggaagaaggaatgttcagcattttgacagtaggaaccgatgtcgtagaaagcacttgtagcctcagtctgaaagtttcccaaaaatttcaaagcgtcttcatggagcaacagagattgcaaatgtttccagactgtgaagctggaatagctaaagcagataatttgggtttggcaggacccagaatgaccctgaaaaagaaagccaactggatttccttcataaaggtagttgtgttctggaaagtcaccaggaacactgagttagcaaatattgaatcgttacccctaggggaaatagagttagttcctgtgaacctctctgcaatgaccaactctgatggatttagggtccctgctgcttgtgggtggtatggtgtcatcccagatagatctactgcatcttatagtccaggcaccaacaggaactggtgctgctgtctccttcaatggatctgtgaacccatgaagaccctttccaaaagctcacttgtcctagccaacctagcaccaaagccagataccatttcagaaggtccttgaatctctttgcttgcaacttttattgagaatcattctgttatgttgtaactttatgtgaacatgtttgtccactagatcaagccaaaatgtgatccatggcaaaagaagcttttgactaaattaaaagaacggagaagaacagatgcattattgcaactccaagcaaagtttttgaagatctaataatatttggttaaatatctgggtgctctggtgttgggtgtatatatatttataattactatatactcttgctgaattgatccctttgtcattatataataaactttatctctttttactgtttttgacttaaaatctattttatctgattgagagaataaagggaattaaattcc

SEQ ID NO: 476976 - DNA, 794 bp, Homo sapiens
ccctttcttaaaaccagtacaactatgcaatgaccctacaactgctgggcttggaagacggcactgaccccagtgataggaatcctgttctgatgagaggggcctacttgtcctttctgtatctgtgccaccttcgaatcagagaactgcagcacatctgcttaggaattctgaattatttcagatctgttgagcgaaccctgacaatcaatacttcgggccttaccttggtttcagggaaactggtccccaccatggaagatagttcctgggtaaatatggcaaaaggaggtctgggcaccttgcagggcctgggcgctcaccactatgtccgtgagacacctgctgagcacaaggacacccttctcttttgggtctcctaccctaaaaagcacccaccaactcctactccctcacgacacacagacttcctctcagatcttcctttacccctctgccctcctccttgggttctagctcatcaagcccaattagtttggccctcagtggaactagagagagacatgggactgagggaggaagacagcaaattatggcagaaagagaaggaatatgtatgcctatataaagggtttggacaatgggatgtggatgggaagagtggaaaaatgaccactaatatagatgatggcattaaagttggcatcttgacaatactattgcttttcatcagcttcagaacttaatccaattgccattgcctgaaagacttataaaattcttctgtacaagaactttgggaaaggtcttttccaataaagtgaataaagcat

SEQ ID NO: 476977 - DNA, 694 bp, Homo sapiens
ccagagagaaagactaaatatatatcttatttattatatcgcaccatgatgctcattatctgtctgtggagcacagagctgggtgctggaaatctaaagagaaccaagacacagtacccaaggctgctgcaggagtgtcagcatcagcagactgctcacaaagtcactgtgttcatccaagggggccaccaaattttccacagcttgacttggaaatgcatgtgctcccacagtcacgtgacccccttggacgacaaacacagcgactttgtgagcagtctgccgatgataacattcctgcagcagccttctgaacagtcagcacacaagaacttccaaatgcctgaaccgcagcagacaggcgttcctccaaaacctcctcccccaggagcttgctacaagtgccagaaatctgaccaccaggccaaggaatgcctgcagcccaggattcctcctaagtcatgtcccatctgtgtgggaccccactggaaatcggactgttcaactcacctggcagccactcccagggtccctggaactctggcccaaggctctctgactgactccttctcggcttagcggctgaagactgacactgcccgatcgcctcggaagccccctagaccatcatggacgccgagcttcgggtaactctcacagtggaaggtgagcccgtccccttcttaatcaatac

SEQ ID NO: 476978 - DNA, 3601 bp, Homo sapiens
ttccccagagcccttctccagacaaccacgattcagaggttctcatgtctttccccagctggaggggcagggtgtcctggtgtgccttcccagcccagcacacaccaggaagccctcctctcctctacatgtcctctctctgcgaaagccctacagaaaagtcccttccaccatgaagctttaccagacccattccccaacgctcccgccactcagccctttctttgcccctggattccacagtgtgcagtgcctgattccttcgatgaaggtatcgaccagcaattctcttgctctccctagcacagaaacacagaagggccatatcaccggccctgaggaatccatgttgtcagaaacgcgttgctcactgttccgaggttcttggtccacactctcattcccaatcagaaatagccagttcttggaaaccaccattctgagcaaactatcacaaggacagaaaaccaaacaccgcttctcactcataggagagtcctttcaccaagacaattttggagtgacttttctgggccaagggtcatacctggctcacctccttttggtgaatggtgccttccaaggctttggagtataacatggtctgaatcattactactgactgttccaagtgatataacttcaccagaagcctcaagtgtgtggtttgaaggctggggagatcctaattttacagcccagccgttgatgtctcaacgggttttcccatcagtgggacaggagggtgatgaaagatacattgggaataactagatatggtccaggcccaggctgtgcctgggaaacaccattgaggaaggacctggaagccagactctgtagactgaggcttttaccggatgtaacactaagctacagggaaaaataaataaataataaataacctgtcaccgaaactcattcttaccccaaatcctgaaactaaccatccgatcactgatgccaaacactaaagagtcatttgaattaattcctcctctcttcatccatctaagcaatctccaaggccttcagttttagcatactagcatgttcccatcctcacggccatgaccttattcaagccattagcatcactctgctgctcctacctggcctctctgccggctgtcacaccctttcaaacagttgccgaagctgatcatgtcactctggtgtttaaaatacgttttacatctccctgtggcgtagaatatttacactcttaagctgggagagaaaatgtccctgtactcctcatccaagatctggcccctgccagtctccccagccctactccttaccatttcccacattcccctcacatctcctgggaaacttggttttacccaaccccccatgatatggtttggctgtgtcgccacccaagtctcatcttgaattgtggctcccatgattcccacgtgttgtgggagggacttggtggagatggttgaatcctgggggtagtttcccccatgctgttctcatggtagtgaatgggtctatgggatctgatggttttataaggagaaacccctttcacttggttctcgttctctctcttgcctgccatcatgtaagacatacctttcaccttctgccatgattgtgaggcctccccagccatgtgaaactgagagtcaattaaacctctttcttttataaattacccagtctcggctatgtctttatcagcagtgtgagaacagactagtacaccccactttgttctgaaggctatggggccttccctgacagccctctgcccccaacaataagtggaggcaacaataagtggcctcagtgccactcttggggcatgggcaggctattgcctgagcttacctctcggtgttgacatggtttattgatgtatctgttctttctgcttccttatgtcccaagatcctaacacataccttggcactagcagttgcccagtaaatgtgtatagaatttaattgagtggacgaatttggccttttactggggagggctcaagtcttcctcatggggcccacctccaaagagtttggacacagtggtctgtgtcagagttgctgtcctcacctctccctaaaccctccgcctgttggtgggttgtctcttcggacccagaaagtgctgcaaggagcagaaaaaggttagttaattctttagattcctggaaatcttcttcacagccattcttggggccagggccagggctgacagaaggggggtaccgctaaagggatgagagcttggaaaaaaggaagaaaaggtaaaaagaggttgatgctaccaaggtggtaaacacttacctgcctttccctcttgggcacaatccccatatattaatgtaaatctctgcacagcaagattcccactgaccatttatccccaggaccctgaggaaaagaggtcctaccttaattcaccttttcctcagttgcctcttaacttctttctctaaaacaagcctcttcaactggtctctgcatcttccagcagggcccagcagacctgatcttaaccgctccctttcagtaaatctggtctcaaaccaccctggctttctcttttctgtctttaaaaactaaacttccagctaatattccagtcttccctggagatccaatttgtgggcagggccatgctatctcagtgttcttgctgagccataatggtaagagtcggtatttacttcttcctaacatctttccaataatctgaacatctagaatctttttcccctcacattttcattctctgtcatcaaaactcattatgctgttctcattccacgtatttaaaatgctcagagttagtgcggcatctgtgcttcccatggctaactgtgccttctagatgagtatccacagtagatctaattagcacaatatttacctctgcttcttgcttattaataaagatatcatggcagagcagactcccgtgacagtcctcctgagccatatccaggtgtatgagtgtgagaagaaggctatttgattatttgtgtgatcattgccataatgatgtgttcataactgtttccccaaacattcagcagacttctcagaagcaatcgtcagacaagtattagagttacttttagagtgacattttataaaatcaattaagcattggtgagatatttttaaaaatattcccttcaccattccaccctgtccacatctgcttatggatccagagcccctaaaatggaagaataacaaagtgaaaggcacagagctgggggaagagaagtgggatgatgagcaaattttctgtggggtcactatgcctgcctgccatgggctggaacatgccttgtttgctgtgccttgaaatgtgtctgctgggcattttggattacctagtaatgttctcatctaaatcaactggaactcatgtttgagcagggaaatttcataaataaaccaaatcaaagaagacctccgtctgcaacacttactttgaactcttcagttgttaattccagagccccaagggtatttagacaatgcaaagaacccttttgtgtaaaccattacagtcagggcattgaataggattgttctatacatattatcaatgtgtctggtaagaagaa

SEQ ID NO: 476979 - DNA, 610 bp, Homo sapiens
cagcccatgaatgggaaccggctcccttgtgtcagcactgctgagggctgcatccctgagctaccatagctgtggcagggccaaggtcttccctccctccccatcctttccaaaccagtcacttcacggttccagacagggctttcagtttcatgtagcatcccctgaggagcacaccaggttcatgcagtttctccctcaccatgctggagaatttaggacactttcgcttgaggcagggtcacaggtcaatgcagaacaacacatgggggcccctcagaaacctccctcccctccggcagcactccatgagggatttggcgcctcggtgcaaaactcccatagctacgtccccagctcaggggagcttcgcaaaccatacagttgcatagcagttgctcaactctaccaatatagtgcaaaagcaaccatagacaatatgtaaacaaatgaatgtggtcgtgttctagtaaagttgtattaattaattccaataaaactttactgaaaaatagtcatggacttgtaaatatttatggaccttgaaatttaaatttcctataattatcatatcacaaaatattcttattgtttttacgtatttaaaaaa

SEQ ID NO: 476980 - DNA, 558 bp, Homo sapiens
gctcggtgcctgctgacgaactctgagatcccaatggtgatgtggagcttcctattctgtgaaaaaccaagaaaaagatatggttgtatactcaaattgtacatcacgtttgtcaaacgaagacattccaatactgcttaattatagcactttatttttagctgctgaactgccaaaacagtgttgccattttcaagggcagggaaaagggagtaaaaggtgtatttttgtcaggagaaatcaccacataactggaaacactgaaaataggagaggggaaagatggctgacagagtcaggcttgacaggaggaggatggggtccaggacacagtgtcagaggaaagaggagtatagacaggaggaggtggggacacagttcccctactctgacaggaggcaaggtgggaataattggtactgatagatctaagtttatgggaggtgggaggaagttcatagagttcctacctgacaacctagattcatctgaaggaggagtgccagttaagagactgttacaagaagtatcgagaacctgagttgatgacattgggaa

SEQ ID NO: 476981 - DNA, 682 bp, Homo sapiens
cccaggtccatctaaagtcttccaagacatcttagtgttcatgttcctccttcgtactcagatcttagagttcatgttcctcctttgtacagatcttagtgttcatgttcctccttcgtactcagatcttagagttcatgttcctccttcatactcagatcttagagttcatgttcctccttcgtactcagatcttagtgttcacgttcctccttcgtactcagatcttagagttcatgttcctccttcgtactcagatcttagagttcatgttcctccttcgtactcagatcttagtgttcatgttcctccttcgtactcagatcttagagttcatgttcctcctttgtactcagatcttagtgttcatgttcctccttcgtactcagatcttagagttcatgttcctccttcacactcagatcttagtgttcatgttcctccttcatactcagatcttagagttcatgttcctccttcttactcagatcttagtgttcacgttcctccttcatactcagatcttagagttcacattcctccttcatactcagatcttagagttcatgttcctccttcatactcaggtcttagagttcatgttcctccttcatactcaggtcttagcttgtatattcctccagcttagatcagattaggtctccatgaggtgttcctgaag

SEQ ID NO: 476982 - DNA, 665 bp, Homo sapiens
gactgggcggcttaaacaaaaatgtattttctcactcttccggaggccagaagtccaacatcaatttcctcttcagggttggtgtcttctgaggtttctccttggcttgcagagggcgccctcttgtggcctctgcatgcggtcatccctctctgcaagaggccctaatagctccttgcagggcttcaacatgagttttggggaagcacactgccacccatacaaggagtcttctcaaaatggacggtgtgtcagcatccaccagtcctctctgaaaccctttccttcggtgtgtgggaccaagctccctcataacctcacaccgctctccaagaggcagctgattctgtggacccaactgcctctccgaagagcagctgcgcccttggtaaaggagaaagtagaaaaggaaaaggagaagctcagggagaaggggcagcagagagggggccgcctgcctctgtctctgcgcgcggtgtcagagccccggcaccgggaagtggtcgactggggggttggtaaaaagaatttaccgacaacagtacagctttgaaaaaggaacgtttattagaaaggaagaacgctacaaaaggatggcctgtttggtggtcaccaggtggtctttgctcctttctgaattgttcagataattagtttttatctcc

SEQ ID NO: 476983 - DNA, 539 bp, Homo sapiens
gaccaatctgcttcaaccaagagttcccttcaaagagcaatttgcatcttattaatggactcctggagacagagaggccttcaggaaattagcagtgagagcaggcatttggggatggcaggctggctgtggtctccaatgctggccctaagaaggcaaggcggcagtgattcagggaagttagacacgctggatctcataaagaggtggtcctgttcatgctgtagcaaaagcacccagagcctgcctgattcagaagggagccctgactgtgagctaaacctcatcttgcacaaagggcctgctgctccccacagcaaagccctgccgggctgtgggccacaagaagcatcaagaagaaactataaagaaccacctgctgtgtttctaaccactaggtcctcatgtgcaaaaaccatattgctcatttcatgcaggggatccaaaatgactgtgggactgcatgtggctttgtggtctcctgagacctggccccgggctcactctcatgatttcccggtgcttctctcatgaaagtg

SEQ ID NO: 476984 - DNA, 1074 bp, Homo sapiens
cttgcccaaatgttcaggggacaatgtcagagtgtaattttgatcatggccatttcaaggcatttgaaacgggattcgttgccgggttgggccaccatgaacttgcacagtcacctcaggaggccgagccttcagagatgacagcattcagcctcaggaggagcctgcaattcacccacggtcttcccagtatatcccttccatggggatacaagacatttcacaacagtgatgctatctgtaggagtagttgggaaatttataaatcttgcaaccctgggttccatgactctggatcaggaagcaacttatggaaaaacaagctgaatgatgacgggtcactgtttaactctgccacctcttcttcagcaaaattcaacaccctaccagaattctaactttgtcttatgaatgtggcttcaacctccgaacaaggagatgggttagttttccttgcctcaaagttgagctataaacaaaattcctctcatagttatcttggcctctatactagattaagcaaaaaaccaatttagcctgtgaagttagaagcaagatggagttagtcacgttacatttctctccttacttacaattctgcaaatttcttttctctgcttacattgcccatctgttctttcatatgatccactttttccattagagcccttagcctattattcacagggagggattttgttaagacacaatgtcctggatgtatttcacaatggttactttttcccttccctgaggaaatcaggagagagcctttctctggtgttctctctgagcacctggtgggggctcccctggagttaggcttatgaaagtgtgggccccctataatgggaccttcctaatgtttatgtttcaagctcatgcacactgagcctccagcaatttggcaattgctatttaggttttctttccctggtcctggctccagtggcctctgctcctggctatggggcctgaggtttcatcatacatcattgggtttattaaagcttaaaagtgatctaataattaacatgccagctactagttatttgttgagtttttttccttttt

SEQ ID NO: 476985 - DNA, 711 bp, Homo sapiens
ggaatgtcccaggaaggtccttcttcgccattttgtttcttaatgtgcatgcctgagcctactcaccgaattcctgagctgccaattaccaatttcaagtattttttatatattgtgaaattgcctctccctgggcctgtgaccaattatcgctctagtgtgacagttgtgggccatcaggaaattgcctctccctggctccagctgccaattattatttttagagaggcactttcagctaaagacagggttctttgtcccatggccataaaaattcaggcttgcaaacaatttgaatggcagaagcttggaagcacaggtgacagtctggacttgcctctggcaactgaagtaggggagcattcctgtgggactgagcacttaacctgtggggtccgcaccaactctaagtagacagtatctgaagtcaattgagttgtaggacattccaaaaaacccacacatttgatggccagaagtattctgtcttttttgtatgtggatgtccagttgatccagtatcattagttgaaaagaccatctttgctccattgaattgtctttgtcctttgtcaaagacaagttgactctatttatgtggatctatttctgagatctcacttgtatgtcatagatctatttcactaatctttcatcaatattacactgtcttgattattgtaactttatagtaaatcttgaagttgtata

SEQ ID NO: 476986 - DNA, 675 bp, Homo sapiens
ggaggagaacaaaccagaaagagaatgagggaagaacattctatacagatgaaagaaatggaacaaagacatgaaataaactgggcatggtttattaggaaaaccccattaggaatggttaaaggaagcaacggtgttaaacctagaaaaaagatcatggacattttgcaaaatgctgagaagcagagcatggagattggccctttaaagacacaccttgcaatccagagtgggatggaatctacttctggtgaagatgctgtgaacattgttgaaatgacaatgaaggatttagaatactatgtcaacttagtttatgaagaagtggcagggcttgagaggatttactccaattttggaagaaattctactattggtaaaacgctatcaaatggcatctcacgttacaaagaaatctttcataaaaggaagagagagtccatcgatgcctcaatttccattgttgtcttactttaagaaattgcctcacagccacccaaacttcagcaacaattaccaccatcaacactgtggcaagaccctccactggcaaagcttacaatgtgtcaaaggctcagatgattgttagcattttttagcaatcaagcatttttaaattaaggtatgtgaattgttttcttagacataatgattttgcacacaataaactgtggt

SEQ ID NO: 476987 - DNA, 520 bp, Homo sapiens
aaagatacatgcatgcgtgatgggcgacctgtgcaggaaacaaccatggcacacgtttacctatgtaacaaaactgcacatcctgcacatgtacccctgaacttaaaagttgaagaaaataaagaagcagtgggtaatgttcgtccctgcagaatggttcactacatctgcaagggccccagtggctgccagagtccacctagagaccagaagaaggctccacatgagatggctgcagctcttgcaataccctgcagtgatctgcagagcagattcagtgccggacacagggacagtgtgtgcatttcttccatcttcctaggggagctttccacaagttttccaagggccctttcagctgtgatatttttcccctccaaaattggagaaaatgcatagcgttccttgcaggaatcttttcaaaagaaaaacaatgggtagtcatggagaagacatgtaagaggctgtccctccatcaacattagtggaaagatctccatgtttcacccaaacgctgagc

SEQ ID NO: 476988 - DNA, 582 bp, Homo sapiens
tgctttctcttctttgaagaaatcgcagtaatgcattgtaggggacatcaaaagggaacagatgagtgtgggaaggctccatcagaggaattaaacctcagtactcccctacagaagcagaatgggccacttcttgagggtatacatttcggccctcaggatggtgacagtcggaggatggcaagctccacttgccagcctctagccaatggaaagtatcttcaaaatgacaatggaccctcatttaaggcagctgtcacacaagggggtctcaaaagcactaggcatagaataccatctccactgtgcttgaagacccgcatcctcaggaaagatcaagaaacctctgagctagtcaagcaggtaacttctctggctcacttgcaacaggaattagcacaattagcaaagccccaaccccaggaaattggaccacctctatttaacccaggagatttggtactggtgaaggctctcccttctctctcttcctaagcccaagctgggaagggccttacaccattctttcaactccctcagcaataaaagttacaggaatcaacttttggatacatcacactc

SEQ ID NO: 476989 - DNA, 679 bp, Homo sapiens
ctacagtcttcttacagtatctgatttagagaaacctcatcttgaatcctccacagctaaaatgattttgctgccatgactctgacaagctggaagaatgaaatcgttgttgaggctatttattgcacacttgagcaaaaagtaaggccttccaggggttacaacaagtttagctacagcatcactgacccaaaactaggctctgcctctgagagatgtaagagaaggcgatggcggccgggaagcagtccagagatgctgagacggtggatggcagacgtgtgggtacggaccatcaccacagaggaagacacagatgcccagagagatagcatttgtcctggagactggaagcccatccatgggtccagcaaagccttgtcccttgcgaacgctccccacgaaggcttgcgggtggttaggccgccatgtcttctgtttcacattcttattcctgtacccgaacgtggaaaccccttcaccacgcacctcaaaaccaccaggccgccacttcgccgcccgcctcaccggcaccattgcagccaactaactgctcaccctgcttatggtagtttgttgtgacggtcctaggaaactaatacacccttcaagcccacaaacactttccctcagagctcttagttgtgataaccatttactcacagctaagcacattctc

SEQ ID NO: 476990 - DNA, 473 bp, Homo sapiens
tggttttgactgtatctgcagtcagttcacagagggcattcctgaatgaggcagttacagaaacatttcccccagaaagaagcctgggaagcacaggaagcggtagaggttcctcccctgacaggggtgatttccctgtctggctccttgctgtctctcggaggctgtctccagctctcagttcttcagagctccgacttcacagcaatcacccccctgcagtcctctgggctctgtgttttgctccatcacgacccctttcctctcccactcttctccatctgttacctccatgcccctcaaatctccccatccttcagagccctccccttgaaccttcctccagggcatctgcccaggccattccagtgccaggagccctcgttattctcagattgcttcaaagctgtcctttcagggcagaactggtccactctgctccacggcaccctgccaacagttttgctttgaac

SEQ ID NO: 476991 - DNA, 638 bp, Homo sapiens
ctactgcctttgccacaaacagatcatgaagagctattttgaaaacgactgggccaaaaaaattccctggagccgaatcaactcaaagagctcaaacagagaacaggaaaatcttcctccttctctcccaagagaccagaccatgaggcccccagagctaagcacccacagtgagggctgcctccttgcactggcgagagcacagtccctaatgccagacccaggacagtgttcgtggccttgggtgctgcagactgacaggtcttcccccaacagccactgcagcctgcaggtgggcagcttcccagaggagcctcccaagatccttcactccccggcccaggagccagggcccgcacgggattttctagcagcgcatccaggtgagctgctcacctggactatgcacatgggttcaggtctgacagccccggggctagccagggatctggcccacgaggattttctttccatgaaaaatgcacacatgcatgtatgtgtggaaaacggcctgaagggacccccattggtattatcagatgtcactgcaagatccctgaattttacaatggctacattctgtacaataattttttataaagatgactgaattttctgaataatgaatgttttccctc

SEQ ID NO: 476992 - DNA, 721 bp, Homo sapiens
ggctgggcgcgatggctcacgctttggtctgttgttgtgcagatgtggagaactgataagcgacgtggaaggagaaagaaacaggctgcccaacacagctgctggtgtcccttcagacccagggacgcatgtcagaaccagcaccaaccattaggtggcgccgttgtagcacaacaagcattgacctgggttggcgacaaatctgaccccgctcccggtggaactgccactggctctctcccctgtcatggggttcccacaagcctagcagctcggagccccaggccagtggctgcctctccctgggaacacacctcaggggcccgctgcccccaacggctctactggatgtccccctggcatcgcgctgctcccatgtacccactgctctctgtgttctctaaatccacgaatgccacagccatccacgtggccaccctcaccagtcgcgggcaacacccccgatgcccccccgtccactttctcaccaaacctcctggtcgttctgctctcacctgcccgtggctttgtccccaccgtgagttctcctgtgaaattccctctggattatgtaaattctttttgccccccaaactttctttaaaaaagtttttaaacatataaaagtgcagaaaatgtcataacatatacctatgcgtctactactcagattttataaatgctaccattagccattacatgctttgaatttttaaaagaa

SEQ ID NO: 476993 - DNA, 559 bp, Homo sapiens
ccggaagaccaaagtaccaggatggcacggatcttggtgtacatacggcaacattcacttggacactgtcagtgggtcacactgagccccctgaaagaaaatgatgacaacacaatgctcctaacacagggtgaccacaagcagttatctttctcagcattaattcagcccatcctggcattcttgggcttagaacactcgacagcatttccgcacaatgttgagggcattttaaatggcaaaatcaccaatacaaatgcaaaaaacatatccctaaatagactgcagaaaggacacttggttcacagtacaggagctgacacaagaggcagaccattcttcctcacttgtctcatagaattgaagagtgttagagccttcctctggattaagccttggcctacgggaatgttgtggctggtttgactttctatccaggtgattaaaactcttcatatcagcaataggctgcttcactttcttatcacttgtgttcactgaagtagcactattaatttcctttgagaacttttcctttgtattcacaacatggctgttc

SEQ ID NO: 476994 - DNA, 883 bp, Homo sapiens
aacggaagataaatgaggatttcacgtcttccttgcccttgtcctgcagtggggtggagagagaagccagacattctgtttctaacatacttggagccctatgctcagggctacaccagggtccaggggtcttgtggagccccaaggcactggagctggttctctctctggcctggttactgcagagatgcctatagtccatccctggcctctacccactcgatcagtggtcctcgatgcttttgtcgccagggaccagtttcatgaaaggcaatttttccatggacatggggcgaagggtgcggggagatccaaaaaagagaagaaactgaaagacaaagctgggcgagttgaccatgtggacagtctgccaagtggaccagaatgcttctgttcactggcgaggacaacttctctcccggacaaagacacagacacacgtacaaagacacagacacacggacaacctgtgactgcttgggatcccttgggctcctttttgcgagatttcacacagtttaaagtagagatatcatggggaaaagtgagaagtgacatgtataattatggtcacattgagggaggaagagacaccatctggaatgcaggcagaaagccatgtgaagctccctgtgagggaaggactgtggaactgtcaatcatgaccatgagccttatgcctgaacactctttcagatcacaagactcgtgtgtggaactgccatgggtccgtgggctgccacagaattatgcaggaaataattttcaaggaaacaagaaggaaaacatgattgggtccaaaattctatcattgttttattgaaaaagcaaatctcttctctagcttgaaatgctagagctacaatttatttcttcttaagtt

SEQ ID NO: 476995 - DNA, 1598 bp, Homo sapiens
aacagcttcaaccaactatttttgctaactagtctgaaatgttaagtatggaggcaaaagctgaagctggagcaacagtctcagaatatgacaacaaccatgagaatggaggccattcatagcagaactacgagacaagaggagcctaggtccctgagctgcagaactgcatactaacctgatgagaagactaatgctcagtgaggtgaactccttcagggccacaggctgtaaagatctaaacaccatctgatccagtttcaatatgactgcctggatgaagaaggatttgagactaagtttattcctccaaagcaaaccaactgagaatgcagagacagggtcttgctatgttgcccaggccagtctcaaactcctgggttcaagcaatccactcgccttggcctcttaaagcactgggattacaagcgtgaaccaccatgcctggctgaagattcaagtttttaaaacatctgatttccacttgaaaccttgaattgtatcattggcaacaaataatgtcagttattttccttgagatgacaacttcacttagttattttcaagaaaactgctgccatgtagccaactgtgaatgaccacagtttgcctgtcagtcattctgtcaagtaaaatggtgctcctcaaacaaagcagcacgtttagctcacaactcaacaaccacacagcagtcttcctcccacccaccatggcacttatattaatataagcagcagaggtgctttatgtatgagtattgtgtgaaaatactcaaaagacctgtaaccaagggtcaagattactacaattaatttctactgcttcctaagggcattcttaagtgacactagcatattttacaagccagagtgtaacaatgagcacaatgactgctaccacagcttgctgccagccattgccttgacttgtcctaaaacacagccattttcatccgcctccatggctactgcatcatcagtgcaaatgaaacacttaacgcactctctgattgtggctcttaactcgccagagtatcggagagcagggtttctggaccagggctccctacccagagcaacgggttactggcaaaggacagcgagaggatctacaaacgcttgggaaaacatgcttaacaggaagctcactgacctgattgtgaggatcagaaacagaaatttgagggtggagggggaaaactctgtgaacttacaggacagggaacaagacatgaggaaactgaggcttggagaagtaggctccaagcaggctttcatcctctacactaaactgcctccagagaaagtgccccagagcagaacaagccttggaatgctgtcgtacccctggcccatcctgagggatgctgctgtacttccctcacagcgacctgtgtggaaggagaatggatttaaggcacccaaaaagtgaaaaatgaccatgacacagagctcaaaatgcagaaatactttctaaagattaaagtggtccaggacattggagactacaaagggtgggagggtgagagggaggtgagggttgaaaaattacctattggggacagtgctcactatttgggagatgggcgcactaaaata

SEQ ID NO: 476996 - DNA, 1096 bp, Homo sapiens
ctcctccccttgggaactgcaacagcagcagaagagctgcactgcagccctcaggacttgctgaagaccccagatccttgggtgtaggccagcaaaagcaggaagcataagccgggcattctgccatccttttacgtgcttagtgatcaaagagagaaagcaagcaagcaaggttttcctccttcctttcttccccctcctcatcctcaccttcgaaaagttacctcttcagaggcagagttttgctctgttgcccaggctggagtgaagcgctgaaggagttgaacgagagtgtgcgtctttgcatggcaccattcctgatgtccaaattatatttgtcgatggaagccgaattaagtttaactgacttcctgccttttcctcaaggatgaaatctgtgagagaattgttgctgctgctactgatggtgggcatccaccttaaatggaattgcattcctattatgcatatcgttaaaaaatcttacaaagttttgagactaaaaaacaaaattccaagcggtccttattccatattcatgggcactgcctggaatgggcctgattgttgtgatgagtttgagtttgtggccatttttgctggtccttattccatattcatgggcactgcctggaatgggcctgattgttgtgatgagtttgagtttgtggccattcttgctggtccttcaaggaagagcaaagggatgtcttacatgggagaagacaagagagcatgtgcagggaaactcccctttatagacccatcagatcttgtgagacttatttactatcaggagaacagcacaagaaagacccactctcatgattcaattacgtcccatggggtcccacccatgacacatgggaattatgagagctacaattagagatttgggtggggacatagccaaaccatatcaatactgttatgattgtttccttagtatgcattctgagaagtggaattcctaagtcaaaggattctgtgcatgttttagctagtaagtttcttgttaaaaataaatgatgcttctactaatacattgaaaattattataataattacccccctccatctacttttctttcaaaga

SEQ ID NO: 476997 - DNA, 565 bp, Homo sapiens
ttaagtgctgtatttgtgtcatttcaaagaggcagtcactgaaatgtaaaggaatgagcacaatgtcctgctttgtttatctgagaaacaccagcagctcccagacgcttctgttttcttcaagaaagacagaaagagagaatctggctgtatttgctgtgaccaagggatggagccagaactgggctggagaggattttcagcattcctctccagcccagcaggtcaatggggactttgataaaaccataatgaagatgatgaggggtgcagggtcttcctgcttccctttcatcctctccaacttcccagctgcccttccttgtggtacccagggccaccttcagtgtgtggtccaggatggatccaggccttttctcatgagctcaataaacctcattccctgggagaagcatcatgattgggctttaggaggtcatctgattctggtgatatttactggtagaaatggctgatatatgggatcacttggcagtatttaataccttttaaaagagaagcccattaaccaagattatggtagaatgtggtacattttttagct

SEQ ID NO: 476998 - DNA, 570 bp, Homo sapiens
aggcgttcgtgcaaaataataccctttgactcctgcacccgacacagatgtttctggagttgtcgtccatgtgccagaagttcctaccatttactgagatccctccatttaaggatactccctggaaatttcaaatgacacttctgatcatagaccattggccacaagttggcatattcacaagtggcatattcacatgcccacacctagcttcagaggaggctgggaattggagttattccaatccagaatggtgctcgcatcaagcagccatgtggccagttaaagaatcagggcttcactttctagaagaagggaattgggtagtgggaacattggtggtctgtaacacaggcttgtaccaaattactctcctatcaacagaatacggcagctccttctcctccatgttttcatttaaatttgatgttctagaaaaaaaagggaaaatccagggtggtgcctatatcaagaaatctttcccagaatcctctgcttatgtctccctgagagtaaaagtcacatagccatgcccagatgcacagagtctggataggtatacttgggaat

SEQ ID NO: 476999 - DNA, 475 bp, Homo sapiens
agatcctgcatcaattgcgtgatgatttcaggggtaatttgtgaaaactccataagcctggaaattacagtggacccacatgcatgggaatttggcgagactcagtgtgagtacaagtcttctccagtgggtgaggaagtcaaggagccttggaatggaaagaagagaggaagcttgatgagcagatgccaagtaaatgagaagtggagtctgctctcagagttgacagcccaagttgaggatttgacgtgtaaaatgattgttggtgttcacagacctcccgagggcctcagctcggtatcctgtgttacacataccacgatgccaaggaaggttgaccgcattaaccaagtgttctcacaggtcttgcagccagatctgtgtggagaagtattttctttaattcaatcattaagtttccaggcctagcaaactcacttcttgaaaataacaatgaattttaagtacagtgggt

SEQ ID NO: 477000 - DNA, 638 bp, Homo sapiens
tctccagggttggaatagcgacaccttttgtcctcacttatatgaataggaaggatacaatttctgaggctccccatattctagcttcaggaataggttttgttaggcctgttagtctgaggagggatcctaaaattccaagtagtccccaggacaatggggctttgggcaaaaattatgtctttctgattggtgagcccaggtgcctaaagaaggctcagcccagaagtacaagaaaagtggaagctggttcgaggcacaccaacgctcccaactccaaagagtcgggggttgttagagagccctatcccagaaaacctgacacccatgtctttagtctggcggccacgctagtcgcttttaactggccgacagctgatagcttttctgtggtgcaaacccccacctacatgtaccccacatatgtgcgtgcctccactgtccttgcataccctcctgcactctttgcctccttctgacaatgtcccttccacttctatacttgcaccccccttttcatgtataacttatttcttgtttctccctaaaaacacactatttgcagatctaaaatattaccttaattcatagtcttcattaaaattagattctattgtaacttcagtacactgttcctg

SEQ ID NO: 477001 - DNA, 1101 bp, Homo sapiens
tgagagtctgagtggatcctccaacaaagtttgaggagagggaaaagctctcccgactcctaaccgatctaaaacttctccacaaaaaaaggagaacaacaaaaaatccaataacagctgcacataccaccagttccgatggaaaaccataaggattctcatctggtctcatactctcaggtagtgctgccacaactctgcgtagctcctccaggaccagccccaggtagggctgaggggtagcaccaggctcctccatagcgtcgaggctgctctggcggtcaccgcagtaacactggccacaacaagcggtggagaacacgcagccttgggtctggaacccgaatgcgcacgtgacaaccaaccggagcggaccactgtggagcgggctgcggggggagctggggaacgcgggcacccacaggcctcacaggcccatgttgtcccccaccacctcccctggccctcttgttacacttcacatcctgaggcagcgctggtctcccctcttcttagccaactgtcacatagctaaggagtcacagaaggaccaaaatggcatgtatacacccatttctaggttctttctctctcccatatggtacattgacccccaattcctaaccaatttagcagctttgaactctattcattgcttcttttggttcccaagaccactaacccctggttgggtcccattttcctgtaccaaggtcaggaagatgcctttctggaaaatcctggcaaatgtggtactaacctcatgtgcctcaccttccttaaagatctcatacctgacttgctacaacaatgttcttcaatgcctgctgatatggtttggctgtgtccttacgcagatcccatcttgaattgtagcttgcataattcccacatgtagccagcccacctgaaccatgctcagcagctggtgagagttgaaagccatcataaggtaaaatattattgcctaaaaatactctgcttctctggaaaataaaaaagacagaagtttcaaagaaatctttcaagagatataaaaatcatatgaaaatgaaataattaaagaataaatctgtaattatgcatgttgtaaaatacaaa

SEQ ID NO: 477002 - DNA, 527 bp, Homo sapiens
cacttccatctccacactgagctggaatccaaccaggatgaattctgtgacccgaacctctggaccctccagtcctcagttatggccgccagtcctcagttagggccattatggcataaagtgtcttcttccttcacagctcaggacaatcccttttccaatgacccgcctgcctgcagtgagaacagggttgggtgggctgccctgactgggatagttcttgctctaatgtcctggcttcccacacttaaagtagcagccattacctgcagacagcgtcctctgcagtgctctgtggagggcgcccttcacctgagcattcctcagactgtagatcagggggttcagaattgggttcaagacactgtgaaacagggacagcattttctcctgctcctctcgttgattagagtctgggactatgtaaaccaccatggctatgccaaagaagagtccaaccacacacaggtgggaggagcaggtcgagaaggcctttatgcggccttcctttgtctggatctttagga

SEQ ID NO: 477003 - DNA, 1868 bp, Homo sapiens
aagccctcgttagaattttctctcacagttgcaatgctgcttggccccaacattatttggaacctggggttcaatgtctactgggaaagtggaacagcattgcatgtatccaggcttttgtgctgtagttctaagcagggggcctggttaatgtatgacaccctcctttggtactgtttggccccagtgatctatggagtctggggaggtttggcctttaaaaatcaaactgccatggagactgttttacccaaaattttggttcacagtcttcattggattgtctgttggggcaaagtaaaaccggcaagctggtattgctatctcatggctaaggttccaagctattggaacaagacaagtctaactgtcccactatacacctccaatacaatgttgaatcaaagtggaagtcaatgccaaagtgatgcagactttccaggtcatgatggtagaatatcggagagggtggcagatggccacgtaccgatcataggacatcaccaccaggaggagacattctgtatgtgcaaaactcaaaaacagaaacatctgggtcatgcagccagcaaaggagatgggcttggctggatgcaggaggttcaccagcatctggggcaccgtgctgcaagcacaggcgatgtcgacgaccgccagtttgtgatgattacatcagatgcttgccttctgtattccttcattgcagggtacttatatccatgcatgtggaagtgtgctggtgtctatgtctatatataaggatagaaagagggatgatgaccatgtcaatgatcctgctatcaggtcttctcaccaattttctattttattagtattttttgaaaaaggaactaagattctattttaataatgtttatcattctttatttttccaataacgtttgctcttatataaattatatactatttttattttaatttttggtcattgtatatttctgagttgaatatttaacttattataaatcttacttttaaaataaatgtaattttagctgtaaatttattttcccccaccattttagccatacattttaagtctgacatttagaactttcattatggttgatttcatcttcaaaggacaaattatgaagaagtgcatttttaggtttccaaatatttttgttacatttctgttgttaattttacatttattatcacctgtggtaagagaatgaatccttgtgatactgattctttgaaaatatgaggggtttttttgttttgtatatattcactttttgcaattgttatattgactttaatgtatatgctttattttagggaatgtaggaatctttatatatctgtttgatcaagcatgtaaattttttgtagtttttatttccaatttttgtcaggattatctattattttctgagagcatttttctaattcccccactaagaagttgagttggtaatcttttcagtgtaattctattttttttcctatttctacattaaggttatattgttgtatatacatatttatgattgttacatattcttgatagagttttacctctattattatggagtactcttcataccaattagtgcatttgcctgatataaacatgagtgcaaacatccagcttgtatttatattgccgcatcaacttattaaatatttgcataggctgtgttcttcattctcatattcccagactttctttgtgattgtgttttagctagtcttacaaataatatataactgtattttatgggcttaaaaatatgaaatacaatacaatatgaaaatgggaaaatataatcaattttctctcagtgtaaatattgagatatttgggctttctattatttgtgttttgtgtttagcat

SEQ ID NO: 477004 - DNA, 714 bp, Homo sapiens
ctctccttacaacctcaggattccgagagcccagtgtgcaggcacacataaaggctctgctggctctcctctcttttgccatgctcttcatctcatatttcctgtcactggtgttcagtgctgcaggtatttttccacctctggactttaaattctgggtgtgggagtcagtgatttatctgtgtgcagcagttcaccccatcattctgctcttcagcaactgcaggctgagagctgtgctgaagagaaaaggcagggcagacatgctgaaaggtttaattggatcaattagtccaacactcaatatttatatagacgattttccagaagacagcagatcaaggcactggcagattcagtgtctggtgaggaactgctctatcgatggcatcctctcttggtgccattctcacctggcaaaagtgatggaagagcaaaaaggcaaaaggcaaaagggcaaaaggcatgtgggcactcccttcaatttcttttggaaatacatacaaggcaaaggatctaattgcttgggctcctcaacccacatgtcacctcctgagaaagctgctttcagccctcaggtgtatgggggcaacattttcttctccagccagtctccagaaatctaacccttctattgtcttcatagaattgattattatctgaaagtatcttgcttttgttgttgcttattgtcacttaccttctatcggactg

SEQ ID NO: 477005 - DNA, 928 bp, Homo sapiens
tagtgaccaaatcaggaatctgagacatctggaaacctagacctgaggttttcaggaaggcagccccagtattaagaagtccctgattgtgacattaatgggaaacacggtcatcattgtgattgtctgtgtggataaacgtctgcagtcccccatgtatttcttcctcagccacctctctaccctggagatcctggtcacaaccataattgtccccatgatgctttggggattgctcttcctgggatgcagacagtatctttctctacatgtatcgctcaacttttcctgtgggaccatggagtttgcattacttggagtgatggctgtggaccgttatgtggctgtgtgtaaccctttgaggtacaacatcattatgaacagcagtacctgtatttgggtggtaatagtgtcatgggtgtttggatttctttctgaaatctggcccatctatgccacatttcagtttaccttccgcaaatcaaattcattagaccatttttactgtgaccgagggcaattgctcaaactgtcctgcgataacactcttctcacagagtttatccttttcttaatggctgtttttattctcattggttctttgatccctacgattgtctcctacacctacattatctccaccatcctcaagatcccgtcagcctctggccggaggaaagccttctccacttttgcctcccacttcacctgtgttgtgattggctatggcagctgcttgtttctctacgtgaaacccaagcaaacacagggagttgagtacaataagatagtttccctgttggtttctgtgttaacccccttcctgaatcctttcatctttactcttcggaatgacaaagtcaaagaggccctccgagatgggatgaaacgctgctgtcaactcctgaaagattagctgttctattta

SEQ ID NO: 477006 - DNA, 987 bp, Homo sapiens
gggtcttggggcacaacctctggggccccatactgtggatcatggcaaatctgagccagccctccgaatttgtcctcttgggcttctcctcctttggtgagctgcaggcccttctgtatggccccttcctcatgctttatcttctcgccttcatgggaaacaccatcatcatagttatggtcatagctgacacccacctacatacacccatgtacttcttcctgggcaatttttccctgctggagatcttggtaaccatgactgcagtgcccaggatgctctcagacctgttggtcccccacaaagtcattaccttcactggctgcatggtccagttctacttccacttttccctggggtccacctccttcctcatcctgacagacatggcccttgatcgctttgtggccatctgccacccactgcgctatggcactctgatgagccgggctatgtgtgtccagctggctggggctgcctgggcagctcctttcctagccatggtacccactgtcctctcccgagctcatcttgattactgccatggcgacgtcatcaaccacttcttctgtgacaatgaacctctcctgcagttgtcatgctctgacactcgcctgttggaattctgggactttctgatggccttgacctttgtcctcagctccttcctggtgaccctcatctcctatggctacatagtgaccactgtgctgcggatcccctctgccagcagctgccagaaggctttctccacttgcgggtctcacctcacactggtcttcatcggctacagtagtaccatctttctgtatgtcaggcctggcaaagctcactctgtgcaagtcaggaaggtcgtggccttggtgacttcagttctcaccccctttctcaatccctttatccttaccttctgcaatcagacagttaaaacagtgctacaggggcagatgcagaggctgaaaggcctttgcaaggcacaatgatgag

SEQ ID NO: 477007 - DNA, 825 bp, Homo sapiens
tgcctcttcctgccaattgtccccattttccttgtcaaagatatccatcagtggtggactggataaagaaaatgtggtatgtatacaccatggaaacgtggcatatatgcagccgtggaaaagaatgagattatgtcctttgcagcaacatggatggagctggaagccattactcttagtcaattaatgcaggaacagaagaccaaatgttgtgtgttctctcttctatttaaaaaatgcctggcagcagccctatgtggcccctgccctgggagcagcccagtggagagggggcggctgtgtgctgaggagccgatcaggaccttggcaggggaatcaaagattccttttggggtatttttacagtctccaagctgtgtgcttgaatccagcaaaagggagaggagcagcattgaagaaaggcaagtagtatcctggcacagaggagctaagaacatagacaaagttgtcaatgccatttggtttcaagatatagctgacctggcatttgagaaaccagtgaggaagcctcacccattccctagtgtctgcaaaataattgctgacatgctctccaaccttttgctgcaggctcttttcctcaatcaaggagtgtttgtgggtctctttcccatccatattgttgttcagctgcggtgctagcaaaaatggctgttcaattgaaaaaaatacgagcatattgtcctgcctcacattatgtagaaattgaaatgtaacatagatagtagtttaaatattaaaaaataagaagtttggaagaaaacatagaaaaacatttttaaatatcttaaagaatatttgttt

SEQ ID NO: 477008 - DNA, 2185 bp, Homo sapiens
ggcatagagagatcaaattgaaaccattcaagtcaacctttcgatcttgcagcagctcgttagtgcccttcgtgccatttcctcctcctccacaatgtgggatggcacccagtgccctggagagcccagtcctcccctagatgagcaatttgttataggaaccatttacaatttcgtatcaaggagtttacaagttgtacatgctgaggaacttcctgcaggcttcccaagcagccaggtcatacaagctctggagcacagcgagaaacattgcgagaaattctgccgtatgcatatgctcaatactgaaggattagagaggaaggaggagccaatcttggtgataaagggacaaagaggaccagagaatttaagagcctgctcagccatgcttcttgccctgagcctggagcgcaggcattgccttactgaaggtcagtcttctgatgaccctggagagaggaccagaggggcctcagggatactgaagaggagcatctccttttgctagagctaggtaatacatctctgatgatgatttattctagtttattctgtataacttgtgctttgtataccacactcttacaaacatatatacatttgcacatagatgatgaatctttttgctatgttgatgagtgatgtctttcatataaccacaagaagatttttttttttaatgctattcactcattgcagtaggcagtagaataaaaatataactcctacagtgaatgctaagaggacaaacaaaacaaatacaaataggcaaagacttgaacacacttcacaaaataatacaaatgatcaacaagcatatggaaaagggcttagtaagttgtcaaaaaacatccataagaaggactaaagttactgaaaacacctagtgttgctgaggctgtggcatcgttttggtggaaatgggaaacggtactttggaaaacttagcaataaaaaggaacaaactactgacacatgcaataatgtaaagaaataatacaattatgctgagcaagagaaactaaaagcaaaggagttccaaatacatgatttaatttatatgaagttctagggcaggtaaaattcatttatggaaatagaaatcagaacagtggtttcctctggtaggagagatcaagtggaaaaggaccagagaaacatttctgagtaatggaactgtcccgtttcttgattgctgtgttggttgtatgagtacatatattcatcaaaactcaccaagctgcactctcaagatttatgctttttagcatatgtaaacattacttgataaaagtgtattacacaaagaacatgaataatttagacaatttttcccttataactatgaactgaacacatcgtagatacgcataaaatcttgtacagatgatcattttcaagtctgattcagttacggtattctagatttgttcttttctcctaaaatgaatttcattgcttattctttcgttatgttgctactttcatttatgattagattaactggttcccaataaaatctaaaaactgcatcttatttgtttaagacattaattttcattatttgaaatgcatcattttataatacatattaaatatgtatacatttcactatttttattaaaaatctgtatttgtaaagtgttttccaaatcatgtaaaaatgtgcagtacattttcagtattctgcaaatcattgaccaatatgcaattatataaaatttacagatctgatgttaaggaaagaaggtagctgaaatgaacgcattagttaaggactataatcttcaaatcaaagagtcactgaggggataaaaatgactaggaaaggatccctgctgttatttactttgaatactttcataatgtttaatctcatattgccaaacagaataccttatattcattttttaaccaaaatttcctgttttgatggtgataataaacatataaactaagaactagatatattctcatttaggattaaagcctttggccttttgaacagtatcttggtaacttttggtatagtcttgtggtgggtaattttatgtgtcaacatgactgagtaaagcaatgcccaggtacctgcaaaaacagtatttccgggtgtgtccgtgagggtgtttttataaattagcatttgaatcagcagactgaatatagaagatttaccctcacc

SEQ ID NO: 477009 - DNA, 795 bp, Homo sapiens
ttctccttcctcagcttccctgttttctatcattatgtcttcaagtttactgactcatctgttttctaacccatccatgcatttgtcatctcagacgctgcagtactggatcttagagtacaataactctcaggtggagactgagctagagaccctgagagagagttcaggacacacgtgcatccaagacccaccaggcctcccaggacaggcagtaactgagcttaaccctggaggtcaccgagaagatagccaggaagagaagtggggttgggatctgatctttgtagaccgtattttgatccaatacccgttagcacttctatgcacgggacatctgcctgggagattagtgtttgggaggaagcctgttggcaacagaggattacatgagaacagtgaactcattggtcaaagtggactgggagtggatggtacaggagcgtgagaagctcccaaatcaagagagatgagagaacagaggatgagatttctattcaaattgcacttaactaattgccagtatatctgtttatttattcatttatatttaatctgcttaattgggggacatatatatatataataaacttaccaattttaattttacagtagtatatcacttgtgaaatcacctagttcaccaccagtggtgcttaattgatacttcagcaaactgccatcttattaaaaactttgtgtataataaacttttgaatatttctcataaactggtttgtaaacctgtggattgacaatatttgttgtttcttcattcttttcattatgtaattt

SEQ ID NO: 477010 - DNA, 572 bp, Homo sapiens
aggccgaggaggcgcccagagcgagcgagggctgcctaaagccaggatggcactgggtcttgcccaaggcccacactgtaaccacaacttgggtattgcctgtatttattcagggttctgtggatctacaatcagctggtgtccttcccttaaggttgatgagtttccccaggccccaggcaaaggagcctcacctcatggccaccaccaccacagacccacagggagtactgccatgctactgtccatgttctcctcaggccccaggaacctccagtcagcttgtaaatgctacctcacttgggactctcctttcatagcagtaagcgtccctctgaatgtccaagacccaaggcctggaataaggaactccaagagcccacttggtgctatacctgtggccaagctggtacctaacgtgcaagaaaaagtcctcattgcttttccccctgcttttctcaagcagaaggaactcacctcatagccaccacagctgggaatatgctgagtctcacaagaagccagcgagtcttagagtctcacccaaggtccacagtttactacttaggtat

SEQ ID NO: 477011 - DNA, 605 bp, Homo sapiens
aaataacaaagaaaaatttacttattagaaacatcgttcttgatggagagggaaaatatcttgctgaaaacaaaacaaaaaaaaattaactgtaaacagacagaacctctttacctatgctctctatgcttctgctaccaagtggctctagaactgtggctcctgtttttagctatgattgtaggaaaatgggcaaaggacctgaatagactctcctcaaaagacgacacaaatggccatgggtacctggaaagatgttcaacatcactaatcatcagatctggaagtcaggctaattgggaaatcacaaataacatcacactgagggagcttgtacagaaagaattaaatgaagcagaaaccaagaaaagcaaatatgaaaaaacaataataacctacagagaaagtgaaagagtgggaatcagtcacttgcaggacttgcgtgaaaactgtgctctggtatcagttaaaaataagcagtgagaaataaacttaaagaactttctataagatttttgggaattttcccctttatattaacactttgatttcaatctaagtttccttaggagtgaatattttaagatttagaaaatattgccacc

SEQ ID NO: 477012 - DNA, 657 bp, Homo sapiens
aagtaggtttcagaagacggccacctaaaactgggggcagagtgacataaacacccctgtgtccaccaccaatatggctgtcctgggtcagacccgaagccagcacagcactgggtctcacctagagcctgctgtaatgactccctggctactgtctatgtttgctcaaggttctacagctctactatcagcaggtggcaaagccagccagaccctgtctttcccttcaggatggcaagctcccccaggccaaggtgatatgaagttaaaaccaggggatcgggggccacaggcacccccacctagatgctgccacagggcccacatggagtatgctcctgccagagcccaaaagcgctggttccagctcctgcatctactcaactgtgtgctccctcccacaaggggtgggacacagtgggtccgagtaagacagctcatgggtttcatgaccaggactgctggcagggtctatggacctggtgtctgggtccacagatgtggtgttggtgatgccccaccctcatcaactatcattgctattctgggggtgcttcacattgcatagttagttttgcttaacatgtttgtagattagttcattcataaagtgatcctcagttaccttgtttgagtgtatctggcttatctgtttca

SEQ ID NO: 477013 - DNA, 479 bp, Homo sapiens
cttcttcttatcacccatatcctactccatggtgagtcatcaccagcacagccatacccagtcacgggagtgcagcagccttcactcagatctaagccccgagaagaggaacaaagaggagaaggggtgttaccagagtctgggagttgtagcacgtgcagaagatggaccattctggaccttctcagcaagctgggatcttagaagaaagaactatttggtgggagatggagccactgtggacatatgcctgcccttggaggtgccccctgaggcagagagagaaaacaagaaacatcctggtttcatctctgcttccaccctcttccccttggctgaatctttgcagaagtcagaaagaaaagagcctggggaaacagttcctcgtgatacagagcagaacagaggaagccaggaaactgacctgcaaacaggcaaatgactggcacagagtatttgtaggagtatttgatttgtgc

SEQ ID NO: 477014 - DNA, 532 bp, Homo sapiens
tgctatttcttgtttttaaaaatgcatctgttggtgacactggtggagaaacatgtttacgagaaaacaactgactttttcttctgctgttactccaggagatttcctaggagctcatactgtcatttaaattccaggtgcaggtcttctgaacaaatgcctcctgaggatttctgtgcctggaaaatatctgttaacagactgcttttacacctacatgaggagactgaggcacagagagttaaagtgatttgtgcagggttgtgtgaggagctggtggcagagcttggcattctggctctggggtctgcatttggccatctcaccgtacagtgtcatagaaacaggaaactcgagaagataaactgccaggctgtattttggagtcagtattttaacactgtcaccatctcaagcatgatctgtgggactcatcgctgtgctctttgacttgaacttctttaaggtatggtaagattttgtggttatgtagaagagtgtcttcattttatagaacgacctcaaagtagtt

SEQ ID NO: 477015 - DNA, 477 bp, Homo sapiens
tggagtcaggagactcctgggtccctccagtttacctacacgggatggctgacttctctctccaaacttttgtctttgtccacaaaccagctgatactaatcaaggcacatctgcacacaggagtgtgtggccattggaaatgagcgtgcaaatggacacgttggaaacgtgtgcaaatgatcacgttggaaaggagcatgcaaatagacatggtggaaacgagcgtgcaaatgcacacgttggaaacgagtgtgcaaatgggcacattggaaatgagcatgcaaatggtcatgttggaaatgagcatgcaaatggtcacgtttctggaaggcaggttgttaagtgtgtccaaagcccatccttctacccaatgatctcacatgtaggaatttatcttacacacatcctgacaagacacatgcacgatgatgtatgagtgaggtggttcacctgtgtattatttctaacactaagac

SEQ ID NO: 477016 - DNA, 1487 bp, Homo sapiens
tggcacacctgaagctgagccccgcggagctgcgccaggtgctgatgagcatggagccccggcgcctggagcccgcacatctcgcgcagctgctgctcttcgcgcccgacgccgacgaggagcagcgctaccaggccttccgcgaggcgcccggccgcctcagcgagccggaccagttcgtcctgcaggtgccgcgaccacaaccccgccccgaggcctcggccggctccacaggggctgtcgctgtggccagggctgctggggtcccgcgcgccttcgggggccgccattgcgcccaagcctctgagtcccagtttaacacctttaatggccgggtcctatcaggggtccaagttcccgaatacaagacacgcctgcgcagcctccacttccaggccaccctccaggagaagacagaggagatccgaggcagccttgaatgcttgcgccaggcctccctggagctcaaaaacagtcggaagctcgccaagatcctggagtttgtgttggccatgggcaactatctcaacgatggacagcccaaaaccaacaagactacgggcttcaagatcaactttctgacagaggtgaggggacctgccggcagcaatcgactggtttgctctaccagcaaggcgctaacgccaggcctagctcagttgtggcagagggcagaagaggacatcctgaactccaccaagacagtggatgggaagtccaccttcctgcacatccttgccaaatcgctgagccagcacttccctgaactcctgggctttgctcaggacctgcccaccgtgcccctggctgccaaagtgaaccaacgggccctgaccagtgacctggctgacctccatggcactatcagcgagatacaggatgcctgccagagcatttccccctctagcgaggacaagtttgcaatggtcatgtcggcatcctctgagcagcctgttcctgcaccaggctggatcctggggtggttggaccctgggggcacaagcgggctggctgtttccttaactgaggcctgtcagtccttcctggagacggcccagccagcacttcgggcgctcgacgggctgcagcgcgaggccatggaggagctgggcaaggcgctggccttctttggggaggattccaaggccaccacctctgaggctttcttcggcatctttgcagagttcatgagcaaattcgagctccgggatggtttcacccctggcctggtgacagtggccacaccgcgtcctctgcggcctgagcagggagatggaggccgagagggcagcccagacactgccgaggtccggggccactgtgccccgggctctgagcacaccgccagcctctcctgcagctacctcagccgccgagctgtggtcgggccctcctctgccagcccttgttcctacccccaggcccagagccagatgctgtaggagcaggtgctgagtgtgcctgcacatggaggaccgtgctctgtc

SEQ ID NO: 477017 - DNA, 861 bp, Homo sapiens
gcacaccttgggcatagggatgctagatgggccagtgtagacagtcacgtgctcccctggtgcacatgagcatctacattgaacgcggaggcgatatgcatttgggcttgacaggtgctgctttcctctcctgccaagtgaccggccagtgcagggaggttgagtcagacatcacccctttctatgcaacaccaccccaagacctggcagaaggcaaccttcaagggtattgcaaccttcatgcaaggaacccgctaggtacctggatcaggagtgggggtgcccttcatatggtggtcttggcagcccctcctgactcctaccttctatacacccagaaattccagagcaaagggaatctctttttcaaacagtgccagccggaggcttggactgactctgagccacacagccagagtcacaagatcatctttatccaatcactccagctccaggccctgggaaatcagggctggccttgtcatttggatggacagcagattgtggcagaaggcacggtgtaccagctctgagcctcagcctcaagccatcttctgtgcctttggttgttcaccttctttgacccccagtcccctcatgaaaaaaatcctggctatttgggtgcaaaatgagagaccccacagggctatcccagcttttccagccaaaggccccagacatgagattgcttggtatgattaccaaagctgcctagctgactcatagctgactgaagatgcagagcctagctcagatcagaactgggacccagagacttgtgagcagtaagtgattgctgtttgaagccaccacatcccccttgcagtatatattttggttttgatgtttttgtatggtgct

SEQ ID NO: 477018 - DNA, 584 bp, Homo sapiens
cctcttaactgtctctcttccccactagaaagtagggatgagcaaactatggcaatggaccacatttgggctagtccctgttattacacactcagagaggatcaatgctcatctactcatcccttcttggcttattttgatgtacttcctaataatggcagtacttcactaaaacatgaaaaacctaaaccaatttaccaaacaggaggcagggacacagtcactaacagagactttcttggacaaactggaacctacagtcctcatatttttagtcttgcagacatgaagaacctaaaggagaaaaatgcacatttctcaaagattctgactgggagctcgatgtaccacaaaaaggaacaagatcatgtccattgcagagacatggatgaatctggaagtccttatcttcagccaactaatgcaggaacagaaaaccaaacactgcgtgttctcacttataagtgggagctgaacaatgagaacacatggacacagggaggggaacaacacttactggggcctgtcaggggagtctgggggtgaggtgagcattagagaaaatgctgggcttaatacctagg

SEQ ID NO: 477019 - DNA, 1084 bp, Homo sapiens
cactgttctcatggtagtgaataagtctcacgaggacagtgggtcacatctgcctctggtcaaagttcatgcagctcctcaaatttccagaaaaggaaagtgaatcggcctggctttctctgtcatgcaaccactgccctttccagttccccttgcctcaggcacccagcacccaaggagcccagagcccaccgctgtgaccatttccccgaactgactctcccggattcttcgctatagtcatcaaaaacacaatgcactccacctctgcattcacacttgcaggctgcagttctacagtatcactgacagccaaaatggagggccctgcgggctatgcaaaggctggggagcccttgaggaagttggggacccaggttaggaagctcatggtgcctgtgcctgctgcagggaacagggtggactgtaaagaagatacctgggtgtgggaccaactccacatctactgccgtggcccaggtggagcacaaagaggacctgaaggcaatggcagcaaaaatggaaagaaggttcacttactcaatggaataagagaaagagggagaaagggagggggagagagagagagagagagtgagagagaaaagaagaagaaaaagaagaagaagaagaggaagaaggaggaggaggaggagaggaggagaagaggaggagaaaaaggaggagaaggagagagagagagagagagaccccactgaaaggctattacaaaatatcaggcataaaacattgagggtctaaattagaggaaaatgagagttaggaatggagaaaagaagatttaaaaaattagtagacatattttttaatatctatatgcagggttcctgactacaggtctggatccctggttggggtatcaagatttatttgtggatcaccagcagatagaagcaactgaacacaccttagtagggcaagttgcacgtgaatgttattttcctgtgtttcgtttctctcctattcaaaacttcctgtagttgattcaaactcatcttaaaacactcagaaatctttataaatctttacttgattgttatttacagggaagagtccaaagttc

SEQ ID NO: 477020 - DNA, 611 bp, Homo sapiens
gaaagcagtggctctcaaagcagcagcagaagcacacagcaacagaagaccagcagcaacagaagcacacagtgtttgttaaaatgcaaattctcaggccccagccaagcctctggatcaggcactctagggatgggtccccaaagtgtgtttcaccaggccttcgaagtggttctgctacacacggggctttgggaatcactggtcctaaaaagcaggacctgtcatggaaacgcaatgttacagaaataatgaaggcagcccactacctaaaactcagtaagaaaactcatcttgctgaccagaggaattgggaaaatggtggcagtaatacttcagggagatatacaacctttatatccagtggctttgtgcttttggcatatgtcgtatcctcccttggataccatattccacctttgagaagcacagctaattctgacaaagtcctcatatttcaacaccaatgtcctacttttatcatttttcttctttggatccataaagtaagatgacatgtatacttgcagaatggaggtcttctgatcgctaatgggagcctagtgcctacttaatgcagacaagcatgtctaaaactaaggggtttgatc

SEQ ID NO: 477021 - DNA, 780 bp, Homo sapiens
gaaggaaaaaggactggctggggatggcgcagtccagttctagagctgcttctcttcctgagaattgctgtactgttgccacatacactgtctttcctcctgtttccttggccacccttcctacccttgctctggaagcctcctgtcctggcggccagaggtctccccatctgcgctgtgtccagctttgcattttccctcgggcttggctggaggaggccagatgttggagtcactgcacagcctcctccctggggaagcctcatggggtttcagtgggagaagggaacgtgggattcctcctgtgcatctcatcttggtactgtgatgtcgggcagtcaggggcttgcctgaggctacagggcacgctgagctgcctgggcctgctgaccacgccagtggggatccagctatgggttggtgaaatgagcctaaaagagggtcactgtgacccagaatgccagattggccctgatgactggggattaaagcctcatgtcaaagctagaacccacggctggagccacggctgcagcttccatctgctccttggcagcctctctgtatctcaggaggtggaaggcactagcacatttgaggctgcatcttcctcagctggctgctgagttcacgtgggcattggggtttgtgtttgttttattttgctactttaacaacattcccttccttacatgagggctgtgcaaggcctaggtttgagctcaagtgatgtcttaatggagggaaagtgcccattttcatccaggttggtatcaaaga

SEQ ID NO: 477022 - DNA, 700 bp, Homo sapiens
atcaaagtttactactctaagaagtacaataagcagttggtttagaatggttggaattgcagatggcatagcactgtgcaatagtgggaaaggatctagatccataaggcagagatacctgttctgttccacagctttaaagatagatttgtatgccaatgccattagttccttaattaaatacctttataataagcctcggaatcagcataatacgaatctaatgccaagtttatgtttacctaaactgatgatgttctggatggagatgcttaatctactctattacaagaagggggtgaagcagaaaagtagatgtgtggcctctcccttctttctcccctccttcttcctcaatgccctgcaagaagaagccagggatctcacatcatacagtcagcggcttcttaacctgtctcaggagaagatgataaccacagggcttaggggattggctttgcgtgtcaaatggcccttcacggtagacacagacctaagcttcgggcacataactgctccaacctcagtgctcttatctggaaaatatgggcaataatatctcatagggtttttatgaagattatgtgtatttaaatcactggttgctctagtttaacgtgcttaataagatttgcgaatgttaagtgtttttacgtaagatccatgtaaaggtcatcttatcttgacaattacttcttcc

SEQ ID NO: 477023 - DNA, 616 bp, Homo sapiens
ctcctcaagtgccatcaaagtgggagcccaggcagaggaggcacctagagcgagcgagggctggcagtcagatgggtggccttctctggaagcacagtcactggtcatctagcagcagacctgccgtggaactttctccaggtgtccactgggatgacactgatattaaaaggaaacacaaaacaatcattttagcaatgctttttaattcttttctcccttctccttctccttctccttctcctcctcctcctcctcgtcctcctcctccttcttcttcttcttcctcctctacttcttcctcttcttcctctacttcttcctcttcttcttctttcttcttctttttggtgcatgctgttccctcttatcatccccacggtggaaccctggcagcaggtgacttcccccgccctccgctcctgcacttggtgttgctgtcagaggctgctgctcctctggggatgcgtcgccgcagcgctgccagctccttccttagctcctcagacagagctgagcatggagggtgtcaggctggggtcctcatcaccgcgctccgccccccagggacccgtgttgtatggatttatatttgaaggggaaatcactcaattcc

SEQ ID NO: 477024 - DNA, 771 bp, Homo sapiens
aaccagtggaacctcaaggtgagccagcaattcacttacatccagcacctttatgagatgcggcataatgctacatactcatacagccattggctcacttaccacagctggtggggaactctttctgaagagaccttatcagttatctctactggggggagttggagatttgaaaccagaagccaggaacaattcagcagaaagctcacctgtgagcacctcctgccacactcagcatgcagggttacctgctgtcattcagaacaagagtactagcttggggcattccaagagacgttctggtcccagacctagatatccatcaatcaggagccctgaactgagtgttcctaggaattacccacactacacttataaaagtattcagcttgtacttgttagtaatgaagctggagatgtcacaggactcccaagcttcttacaaacactcaacacactagaaaagcagacacataaggggcaggaaacaaagactatgctcagattgaatgtgttaataaatcttgtctataaagataaaggatcatatggttgtgattgataagcaggcagctgtcactcatattagccaggaaaggggaggggttgggggtgcatatgaaggtttgttacctagataaacacatgtcacagagatttgttgtccattttattagatcacccaggtattaactcagtacccaatggttatctttaaaaattatatagtctggtttatttatttatttttatgttttatttttaatcaag

SEQ ID NO: 477025 - DNA, 788 bp, Homo sapiens
cagccatgattgtgaggcctcatcagccatgtggaactgccacagcttcagagaatatggcaacagtgcgaattgtccttcattccacttttcatccacttgggtcgagccccctaagggcatgcaatgggggtgtggcacgcttctttggtgccctgctgctcatatccctaggaggagcatgcagacaggcgggtcgtggggagcaccgaccccacggcaacatccaggctgtacagctgctgctgcagctagctgggatgtttctccggaagccacaatacctgtttgcttcccaccagcctctgcatgagtcagacaatttggctgcagtagtgtgttttaaaagggaaacagagcacaaaagtttgaaaagtttgcagcctgacaatgtgatagaaaagaagatctcattttctgagaagaaatttaagccgtatgcagaaatttgcataagtaatgatgaatcaatgttaatccccaagacaatgaggaaaatgtctccagggcatgtccaaggtcttcagggcagcccgtaccatcacaggactggaggcccagggtccccatgctgtgtgcagcctaggaacttggtgccctgcatcccagccactctagcactggctgaaaggggccaacatggagctcagtccatggcttcagatggtgcaagccccaagccttggcagcttccatgtggtgttgagcctgtgaatgcacagtaagttaagaattgaagtttgggaacctctgcctagatttcagaagatgtatggaaatacctggac

SEQ ID NO: 477026 - DNA, 1482 bp, Homo sapiens
ttgggtctggaaaccagggtggagtctacaccatattactggtgtccttaaaagaagaggaaaatgccatgtggccgatggaggcagacactggagcaatgaagctgccaggcaaggatggctggccactaccagcacaaaggagaggcaaggaagggttctacacagagcctcaaggaggctgctctgcccgcttggatgctctctcggagaacctcacaaggctggccctcgcttcccgcggccttgcacccccatggcatcttggagaggcttccctgactccgacgtggttctggcacatcgacatcactttttcaaaatccagattctcggactccctccagacctactggatcagaccctctaagggtggagctcaaccgtctgtgcttcaaggagcactgcagggagtggaaggaacccatggtgcccacgtcgagtgtggaaagaagcctgagatgtttaggccacggaatggacatcatttcagttgaaactttgggcaatgcactaccagggtcacagccttttcctatagtgtttctgggacctgtccgctctgaaatcagtgtgcttcttctcccccactgtccttttgtgactactgtggggaatttgtgggaaggggtctccacaactggggcttgttgagggactcccacccaatgacaatttggcacaggtatgcagagtaataatgggctctcccagctcccctccatgctgcacctactcccagctctgagctggagctcccgtgcatcttcagccaggaagaggaagagggaggtggggaggtgggaaggtagcaacaagcaccaggcaaccatgagtaatctaggccagtgccagtgccaggggaggtgtgatgggaggcacctgggcctcctcccctgactcctgctgctgctgacagccccactgggagctgcaatggtgctcttaattgtgcctgctcctcagctgctggagggacacggccactgtggggtgcaatccaggaggtgtctgggtttggaggggtgcttctaccagagggcagggctgccaaaagatgagaggcaaggcttggggcaccccaagagacagtcctgagaaagagacatcattccccttcagtgaggaaaatcagctccgggccccacttcccaagggtcctgtggggataagacacttccaaagctttgtcataggccttgtcttataaacactgccagcaacgcttttgagcgggagggactcattccaaccaccagccctgctgattttttctctctcttctttctacacaggaaaacttaccttcctctccggggtcctggaagacctacttctccatgtttataaggtcctttgaacaaagcagcattttgtacacatatttagctgctgttgttatgcttattaaatgtgtttaataattgtgatgattttataacatctgtaacttctttgttttacattatatgtaatctcctt

SEQ ID NO: 477027 - DNA, 504 bp, Homo sapiens
ccactccatgtgcttcttctctgggatctcctttccactcttcttgtgccccctgacctctgcctctgcccaccagcatggccatccatatgtggccaacactaattcaggtgctcatgccaaccaggcatcagctctccctgcctgccataggcatacgtgcatcctcactggggaccctcagggcaaaagtgagtcgtcgactcctgggacgtggctccatggcagttccttctgtatctccctccttccctgccacctcactcccgagtgtgtatcctttttgagggtggaaaatcaagactcagaaagcacagggtctattaccctaaagacagaccctcttggtcctggaagtgaggaaagaactgaggctctcacctctggctcctgcacaatgtttttggagctctgaatgtactgtgtgtgtttcaggaggagccctggatttgcacttcacttctcccctctgcctcatgtaaaaatgccttccttttcttttcc

SEQ ID NO: 477028 - DNA, 3660 bp, Homo sapiens
tgcccctcttcctcctcctcctccttctcctcctctttctccttcttctcctcctcttcctcctcttcctcctcctcctcttcctctccctccttcttgtcctcctcctcctcttcctcctcctcctcttcctcctcctcctcttcctcctcctcctcttcctccccctccttcttgtcctcctccttcttgtcctcctcctccttcttctcctcctcctttctcctcccccacctcctcctcctccttctcctcctcctccttctcctcctccttctcctcctccttctcctcctcctttcccctcctcctcttcctccttctcttcctcctccttctcttcctcctcctcctcttcctcctcctccttctcctcctcttcctccttttcctcatcctcctccttctcctcctccttcacctcctcctactcttcctcctcctccttctcctcctcttcctcctcctcctccttcttctcctcctcctccttctcctccttctccccctcgtccttaacctcctcctccttatcctcctctttctcctccttcttctcctccgcctccttctcctcctcctccttatcctcctctttctcctcctccttctcctctgccttctccttctccttctcctccttatcctcctcctcatcctcctcctccttaccctcctctttctcctcctcctccttatcctcctccttatcctcctcttctttctctgcctcctcctcctactcctcctcctcctccttctcctcctcttcctcctcctctccctcctccttctcctcctcttcctcctcctctccctcctcctttctcctcctcctccttctctccttctcctcctccttctctccttctcctcctccttctctccttctcctcctcctctttctcctcctcctccttctcctcctcctccttctcctcctccttctcttcctctttctcctactcctccttctcctcctcctcctcttctttctctgcctccttctcctcctcctccttctcctccttctcctcttcctcctcttcctcctcctctctctcctcctccttcttctccttcctcctcctcctctgcctcctcctccttctcctcctccttctgctgctcctcctccttctcctccttctcctactccttttcctcttcatcctcctcctccttctcctcctcctcctttctcctcctccttctcttcctctttctcctcctcctccttctcctcctcttcctcctccttctcctctttctcctcctcctccttctcttcctcctttctcctcctccttgtcttcctctttctcctcctcctcctccttctcctcctcttcctcctccttctcctcctctttctcctcctcctcctccttctcttcctcctcctcctcctctcctccttttcctcctcctccttcacctcctcctccttttcctcgtcctcctccttctcctcctccttctcctcctcctccttctccttttcctccccctcttctttctccacctcctccttctcctcctccttctcctcctccttctcctcctccttctcttcctttctcctcctcctccttctcctcctcctcttctttctctgcctccttctccccctcctcctcctcttcctcctcctcctctccctcctcctctccctcctcctcctctccctcctcctcctctccctcctcctccttctcctcctcctcctccttctcctcctctttctcttcctctttctcctcctccttctcttctttctctgcctccttctcctcctcctcctccttctcctcctcctcttcttcctcctcctcctctccctcctcctccttctcctcctcctccttctcctcttcctccttctcctcctcctccttctcctcctccttctccttcctcctcctcctcttcctcctcctcctcctccttctcctcctctttctcctcctcctccttctcctactccttctcctcttcatcctcctcctccttctcctcctcctttctcttcctcctccttctcttcctccttctcctcctcctccttctcctcctctttctcctccttctcctcctcctcctccttctcctcctcctcctctttctcctcctcctcctctccctcctcctccttctccttcctcctcctcttcctcctcctcctccttctcctcctcctccttctgctgctcctcctcctccttctcctcctcctcctcctcctgctgctcctcctcctctttctcctcctcctccttctcctactccttctcctcttcatcctcctcctccttctcctcatcctttctcctcctccttctcttcctcctccttctcttcctccttctcctcctccttctcctcttcctcctccttctcctcctctttctcctcctcctcctccttctcctcctcctccttctcctcctcctcttcctcttcctcctcctctccctcctccttctcctccttttcctcttcctcctcctcttcctcctccttctcctcctccttctcctcctccttctcctcctccttctcctcctcctccttctgctgctcctcctcctcctctcctcttcctcctcctccttctgctgctcctcctcctccttctcctcctccttctcctccttttcctcgtcctcctcctcctccttttcctccccattctttctcctcctcctccttctcctcctcctccttctcctcctccttctcctcctccttctcctcctccttctcctccttttcctccccctctttctcctcctccttctcctcctcctccttctcttcctcctcctcctcctccttctcctcctcctcttctttctcctcctccttctcctcctcctccttctcctcctccttctcctcttcctcctgcccctcctctccctcctcttctcctcctccttctcctttctcctcctcctcctcttcctcctcctccttctgcttctcctcctcctctccttttcctcctcctcctccttctgctgctcctcctcctctccttttcctcctccttctccttctgctgctcctcctccttctcctctttctcctcctcctccttctcctcctcctcctcctccccctcttcttgctcctccccctccttctccaggagcccttcttcatgtcctgcttttcataactggatgggtgcccgcctctggactcctgcactgaccatcccctgccactgtctcctgccatccctgctgcattctcctttccgacctgccatccctgctgcattctcctttccgacctgccatccctgctgcattctcctttccgaccctctgcatgtggtttttatcccttacacctcctcaccagatcagcaaacacacgggagccggcaaggagacatcaataggcttaaatactcccacacaaacggatccccatggcccaataacctgaaaagcagtgggcaaagaataaataggtttcccaacaacaggtcttcttcacctttaattcgcccttatgcatctcctgaagaggacaaaagagaggatgcttgcaaaacttacttggtcacagaatgctctttccatggaggattttatagactagtctttggaatgttctgctaaattcagcttggtctcccccccaccc

SEQ ID NO: 477029 - DNA, 467 bp, Homo sapiens
agttcttgtaaaaacaatggaatggaagatgataattaatgatgatgagtattttcattatgaagtatgaggagagaagcagtggaggaagaggtcgctggaaatttaggacaggaaaaccatggcagttgaaaggctttcctggtcttcgctcaagatcagttccttatctgacatactcactgaactcttctcgaatgagcacagctggatttcccttttgtcaagtaagtttgcaaaaccctgggtgtaaagcaaagctaaagatactccttgctgcaggacttctcagagcctttaatacactcacatggattgtgaaatcacaaaagtatataaactgtgtagtggacctggaatccactgagaaacactggactaagacaagcactttgctatgactactgtcaaatgtgaataaaggggtggcttctacagtgaaaatttccactgaacctttgcattac

SEQ ID NO: 477030 - DNA, 700 bp, Homo sapiens
gtccccttctccagacatgcaggtgcactggggtgggaaagggggctgggagaagaaggatggggacccagagccccagggtcatcaacccaaatgagatcatgcctgtgaaagcactctgtaaactctttttattactcattccctcctggggggagagccccccactgccttctgcagccacttgatggcccagaggccaacaagtgtaacaactggcataccgctgtctctcgggaattctaaagagaactgctacatcagctacttcaggaaaacgcatttacctgggaccatggagcgtcaagtcctcggagtagagtcaagactcaagggagaaaccaacaagctgaggaactctaagtcgtgtgtaaatcagtattggattggtgcaaaagtaattgcggtttttgccatgaaggataattgggaatctatgcagcaagatgctggctcagcagagaccccatatataaaaattattcttgatggcttcaatagattttgcactgtccaggccaaaatgaaatatgaagatggggtagtggaggatgacttggatgacacccggaagtggtgattgaatacaacccatgagttacattcaatacttattgaagaataaaggtgaggttatttctctttggatcttcctgatattgtctccggcatcacattatacgattcccttcttctctgc

SEQ ID NO: 477031 - DNA, 635 bp, Homo sapiens
ttatttgcccagagggtgatctatagttgcctgggctcccctggggaaaggcaataaacctcttcttcacctgtccccgctgtgccatgacaatgacatttctcttcgccaaagccgagcttgatcagaactctgagctcctatctcttatctctgtgcctgtgtctgtgactcagcttctcaaaagctcctgctttggcctggacctgtccattctgctgtctgtggctcccgcacccatgcgcctggatcctgaggacaagacaggcccccaccccacctcatctcagggagcctccgtagagatgccctctctgcactgcacaggcctccatcaccctcacaaaaagcacccaggaatttcctccaggctctataatcacccctctgtaaatggcacacttgttcacaaaagccgctgctgccttgaactattttgcttgcctctttgcagctcctctgccaggggcagagaagtgctcatcgctgaagatttccagaaggtcccattggtcaagattataaatgccaggaatggtgtccctggattttaggcgcttcctcctctcctagtgcttaattgtctcagagtaattcccaaaatagtggctgcattttttcactttgactctgac

SEQ ID NO: 477032 - DNA, 576 bp, Homo sapiens
agcttctgtctttatgtacctattctaggtgccccacaaagcccctgattgattaaatgtctccctgcatattgccattaatcctgtgctcttctcccccaaccccctctccagcacccaggcattctaatttcattgtgcagggagctggcttgaaccaaaacaaagcggcacacgaacacagtaccaagcaatatggcacagaagtgccagctccaaaggatttgccagctcaggagagaagaggggatggaggcggggaggccatgggtcagaatgaccctgcctgcccctcagaagggagccaagaggaaggacagatggccatggggacccccccagtccatggaccactgaccatcaagaatgttgctatgggtttctctaggaagaactgggaccaccaggccctgataaaaggagtctatacaagatgtgaggatggtagatctgtcccagggaatatcagttttccaaactagatgtgattgtcagttgaaaaaaaaaaaaaagagtcctagaagcctcagtttcctcttttgtaaagtggagataataatggtccctacctccgta

SEQ ID NO: 477033 - DNA, 577 bp, Homo sapiens
cactccgctgccacggagctgtcaatgcaagcagctgttgggccagggtatttgtacacatctcaattagaccctctacctgttgcaaggacagagggctttctgtatcctgggttcttaccttggtgtaccggaaggatcgaatcacatgtgggcttggagaatgagtgcaaagttttatcgagtggaagtagctctccgccgatgggggagccagaagggagatggtttttccctggagttcctccgattgccccagccaaactctgccttgtcctgcgggttgtgagaccagccagagtgcgggtgtccctctgttggtgtgttcttctgccagcatgctcccctcgatgtcccctcgatatccagctgcttgtcttcttccgccaacgtgttcctctcaccaattccattgtacatatgttcaatactttaactagttcccatacagatgacaatttggctgtttccattcttttactgctataagcaatgccaaaatgtataaggttgtatttatatcattttgcttgctgctaagtgtgtcagtaagataattcctagaagcggagtttct

SEQ ID NO: 477034 - DNA, 746 bp, Homo sapiens
ctaagaacctttctaccctttatgtcttcatcaggccttaggtttttaacactgactggaaaacagcctacgtcccgggcgctgttctgggcgtctcacctgcatgcccgcagcattcagggtactactcttggcgctgctccacagtcccctggctgcacattctcaacagccccaactctgctggcctcccgcttccagggaggagggtggaggcagcaaggagaggatggagagtcatcaggaaagatgaccagaccacggcacctgtgcgcagacatgctcttctccaccaggactgcccaaggggtgctcaagtgtgtgtcgggggcaagtgggggctctctgggtgtgtgtcttcctttctggcccctgcttcctcctggcgcccctgtgtctccctcttgcccaggtggccctcatgctgtgagcatccaccatgctccagttcttcagggaggcccaccgatcctcactgattatctgagcaagtcctctcaatcagctgcaggttatcgaagccaagtgatgtatttgcattttggtttatcaggcttcaaggctttcacttggaaggaaccaatggcctctggggcctgctcccctgtagccctttagatctgtcaggagagccagatgctgggttcacatccagttcagcctcttactagctctgtgaagttggggttgttgtgtggattaaatgagttgctcttgaagctcattgaacggtgcacatggtaagg

SEQ ID NO: 477035 - DNA, 496 bp, Homo sapiens
tacacgagagaaagccgacgaaaatgatggggcttttattccttcattcaactcaacatttattgaaggcttgtcctggacaaatgcactgtaccggacaccgtggggatggggggaacttggaggtttataacaagggttgtcctaaagatctagtgtcaagtttggaccattcctttgttactcagtgggttaaatctgcccaagttggggccagtgatagccccttcaagatggcactgccctttcgagccacccttctttccccagccaacacaaccaccctcctcccatcactcaggttctcgcaccacgaatggacacccttctcttcctgctcaggctcaggcatcccagtcttggccgccacccccctcatcccctgcgtgggggactaccttgcttggctctacctaagggcttttggactgagttattcaggaaggaagaaaggcagtgagaaaaggaaggcactcagctacttttaattattgct

SEQ ID NO: 477036 - DNA, 1185 bp, Homo sapiens
tgtatgagatacaatcattcagaccctcgtagcagtgttctggaatcctaagtgtgggacaaatattcagacaatagtagtagtgtcctggaaatctatgtgagggacacacattcagaccctcttaggagtgttctggaatcttatatgagagacaaacattcagacaatcgtagcagtgttctggaatcctcggaatcctatgtgagggacaaacattcagacaatcgtagcattgttctggagtcttatgtgagggacaaacattcagaccccagcagcattgttctggaatcctatgtggggttcaaacattcaaacaacagcgggattgttctggaatcctatgttacggacaaacattcagaccatcgtagcagtgttctgcagtgttatggaagcctatctgtgggacaaacattcagaccacagcaggagtgttctggaacactaagtgttctcaaatcctatgtgaggaacaaacattcagaccctcgcagcaatgttctggaatcctatgtgacggacaaacatttggactgcagcagcaatgttctggaatcctatgtgagggacaaactttcagaaaatcgttgcagtgatcctcgtcgcagtcttcttgaattacatgtgagggagaaacactcagaacccaccagcagtgttctggaatccttagcgacagacatacatgcagacatcagtagcagtgctctgggatcctatgtgagggacaaactttcagacggcagcagcagtgttctggaatcctgtgtgagggacaatcactcagaccctcgtagctgtgttctggaattccgtgtgatggacaaacattcagaccctcatagcagtgttctggaaacctatgtgagggacaaacattcagaccacagcaggcatgttctggaatcctctgtgaggaagaaacattcagaccctcgtagcagtgttctggaatcctatatgacagacaaacatttagaccccagcagcagtgttctggaatcctgtgtgagggacaaacattcacaccctcggagcagtgttctagaatcctataaagggacaaacactcagaacccagcagccgtgttctggaaccatatgtgagggacaaacactgagaacacagcaggattgttttggaatgctatgtgatggagaaacattcaggcactcgta

SEQ ID NO: 477037 - DNA, 928 bp, Homo sapiens
gtttgtcaattttggctttgttgccattgcttttggtgttttagtcatgaaggctttgtccaagcctatggtattgcctaggttttctttcagctggggcttggatccggtaaaaacccaaatcctatctcaaggatgggaagttaaccctagtaaaattcaaggacctgcacaaactgtaaagttccttggcatcctatggaatgcagggaaacagtccattttaccaaaggctaaggctaaaatactagaatttgcagccctaccactgaaaaggaggtccaaaattgtattggtttgtttggattctggagacatcatattccccacttgggtaacattttacaacctctgcatgcggtcactagaaaacgctatgactttcactgaagacagaaaacccagaagctgtcagaggctagcaaagcttatactctttgagaagcagctgttgacctgctactgggctttacaggaaacagaacacctttgtcttaatcatgatgtttttatgaggccccaaattcctaatatgacttgggtcatgagctccctcaaacctcattggatagggtacactcaagaaagtaaatggaaatggcacatacaagaccaggctaagccggaaccaaaacaggtatcatttttaaatgaggatgtgcaaaacttgccagctcagcaaaccactgagcaagtcctgcagatagggaaggaaacctcccctgcccaatggggcaaatcctttaaagaaccaagcccagacgatcagagacatgcttggtttgctgatgattccaccaaatatattgatgggacccgatgctgggaggccgtgtcttataatcctgttaaaaacataagcatttctgaggaagggaggggtgttagcagccagctggctgaactagaatctgttctctgaactatt

SEQ ID NO: 477038 - DNA, 684 bp, Homo sapiens
acaaagacaggattgcacatgaccatgatggacaaccattgctttttcctgaagagacttagtaccctgtggctgagcttaagcgggactctaggaattattgattgcattttcttcttcttctgtgaactgcgatttctccttctgtttttctactacctagagattaatctgtatttgtcaatatttagtttttgttgcgatggcctgaatgtttatgtcccctttgcaaattcctatgtggataattttaggcgtgtggcctttggggaagtggtgaggccaagagttcttcatcctcatgaatggaatcagtgctttttcaaagggaaaaggttctccccgaagaatgatgctcacccaggccagcgcacacagcacagtgacccatgcacaggatgcactgagcacacgcggcactgggtgaaccaggaacagagcgagcagcactgcctggcatgaccgacatgaaagtagaatgtcatcatgtcaggctgtaccagcgtcggaagactaaacaccgtggggaagaacctcccttatggaatattatcaacaggtgagagaccagctcctgccctgatgggctacagaaatgagttcctgagataacacattgcagaaacatgcatagagtagtttaaccttttttgtgtgtaccctttctccattttcctgtgaaat

SEQ ID NO: 477039 - DNA, 572 bp, Homo sapiens
agaatcgcttaaaccgacaaaaaggaaaaataactaaaatggatgaaggacttgaacagacatttttccaaagaaaatatacaaacgggaaataagatgcaaagatattcaatattattaggaaactcaagtcaaaaccacaactttgtacttactaggatggctactgaaaaaccaaaaacagaatataagttgtggcaaggtggtgaaactggaacacatacattgctggcggggaacaaacagaagcctatcactccagagactgctgaaaagctggcccatgacctgaagattgtcaagtatgtggagtgttctgcactcacacagaaaggcctaaagaatgtatttgacgaagcaacattggctgcgctggagcctccagaatcgaagaagagccacaggtgtgtgctgctatgaacatctctccagagccctttctgcatagctggtgtcagcatcacactaaaagcaatgtttaaatcaaactgaagattaaaaattaaaattcatttttgcaataatgacaaatgccctgcacctacgcaaatgcactcatgcccacagagctg

SEQ ID NO: 477040 - DNA, 1184 bp, Homo sapiens
gatcgttgttctccgacttgactccttggttgggcttttcgtcggccatggcgagcgccggtctcctcagctgccacttcacaaaagaggtaccaggccttcctggccagtgcaccaggaggaggcctggagctgctcagcgtggggtgctgttctcagtgggtgggaagggggactcacagcctcgtctgggagtttatgtggacaatctcctgcttcctggggcatcatgccctggctttgaggtgagggaagggcaggaccgattggctctttcaggacaggctttctgcctcatcggcaccaggtggtgtggggaaggggtgcaggcagcagctgctgccttagtcctgatgaatggggcccagcccacacggggctctagctgggaccagataggcaggtgctggccaagctttccattagcccactattctgaagctcacaccaggaagacaccagcagggacgccagccgctactcttctgctgcagatttacatgtaatacagaggctctcagagtacaaaatgcacttcctgataaggagctctggctcatgtggctcctcagtgctctgccaggatgttatgagtcctccaaacacaagcaagaggcagggagactgactctccccgccccacgtgagaagcagatcctggagcctctgagaaggaattctttgttcattccccaccccacttcccctttcttcagcctcaggatcagcggacaggaatatgaacatcagcaggagcagtgacagcagccacggaccttacagacccttctaacctcatggaccattttcactcttaggagctcacttgatccacaaaagcactacaagccatgccccttccctgctgccctgcctcccgctagcttccaatagtcagtggttgggatttctttgcaaggtctgttgtaagccaggtccctgtacatctgggccctggaagcctagcacatatttcactgattctaaaatgcttattttttcacagtttaacctttgtataattaggatacattttatgaccgacagtatgtcatcaattagcgtttttacttggtcagagatacatgaaatgtttccatcacgccctttagagttgttgaaatacattaaatgcattagcatacaggatcccataccgagagggagagctctgaagagtatat

SEQ ID NO: 477041 - DNA, 822 bp, Homo sapiens
tgtgtgagtgtgggggagtgagtatggggaggagtgagagttgtgtgattgtgtgtacacacacgtgtgcacacagggcgggccgcgcttggcatttgaggaggggctcggaggtcctcctgggctggccgctgtcctgggagcagggcaccagggcaccctgcgagttttcaccttgccaaggtatgccagaagctggactccagcttccttgccaacgtgtgcgggaagcaggaccccagctgcggtccagggaggaaaaggggggtgctcacagctggagcgagtccctggagcccacaggcagtgacttgccccagaatgagcttgagagagtctggggatggagaacactggggatgcttggtgtggtgcagagcaagccccacccctaagagccacacccccaacagcccacccccctgccagccttgccctcagtcctgccccctgccggccttgcctctgccagccagagccagtcccccagcaagccccgccccctgctggctctggcccttctaagccccaccctcaggcagtcccgccccctgccagccccaccactgatcatccccgccctcagacagttttgccccttgccagccccacctcctccagccagagtgaatctcttagtaagccccaccctcttccagccccaccctcaggcagccccacctgctccagccagagtgaatctcttagtaagccccaccctcttccagccccaccctcaggcagccccacctcctccagccagagtgaatctcttagtaagccccaccctcttccagccccaccctcaggcagccccacctg

SEQ ID NO: 477042 - DNA, 830 bp, Homo sapiens
gacctacgtctgcacattgtttatagacatggtatggtgaaaggcatcttggcttttccacgcagccagtgccgcttgccattgatggcagaagtgagggtggacttggggacctccaaaccctgcagtcaggaaagaggtgtttgttccagcatcacaactgataagaggggagacagctattactatttccttggtcctggaacttcaaactctaacaggctcctatctaaacgctttggcaaatgcgctggcactttcctcctaatggacagacacaccatgtgtggacacacaaagaccccaaacgttgctacccagagggtcatccatggaccaacatcaactgcatggcctgggagccccttccccacagatgagtgtgaccatcagctgaagtgggaattcaagggccacaaaatcaaaagcctgagtggctcatttacaaagaaggagtcatacagctgctctgccctgccttcggggagtggagaggagactgaagtccagaaagagggtgtgtacaccaacgtgcacgcagaagtacaccagaagtacacggttgcctctggcgctctgctctttacactgctgagaatgtatgtttgctccattgttgaaaattcctttctcttcatgttcatctcagatgtctggagcggtctcagtccgttcgtaaagacaggaacatctgctctttgtcaaactgccctgatgcttgcccgccccaaagaggaatcatatcacgctcatcttttccgtgctctcacaggaccttattcccacagtgacataactggccacactccagtgtgacaattgtttacctg

SEQ ID NO: 477043 - DNA, 662 bp, Homo sapiens
gcatgcattcatctcacagtgatgcctgcatccatctcacagagtggaagctttattttgatcgagcagtttggaaacaatccttttcttaaatctaaacatcacacaactaagagaaactgtccgaataaactttgccaaaactctggaaaatggtcaaaagattacaacaaccaagtgaaagcagactcaaggaaaagacaactggaaaactttacgacatttttagcttgcctttgcctcagcaaattggcagttctgaagtgtcagaagcccacgttcccagtgaggaagcctggtccatcgtccaaaggaacaagagaagatcttacccgcaaattattatgtgtctgttctgactgggagtttaaaattactaaactaacatttttgaaagaatgtatttgggcatttaacaaatatgttaatccttaaactgttattgggcatacagcaataaaaataacataatttttatgtgtacaatatttatggaatacgttactggaacaaatgaataatttagataataacatgacaaagaacagaaattgtatacactatagagcatagtaatagaataatgaatgattaaaattattaatatcaggtagaaaatgaaaggtatctttgagagcagaactcaaggaagaaagcaattc

SEQ ID NO: 477044 - DNA, 1313 bp, Homo sapiens
gcggctttttgcccccgccgcggctttttgcgcccgccgccgcgggttttgctgacgcggctttttaaccccccgccgcggctttttgcgcctacccccgcgggtttttgctccctgccgccgtggctttttgcccctgccgctgcggctttttcccccggtcgtggctttttgcccccgccgctgaggctttttgccgctgcggctttttgcccccgccgccgctgctttttgcggctttttccccccgccgccgcggctttttgcggctttttgacctcgccaccgcggctttttgcccctccaccgtagctttttcccccgacgccgtggctttttgccccggcctcggcggttttttgccccctacgccgaggctttttccccgccgtggctttttccccccgccgccgcggctttttgtgggtttgtttttttttgccgccgcggctttttgccccgccgccgccgctttttgccgccgcggctttttacccccgccgccgaggatttttgcccccgccgccgcggctctgagggcgggagcggcacactcggctgccagctccactggcgttctggcaagggcagcgcggaggggcgctcctggtccagctctccctgctcgggagtgtatgaatgctttgtgttctgacaaagagactgtagctcccatgtcctacctgcttggttgcattgccagtgcccacgcaggactggatgctgcacagagtgtaaagggggcagaaggatccaggacacctaggcctggagataacgccaatgctgggaggggctggaggtctagtgagagacacaatttgcggcaagatggggacgaagtaggatgcacagagaagattttcagaggtgatggtgatgataaggatggtgatggtaaggtgataatgatggtgatgatgaggaaggtgatggtgaaggtggtgataatgatagtgatagttatgctgaggatgatgatgagaatggtgagaatggtgaaggatggtgatggtgaaagtggtggtggtgataatgatggagatggtgagggtggtgatagtgaagttggtgatgatactgatagttatggtgaggatgctgctgctgatgctggtgagaatggtgagggtgagactgacgataatgacgatggtgatgatcctaagctccatggaggcaaggagtatactatgttcattgttgtgtcctccatgccaagttaagttcctggaacacagtacactctcaataatttgttgttaaatgaatgactgaatctatattcttagtatggaaagatgtttgaaata

SEQ ID NO: 477045 - DNA, 534 bp, Homo sapiens
ggctccaggtgtatatcaggccccaggtgtacatcaggctcacaggtggacacccaggccccatatggacaccagcctacagtcggatatcaggccccaggagaacatcagtcccccggtggatatcagcttccaagttgacatcaggccacaagtggacactggacttgaggtgtacatcaggcctcagatggacatttggagtctaaaggccccaggtgtacagcaggctcaggtgcaaatcaaggcacaggtaacaccatgccctaggtggttacctaggcttcaggtagacatcagaccccaggtggacacctggacctcaggtggtcatcaggccctaggtggaaactcaggtcccaggtgcccatcacgttccaagtggacacccaggccccatggtgatacccaggttccaggtgggcactgggccccagatgaacaccaggctccatgtggataccagaacctgggtggacacccagctctgaggtggatatcgggctccaggtggacatcaagcctcaggtaggt

SEQ ID NO: 477046 - DNA, 766 bp, Homo sapiens
atagaagacacttctctgcaccccaaaagctccatgctgattgcgagaaggaaatgctggatggaggggttcctggaactactgtgagggaaatggtaacagaactttggatgtggaacgtgcagtaggagttacacgaagtgcgggtctgcacttggggtggtcagcacggcggatgcccagcaaaggcactgcctggtccacatcccggagtggtctctacgccccagtcggcatcgcagctgatggtgaaacttttggtgtggcagaagagtgtccacaaactttggaagttgctagagaaaaatgaaacgactagttttgaaagccttacttctgccaatggaagcacattccagcatgtcgccaacgcaatccattttccaccactttcacaagaaaagttacggcacaattatactatcctacccttatatactttttgtgcatgtgtacttgtgaaaactccaggctctaagtggacaaccaggccccaagctgatgtttactggggccagatgtctacgaggccccaggtgaaaagtccaggctccaaatggacagcatggccccacgttccaggtagacattggaatccaaatcaacaccaggcccaagatggacacgcaggcctgtggtggacatcagactccagaaggtcatctggcttgaggtggacatcaagccccaggtggatacctagtccccaggtggatatcaggccccactttgacaccagtccctgggtagatacctaggcctcagg

SEQ ID NO: 477047 - DNA, 669 bp, Homo sapiens
aagtccaagatcaaggtgccagcaggattggtgtctgtggagctgtgaggagagggccactctcctccagaccccagaatggtagattcactaacatcttgcaccatgagcctggaaaagctgcggacactcaacatcagcccaactcaacatcagcccatgaaaacagccacgaggtgggctataccctgcaaagccacagggacagaactacccaaggctgctgttactgccataggtcatgattcctttgatggatctgggcaaagtcaattggaaaccttctggaaaggattcactatgatagatgccactatgaacattcatgattcaccagaggaggtgaaaatagcagcattaataggagtttggaagaagttgattccaaccctcataaatgactttgaggggttcaagaccttagcagaggaagtaaccacagttgtggtgaagatagcaagagaactagaattacaagtggagcctgaagatgaccttccgagaggctccggaaagttatccagaactgtccacctgaaacatgagcctgcagcatttgtccacctgtcccacactggttgaggtcttcccctgaggctgttaacctgcaagtgcttctgggctgtatttgtgctcaggcaaaatcctacaataatggagatgccctag

SEQ ID NO: 477048 - DNA, 1431 bp, Homo sapiens
gtgcggctgggaagagctggcaggtggcacccgacccgcagcctgtgaatatgtctcatgagatctgatggttttaaaaatgggagttttcctgctcaagttctttttgcctgccaccatgcatgtaagacatgacttgctcctccttgccttccgccatgattgtgaggcatccccagccatgtggaacttgagaacatgtgatatttgtctttctgtgcttggcttatttaagataacggccttcagttccatccacgttgctgcaaatgacatgatgtcattcttccttatggccaagcaggattccattgcgtataagtaccgcattttctttatccattcatctgtggatggacacgtaggtggcttccacatctttgctgttgggactagtgctatgataaacatgtcagcctgcttcattaataccctcccgccttttgaaatcgaggcccagctgaccagcattaacatcaacacagaccttaagactgatggactctttaaaataaatctcttcaagtgtttgacagactttctcttcatcgacacatctatgcctttccatgtaaagggttgcaagatttaccatctgctgtatcaggcaccttgggccaccacctcccatccccaggcccggcctctgagtccatccctggtggtggaaaacggctgtggcaaacaggttttcctgctttgttctgacaatgcctcacctgaagtgtcaactgtggccctggcttcctgcccagggaccttcccccgacattgtggtgctgccgaaagcactcatatctgtgcaactggcctaggggagctcactccccagggccatggagagtgtcagggaagttatggctacctctccctccaccactactgctactgccactattaccattactgccactaccactaccattgctgctacatactaaaatcactactaccattactaccaccccataacaactcttaccaccaccattcctactatcattactcctaccatttctatcactactactacaactgttaccaccaccactaccactgtcgccactattaccatcctcatgactactaccactaccatgctgccactactccctctactactgccattacctttgccactactactaccgttgttaccatgatcactcctcacaccagcacaaccaccacgagtgtttgccgtgagtcagacactctgctgaacatttacagtatctgatcacatttactcctcatggcaactctacagtaatttatcatttccaggttaaagtgaggggtcactgagactcagagtctattttctccatctttatgtccatgtgtaccttttgttgagctcccacttagaggtgagaaacttgtgatatttgattttctgtttctgtgatagttcactttttacaataa

SEQ ID NO: 477049 - DNA, 903 bp, Homo sapiens
gggtttggcgttgatgctccttttgggcaatctcacagcatggagctctaggcctctgtgcgtctctggtgtttggatcctaggacctgaaggtccaggggagaagtcgtctggggggttgggaggctcagggaagaggctgcttcctgctgtggacttgattagcagccccatggacagtcactggactgaacaggaccacctctcacttcccctagacccaaagggtgaccaagagactggctccagggcttgtgtgggaaagtcttctgttcgagtgagcctgggagtaaacactcctgctcgagtgggaaagtcttctgttcgagtgagcctgggagtaaacactcctgctcgagtgggaaagtcttctgttcgagtgagcctgggagtaaacactcctgctcgagtgggaaagtcttctgttcgagtgagcctgggagtaaacactcctgctcgagtgggaaagtcttctgttcgagtgagcctgggagtaaacactcctgctcgagtgggaaagtcttctgttcgagtgagcctgggagtaaacactcctgctcgagtgggaaagtcttctgttcgagtgagcctgggagtgaacactcctgctcgagtgggaaagtcttctgttcgagtgagcctgggagtaaacactcctgctcgagtgggaaggtcttctgttcgagtgatcctgggagtaaacactcctgctcgagtgggaaggtcttctgtttgagtgagcctgggagtaaacactcctgctcgagtggctagctcatgggtttctgcaaggaacgtctttgaaatatttggtagatctaaggctgaatacagaccattcaccaaaacgctttccaaaaccatctactccagattttgtgaataaatttaaaatgctgttgc

SEQ ID NO: 477050 - DNA, 1298 bp, Homo sapiens
caggttacactgagcagggaacagtcacactgtctccaaatccaagacactgtcagtccctgcggggcccccagctgagcctgtcttgcaggccccaccctggccctttgagtctcacatcctggaacagagtggcctggaaagaggtggattgggctgcattctgcggagaagctgttctcttagcagcagctgtgtttcccctgctgggtccaggtaactcctgtgtccggagcctcccaggatggtgcccctgccatgtcgctggatgtgctggggcggctcctccgtcgtcggggacagcgctgagagctgagactggggcggctcctccgtcgtgggggacagtgctgagagtgagactggggtggctcctccgtcgtgggggacagcgctgagagtgagactggggtggctcctccgtcgtgggggacagcgctgagagctgagagtggggcggctcctccgtcgtgggggacagcgctgagagctgagactgggacggctcctccgttgtcggggacagcgctgagagctgagactggggtagctcctctgtcggggggacagcgctgagagtgagactggggcagctcctccgtcgtcggggacagcgctgagagctgagactgggacggctcctccgttgtcggggacagcgctgagagtgagactggggcagctcctctgtcggggggacagcgcttagagctgtgctggggcggctcctccgtcgcggggacagtgctgagagctgagaagtgtggccgcggtgccatggagacagaccgtccccttcctgccttcctttcctgatgagatgccaccctctcctccacaatcctcactgctcaccaagggggaagacctcttgttttcagtaggagaaatctttgtgctcagtgacgaaggtggctctgttgacactttatggggggaggacaaagggggctctcgggttcctcttgccctctccctgggactcctgccacatttccctgagtcctggctgctcccaacccttccacctacccagacgttcatcccgtctgctttgcgcacctgctgggtgcacatcaggagaaaaaacctgggaaatgccattgtgaacataggccctggcaaagatttcatgacaaagatgccaaaagcaggtgcagctatccatggagtaataggcaacctacagaatgggagaaatatttgcaagctgtgcatccaacaaaggtctaatattcagcatctgtaggaaacttaaacaaattaacatcaaaaaacccaaacgactccattaaaaa

SEQ ID NO: 477051 - DNA, 1032 bp, Homo sapiens
gaacgcttcgtgctgtttctgcaatgctcacttgcgggtggtgttacaatcaaaagaatgaacacatcaagagtgatttcaagtccaaccccttccctgtgttttctgcacagcttggaggccgtgcccaggtcctggatgttcctggtgacctttcctctttgccctttgctctcccacttggagctccatgctactccctcctgttgtactgaacctggccctcgttgccccttacgagggaagtccttgtcctctcatggcttccttcttgtccccttccctcagactcttcgtaataattatacaatactaattccaaatggaaactggaggcatggagcctatgccggcgtctccagcttctccagaggtaggaatggacactcaggtctccactgcatgctggtggatttgggagagtgtgatccatccaagccatgcgaaaatctgcacgactgagtcatgggacagtggagctttgtgatatcgcgtgcttttaaatccgaaaggacagtcatgatttaaggatttgaaagtcacacatttaacatctggattcacagtcataggtcttaaaccatgatagcttgtgcttctgaggtgcactgaattcatgcgtggctttcctagactttatcccatggaaccttcacgtgtcaggctatgtagagccctgaatctcaaagggagagcttggtcccagcaggtctcattattttgtattatattttaatagtttattttccctcttgcttcttcagttccaggtactgaatagaagctttacaaaagatcccggtaccggtaatagccctggggcgcccacttcacggggcctgcaggaagtcctgggaagggactgtttccacaagtggaacaagtgggccccccactgccctcgctgcctgcccctctctcctcattaaaccttcagagaacacaaaggagccgagagccccttttctctccatcttccaaagaagacttttcagtataaaaggtgccctaaatcctttgtgatgccgccca

SEQ ID NO: 477052 - DNA, 1596 bp, Homo sapiens
gcatgggtcggaggacggagtgggacagatctgctctcactgtgggctggcactgcccaatcggctggggcccagaggaaacaaaaaggtagagggaaggagaattctctcccttccagagccgggacactgcttctcctgcctgtggactttggagctccaggctcctcggcttttggaccccaggacttggggatttaccttggcagaccccggactcgcaagccctcagcccaggactgagaattacaccatgggacccctggacggagaattacaccatgggacccctggacggagaattacaccatgggacccctggacggagaatttcaccatgggacccctggacggagaattacaccatgggacccctggacggagaattacaccatgggaccgctcgatggagaattataccatgggacccctggacggagaattacaccatgggacccctggacggagaattacaccatgggacccctggacggagaattacaccatgggacccctggacggagaattacaccatgggacccctggacggagaattacaccatgggacccctggacggagaattacaccatgggacccctggacggagaattacaccatgggacccctggacggagaatttcaccatgggacccctggacggagaattacaccatgggaaccctggacggagaattacaccatgggaaccctggacggagaatttcaccttgggacccctggacggagaattacaccatgggaccgctcgatggagaattataccatgggacccctggacggagaattacaccatgggaccgctggacggagaatttcaccatgggacccctggacggagaattacaccatgggacccctggacggagaatttcaccatgggacccctggacggagaattacaccatgggaccgctcgatggagaattataccatgggacccctggacggagaattacaccatgggacccctggacggagaatttcaccatgggacccctggacggagaattacaccatgggaccgctggatggagaattacaccatgggaccccaggacggagaattacaccatgggacccctggacggagaattacaccatgggacccctggctctcgggcctttggactgaattgcaccaccagcctccctggtgctccagcttgcagagggcacatcaccggacatcacagtctccgtaattctgtgagccgtgataaatgcatgaccgatgcctaccgatgatgaccagggaggctcagctgacagctttctccctcctcccaccaggccccacccgggcctcatctctcaaaaaggaaagtcctggtttaccaattcacccacaaatgttagcgatttagcacctcttgcttctcctttgaaagggaatcagagaggagagcataacccagaaagtgaggacgccctggcgaggggaagggtctggagggcagccccactgacctgctccctgcctgtggagccgaagcgtgggctctgggctgggcttgagggcgagtgctcagggtggggccctgctgtcctggcagccgctggctgaaccctccaga

SEQ ID NO: 477053 - DNA, 1348 bp, Homo sapiens
gccaaacagttttccaaagggattgcacatatgtatgccctgatcaacaatgtgagtgctattactccatatcattgccaagacttggaggtcgagctccacaacttgcaccctgagctctccgactccatgggagcagtttttattccagagctcagcctgggtctgacagggactgcactggaacctggactgggatccagagtgaaactgggtgttctacaggaactggcctggatccagtcggaggcctcagagataccgaaatctttaaaatgcaggcatctgggaaatgacgcatcagaagggagaaaaaatgggaacactgtagaaaaaaactggcaaatggaaaatcgtaaagtcctttccatatgtattaacaaaagactttggccatccgaacaggtaactttatctgccaagaacacaatttggaccgaccagtgagttttatattatcgttcctggcacagggctacaatttgagaacagaagccaggaacctctgcatctgtttggttatgtacgtctatatgtatgtatgttatttatatgttatatcagtctacctctggatggtattattagaaataatattaaaagagctctattttactggcctaaagaaaatggcctgtggtcttaagtgttttaagccatttgacatttttaacggcatcccaaaatcaaattctatattaagtctttttcacctcaaattaactttggtagttttcaggagggaccctggggaatacatcaaaagaacattttctctccttataaaaagagagatgctaaactaatgagcttattgaatatgttaaattgcatgagaagcactgtcaaatacagaatcttaggttacacatacatggatatgtattagtcatagaagtgcttaaaaattacatgaaatttctaaaaatctgatatgttctggtataacatcatcagtcatactctaactatgttcttaaaatgtggcatgtcaccaaatcaaccaaatttcttgtcagttgcttgatacaaaattgcaagagattcatgagaaaaactgtaacaagtacttgtgtctgataactttaagatcatactattaaggatttccagaactgtaacgaaaaactgatggattcataaaaccgctaagcaaagactgaacaaaacaaaattcagtaccattaattatatggtactgaattaactattagaataattgtaacttttatgactttttgtttgaaacattactggctccttaatatcttatttttcagatttaaagaaccctttttttttctattaagctgtctataacttgcagccatttgataaaataagcttt

SEQ ID NO: 477054 - DNA, 949 bp, Homo sapiens
cgccaccgagaagccaggctgaccaaggctgaccctcgcaattggacaacccggagtccacagtggaccttgtccacacggttttcgtggcatgtcaaagagaggagagcaacttggacaacccctacgcacagaatgcaacttaggaggagaaatgtcagaagatgatgagttcattgccaaagagatgccttgggtggtctcacccttccagcgacatcttcattgcctgcagcatggaaaaattggagacattcagcagggcgtggaggagttggagctggatgcaggaatcctgctgtgtcagaaggagaacccacaggaaattcggcagcccagaaggagaacccacaggaaattcagcagcccaggagaacccacaggaaatccggcagcccagaaggagaacccacaggaaattcggcagcccaggagaacccacaggaaatctggcagcccaggagaacccataggaaatccggcagcccagaaggagaacccacaggaaattcagcagcccaggagaacccacaggaaatccggcagcccagaaggagaacccacaggaaattcggcagcccaggagaacccacaggaaatctggcagcccaggagaacccataggaaatccggcagcccagaaggagaacccacaggaaattcagcagcccaggagaacccacaggaaattcggcagcccagaagaacccacaggagatttggcagcccagaaggagaacccacaggaaatccggcagcccagaaggagaacccacaggaaattcggcagcccaggagaacccacaggaaatccggcagcccaggagaacccacaggaaattcggcagcccagaaggagaacccacaggcctcccagcttttggaagaagatgccacctaagaccttcatagctagagaggagaagccaatgcctggcttcaaagcttc

SEQ ID NO: 477055 - DNA, 1396 bp, Homo sapiens
gatggtcttttttttggatgctaacatgtacaacgctctctgtaagaccctgcagcgtggctgtttggtgctgcagatctttgagataatggactatagcctcttgatgtttgttaagaagctggagcattcttggaaagccctggtatgtgatggggacactgtctcagtgcatcgcccaggcttctacactgaacggttccagtgcttcatgtgcaacacagcatttaagaagatcccggccaggtgccccctgcacatttctcagctgcctttcacctcgcctccaacatgtgcaccggttcttgggaatggactactgcagagtggtctgtgcttctcccaggcctgcgccatgaaaacctccatgcagggggctccacattccatcctaaaggctgcatgtggtttcctgggtgacgctggaaaccgggagctgaagatagaggaatccatgtcagtctgggttcctggactgatgaacggcatggaaaagactccactcttctgatgaccaggaacacactcaactatctgtgaattgagttaaaaataaagtttcattgtgttaagcttcctgcatttgggggtatttgttacattatgtggcattgccctaactaatacatactaggcattttggatctaaagattaacaaaccacagatctgtactcaaagaacaaggcctagtgaggagagcagctacataatcaggcaggtttcacaacatatcaagagcagtgaaaggacatgcagaggacagtatcagatgactggagaggggcccctgatcaacccagaagctgcaggcccaggaggagtcagggaagacttcttggaggagactgaaggagtgagagggaattggcaaggctaaggagcgagaaggtggcccagtgtccgaggaactaggacggcatgaatgagtcacacctggcatgaggggtgggggtgctgctgtgccaccagagcttagaacaggagcttctggcagtgcagaggctcccacactcctctagcgacttggactctggggaatctggatgtgttttcaggaaggcagactaaggttagatttgcagatttttgtttttcaactatttacttttatatataaagagaacatgcatctgtttcttctgtctccactcttaaaagattaactgctgtggtaatgccctcctgccatcaagagctagaaaactgaacaaaatgtatggagtgagtggtgtgctgaactgaaacacctacgagaggctagcaagggcagcgacctgagatcccccctacccagaggcagccttccagactcagtgcagagacggcggctctcacagagcccagtgtctcactgaactctggaaacacaaatcagatgtgggaggctgaggcgg

SEQ ID NO: 477056 - DNA, 720 bp, Homo sapiens
ttcaatgtctctttcaaacactcagacaaaaactgaccaggaaagggaggagagaaaatgtgtccttctactgctacaaagtggaaagatggaactagtgcatatagcccaatctctcaggccaaagaccagaaagcagagctctgctttggatcctatggaaaacgtgtaacagatgaagtactcaggcagtgtggcacagaaaataaaacagtatacaatgatgggattgtgaaacattgcactttaaagagcccgaccctcagctgccagtctgttggagtttcccctccagacctgtttgcctgggtatcagcagtggaggctacagaacagcgaatattggtgaacagcaaatgttgctgcctgatcgttcctctggaagcttcatctcagaggggtacccagccgtgtgaggcgatgcctcgccctgctttggctcatgctcggtgggctgcatccactgtcctgcccccactgtccgaggagccccagccctattcatctgattcgctcccatgcctggagatgtcactcaaggaggctggagagcagcaaagatggatgcctgctccttcttctgtgacatctgacctcaagggccaccaacctgatgccataggattgctcctgtatagggtgtgtgactacccatgttggagggtcttacccagttgggtggcatgacgaacaggacctgtttaatgaagcactttgtcc

SEQ ID NO: 477057 - DNA, 663 bp, Homo sapiens
gtagtgtttggttttgtttctgtgtttgctgaggataatggcttccagctccatctgtgtccctgcaaaggacatgatcgcttttccttctaacagtgaggaccctcagctgcaggtctcttggagtttgctggaggtccactccagaccgtttgcctgggtgtcagcagcagaggctgcagaacagcgaatattggtgaacagcaaatgttgctgcctgatcgctcctctggaagttttgtctcagaggggtacccagccatatctccggctgcgtgttggaagtaacagtactctcttccaagctgtcaaacagggacatgaaagggaattccctgatcccttgcacttcctgggtgaggtgatgcctcgccttgcttcagctcatgcttggtgtgctgcacccactgtcctgcacccactgtccgacaatccccacaagacagtcttaaagctctgagattctttcctccacttggtctattctgctattgatacttgtgattgcattgtgaatttctcgtgttgtgttttttagatttatcaggtcatttatgttcctctctaaactggttattctggttatcagctcctgtaatgtttttatcatggtttttagcttctttgcattgggttagaacatgctcctttagttcagcaaag

SEQ ID NO: 477058 - DNA, 1466 bp, Homo sapiens
aaccatcacaaataacaagtgttggtaaggatggtaaagaaaagaagacccttgtaccctgttgatgggaatgtaaatcagtacagccgttgtggaaaaccaatatggagggtcctaagaaaggtagccggacctacctgctacctgctgccacctggagtgagagccgccccttggttcctggagggaacccaccaagggacacaggactggaagcccaggatggctagcgcagctcgggatgaaggccagggagaagcgggtgctctgcagtggccaggaaaggtccagcccctgaggccgaggggcttcctgtttcgtcgttgtaggtgctctgggagccctgggcgccggtggcttcatcgcctgcacatagcccatggaaggctgtccaaagttgttaaacagcggtctgaaaggggcaacggcacctgacactgagcccgacggagatgagacgcttcgtgactatgcccacttcacgggccagcaaactgaggctcagggaggggagaaagcagaattccttaaagtacatttcatagatcactagtagaggtgcctgagggaagatgtgtcatggcgatatattcagaaattcttgtataatatatccacagtcttcttagagattcccagataactttaatattttaaaggctctgagaagtcctgatgaatgaaatatcttcactgttcagtatacttatttggtcacagaattctcttttcatatgataagcgttatcctgtagaactgaggttgcatatagcatattttgataagataaatgctattctagaaactttatattaattggattaagctggaaaacttaactagtctctaggttcttctacttgactggcacaagtgtaggaaaaaggctgtgagttgtacatcaataaaattactcataatgctactcaatgcttactgttataattttcaaaatttaaaaagaccacgtggattccatttcagccaaacagaatgataattgaaaaattaaatttactggagattaaattgattctgggaaatcttggtttgatacttccatcctagagcacttacaggatgtacatagaaacccgcatagttgcaagtagagtgcaccgaccagtcgacggcctccagccattcaggtgagaaacaggcctgtgtacccttggtgttccacttcagctgttattatgattctcttaggctggtggttatcaggtcaaagaagcaatacggctgtaagtcatactcaaataagttgaaagattatagacagaaataaattttagctcacagggaaaaatttgatgaagcattaggaaaataaagctcgtaactactgagtgatttggtttttctcctccccctttattaatctatagttttcctctgagttaaatcctgtgatactttaacaaatattattgattcttattgctagtttagcatgtttatttat

SEQ ID NO: 477059 - DNA, 1110 bp, Homo sapiens
attagttttgtctgttctaacatggagtcacacagcaggcactcttttgtgtatttaatgtcttggtgttatgttgaagaatcacttatcgtaagccttaaagtcagctttttaattctcagcttcctggaccatacgttcaatgtcttccttgctcaaatggcccttattattagtgatagtaattttattctcttttcctgtacttttgtccacagcagagacactgaggataccattggcatcaatgtcaaaagtgacttcaatctgaggaacaccttggggttcaggaggtatgcccgtgaattcaaacttgccaagcaggttgttatccttggacatggcacgctcaccttcataaacctgaataagcacaccaggctggttgtcagaataggtaatgaaggtctgtgtctgcttggtaggaatggtggtattacagttgatgaggatggtcatgactccactagcagtttcaataccaagggaaagaggagtgacaacaatagaggatacctcctctggatagaagcttttggtctctcccttgtattctacttggacctggggcctgtcagcatcattcactaccatgaagggccaatgcttcatatcagactggacaacagcatcatcaaatctgcgtccaatcagacgtttggcatcaaaaactgtgttggtggggttcattgcaacttgatgctttgcggcatcaccaatcaactgtttagtgtccataaaggcgacatagcttggagtggttcagtttccctgatcattggcaattatctctacttttccgtgctggaaaacacccacgtaagagtaggtggtgctaagatcaataccaactgcaggtcccttggacatggttgctggcatgtagccctggctccgataaagaagaaagccacaggaacccgagagctgcaggcgagtggcagggagcacagaagcatctcccacttttggggttctgtgacagtgatggctgctggttatctcagtgatgaaagctcttgatgtcctctgaggaggaggctgctagcatctttgttgctgaacactaaggggatctttactgtgaaagctatgaggagtgcatggctg

SEQ ID NO: 477060 - DNA, 678 bp, Homo sapiens
ttttttttttttttccttctgagcgctgatcataagcgtcctgatgcagggacaatgtcttttattgctgacggaactaccttatttcatttttatcctgaggggcttgttggatggctttgacaaaaatactgttagtgatatggtcaatgaaatccaggctgaggtggtctcagatggaaatgaggaatgtgttggaaactggagtatggtttgggaacctccacctagatttcatgaaatgtatggaaatacctggatgtccaggcagaagtttgctgcaggagtggagacctcatggagaacctctgctaaggcaatatggaaggcaaatgtggggttggagccgccacacggagtccccactggggcactgcctagtggtgctgtgagccactcttctccagaccccaaaatggtagatccactgacagcttgcaccatgcacctggaaaaaggaggctcttagatagcagacttcagagagcaggttgtaaaatgtttcttattggacttaaaagggtgcctggctcttagttgattatctcacaacagactttgcagggcaactccaagctatggcaaggaaatatattttggggtaaaacactttgattttttcgcttgctatgtcagagtcatattggaaagccttatgagatttatgctttagggagg

SEQ ID NO: 477061 - DNA, 851 bp, Homo sapiens
agcatgactaagtcctgctgaatttcatggatagaggaggtcatggtagcattcatggatagaggatgctcccacttcatggatagaggtcatgctagcattcatggcatagacaagacagtaagggaagggtcccggagagcctctgacccaccccacaggtgcttgtaccagatgttttgtgcagataagggaacttgcaaagggggcttgattaaacatgccagcagccgactaagggcccacatgcacactgggggaatagggtggaggcaccaggaattttcaccttatacaaataaagaagtcagccccatcagtccgaacaaaaagacatattattttctgcctgttccttgtgggaaaaaattcaaattttctaaattttataagggctgcaatttccgaaatattcttccattcattcaggaagtacttgaatatctactaaatgccaaccactcttttctggatgtttagcaaacaccttctttctccgttcccttcccttcccttcccttcccttcccttcccttcccttcccttcccttcccttcccttcccttcccttcccttcccttcctttcccttccctttctccctttctctctctctttctctctttctctttctttctttgctgtctttctctctttctttcttagacggaaaatagactggtaaaagttttaataaatgtatggaacatgggttaataacaggtgattgatggtagaactgttgctgtagggcattataggcaacttttgtaacatcataaggaagtcaactgctaactgtcattggagccattataagtctcagaataaggaatagaaagtacaactttt

SEQ ID NO: 477062 - DNA, 515 bp, Homo sapiens
gacctaacaaatgatgcttatttagaagaattgcttttggcattatggtcacattgacaatattgagtctaccaatccatgagcataacatgtgtttctataatttctttcagcagtcttttgtagttttctttgcagatatctttcactttcttgctgccttcaagcatctgtttaacaaagcacatcttgcaccgcccttaattcatttaaccctgagtggacacagcacatgtttcagagagcacagggttgggggtaaggtcacagatcaacaggatcccaaggcagaagaatttttcttagtacagaacaaaatgaaaagtctcccaagtctacttctttctacacagacacggcaaccatccaatttctcaatcccttccccacatttcccccctttctactccacaaaaccgccacggtcatcatggcccgttctcaatgagctgttgggcacacctcccagacggggtggtggccgggcagaggggctcctcacttcccagtagggg

SEQ ID NO: 477063 - DNA, 3699 bp, Homo sapiens
gataacattaggagaaatacctaatgatctatgtttgcttaaagccatggggctctacaatcagcaggagacaaaaccagccaggtttgtttccttccctgcagggcgctgcgaatgtgctgagtctacgttcaagccaacaagtctcagtcccactcaaggccctcaacatagtaccagggtgttgccactggtaaggcagggcccatgggctcttcagttagcagaagcttacaatccattgagagaaatagataagaaaatttatggtgataacagtgtgataaatattgtgagagagatgcaatatgagaaggacttgactccccctcaccttcttgctaactttgaagatggaagaagggggtcacaaatgccggtagccgctagaagctgggaagagccttcagcttacatgcagcaaaaaatggtaaccttggtcctacagctgcaagatcttctaaaagaaaatgcagccctgcaaacaccttgatattaacccagcccttttggacttatgaccttcagaactataaaataacaaatcattgttgtcataacctgctacatttatgctaatttcatatggcagtaatgggaaactgctatactatctgtatcaataatttaaaaccatgagatcgcactgcttcctccaatttcaatccagcaacacagaattcattcttttcttctgtcttatttgtaacctctttcttcaacaatgagaaggctagctatcattatctacagcatatttatatgttcaatttaatatacatataacttagttccataatttctaacccatacctgtgtaagaagcacatttgctaattacagtacagacttgatgtgtagtacattttatattttagctttataacctggagtcaaatactgcaaagaaatttccctttacattgaaaatttggctgtttgacacaagaggcctagctttcagtcagtctcatctttccttcctcaataagtttaatcatttttagcttttgattgaaagtgagggatgtgtgactcttcctttcatatgaacacttagaggtcatggtagttttattaattggccttatttcaatatttttgtggctcagggacacagagacacaaagtaagcacatgtggttttaagaatgatgccaatagactttcttgatcagggttgtcagaaatcttcaattttgttttaaaaaagaaatatctgccaaatacaataaattaacataaaataaagcaaaatatagcctatacagtttgtactgtgggttacggctgcaacatatgaattctgggcaggatacaattctgttcataaacatatctctgtgaacctgggcgtctcaatggttaaatgacagcagagctcccttcaaatccatgttgaacttgatgatgggcaaaaaacaaactcttatgttagaagtatttttaaaacatctcatacactggacagttgataaagttgctgataaacaatttaaatgctattcttgtagagtttgcatgtcatttgataaacacttataatacagcccagcaaagaacactaagcaatgacaaaatttataatggaaatgcacatttcacagtaaaaaccaggtaatatctggaaataaactgtttgctcactaatgaagtgaagccttaaaaattaaagaaaattcagaagaaagacggtaaggatggttgacacttcattgtcactgattacagatgtaatggtgaagttgagatgatgatcagagtcttacttcagacaaatcatgagtctcagaggaagtgatgacagagatgtctgtggaaactattgaagaggaaggctttgctaaatcttcatggagtaatatatcagtgaatatatttgaggggagattttcctataatttgaagtatttgtttaatatttcactagaatggaattattgtgctttgttaaaaagcattcttagtgttttttttttttttcaaataagtttaaatttctttcctgaagcttgtataatgagacatcccgtaaggcctagcaggaaaaactgccaatttcaaaatcataagcattttataccatccaaaaaatgtttggaatttaccttttggagctaagggcttctttatactgggaaaatcactttatcaggttgtttaatgaaacagatttaaagtaagtaccctgtattgtccttggaaaagttagaggggtttgaaggacttcagacaagtcagattctcaaggaaaatgcaatgtgatgggaaatcatttccatttccaatatgtaactttcgcagttttgaatgaagttttagaaaatgattaactgtctgctatatactaggcatctattttaagttttattatgtttatttaacatcatttgcacaaaaatatatgataatgtgataattgaacacttccacctattgaaagaaaaatattgagaatcagatattttaaataaattccttaagtggagcatggttatagtgaatgagggaataaagttaaattaaaatggaccatttcttgatttttttttcttatacaaactcaaatttgttgtacaatttttcttctcgtttttataattctggctatatgccatgtgttacatactgaatgtttgtgtccctacaaatttatatgttgaaatccaaacccctaagtgatggcaataggaggtgagggtaattaggttgtgagggtggagctttcatgaatgagattagcactcttacaagaagagacactagtgctttcttcctttctctgttttctgacatgtgaagacacaatgagaatacagccttctgtaaaccagatgagctctaaccaaacactgaatctgacagcaccttgacctgaaattttctaggctacagaactatgaaaaataaatttgttttctttaaaccacctagcccaggatatatttgttataagagccagaactaactaagacatcatgtcaagggacattaattattttttttcttcttcagtagtttctaagatgtttttgtatttttttcaaacatttctataaagtatttgacattggctgacatactggccatttcttctgcttattagtttccacagttttttatatatatgtgatatatatatgattatatatattttatacatgtataaacatatagatgcctatatatctatatattaatataaatatatagatgcctatatattttatatgtaaatgtaaacatataaatattatatgtataacatgtatatacacacacatttgttttcttggatcatttgattactgagcaagtgatgaaaataaaagtaagcatactcaggtctccctaaacaacttcaccttcattttaaaaaaaaaaagaatttttgctgttctatatagtgccacctttggaatgcttaaggcaaaaagccatcaaaatggagctcactcatgtcattccctttttatgggtatcaacccttcttctagaattgacctactttagcttttactacccaatgccctcaatttattgttattccactctttttctagttaacatttgttacctgcagaagagatgactctggtaggagcttatttagctacattggaaggtgctccctttgaccattttagattcttgtttaagttctttaatgtttgttttagtttgctttagttatgtttg

SEQ ID NO: 477064 - DNA, 1505 bp, Homo sapiens
tagtgtgttgctattatctgtgggctctgaattcctcaaatcccagttccctagttatcatcatgtttagaagtccttcaattgggaaaggaggtgttccagaagaaggaattgttatcatagatgacagctccatgtgtgttattgcccctgatgaccttgtagtgggacaagatgcggaggtggataacagtgatattgatgatcctgaccctggggtctgcatggaaattgtgaggaagggagattctcattgtggtgggggactgagtgcagcagggagctccccggcagctgaaggcctctctcttcctcttgcactctcgttggggttggtggtctggggggtcttacttcttggaggccatgtgggtcatgaggttcaccaccctgttgctgtagccaaattcattgtcatatcaggaaatgagcttgacaaagtggtcgttgagggcaatgccagccctagaatcgaaggtggaagaatggcaagtcaggtccacgaccgacacgttggcagtgggaacatggaaggccatgccagtgagcttcccattcagctcagggatgaccttgcctacacctttggtagctccagtagatgcagggatgatgttctgattagcccacagccatcataccacagtttcccagaggggccatctacagtcttctggatggcagtgacggcaaggactgtggtcatgacagttggtggtacaggatgcattgctgacaacctcgaggctcttatcctacttctcatggttcataaccacaacgaacatgggggcatcagcagagggggcagagatgatgacccttttggctctctcctgcaggtgagcccgagccttctccatggtggtgaagaaactggtggcgtccactatgtactcagtaccagcatcacctcatttgattttggtgggatctctatcctggaagatgatgatggtaattccattgatgacaagcttcccgttctcagccttgatgctgccatggcatttgccacgggtagaatcatactggaacatgtacaccatgtagtagaggtcaatgagggagtcattgatggcgacagtattcactttaccagagttaaaagcagtgctgatgaccaggtgcccaatatggccaaatccattgacttgggcctttacttccaccatagtgtgtcagggatgccaatggcgctgcacgagaagatgcagctgtctgtcaaactggaggagcagagagcctataattttcatgttgaactattttatgttaattttattgttacgctagtataaaatgttaatttaaaaaatacatatttttctaggctttggaatgcttaagtataataaaagttatttggttctttgacttttgaaagaaaacacatttttttggaggctgtactctgatgcagttttcaaggtcttctgcatttatgagggtattcaggtatttcaattcataggggaaatgcctccagcttttatccattcagt

SEQ ID NO: 477065 - DNA, 580 bp, Homo sapiens
tttgatgtacagactattttgtcacccagcaactttcctgtctcacccctatgagcacatttacatgtgtgatgacagttgctgtatcaatcacgggatttgcagttggttctcatgatccacctacgcttgaagatccatatacaaactatgaaattctcatgaagaatcagactactcctccaactgacactgtttttccaatttgttggcatgaagtcttcatgtatgtatgctttgatgaattgcctgctttccaaggtgtagggcactgtgtggacttgggtgctggtgccatgactgcaacaccaggcccagcttttgctgtgacactgcagccatctgagtggatgtggcttaatatctaccatttaaaactaaaatactgctcacaaataaagttcagccctactggttatcaatacacttccctgattatttcctttatacgtcttttgtctgctgacctcttaaatgacatgtaatatagggatccattttcttctatattaccagatagtacatatctaaacatctctaccacctatatttcatgaagatctctgggaatagtgctaga

SEQ ID NO: 477066 - DNA, 820 bp, Homo sapiens
ctcagatgaggcaccatactaagatatgattcttttctggatagtgaagaggcctggtggaactgccatcaataagccaagtgcaatcagggtgagaaacagggaagaaggaaatgtggggaaatggggtgaacgtcaggtggatcagagagatgcagtcatgagggtcaggtgtggcatctggaataatgtgggaggccggattgaagtccaggccaggaacaatggtaactgtgggagactcaacaaagagcttccgaggcaatcaggaattgtcagtcttcagctgctaagccaagaagatctgggaaggagtcagtcagagtcttgggccagagttccaggggctctgggagtggctgccagccctcaccctgacattcctctgcccaatacaaacacattctctcttctttcctcctttcaaaaaatgcctaaaatagcagaaggcattatatactgagaaactacatgaaccacaacttacaggacaatgaaatgaaacgatgtgattgatgcacactgactacttatgacactgagatgtattttctgcattctttaatgacagtgaaatgtttgacgatgaacagtaagtactgacaaaactgtcaatatattagtatcgattcactttttaatagcagtaaaataattgtgcatgcagagatatattggaagtctaatttcaaaccaaatgctcttagagatacaattttctttctttacatcctggtttttcttcagaggctagaaataaaaggaataagtgaaataaatagcattagtgataagcaaaatatattctcagctgttctag

SEQ ID NO: 477067 - DNA, 6553 bp, Homo sapiens
cctctctctctctctctctctctctctctctctctctgtgtgtgtgtgtgtgtgtctctgtctcttcaccacccctcctctggctgctgcagtttgctgggtgttcacttaaggccctattcatctggttcactcctgtacctggagatgtcactcgaggaggctggagaacagcaaagatgggtgactgctccttcctctgggatctctggcctcgagggcaccgacctgatgccagtaggaacacacctgaataggcgtctgacaacccctgttggatggtctcacccagttgggtggcacagggaggaggacacatttaaccaagcacttcgactgtcccttggtggaggtgagactgtggccgcccctccctctagggctcaggcccagggagatcagcattctgtttctgagcccctggttggagttgttggagttcctgcagggaaaccccatccagtgaggagggatgggtcaggatcaggactgaagaggcactccagccacagtctgccacagctggtgtgttgggctgtggggaagacctcttgggaccaagccgtcagcctctctggctccagcaggggaaaagcatagcctggagcaacagggatggctatttgacaaatgcctgagaaatgacaacaaacaattatctaataaaaccattataagtttaagcagtatatattgtattatatgggaagcatattaataatatatacgatatgtattaaacaccaatgatatgcattaaaattttcttttttactctttaatgaaagattttcaagataaaatatttttgttcttgtttcttttgaatcagaaatattatataactagcataacaaattgtttacaacaattttaattcaattgaagcagtatatttggaggactgattttgtgccaagtatcctgaatctctacccttctctgttagtattaaaatacacttcctgtaatcctaacttaaaactactgttatggactgcatgtttatgtccccccagaattcatacattgaaaccctaatccccagtaggatgtactaggaggtagggggtttgggagataatttaggttagattagctcatgagggtgggtcccttaatgatgggattgatgtctttataaaaagaagggaaaacaaaacatcactctatttttgtgcgcaatcaagaaagaccacatgaggacacaaccatgaaaaaagccctcatcaagagcctgactgtcaagctgacaccctgatcttggacttccagcctccatcactgtcagaaacaaatttctgttttttaaagccacccaacctcaggtattttgttatagcagcctgagctgaatgagacaactctcatttattgctcattttctctatcccttcacagagaaggctcacaatacagttctgacatcctttcttcatgcgcttgcttcctatttattctttcacaaaattaccttatgtgtttttttaaatttaatgtttcttatgaataatttcagaaactaataggtgtacaaagaacaaccatcattccaccacctaaagatacccttcaaatttagtgaatttaatttcaaataactcataatacagacttgcagattgaaaatacgcaagttttatatgtaccttgtcagtttgacaacatgagttcatttgacacattgtctcctttttctccaggcttttttgacatataattgataaaaattatataaatgaatatccctatttttctgtgaactgcctattacttttttcactgttctaataaaaaaaaaaacactttggataggttttccaatattatggcaagtatttttaaagaaatctatttcgtggtgaaactccaagaaggtatgtatcagctttctgttttctcccttattttgattcatatttcaaaatatttgtctaggaagcttcattgctggagaaatttctaactaaagaaaatatcttcatcttttctttaggtttcaacctgagtacctggtgattaagctaacagaaacaacactttacaattgctcctactgacaccaataaggaaatgtggcagttctcttagtttggttcaaaactgataataccatacttataaaccaaatatcagtatttttaaaataattcatgattagaacatctgtattttaagatgttttctgtttatattcaaaaattagatgcatagagttttatgtgaaatgtcagaattgagagatgcaccatttatcaaatggaaaaagtaaagaagtaacactctggactttcctgactctctttttatagttcttctattgactcacttgtgaccttcagcaaatggagctcaggtgagctgactgtaaaacgagtatagtcatactgacctgtctacccgtggtgttataagactcaataaatcagagcctacacagttctttaaggttctcagatgaattgtgttagacaagggtgaaatgtcagagtagaaaaactgcttgtgccttttatacgtcagttattaccaaatggccactacaaaatagtatcacctcacacctttataaaattattcccattttctgaaacaaactagttcagccacataaaaattcgatgcttaatagattgtgttaacctcaaaaagctgtttcattatctcaagtattcaataaaatatgtagccctgttatctctgatgacataaataaagctttttaaaacaaattacggattaataaatgcattttatgcatttgcatgtttcagcatctttgcttgcttttcagatatgctgtcgggtgttaatagctatgttgtctttgccaacccaatatataagaagttggtagtatattttaaatcatctatattcagagttcaaattaattttactttgatttttttaaacactcactgattaaacttaaggagctaaacatcttaggcatttaacttcagtgttgtgtcctcccttatcagagcaaaattgggcattttcctatgcacaatagaggaaaaaaagcaattactatcaatcagtgactaagcaacagattggagtatttagaaagactcattcatacacagatttgcagcagcgttcagctcttctgattagattccatagattttaaattgtagctaattaggctgtcataggttcattaatggctctcctgattcagcactccctcacctgcatgcatattaaaactcattagctcccttgtctaaaataccacctgcattaattgctgccaatgcaccaggactcttcagaaggcttttctgacaacgatgctacctgcttgtagtgccccgtgccccgatagctcttcaggagagctcacacataaagttcatggtgctgcacacgtggtgagactgcagctgttgtaagggcagtcaagcctgttttacgcttaacagcaggatataaataattagtgatgcctgtgctgtagggcttaacacaaggccagtgtatccctttctaagcttctactaaaccatccctctctacaaaataagctcccaaatcgtctttcttttgattcctgattctgtaagcagctcccacaaaatgctaagactaagccagaagagaaggaacactgtagctttcttttagttcatgtcctcggtctcttgtgtatgtgagatgagcccctgggtagggcttttgaaatgatctcagttcatagctgcctgaatcagttgccagcatcaattaactaattatgacctcacatgttttaaaatatcttttatccctaaagtcaaaatagcctttcatttatttgtttatttatttatttacttggatattcattccctcagagaagcatctttgtagcaaaagaatgtggaattcggagttatcaacataatctgatggaaaatattactgcttatgttaagaaagaaattctactaagaatgagctggtaaaaatggtaatagttgtgaagttgactaatgataaaagtaagccttactttccagcccttttgtgttctttaattctttcttcttggtgctaaatcttttaatagtaggctgctaccaactgctagttatgatttctgggtatttctgtgtcttccaaatttattattgtagtgactcttatttgagggtttcaagatttgagcatgtcaaattacaagaaaattctatatttttatatttatatataattgagaagtattccactatttgtcgaatttaaatcaacaaacaataatgggtaatcaaattccatacttcatataaatatatcttaattattactcttctatatgcattgtattttcagtgatcagtaacttaatctaacttatccctgagaaataaaaaagaattatgagaaaatgggaaaataaagcaaaaatatatccagaaaatgtgctttgggtcataataatgtaagttatttttagattatagataattttagatatttattttttaccatttattttatgtatcatttcagtttcattccatgggatttaaaaataagataattttaataaaaatattaaagcaataaaattataagtttcattgtatagggagacatgaactttattatgtttaaatgtatcatatatctccaggaaaagaaatctttactacactctaatgtcctccagggagagggatatctccctgtttactctcagagaatgtaaataaatttgctccagagaaaaactctgtctctccttttccaaggatgccttaacatatattattgaaaatataattctggagtatgtgctgttaatgccaagatgtgtaaataggtgagaaatttttcaataatggtttcccaatacccaataaggcattagaaataacacatattattgtggttgttactgcacattatccaatgttctgaaacatactagaaggtatttttttaatatcgccaaatatacatccaaatagctagtcttcttaaggaaacaaatgctactagctcatattaactcagaagttaccattatcttgcccatgctcattctatcaatttgagatgtacttttccgtttattctgtgtatcattttttaaaagcatcttaatctgaacacaattcatgaattaatataaaatatttttataatataaatattgaactataaatattcacattaatttcactttataagatttggcatgcagtattttgactgtcaatcaaatctaaatttaatttccattataatttcttcttcaacccattagttatttaggagtatgttttaaattttctaaacaaatagaaatttgaaggagttttatatgtttacttactttttaaaatctattttctttacctactatgtcaatgtcaatgtattttaataactagaggcctatgcaataaattttattcacatttttgtggctttgaagaggtaaaaagactttttagatttttttttcatttcctgagatttagatatacaatcaaaattgtttaggtcatgatctacagcctttgcagtacttatgacatcatattttaggatacagaggcctcattaatttttttaattttttaatatgataagcaaactgttgtcttgttcaatttatatttctaatcaaattgaggctgaaaattgagcaaatgaacagtgtactgtttatttgctttatgttgtaacatcattacaacgttcttctttatttcttctttttacatgtttgctaaaatccccagtaaaggtatttgagcgtgggtgtttcttcatggaaagatttatttttttattattactaattcagtctttttagttgttgttggtatatccaggttttatttattcttgagtaaactgttttctatttataaatttcatatttcatttatttgatttttgacataaagttgtgcataatattttcttctaattattttatttagagactttagtaatgtcccttctctgatttttaattttggtaatatgttgtcgtattttttgtttttcttaacatcagattagataaatgtctattgctattttgatctttccaaagaatcaacttttgatttcaatttctggatatttttctactttttaattacatgattttcactcttaccttcattatttctttagccctacatactttgcttgatttgcgtttcttctgcattctttaggtggatgctaagattattgactttagatcctgttttccttttattataagcacttaatggtaaaaatatcccttttagcaccactttatctgtattttaccaatgttgatgtaatatatattgatgttaaggtattatccctctgtgttcctagaaacctgtgaattaacatgcttatttattggctctgaatatattttcaaattaattcgagaattatttatattctggcaatatgtttctcatttggatacagaatatcctttcaacaaaaacttaaatgatagacattttaagtcccaatttcacctttgatgtaaaagaagttcttaaggtggtcttatttaaaagggaatatt

SEQ ID NO: 477068 - DNA, 810 bp, Homo sapiens
gaatgtaatagaatggaatcattctatgaaatcgaatggaattatcatcgaatggaatcgaatggaaacctcgaatggaatcgaatggaatcatcatcaaatggaatcgaatggaaccatcaaatggaattgaatggaatcatcatcgaatggaatcgaatggaatcatcatcaaatggaatcgagtggaatcatcaaatggaatccaaaggaatcatcatcgtatggaatcgaatggaatcatcaaatggaaaccaatggactcttcatcaaatggaatcaaatggaatcatcgaatggtatcaaatagaatcatcatcaaatggaatcgaatggaatcatcgaatggaatcaaatggaatcatcatcgaatggaatcgaatggaatcatcaaatggaatggaatggaatcatcatcgaatggaatcgaatggaatcatcatcgaatggaatcgaatggaatcatcgaatggaatcgaatggaatcatcattgaatggaattgaatggaatcattgaatgaaatctaatggaatcatcgaatggaatcgaatggaatcatcatcgaatggaatcgaatggaatcatcatcgaatggaatcaaatggaatcatcatcgaatggaatcaaatggaatcatcatcaaatggaattgaatgaaatcattgaatggaatcgaatggaatcatcatcgaatggaatcgaatagagtcttcaaatggaataatctaatggaatcgaacggaatcatcgaatggaactgaatagaatcatcattgaatggaatagaatggaatcatcaaatggaatc

SEQ ID NO: 477069 - DNA, 986 bp, Homo sapiens
tcatcattgaatgcaattgaatggaatcatcatcgaattgaatcgaatggaatcatcatcaaatggaatcgaatggaatcatcaacgaatggaatcgactggaatcaaaatcgaatggaatcgaatggaatcatcgaatggaattgaatggaatcttcgaatcgaatcaaatggaatcatcatcgaatgcaatagaatggaatcatcgaatggcattcaaaggaatcatttccgaatggaatcgataggaatcatcgaacagaatcgaatggaatcatcatcgaatggaatcgaatggaatcatagaatcgaaatgaatggaatcatcatcacttggaatcgaatggaatcatcaaatggaatccaatggaatcatcaaatggaatccaatggaatcatcatcaaatggaatcgaatggaatcatcaaatgaatcgaacggaatcatcgaatgaaatcaaatggaatcatcatcgaatggactccaacagaatcatcaacgaattgactcgaatggaatcttcttcgagaggactctaatggaatcacaatcgaatggactcgaatggaatcatcaacgaatggaatcaaatggaatcatcatcgaatagaatcgaatggaatcatcgaatggaattgaatggaatcgaatggaatcatcatcgaatggaatcaaatggaatcaccatcaaatggaatcgaatggaatcattatcgaatggaatcaaatggaatcatcaacgaatggaatcgaatggaatcatcatcgaatggaatcgaagggaataatcaaatggaattgaatggaatcgaatagaatcattgaatggaatcaaatggaatcatcatcgaatgcaattgaatggaatcatcgaatggaaacaaaaggaatcatcattgaatggaattgataggaatcattgaatggaattgattgtaaacatcatcaaccgcatcgaatggaatcatcaaatgaaatcaaatgga

SEQ ID NO: 477070 - DNA, 442 bp, Homo sapiens
agctgcctagcatgggctttttttcacagagatggcagcattgtgaaagaaaaacagaagcattcaagactgctaagccccaaactggcacgctatcatggtcacatgtttttactgccttgagcaaacaaggccagccagatctaggtttcggaaaacagattctggatctcaatgggaacagctgtaaaaatccctggcaacgggccacaactttaataagaaagtttaaagtctatcgtgtaaccatagcctttacagtaaaatctgctacagacccaattataggggataaatttctaaccattgcctcatttactctaaaccatgggaaaaaagacctaaaaattatgcccattcagaggagtaatggcttcctggcaatgctccctaaccaattctgaataagttctctttaacttatgaattgttttatttactt

SEQ ID NO: 477071 - DNA, 667 bp, Homo sapiens
tgaggagaactgggcacacaggatcacgatgagcagggaagacggtggagaacgatcaggcccctctgctgccagtctgctggagtttgctggaggtccactccccatcctgcttgcctgggtatcatcagcggaggctgcaaagcagcaaagattgctgactgttctttcctctggaagcttcaacccagaggggcacctgcccaatgccagccagagctctcctgtacgaggggtctcccagttagtatacacgggggaaatcttttggaggaaaaatgatctaattgttcaaattcttagtgttaagaaaatggctgttatgcaggagagagcccatcaccaaactgatctaaagcctttgggaaaaaaaattatttttactctcctctttgagagatgcatatggaatgagataggtcattttagaaccagtgggttaccagcctcctgttaactaaaagacatatgaggtggagatattcctccttttcttgtgaaattctgccttttattcttttcagctctaaaaactgatcacctatcctgcttcttcttgcatcattttccataggaaatccttttctaacatgcaaactgttcaaaaaacaaaattttgtgttgaaaaagctttgtcttagacctactccaaaagggctttgccaag

SEQ ID NO: 477072 - DNA, 445 bp, Homo sapiens
tttaatatatgcaaatcacagtcattgtgttgaaaacaactggaaagagaagggactgggagttggtgagagaaaagggtaaaagctgtaggcagagtgctatcagaaacatttttcagagaggtgtgggaacaataaaagcaggtgctgggctacagcagccagcaggagtaacctttttttctgatttgcacaaaggtactgtgtggaccagcagcagccctgtccgttcctgcgtcggtcactatgggggcagctgtgtcctacagacagagaaacccagcagtgactgggtgctgctcaccagcacatttcagggatgcaccattgagcacgtgagattccgctgggctaaatgattggttagatcaagaatgttcccagcctccacaagccaaatatgtaattaaaaatgtcctactaggcatattaacgcaataaaagt

SEQ ID NO: 477073 - DNA, 576 bp, Homo sapiens
ggctctctgtaaaatggaccaatcagcaggaagtgggtctgcagcttcactcctgaagccagcgagaccactaacccaccagaaagaagaaactgggaacacaactgaacatcagaaggaacaaactctggacgcgctgccttttagaactgtgacactcaccgcgaggggtccccgtggtcctgagggagtaccaggagagaggggcttacccggagaaggatttccaggaccaaagggtgaaaaaggttctgaaggaccaactggcccacagggattacaaggcctgtcaatcaaaggggagaaggtactgtataatagggtgtacactggaaacaatgccaataaaattgtcattgttctttatgttatttgggaacaggtggtgataggttacatgatcctcaaagtcctctgtgtctttcttatgcctttgcgtcctcataacttagctcccacatatgagtgagaacatacaatgttttgttttctatttctgagttacttcacttagaatgatagtctccaatctcattcaggtcactgcaaatgccattaattcattcctttttatga

SEQ ID NO: 477074 - DNA, 837 bp, Homo sapiens
cacttcttgtggtttgagggcaaacatgccatacgtctcatttctcttcgaggagctgcagataactctgttcctgtgttttcacccccaaagctttgtaagggagctggatcatcacagaaaaagctatgacccgctccaaagccttggagtggttgaacttagcctaatctttgcacagaggagatctaacctggatttggggttaggacctcttaaccatcaagttgttggcataagtctgttggcagaaaagacttgttggattgttgttgttattacagagggtgtgactggcgatgtagggaaaggacttttacagtttcacagccaaacagccgaggtctttgcattaaatgacagctggaagaaagtctatggaaaaggagagcctggggtcagaggccctccaggtccttctgggcctcggggcgtaggaacccaagggccaaagggtgatactgggcagaaaggcttgcctggccctcctggcccccctggctatggatcacagggaattaaaatggtatttaaagtcttgagactggatgaggacgtgtggagagtgagagtatacatagaagagaagaaatccaaggactgggccctgggtcctccagcatttggaagtttgtatgatgaagaggacctggcaaagaaggctgagatggagtggccagtggggtagacagaatgaaaagaaagaggtgtcctggaagccacgtgaggaaatatttcacagagagctaattttggtgctgctgattagatgagaactgaaacatgatcattagatttgacaacctggaagtcattggtgactttcacaagagctgt

SEQ ID NO: 477075 - DNA, 568 bp, Homo sapiens
ctctctcctctctcgctccccgcttggtggttgagctccctgttgcctccagacttctgtggcctgccatcgggacccctaacctctctgggatatgtttgactggggcgggaggatccacatccaaaatggcctgcttgacttggctgttggcaggagacctcaggtccttgccatgtgggcctatcttaggcctacttgggtgttctcacaacatggcagctggtctccccccaaatcttataatcaaggacaagtccttagccacaacttgtggaaaagtgggattgggaccaagtaaaacaccaaaggatcagatcttcattgaaaaagtgaaaaagcaacacccacatgtatctttatttctattggtacattcatttatgaattttccattcacatattgtcctgaacactcccaacacaaagttgacataggtagaggagagaaagtcacatgggagagagccgtcttacaaattaagacatatctagtcattgggaaggaagtccctcctccactccattcccaccaccatcccaagcctcaccacggagtaacctagta

SEQ ID NO: 477076 - DNA, 1409 bp, Homo sapiens
caggatctacaggtctttgatctggaaactaagactagagaagtcttaagagatgacttctcaggaaattcctgtacctggagagtttaggcaaataacaatcagcaaagaagccttcaccagtgagaagaacaatgaatgtaataaacctgaaaaaagcttcagtctggactctactattgatgcagatcagaaagttcttagaatacagaacactgatgataatgataagaacgacatgagcttcagccagaattcagcctctggtaaacatgaacacataaatctaacacaggattttcagagtagtatatgtaaggaaagcttaatggatctctccctccttaataaatgggacagcatccctaacactgaggaatcctataaatgtgatgtatgtgagaaagttttccatcagagctcagcccttactagacatcagagaatccatactagagagaagccctacaaatgtaaagaatgtgaaaagcgtttcagtcagagctcgagtcttagtcgacataaaagaatacacactagagaaaaaccttacaaatgtgaagcatctgataaatcctgtagtccaagctcaggcataattcaacacaagaaaattcacaccagagccaaagcttacacatgtagcagttgtgaaagaatcttcagtcatagtgtccaccttactcaacatcagaaaattcacaaagagatgccctgtaagtgtactatatctggcagtgacttctgccatccttcatatctgcttgaacatcagagggtccaccatgaagagaaatcctatgaatatgatgaatatgggttggcctatattaaacaaggaattcatttcagagaaaagccctatacatgtaatgaatgtagaaaagacttcagattgaattcacatcttattcagcatcaaaaaattcacacaggaatgaaactgcatgagtgtaatgaatatggaaaagctttcagtcaaacctcatgccttattcaccatcaaataatgtataggaaagagaaatcatataaatgtaacgagtatgagggcagtttcagtcatagctcagaccttatcctgcaacaagatgtcctcaccagacagaaagtctttgattgtgatgtacggaaaaagaactccagtcagagagcacacctggttcaatatcggagcattcataccaaagagaactcatgaatataacgagggtgagaagacatttagtctagtcaaattcaggcttcattcaacatccgggagttcacaccagggagaaatcatgtacgtactgcatgtggtaaagccttcagtcatagctcaaccgttactcagcatcagataattcaattttcatgctattaataatttcataccttagtcacatttggagaattcgtatgggaat

SEQ ID NO: 477077 - DNA, 478 bp, Homo sapiens
atgtacagacaagaatcacaaccagcagagctgccataagaaaaatcctggccatggctgcctccaaattggcacagagagcagcacagagatctgtccacggatcaagacagccatacagccagaaaagcagtgctgtcctggccaggctgcagggaggggagggtctcagagcacaggatcaacacagaacagcaggagctgtcaccaggctggcactgagagagctgcctggtggtgcagagagaccagaggcctcagtgctggtgaacagttggcaaaggctgtcaagatggaagagaggagaaagggcaggaactgcgccaggagacccagctgtggatgagtctccaggtcatactgagggaaagagtttgaaagaggaggccaatcagtggatgactcctggagctcctttatcattttttctatctcattggctcttacaaccaataactactcctttctaagtgagcct

SEQ ID NO: 477078 - DNA, 676 bp, Homo sapiens
gtttaggctctttttcatcaaatataaaaacccagcccagttcatggctcgttcggcagcaaccctgagacgctttacagccctagaccctaaaagttccggccctcaaaccccacaacaggatttaattaacctcgccttcaaggtgtacagtaatagaaaaaagttgcaattccttgcctccactgtgagacaaaccccagccgcatctctagcacacaagaacttccaaacgcctgaacctcagcggccaggcattcctccagaacctcctcccccaggaacttgttacaagtgccagaaatctgaccaccaggccaaggaatgcctgcggcccaggattcctcctaagccatgtcccatctgtgcgggaccccactggaaatcggactgttcaactcacctggcagccactcccagagcccctggaactctggcccaaggctctctgactgactccttctccgcttagcggctgaagactgacgctgcccgatcaccttggaagccccatagaccatcatggacgccgagctttgggtaactctcacagtggaagatctcaaacatgtttctttactattcctttgcacccttaatcccagcctctcttcgctttcacttggactgaccctgacacccatcaagctcagcaaattacctgggctgtactgcc

SEQ ID NO: 477079 - DNA, 545 bp, Homo sapiens
aactggcatatgaccatctaggaacatttggactgtttaagggaagagcgcctctagtaagcatgcatacaactccattaaacacactgtgcatgctgccccttccaaatgccgataaaaggcacagacacaagtggcgggacgtcaagagagctgaagaacacagcaacagacaccagcagacaacatcaggccatcgatggctgcatgatgtggaatttggctgggggcagttggaggagagtctggctattgggcgacctgactccaggggaagactaccttcccactccatcccccttggggctcctcatgcatctcacgagagctacctccaccactcaataaaaccttgcacgcatcctccaagcccacgtgtgatccgacttcttggaaggatggctaagtaccaaaaagagccacttactttcactgtatcttatcaagaagttaattgggactgtggactgtccaaacaagatggcaaaatagaagccaataccatttattaccacccacctcactagaacaacaccaaactttga

SEQ ID NO: 477080 - DNA, 646 bp, Homo sapiens
gtaacacaggtcaggtctgctgtggagatggccatgctccctctgctagaattggcagtggtggaggaagcaactgcagatgtggtggaaatagcaagagaaacagaagtggaaactgaagatatgactgaattgctgcaatgttataataaaactttaatgaatgaggaattacttcttatggttgaacaaagaaagtggtttcttgagagggaaacttctcctgatgaagatactgtgaaaattattgaagttacagcaaaagatttagaattttccataaacttagctgataaagcagtggcagaatttgagaggattgactgcaattttgaaagaagtttcactggagagcctgactccgcagataaagggtgtggttcaggaacctgtgtcattcaaaagcccctagttcattcggatgctcatggaccatagattaaaatttgagaaatattgatttagaggagtaattggcagttttccatatatgtgactcatcacaattgaggcttatttacaccaatcagacatagatttggtcttttcacatagtcccatatttcttggaggctttgtttgcttctttttactcttttttctctaaacttctcttcttgcttcatttcattaatttgattttcaa

SEQ ID NO: 477081 - DNA, 684 bp, Homo sapiens
ccgagcatgcagccgcgcttccatggtgtatgattcagaatatttgtcctgcactctgcaggtcatcataacacaagctcattcatcagcgagtgtcttaagagtgaagaaaccactggtgtccagagaaagctcagaaaaagaacttaagcatcccaactcagcccaatttcacttctatgagaaaccgctggacagatcatttaatgcaggggtccccaacccccgggccatggggctggtactgggccatggcctgttgggaactgggcctcacagcaggaggctggcaccattgatactggtgggctggggtcggtccccaaataccagtaggacctggactcaagccgatgtccagacttttgacaccattgtgagaaggaacttgaggatgaatccaaaaatcatgaaagttgggagatttatttgcaaaacaaaattacatactcaagaaaaggaagtgcaggcatattaaagagagagtttgccccatggatttgggctgctacctttatggatttctttaaccaaggggtggaatactcatgaaaattcctggaagaaggtagaaatttctcagaactgtggtgccacccatttttacaccaaatataggtattcccagaactgtcacggggtggtgggtgtgtgattgaggatgttaatgagcgtataatgagg

SEQ ID NO: 477082 - DNA, 1134 bp, Homo sapiens
agctctccgttcaactcacgagaacgcggcagctgatctgccacggagtcaagaggatcttccgggaggctctgtcatttctgtaaatcaaggggttaggaagacaggggagaggagagggaaatggaatgcgaagcttctagtatcctctgctctacttttaacctctatgagatcaacatttttagtttccaggcaattctgatccctcttaacctctttggagccaccgtttcccagggctggtggtcagtgctgtttctttccaccgaagcaacaagccagccctccaaggtgtctggcttccagcatggaaccggagaagaatgtggagaagagtggacatatctgaatgctggcaggaaggagctgaagcaaaatgagaggcgggcattccagaagagtgaagggagcattaatagagcaaatcacaagatgggccgggcattggcgttcaccccgaggtcatctgccgtgcccagtcccacagcatctctacttaagcgaaggtgggacagagttgagagaaacttaaaatctactgctcttgatggttttaagtcaacagccggggactggcagtttcctggcctgagcggacccagcccccaatccagagcagcaatgggcgcctcactggatcaggagcacagcagacaccctgccagatccagaggggtggaagtcagtagtgggtctgcaatggcggtaaatatcaatggtggacggcgagcgaaagctcaggtccagccgtgacaaacacggaccagaagagtgtgcacttgcaagatttaatagagtgaaaacagagctcccatacaaaaggaggggacccaaagagggtagccgatgccggctggaatgcctgggtttgtatcccggtcattgtattgtccctcctgcagtgctctcaggcgatagatgattggctatttctttacctcctatttttgcctaattagcattttaaatcactgattgcaaggaagtgaaacctacctgagctaatttcaaatgaccgtaaaagggggaagaggacagaaggatcagtgtaataagattatacaacagacagctttacttgcaaaatgatgaggggcttaggcatcactcctcttctctttctgaactgta

SEQ ID NO: 477083 - DNA, 572 bp, Homo sapiens
attggtggatttttttttatgagcgataaggcattatgtgttcctaaaataatgtgtctgactggcattttaacaaagcccctacacccgcccctgtcccacaacatccctcatacacagcagttcccaagcagaggtacaaatgggaccagcagggcccagcagcaagtagagctctggataaagctgccctggcctgtctccaaaccctccaacccaggccatccccacttctcctgtactgcctcagggattcccggtgcttctgctggtcctgcatccggacacctgacccatcccagtgcagtccaggaaccaggaactcaattcgagcaattctgggcaccaagcctagtgcttacaagaattcctgagctcaaggagcagagccccatgtccaggtgcaccccagcccacacgatagcaaaagctgcaggcatcttcttgatcaaagtaaaatctgctcatggactaaaaaagtattacgttctttcttccaactaagtaatgccagtttctataacctcatcttatatactttaatgaagcttccttcaagggctgtgtatttc

SEQ ID NO: 477084 - DNA, 541 bp, Homo sapiens
tttgtgtatgtatatgtgtatgcatgtgtgtacgtgtgtacatgtatgtgtgccagggtcagctctgtggagggagcccagcctgcggggaggggaggcagtgctgtgcgggaggagggaggccaggacagtcctggcccggcacggtcccagagagggaatgaatgtccacgccctggccggcctctctcccagggatggaagtgtggacacacacggatactcacagagaggcctgaaccaagtctgggaggcaacagggacagggagctctgggactaggagccgggacacctgggtccccgttgttgctcccacgtgcaaagctggcctgtgtctccagccttgcagccctaaagcccagtctggacagagggtggaatggacaagccgcagtgagagggccgagggtgacacctgctggtaaatgggaggcatcacaggcaagacttggctggtgggtctcttgccgcccaggggtgcgtggtgtcacccaccctccagcctcccctcctgttcttcaccccaggaccccacaaaa

SEQ ID NO: 477085 - DNA, 671 bp, Homo sapiens
tcttggaacctagggtgccctggggagccatgccagggcgttctgcccagcacagtcacacctaaaagggtcctcagccgaaccccatccccttgaataccagctcgtgacggctttgagcagaacatgtcacgggaacggcattgtgcagaactttttattaaatggcatttaaaatattccccaggactgtgtagttggggaaacaccacaaaatccattggccgggaacataatggctcaatggttcgaaacaaatgcattgttaaaaaggaaaaacagcaactgttgcggggtaatgacttgcagatgactcagcaggccaaacatcaaaggaattcggatggcagcagcgatgtcaccatttctacctgccacgcatcggtgaaggttgggactcgactggtgtttgatcacgatgggaaaatcatccagaaaaccccctacccccaccccagagggaccacagtcagcgtgaagcagttattttctacactacctgtgcgccataaggaatttcaaaggaatgttaagaagggattagggatggaggtcatgcttctgcttcgacttcatgctgagcagggcactgagtcccctaaagtgaaaggaatgaaactcttgggcttctgagttcaaatgagttctggggtcacccggagtagcttgaa

SEQ ID NO: 477086 - DNA, 468 bp, Homo sapiens
gaggctgcagagagccgccggagccctcatgacttcagtgacctgcttctgcccctctaggtctatcagccacagtctctgcaagtttccaagagcagcagaaaatgaacacattgcagtgatccggatagaataccaagccagccacaacattctcctaagccaaagcctaatccagagcaaagccctaactgtcttcaattctgtgaaggttgagagaggtgaggaagcttcggaagaaaagtttgaagctagcagtggttggctcataaggtttaagaaaagaagctgtatctgtaatataaaagtgcaaggtgaaacagcaagtgctagtgtagaagcaggagtgagttatccagaagatctagctaagataactgatgaagatggctacattaagcaacagattttcaatgtagacaaaacaacctatattgaaagaagatatcatctaggactttcatagta

SEQ ID NO: 477087 - DNA, 1212 bp, Homo sapiens
tctgagggtgtactctagcaaaatgaaggagaagaccaagaaatacaaaaacacaaggacaaagaagcagagcaatacaggggaatctcaggatgacagtggtccatccggctttaaggtggtcgttttagagtgccataggagaatgctgggctctgggagggagaccaatgaagagaaaagaagatgtcatgcaggggactctgtgattgaggggatggcacaaagtggagagttgccaatgcatatcaataacagaaatatagtaatttcaataaatagtgctgaaacaactgggtattactatggaaaagaaatgggccttcacccttacctcaggccgtacacaaaaactgactcagaatggatcacaggactaaatgaggcagaaaaatggccccacaaagatttccacctctttgcctggaaaggcctaatctccagaaactatgaatatattacctttcttcgcaaaagggactttgcaggtgtgattacgttaaagatcttgggtagagagattatcctagatgacctggatctggatgaattctcagagagtaaggagcctgagaaattcatatgggacattaaatattctagtaattgtgatctctatttgatccagagacaaagaaccaaacccaagatgtgttaaaaagaataaaatttccctgtgctagtaaatttaaaaaggagttacaaatgtaaatactgtagatgcattttctccaataatgccttcagggcttccttatttcctgaggtgcaacaatattgaaattaggacaattaataaccgtacaatggtctctaagtgttcaaatgaaaggagtagttacacgtctttcacttttaatcaaaagatataaatgattaagcttagtgagagaggtattattagtaatttagagatgatttgaggtatacaagagaaaatgtgtaggttatatgcaataatacacttgttatataaaggaattaagcatctgtgaattgtggtatcccagggggtcctggagacaatttcccatggatattgagggacaactgtagttttatctggtatcatttccattcaacttgaggaacctgtagcatttcttggagcgcaaatccatatgcaacacattctcaagattttgatttttctgcaaatgtatttatttggctttcatctcttaaggacaatttcccagtttatatcatctt

SEQ ID NO: 477088 - DNA, 1168 bp, Homo sapiens
tgagccctgatttccgctggcctccaacctccaaccctttttctcttctgtaaaatggatataatgatacttgcctccagatgatactagaagtgactcaggtcctgggttggaaagcaccccggagccagggccagcggcccaggccagcggctccagggccagccacgatgtcctccaccgtgaacaacggggcggccagcatgcagtccacacccgacgccgcgaacggcttcccgcagcccagctcctcctcggggacctggccgcgggcggaagaggagctgcgcgccgcggagccgggcctggtgaagcgcgcgcaccgcgagatcctggaccacgagcgcaagcggcgggtggagctcaagtgcatggagctgcaggagatgatggaggagcaggggtattcggaggaggagattcggcagaaagtggggacattccggcagatgctgatggagaaggagggagtgctcaccagggaggaccggcctgggggccacatagtaagcacacactctgggatgtaagagcccacacaccaaatcccactgctaccatgaccaatggcttggtggctaaagagggtgtaagactgggcatggtggctcacacctgtaatcctagtactttgggaggccaaggtgggaggattgcttgagctcaggagttcgagaccaccctgagcaacatggtgaaactcaatctctacaaaatacacaaaaattagccaggcatgtagctgggattgcaggcgcccaccatgacgccccgctaatttttttgtatttttagtagagatggggtttcgccacattggccaggctggtctcgaactcgtgacctcaggtgacccacccgcctcggcctcccaaagtgctgggattacaggcatgagccaccacacccagtcttagtcatcgtaaaggctggcagcactgtaggaacagacagacctcaataggaaacggggaaacccttcttgcagactttctgtattgctgggtagtgaggggtaaagtatttcccaccttaccccacttaatcctcatctctctggccagagtaggagcaaaacaggaacagagacaggctccagcctgggtgacgaagaaagactccatcaaataaataaataaataagactaatacatgtaaagtgctcatc

SEQ ID NO: 477089 - DNA, 687 bp, Homo sapiens
ccttcatcatggctccggcgttggggaccctgctcaagtacatccaaaaggacccttcccacaccagtctttatagcggtcaagtgcagcagccacttagcacccaaggcatgtgccacagctggcatttcatcacaatcaacaataagtgtctgtcaggaaatcctgttgactgtcttcaacatgtactgaagatccccacccagcaactccctggcctcctccccaacttctctcctctgactatctctcaccaccaccacgaccctggtcaagaccactatcatctcccacctcgatgttgccacaacttggcccccatgcttctatccaaatcttcccacagtctttctcaactcagcagccagagaatgcttttaaatcggcagacagatcatgtcgcctctctgctcagaaccctcctgaatttcccatctagcccagcaataacctcccagggcttacacagtctactggtggtggagggaatgacttcaggatgattcaagtgcattacatatattgtgcactttatttctattattattgcattgtaatatacaatgaaataattctacaactcatgataatgtacaatcagtgggatctctgaacttattttcctgcaactagactgtccatctggggcgaagggagaaacaggcattagattctcataaggagcac

SEQ ID NO: 477090 - DNA, 4650 bp, Homo sapiens
tcttctggatcccagcagtgtccagaagaagaccaaggacagaacagagactaggtttggtgagatgggacagattttgggaaagatcatgatgagccatcaaccgcagccccaggaagagcggagcccccagcggagcacctcagggtaccccctccaggaggtggtggatgatgaagtgtcgggaccatcagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttggtaggaggacaccccagagagcacctccaatcctgttctttctaaagaggaaacttccaataaccacacttttccaatgggaaaaatatgccccagtggaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctgggagaagaaaaggagcggaggagcggacatgacacttcccccagcaagcagacgtttccggttgttctctctccttcccacatcaaccgcaaaagccatcagcctcctccgggttcccgtgacagagaagctgacctcagccggaggtctctcctggtggtgcccctgagcagcaacctgatttctgtcctcagctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagcccctgggggtagatcccagccccccacgtaggtcccttggctggaaaaggaagagggaatgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttggtaggaggacaccccagagagcacctccaatcctgttctttctaaagaggaaacttccaataaccacacttttccaatgggaaaaatatgccccagtggaggatcctgtcattaaaagactcctggcctgggacaaagatctgagggtgtcggacaagtatctcctggctatggtcatagcgtatttcagccgggccggcctcccctcctggcaataccaacgcattcatttcttcctggctctgggagaagaaaaggagcggaggagcggacatgacacttcccccagcaagcagacgtttccggttgttctctctccttcccacatcaaccgcaaaagccatcagcctcctccgggttcccgtgacagagaagctgacctcagccggaggtctctcctggtggtgcccctgagcagcaacctgatttctgtcctcagctatctggccaatgacatggaggaggacgacgaggcccccaaacaaaacatcttctacttcctgtacgaggagacccgctctcatatacccttgctcagtgagctttggttccagttatgccgttacatgaacccgagggccaggaagaactgctctcagatagccttgttccggaagtatcggttccacttcttttgttccatgcgctgcagggcttgggtttccctggaggagttggaagagaacaccggacccaggggagatgtggattttcagcaggaactttattccaatgctaatggcagacatcaggaaggaggagaggaaccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaaatttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcaccttcacatcctaataaacattatgtgataaaaagaaaaaagtaaatcatcctgaagttaagtctttaatgagaaatgcaaataaagcatttctcaataaattatgggaagagaatcaactgaagaataaacatctttagtaaatcttttgctcatgtgcattaaccaatactcttgaaaaccaggattaatttactgtaccttcttaatattcctttgaaattccttatggcgcacagagtgcgactctgtctaaaaaaaaaaaaaaaaaaaatatatatatatatatatgtatatatatgtatatatatatgtatatatatgtatatatgtatatatgtatatatgtatatatatgtatatatttatgtatatatgtatatatatgtatatatatatgtatatatgtatatatatgtatatatatgtatatatatgtgtgtgtgcatgtaattatttataaaaatttagtatctgtgctgtaattaaatagtgctttggtgaaatgtttccctaaaaattgataatgaaaaccaatggtaactatcatttattatctatatgttatgttcaaattgagaagttactgttttaataagggtaaccaattttttaaacaatactatttgcttcatttcattcatttattgctcacatttcagaagtactaggacttagattggcagtgagacaaaacagaattcagaagctagaagctgagatattgagatagaaaattgtaaataataatgattccaattaattttcagagaggtttttctaaggggtcaagtgaatggataaaaatattttctcacctcagtgcacaaagtgagctcagagctttcccccgaaagccaaaagtttcaacccgagttaggtcggcaaactcttgaatcttagatgtgtgatgtttcagagctgaaagagactgtaaagtaaggactaagatatctcaagtgctataacaacaaatatacatgatatctagtaactggctttaaaaaactgtttttgtgtttcccaagacagtgttactcaaaattctaagacatgtggcccaattattttgtaataggattagaaagttaacttacttaagccttcgaagttttcttcttctaccccacatccattgcctgaaacttcaatgagatccattccatagtccttaagctttagatctagaaagtttaaaatatttatatatttattaaaaatggacccacgctatcagtttttatattgatattatttataacgtgcaaatttaa

SEQ ID NO: 477091 - DNA, 1588 bp, Homo sapiens
tgcaaacaaagcatgtctgtgtccaaagaatataacctaagacgccactatcaaaccaatcacagcaagcattatgaccagtatatggaaagaatgcgtgacgagaagcttcacgagctgaaaaaagggctcaggaagtatctcttaggcttgtcagacaccgagtgtcccgagcaaaaacaagtgtttgcacacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatcttttcgcgtgttgagaagagcctgaaaaagttctgtatcgactggtcgaaattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagtgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggcttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaagtggttttctgaaagcttctgccagtccttcgatggtcagcctattctcttgacaaccatctgctccccttacgattttctctgatatctccccttatgattgtctcatctctaagggacccgcctcccccgtcctcacatagccacttccgcaaatgtgggacagctctccctgccactcgtggccttcgtgacaagttacatcttttgcaagactggcagcttcactttgcaccttcgtgtctgcattttggggaaagacctgccctcaaagcaaaggcttt

SEQ ID NO: 477092 - DNA, 1203 bp, Homo sapiens
cagcctgagtccagggatccatgtgcgtgtctgtgtgggtgcatctgatgtgtgcgtgtctgtgtgggtgcatctgatgtgtgcgtgtctgtgtgggtgcatctgatgtgtgcgtgtctgtgtgtgtgcatcttatgtgtgtctgtgtgtgtgcatctgatgtgtgcgtgtctgtgtgggtgcatctgatgtgtgcgtgtctgtgtgggtgcatctgatgtgtgtgtctgtgtgtgtgcatctgatgtgtgtgtctgtgtgtgtgcatctgatgtgtgcgtgtctgtgtgggtgcatctgatgtgtgtgtgtctgtgtgtgtgcatctgatgtgtgtgtctgtgtgtgtgcatctgatgtgtgcatgtctgtatgggtgcatctgatgtgtgtgtgtctgtgtgtgtgcatctgatgtgggtgtctgtgtgtgtgcatctgatgtgtgcgtgtctgtgtgggtgcatctgatgtgtgcgtgtctgtgtgggtgcatgtgtgcgtgtctgtgtgtgtgcatctgatgtgggtgtctgtgtgtgtgcatctgatgtgtgcgtgtctgtgtgggtgcatctgatgtgtgcgtgtctgtgtgggtgcatgtgtgcgtgtctgtgtgggtgcatctgatgtgtgcgtgtctgtgtgggtgcatctgatgtgtgcgtgtgtgtgtgtgtgcatctgatgtgtgtgtctgtgtgggtgcatctgatgtgtgcgtgtctgtcccccgccctccctcacccccgatgccggcagcccgcctgggtcctgggagcccagcccactcaggtccccctcagccctcctaccatgcggcccagaccccaggactctcgctgcagaaggaagggaagcattcgctgagctgggacccatccgtgggagctgactatccgcagctctgcccggctccgtgctcggccaccccagttcggcagctggacatcggctgggagggacgtggagcggccgacgggccagtgctgcccagtggttcttgtgccctggaccccaacggcggcatcctggggcggcaggaaggcgtctccgcagccccagcctcacagcctccaggaggtgcggaactggctgagcttttccaagctgtggacgggtcccccttgggccggcgaggaccccaggctgtaaacacacggctggaatcagcgctctgggcactgggctgaggctaaa

SEQ ID NO: 477093 - DNA, 1281 bp, Homo sapiens
agaaaggggctcccacagtgcagcggcgggctgaagggctcctcaagtgccgccaaagtgggagcccaggcagaggaggcgcagagagctagcgagggctgtgaggactgccagcacgctgtcacctctcagtgtccaggaaggaaataatctcccagagcaccgaaatggccaatgatagagactggctgatgtcaaatggcagagtccagtccactctatattgggacacaacacaactaacgcatgatggagcatgctggctgcatggacgtttgatgtatcaggtgtcagtgccctcaacattacattttatcaaagtcttccctaaggtggacagattcaggaaacaaaccatcaggatccctgatagtatcaaggaactgaaactcaccagattactgcatgcggacaatgagacaccagaaccctcatctggcatgtcaggaccctcagctgcaggtctgttggagtttgctggaggtccactccagaccctgtttgcctgggtatcagcagcagaggctgaagaacagcagatattggtgaacagcaaattttgctgcctgatcattcctccggaagttttgtctcagaagagtaccctgccatgtgaggtgtcagtctgcccctactggggggtgcctcccagttaggctactcagggaatatttttattcctttttgcacataatatcctaagttaatgacttttcttctctatgttctgtgaaaagaaataaaataacagcaattggttaggtttgccttatgaatgtaataaatgttgatttgctgttaatgtggaaatgctgttgtaagtaatttttaaaagttcattagacattttataatggaatgtagtgattttgcataaaaatgtaaaacacaactaatttcaataatatttaaactaattgcaaaatgagtttagaatgcaaaatgttataattatacagtagatctgttttatctttaaatctgaaatccatttaatattatttttcaacatttgaaggacaagaaaatagcactgaaggaaatgaataaaatggtagaaagggaaaagaacaaaaaaggaggaaagaacaaaattaaagtaagagagactaccatagaaaaaactaagtcagattggtttttatattcatcatcaatataaaaatatgtttaaaaaccccttgaagaaacatatatcttttcataattcactaatttattttcaatagcacttagctcatctaaacatatttacttaccaaagttgctcaccagtatcct

SEQ ID NO: 477094 - DNA, 682 bp, Homo sapiens
cgggatccactaggggaagatgatcctttcccaaatgaccagcatgtcacgtttattacaaaaacggggaccatatagcaggaggaaaaacctaggaatcctggaagaagcccatggaagatgtggccagcacagtgctggggcacacctgaagtcaggggccattgaggcctgcctcctgctaagggctttctggagcctggcgctgcttacaatggcccggaagtgggtggatatagaagctcagaaagcagataccagctgcttaaatcatatgaggcatggaaatattcctggtgctggtgggcccagtggtagggtaccaggtaaagtcctgtgctcacttgccttttgttcctccaagtcgacagtatctccctgcactgtgcttcctgggcttggggtaaaggtgacacagaactacctagaaggactgcagaacaaaactgaacgacattcactcaatttcaagacttggtgactgtgacacttttattgaatcttctgctcagctggaggacttgactttgagagaagaggatagtagtacttcattctagattcaatttttaattccatggggaataattatgttgaacgtcttttcatatgtatatttgccacttaaatatgtattattttaaggcctctgtttcaggattttgtgtgtctttttcatagt

SEQ ID NO: 477095 - DNA, 765 bp, Homo sapiens
accacgctgcagcagctagtgtgcccggctgtgtgcaaatgatatggtttggctgtgtcccaacccaaatctcatcttgcaatgtaactcccacagttcccatatgttgtgggaggaaactggtggaagccatgctccctctcagtgctctgaaagtgtgggctcctcccctgctgaagtgctgactgcagatctcaacttggcactcccaggctgcacaccacagtccttgggtgaactcaggctttgtttcttcctcagtgagatttctggtgctggtccaatatataacatagataaaagcagagctgctcaggataaaacaggtcctggtctcttgggtctgcttcatgcacctgaggccacacaccaaatggaatctttttctgaattagatagagacacaaaaggcttattctgcctcaacagagcttttcaattaacccttattacttgtacaaataataacaattactttggttatgactgtacacttgttaaagtggaaatgctcttgaaggggtaattaaatcagtctattattttattaacactagaataaattgtttttacattattttccttaaggcaagaaagccaataataaaacaaatattatcaagatgtaaagaaaaaaatatatagtaggaaaatttgaggatattgaaataaaaattttggctacttcataatttctataagattcagattatctgttatattaatataattttaattaaattttataatatgaatatgatatat

SEQ ID NO: 477096 - DNA, 2016 bp, Homo sapiens
gggtcctgctgcaaaccacataaatattcctgagaggaaaggggcaggtctctgctgatactccaccttcaaccaaataacagtctgaagtctgggtgccagtctgccagttttgtagataagagtgagaatttattgtgccttttttggactttcctatggctgcccgtgggccagtcagcatgcacttcctccactctgaagcccataaaaaccccagactcagactcgggcagataataggacagcatgcctatgaagaggatctacccactgtgggtctcctcgctgctgagagctgtacactcattgcagcaacctgcttgcggaaaagagctacacactccaggagctccctgagccagggctgtgacaccctctttggggctctgcagttcctggtatctacaagcttctggccgccaccatgttccccagtgcctacagtggaagctgcttgtggttggcctgatccagctgcagcagggaactggtacttgtgccagtgcctggagctgactgccccaccacaggcagtgtgcctggctgtgcgcagtgacctgagcctgcgttcactcactcatgtacccctcactgttctgtgccttgcttccccttggcgatcatgggatctgggctggtagtgacagctgagtgcagcctgtcaggccaagtgggtgggagaagtatagcaggcccaagcaaaactcaggcaaaggtgtcacccaccgcagaggtatctggctggtgaagcaacaccctaaaggtcctgtggcataactaaatgagaagaacaaaataaattttaaaaaatatctaaataacctaactgaaagtactctagaggtaccaatgggtaaaatctgatgagctagatttccagatttagttctattctatttaatttgaaggaaataatatgtttatgatttcttatgtataaacagtatggtttggttattggaagaatttaaaatataatcctgaaaatctatcattctaagaataccttagtttcattgttttttttttcaaaaagataatattcaaattgtattttagaactcatttttgactgtcagactgtttaccaaggtagacttttatgccttatcaatagctattattatattgcttccaaatattaatttggtatttccaactatatttacagatgagcaaaatcataatgtattacttacaattattaatgattaactaataatacatagaaatgagaattaaaccattacaagagctcagaaataaattttagaccattgctaatttaactttattctttcagaaacaatctcagccaaaaatgcctgccagtgatgacctactctaaactaccttaaacagaaactttggctaaaagccagaaataagcactagcatttatttgtgtctctgtcttagcccaagtgatcaaaaagaaaaaaaaaaaggttttgttctattcagaaggtaaagctatggttgcactatttttatacttttggagccaacatatatatggaaataatagagtgcatccagatgggcagagattagtttttccatcggcagttgaacatcaagtggtttgatgataggaggttaaaattagcagttaaaattagtgggagaggaagtactttgttaaataagttgaccttaaattctttatatgtcatggcatggttctagaattatcaaaagaaatggtagtattaagctgtatcagcctccctctcccacatctcctattgaaataaaaagggtcccagaatattactttaaagttatttaaaatctattagatttgctttatatgagaaagggaatgtgttaagagaaaagcttttcagacaattctagagctttagaattcagggatatttgcatgatttaactaatgttttcagagccttggatctttaaaatgtttgaaaatgtagcctttttccacagaaaataaataattataggtgaatatgaatgatcccatactctaattgacatctatgtatt

SEQ ID NO: 477097 - DNA, 882 bp, Homo sapiens
cattggttcctgctgggacgtgttagactcaaccagtagacaggactatggctggatgttggagagaagcggcttgacttcagaaggacagcttgatggcgtaacttcagagaagaatccgtccagagatggccagacttcaggggaagattacctacctgccccgtcccctttttacttccccttcccactgaaagccacattcattggtaataaaatgccccgcatttaccatccttcaattcgttcatgcgacctcatttttcctggaagccagacaagaactcaggtgccacaaatgtggatacaaaagactgtcacactggccctgtgccctcgctggtggaaggggtggaacccagcaggtctgagtgagtggagtttgatccctcccgcacaaagcggccaggcagttccagtgctccttcactccagttcccgcacttgttcgctcacgtgttttctcctgggaggagttgagaacggcgggctgagtaaaagaggcacccctgtcacaatttgatgagatttggacccagctctgtaatgacaggagatcttttttacatactgttcctgtaagaaaaaaaataaaattgcccataagcatagctctcttcccagatgtgttgcacaagaggaatatttattctactgtgtacctcaattacctgcgtatgcaaatataaatgtacagtcagttaagaattaactactctacatcataaaacgaagagtgtggagagaaaagatttaagggagcaacacaggtaggtttcgtaaggatagtttaggctttgtgctacacaatataactgcattcaaaactccaaaatagttcagtaaatctattataaataaatgttgtctgtgaatagcttt

SEQ ID NO: 477098 - DNA, 1018 bp, Homo sapiens
acctctgggagttttgccccagaggaatgcagagctatgacagctacaattttgtattggtggtgggctgctgtgctgggagctcaaactgggtagctgtgcactggggaaagggaaatgatcagacatttcagggactactggacactggctctgagctgacggtgattccaggggacccaaaacgtcattatggtcctccagttaaagtaggggcttacggaggtcagaaggctgtgtatgctctgaatcagtatccaatgtatgctactgtttctcccatagccagatttcactggtccatgaatcaaggagttaaagtggaagtggcaccactcaccatcacccctagtgatccattagtaaaatttttgtttcctgttcctgtgacattatgtgggaatcacctaatcagctgccggtacagccagaataaaaagcaggcagaggaacatggagagattagaatggctcagcctcgcagcctacatctttcacccatggtgaatgcttctggccctcaaacatcagactccaggttcttcggctttgagactcagactggctcccttgctcctcagcttacagatggcctattgtgggactctgtgatcattttgtctaatgctcagtgctaaattaataaaatattgttttcaatatttaactataaattttataacaaaaaaaccaaaatcaatacatttctccaatcaagaattcttcatcaaacattatttaaaacttaattaaatttatccaaaataatgatcacaatatatttaaactcttggctatttaaaacacctgaaaaaaactaattataaaagtttgattaaagttactacagctgctactgttattacatcctgtggatttatttgttcattatcctatagtcatttaaatcttattgacatgtagaaatacttaggtttctatatcaggctcaagaaataggaacactaactcagagattctgagttgggaaagtccaagtgattttcaacttaatttt

SEQ ID NO: 477099 - DNA, 514 bp, Homo sapiens
aataagttatggtgttctgtggcatggactgctttcttctgtttagcacagcagattccctgctagcccagggtgcatctagaaatgctgtccaggacctatggcctgaaatcaggggcttcagggatcttctctgtgctttagtttattgcagccaaactggtgcccaagttgcaagacaaagcaacaatatcttgggctttaacactgacaactttgtcatagacatcagtagactcaccagcatcaacaaaacagttactttgacagttatgcagaatgatgcagattgtcctcagtggtcaatagtgaaagagtctccatgttttgaaaggagcaaaagactctgcgttcccacagagaccattgagtataagtggactgcccagataagagagccatgggaaaaaacaagaggccagcagtacagtagagttatttacttactgtagagtgcagtagtatctgtcccagcaaaaggaaatcaaagttcaaaacattactaatctaatac

SEQ ID NO: 477100 - DNA, 595 bp, Homo sapiens
tttgttagaactaaatttactgacttgtttatgaaataacaattgagtggccgaatagtattccattatgtctaggacttccaactccatcttgaataacaatggagaaagtggacatcctgcttgtcctcctgatcttggagaaaaggctttcagttttttcccattcagtgtgatactagtttataagctgctggtggatctacaattctggggtctggaggatggtggccctcttcccacagctccactaggcagtgccccagcagggactctgtatgggggctccaaccccacttttctcttccacactgccctagcagaggttctgtgtgaaggccccactcccacagcaaacttttgcctggacatccagaaagacatgtctgtcacaagcccattctcgttcctaaacactgtcaagaaatgtgaaggatctggaattttccctatttacaaaatgggaaaacagcattcaaactgccaaaatacttatgcagtttctctgaccaccaatttccccaggaccacatgaagggtcagatgatacctgtgcatactgtaggttgttttggggggccaaagacctagtaca

SEQ ID NO: 477101 - DNA, 1462 bp, Homo sapiens
agcagcgtgacctggatgtgagacctggagtcaaaggagatcattttggagctggtcaagatggctctagagcaagcaaacaacgtgaactgcaagaagagccaacagtgcgtcaactgcaccgcagttgataaccaagtctcggaaaatggaaccatcacctgcaatgtttcctacagcccatacagcttgttcactgatgaccgccagttcagaattaggctctataatggtggcaagaggttacatctaggccctgttactccatcttttccagaagcagaaatcagcataagaatttctaatatttgttctgtaactatttatgtgcattttgtaagtgaacttccatacagaagtgtggacataagaactactattttaattgaggtggaagttgggctctatatactctctcccttgacaaatattcttctcatttttataaactttgaggcttctttgtgtgatttttaagcttgtaattaggtctgattcaataatctgatgtgataaagcaaaattctccatattgtatctctagcatgtttttccaaacttctttttcattgttactttctaagccttatatttctgccaatgaaactacattatgttcattgtattattaagttctaccctttcgtgtgtctgtatgcttttatattgttccctacacttgaaatattttctaccatttccacatggcaatatattgcaacactaagctcaaagagcgcttcctaaccaaatctttcataaaaatgcttgtttaaataatttctactgttagaatttcatagtatcagtctatgttttcttatcctactttgtattttatatggcatctgagtgcaattgtgaatcatcactctttgtgtctaatatctgtaatatttgtcatataggtagttagtaccaaatatatttgaataaataaatatactttaatgtataaggtggttatataatgtctttttttttctatgcacaatattagctaacatttatatagcactcattgcatgtcagatataattataaatgttttatctgtatttacttatcaaaatagccttgtgacgtataaattaatatattgattttgtaaatggcaaatgttaagtaacttcaccaagttactttaagtagtgttgctgggattggaaccaaggcagtctaattctagaggctactctattaatctctgtgctaagtgcctcttagataaaaaattaatacttaatttcctatagtattaatttgttattttatgtatgcttatctttttttacatatagttattaagctgtttgtggacagaaccacattatatacttttagatcccttccaatccatcctggactgcagcataattaattgaacatagagatattcagtttaaaaacttttttatttatttattttatttatttattttttaattatactttaagtttt

SEQ ID NO: 477102 - DNA, 721 bp, Homo sapiens
ttgtacagaatagctgcaacaatggggaggtgcctgtggtgtgtagttgcaggagcctgtgagaatggaggggcttctgccaggtggacctcaggcatccagcagggcagcacaggtgcgtgggctgggttggtttctggtgcccttgaacctgctggtttcctggagtcaactgcagccatggtctttagaggagtgctcccatgtatcctgcagtacactgtggggagcactcaaaatgccaatggcttctctacctgcttgtgtctagtgaaactagtggccaatattttacggatactcttctggttcagaagtcattttgactcacctctcctgtggcagagcataatcatgatcttgaccatgttgctaatgttgaaactctgcactgaagtctgtgtggcaaataagctgaacaaaactcgcttctttgcagacttctggccccaccacttacagcactggagccagaagtttaggggactataggcagtgcatcttggccttcatagcatggcagagtttttctctccctgcagtgtgcacttcagagataaaagtgtcagttctgacacatggaagtctgtcatgctttcctcaggtttatgctgtaattggaaatcaataaattatagaaatgtcttcacagcacttgatttagccttatgtcctcagtttttattgagggctgatgtaataaatggttttatgaagaaac

SEQ ID NO: 477103 - DNA, 1975 bp, Homo sapiens
agaaagatttacatctcaaaggggcagataaaggatttacaattaaagttttctgaagacacagacactttatcaaaaacatgattatagggacatctcaggctgaccgtgctgtcctgattgttgctgctggtgctggtgaatctgaagctggtatctctaagaatgggcacacccatgagcatgcccttctggcttacacactgggtgggaaacaactaattgttgatgttaacaaaatggatcccactgagacaccctacagccagaaaaaatacaaatccttaaagaagtcagcactttcattaagaaaattaactacagcccctggcacagtagtagcatttgtgccagtttctggttggaatggtgacaccatgctggagccaagtgctaacatgccttggttcaagggatggaaagtcactcataaagatgtcaatgccagtggaaccaagttgcttgaggcactggactgcatcctaacaccagcttgtccaaccgacaggccctcgcccttgcctctccaggatgtctacaaaattggtggtgttgctactttgcctattggcggagtggagactggtgttctcaaacctgtgactcttcctcagaacaatgtggccttcaatgtcaagaatgtgtctgtcaaaaatgttcattgtggcaatgttgctggtgacaacaaaaatgatccaccaacggaaacaactggcttcgctgctcaggtgattatcctgaagcatccagtccaaatcagtgctggctattcccctctactggattgccacacagatcacattgcatgcaaatttgctgagctgaaggaaaagattgattgccattctggtaagaagctgaaagatggccctaaattcttgaagtctggtgatgttgccaccaaattcttgaactctggtgatgttgatatggttcttggcaagcccatgtgtgttgaggtcttctcagactatcctcctttgggttgctttgctgttcatgatatgagatggagaattgccatggatgtcatcaaagcagtggacaagaaggctgctggagctggaaagatcaccacccctggtgagcagggccgtatttttaatctcagtgctcatggatggtgttacctgagaaaatgtattacaatgtgattgctttggaagcatcagtctttttgtccatggcattttcagatgaataaattactaaaaatacatattgatgaaagattcacatgctctgttataatatcattataattaatctaaaaaggcattctctatttaatgcaatgaagtggaacatcttatagggtatttatgctcatttaaaaagatattttatatttatagtgagagtttaaatttacgtgtatattttgcatcataaaaatgtgatcattgctactattcttctattactaaagttctaaatattttatatttctcctttagctatcaccactggtaatagtaaatatgaagtttctaatcttaattttgctttaaaaacagaaaagaaaaatttagaaaaattatctaaaatatttatacattcagttcaacaagatttgttaaatattagctatgtggcaaacactatgctaataagtagtatagtattatatgtatattagtttggagcataaaataattcaactgtgatttgacttatctcaataacacatgatgtgtttgtaaagtgtttaagcactgttgggtgtttgtcattcactacatagtttattcctcacaaaaatctcatggagaagacactattattacacccattttagaaatgaggcacatttgcttacttctgccaggatcatcttttctactactatatgatccagaaaaatgcaataatatatgtgaaaacatcaagcagtgcctagttcatgataaaaactcaagtattaaaactcaaagcagtgtgacagtagaatatagtagttaggactgtaggctcc

SEQ ID NO: 477104 - DNA, 535 bp, Homo sapiens
agcacaacagggtgactatagtaaaaaataattgaattcaggatgagccacagacaaaacctctcagacaccgagatagtgaagggagtggctttaatcagctgggagcatcggcaggctagcatcttaaaatccgagctcgtcagaaggaggttgtgcttctccctagtggaggaacctctaacatacctgcagtcatccagtcccaaagctctaggcagcaatggaccaccattccatgtcatccgaacctcaaacacagatttctgtgactttcttctggttgatatctcatcagctgccaggctccttttccttcttcctaacaccttacttactgattactggaaaacagatggacaagtgcttcagcagactgaagaaagctggattttaaagcagctcttgagaagacacctgacttgccaaaaaatttttcccaaaggctcaccagaggttttggtggcacttgttacctctgataatagagatgaaggaggggctaaaaccaaaatgattggttgaaacactcttt

SEQ ID NO: 477105 - DNA, 611 bp, Homo sapiens
gcttacttttttcctgtttattaatgtatttaaggtttttagcttgcttgccatgggttagaacatgctcctttagctcggagaagtttgttattactgaccttttgaagcctacttctgtcaactcatcaaactcattctccagtttttttcccttgctgagctgtcaggcagggatgtttaagtctgcagaagctgtctgctgccttttgttcagatatgccctgcccccagaggtggaatctagagaggcagtaggccttgctgagctgcagtgggctccacccagtttgggcttccctgtggctttgtttacactgacagcactgaattcaatgactcataattgctgtgttctctctcccacagtgcccagagatgctctccgcaccaagccacagatgtggaggaggcagcttgccattctgttccttttacttggggcatttagcccatttacattcaaggttagtgtttatatgtatgtatttgatgctgtcatcatgatgttagctggttattatgcaaaattggtaatgtggttgcttcatagtatcatggtctgtacttaagagtgtttttgatacttgtgtatgcttcacgaagttctc

SEQ ID NO: 477106 - DNA, 702 bp, Homo sapiens
ctggagaattgaagaacagctacaagtacgcacctctctctctctctctctgttgcctgccgcatgtaagatgtgccttgcttccccttcaccttctaccatgattcagtgtgaaaacggactaatacagagaattggtaccaaggtagtgtggtactgctataaagataacttgagaatgtggaagcaactttggaactggataacaggcagaggttggaacagtttggaaggctcagatgaagacaagaggataaatgaaagtttggaacttcctagagatttgttgaattgttttgaccaaaatgctaatagtgatatagacaatgaagtccaggctgagatggtctcagatgtaaatgaggaacctattgggagctggagtaaaggtcactcttactatgctttagcaaagagactggcagcatttttcacctgctccggagatctgtggaactttgaacttaagagagatgatttagggtatctggcagaagaaatttctaagcagcaaagtattcaagagggccctgggccctgctgctctgtgcagccttgggacatggtgtcctgcatcccagccactccagctccagctgtggctaagaggggccaaggtacagctcaggccattgcttcagagaatgcaagccccaaaaccttggcagcttccacatgatgtttggcctatgagactctgga

SEQ ID NO: 477107 - DNA, 589 bp, Homo sapiens
cagcctgccaggccagaagatatgggtaccagacgcatgtacatcaatcaagagattttgttggtgagaagatgaactcattctcttccaattgcatctatttcctaaggaaaatctaccaactgggtataagtggagacactattgttgattttagtggaaggaagatgtgtaatagcagttttaataggagagaaaacagagttcttatagaaatacatgaagataagccagtactgaaagtactcccgccaccaagcttgagcctccctcgagttcagactgctctgctggcagcgagaatttcaagccagtggatcttagcttgctgggatctgtggggtgggacccaccaagccagaccacttgggctccctggcttcagcctcctttccacaggggtgaacggttctgtgtcatgggaaggagagctctgcttggagaaggaaggcactgggctcacagccagctgttttctaggcgctgttccttctactccaggaggaccctcactgacctggcatatggaatatgctctatagatgttggcgaggaatcctcaaaaaggtatattctgtgtttcagaata

SEQ ID NO: 477108 - DNA, 744 bp, Homo sapiens
gtgcactcagggctcactgctgccatgacctgggctcaagtgatccttgtgctttggcctcccagctgcttcttttctcattctacttgttctcccttgttatctaagcgaccctcccacgttcatcagagctctgcactgaatgtaagcaagcatttgttgaatactaattttaaaacagcatttttccccatctatgtattgtttcttatgtgcttggggcccttggatgtagaatctggagagaaagagagtctctgggctggtatctggggacacccagacaaattagccaaaaccctgcgttcacattccagcagggaagaggaacaaacaggcccagtcactctagagaaacagcaagatgagccccttaatggagaaaccaaaactccaagatcctgtgaggagtttcagcttccagcaccaggaggcccctatgttaatgcagaagtcttaagatttccaggctctaaaaacaatggttctattaaaagagaaatggttctgtcaagctaaacttaccacaccccagtagggcaaagaaggttgcagatttttatagaatgcaagagctgcttatctgcttgtgttaccaatcaaataaactgattgtgtatatcaatcaaataaaataattattactgttaatctaattcacttttagcctctgcaaccactaaaataatgcctttttaatttttttgtggttgaaaaataatgcatgaaaattatgtaaaatgt

SEQ ID NO: 477109 - DNA, 511 bp, Homo sapiens
tcctcatggctttgcggaaatagatttgcaatgtatcaagcatcgttgagtaaatctccacccgaaattcaaccatgtaaaatgctaggttattgccaggtctgctggagtttgctggaggtccaccccagaccctctttgcctgggtatcaccagcagagactgcagaacagcaaagatttctgcctgctccttcctctggaagcttcctcccagaggggcaccggccagataaccagcaaggagggatgtttaattccgctgaagctgtgcccccagctgccccttcccccaggtgctctgtcccagggaaatgggagttttatctataagcccctgactggggctgctgcctttctttcagagatgccctgcccagagaggaggaatctagagaggcagtctggctccggcagctttggggagctgcagtgggctccacccagttcaaacttccctctgccctgttcgaacttcccagctgctttatttacactgtgaggggaaaacc

SEQ ID NO: 477110 - DNA, 1037 bp, Homo sapiens
caaatactactgaatggctctctaaaatttacatgaaggaaagagctattttatgctagcacacagaagaatccacattgggtagtaaacaagacaagagactaatgggaatccaaaatcagactcactggataactaagctttgtgaacaccggcagtgaaggaaatatgaaatgggcccagcaggttctccaacgacttcaaatgttttggtcaaacttcgcatctctccgttatctatttttgggcaatcctgatcacgctttagtttatcaaaagtatgttgaaatgaccactttgcttgatcaatttgaaagtcgtatctataatgaatggaaaagtaatgtggatgaaatctgtgaattcaatttgaatcaacccttggttaaattcagtgccataaatggtcttctctgtgtcaattttgacccaaagtacattggaaatcttgaccttcttgtgcaagggtataataaactcaaacagacgctcctggaagttgaataccctctgattgaagatgagctgagggctattgacgagcagctgacagcagccacaacgtggctgacatggcaggatgactgctggggctacatcgagagggtgagggcagccacgtccgagttggagcacagagttgagcgcacacagaaaaacgtgaaggtgatccagcagaccatgaggggctgggccaggtgcgtgctacctcccaggagagagcacagacgagaggcagccttcaccttggaggacaagggtgatttgtttacaaaaaaatacaagttaatccaaggagatggctgcaagatccacaacttggtcgaggtaatggcttttaacctttcaagatttatagatcttttcattgagttcagagaagagcaaaaatctttaacctaataatgtgggactcttttatcaagcctgaaagagctttatgaatggtattattaggcatttaaagtggaggaatttgtgttacttgcctgcaatttctgtagccctcaccactgtcattcctgagggaagagatt

SEQ ID NO: 477111 - DNA, 886 bp, Homo sapiens
tctggctttggctcactctgaggctataatgcacgacttagacttctttctgaagaatacagagaaacaattgaaaccggcacctctgaatgagctacaagaatttataaaggagacagattccggacttcagagagaattaaatgaaggtgatcatgatggtttagttgacatcatggtgcatcttctggctgtaagaagccgacagagagctactgatgaactctttgaacctctaaaagaaacgatcaccctcttggaaagctatggccagaagatgcctgagcaggtctatattcagctagaggaaatttggtcactcaacaaggaagtccgcgtctgggatgcttacacgggcctggaaggcacagttaaggacatgacagcctccctgagggccatcacagagttacagagccctgccctcagggacaggcattggcaccagctgatgaaagctattggggtcaagtttttaataaatgaagccacaactttggcagatttgttagcactgcggttacacagagtggaagatgatgtccgaaggattgtggacaaggcggtgaaagagctggggactgagaaggttattactgaaatcagtcagacctgggcaaccatgaagttttcttacgaagttcactatcgaacaggcattccattactaaagtctgatgaacaactttttgaaactctagagcacaaccaaggtacacgcgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatg

SEQ ID NO: 477112 - DNA, 1179 bp, Homo sapiens
caggtagtacaatagcaggcttattcacagtcacgagaacagcatgggaaggacctgcctccgtgattcagttacctcccactgggtccttctcacaaaacatgggaattcaagtatcttgagacttgatgaactagataaagagactaaaggagataagccagctgagaatagagcattggaaaagactgaattcggtgaacaagaggaggagacaaaaaggaggcagcaagagagtgaagatattcgaatccagcttgtgaaagatgctagaagatttgatggggtggatgctgaatttaagaagagaaaaattctgtgtgggcctaaagtggtgacagtgcttatcacatttatttttataaaaacggtgtgcttctacattgcttttgatcttcatctaagagttgaaaagcaaaatttagaaaagattgttctaatatccacggccccgtattgtactttcatgcaggagttaatgttcaagacagccaaagtagaaaatgtgttagaagcaacgtgcagacctaatctctatgaaaaacttaaagatttacagtccaggctttctctttgtgaaaaagctctcgctgaatacctggaaaccaagcgcatagcctttcctcgcttctatttcgtctcttctgctgatttacttgacattctctcaaaaggagctcagcctaaacaggtaacatgtcaccttgccaaacttttcgacagcattgcagatctgcagtttgaagacaatcaggatgtttctgcacacagggcagttggaatgtacagcaaagaaaaggagtatgtcccattccaagccgagtgtgaatgtgtgggccatcaagtgttgaatacctactatgcatcagatgctaggtcaggctttggggagttccgaaatggcccttgtcttcgaggagctcttaggcccattgagaaaatggatatgcacataataatggagctccccaaaccttctacccctcagcctgtggtaactactattttgctgtttatgtaaattggactttttcatttaaaatttttttaaattttatttgcagaaatgtatgaagtacaagtgcaatcttgctacctgcgttgaattcgtaatggtgaattcagtgctttttagggtatctttcatctgaacaatgtatagtgtgtccattaatttct

SEQ ID NO: 477113 - DNA, 597 bp, Homo sapiens
ggtagtgtgcagccacccgggagcctgaactggaatcagtgggtcttttatatgattgtatttaattgttacagtgacactatggggtatatcaggattggagataaagaatgtgaatttaacaagaactttcgccttatccttcacacaaaattggcaaatcctcactataagccggaattacaagctcagacaactctcctcaatttcacagtcacagaagatggtctagaagcccagctgctggcagaggttgtcagtattgaaaggccagatttggagaaacttaaggtgattgaagccaaagaaaatgaaagaaaaatcaacgaggcccgagaatgttacagaccagtggcagcaagagcatctcttctttattttgttattaatgacctccaaaaaatcaaccccctctaccaattctctttgaagacaaatgtttattatgatcaatcacgtcagatgcttgtcacttgagtgtatagttttggacaaaacataagggtggaggtatatctatatgtagatacatatagatatatatgtacacatagatatagttccacctttatgatcatacatttgtttataaaagta

SEQ ID NO: 477114 - DNA, 646 bp, Homo sapiens
tggcttcactcctgaagtcagcaagaccatgatcccaccagaagaagaaacttcggacacatctgaacatctgaaggaacaaactctggacacaccatctttaagaactgtaacactcactgcgagtgtccacggcttcattcttgaagtcagtgagaccaagaacccaccggaaggaaccaattccaaacacaatatgaccctggtaggccacctagccatggatataagcgaaatccccaaatcccagaaggtagcacacacaggcctgagggtcaacgttgccatgacagacatttttgacagatatgttcttggcgttgagtcccacattgtccccaggaagagcttcactcgaagcttcatgatgcatttcaacagactttacttcagttgtaacgtcgactggagcaaagctgaagagcacaactggtttgcaagactagatgaccaataccaggtcagatgagggcactgatgaaaaagaacacagaacagtgtttttctgactgtactttctattaagtggaatcattccatggtcattccatacattatgggacactgtttttgtataaccgtcctgtaaatctaaagaacttgagtaaagcaaaagtttactcattccttgtgtacctggtttagc

SEQ ID NO: 477115 - DNA, 1475 bp, Homo sapiens
gctgccaaccttcttgcatggaagacaacccagttggattgccagcttttattcctttatttgtcccctcccatgtcctgctgattggtccattttacagaaggctgattggtccattttacagagtgctgattggtccattttacagcacactgattggcacattttacaaaactctatctagctacagatggctgattggtgcattttacaaacatctagctagctacagagtgctgattggtgcatttttacagagcactgattggtgcattttacaaacctcttgtaagacacaaaagttctccaaatccccacttgacccaggaagtctagctggcttcacctcttacatacagttcatgtacgatgagtttgtggaggaatatgagcctaccaaagcagacagctatcggaagaaggagctcaggatggggaggaagtacagatctatatcataaatacagctgggcaggaggactacactgcaattaaagacaactacttccactgtgtcttctctattacagaaatggaatcctttgcagctacagttgacttcaaggagcagatttaagagtaaaaaaagatgagaatattccatttctactggttggtaacaaatcagatttagaagataaaaggcaggtttctatagaagaggcaaaaaacagagctgactagtggaatgttatctatgtggaaacatctcctaaaacatgagctaatgttcacaaggtattttttgacttaatgagagaaattcgagtgagaaagatggaaggtgacaaagagtggaaaaagaagaggaaaagtttagccaagacaatcagagaaagatgctgcattttacaatcaaatcccaaactcctttcttatctcgactatactaataaatataatttataagcattgccactgaaggctcaattgactgaaattactttaacattttggaaattgttgtatatcactgaaagcatgaattgcaactgcaatgaaattcaaatttacttaaaaaagaaattaatatggcttcaccaaggagcaaagttcaacttatttagtaattgccaacaattatcatggtcctgaatgtagcatgggagcttgtgtttctgaggcagtctttcttgaaatattaaagaagcgagatgggggtgaggagagggaggaaagaggacttcctctggtgttttattataaagcttacattttatatcatattaaaatatcttggtcttctactgtcttgaaaaatgacaattgtgaacatgatagttaaactgtaccactttttaaaaccattgttatgcaaaatttagaagaaaaagttattggcatggttgttgtatatagttaaactgagagtaattcatctgtgaatctgctttaattacccggtgattaaagtagtgtaaacttgtacatggaaatttttgaatatgccttaatttagaaacagaaaaataccc

SEQ ID NO: 477116 - DNA, 648 bp, Homo sapiens
gccgtggctttttttttttttttttttttttttttccctgaggtggaattctgctttagaagtgcacgtctcactctaggggaggaggtgtgtgtgtcccgtggtgttgaggctgacgcttaccataaatgtcgtgtttctccctgcaagccgctctgaatgattttagcgtgttgagaaggcgtgacaggccagcccagaaggaggaagggagcgttggcagggacatgcagctctggaagctgaccggcgggtgcccgcgggagacagagcgaacgcagtgctggcactgcgtccctggcctgcgcctctcccagaatgggaagacgacccccaaccccttgactagtgtgcggggtcctcgcacgcggaccgccgccggcggccgccgggagcagcgagctgagccaggttgggtgggggtgtttcctcgtcgagagctctctggtcaaagtttccttcccgctggaaaacaaaaacaaaaacaaaaaacaaaccaaaaccaaaacaaacaaaaaaaaaaaacctggctaggcgtggacctgtgaattcctgaggggtgccccttagcagtccatttctctttcgtgtggttttactaagaagttacctaacatttcctgggaagagaggtaatacaagcccctc

SEQ ID NO: 477117 - DNA, 836 bp, Homo sapiens
gccacagtccagtttccatttcccctgaagagccagaaccagggcgatggatgctaaacaaacagcttctacaaacgcagactaaggcacttctcgttcaagatgtggaagcgaggacgtggtgggtcctctggtgtgaacttccggatttctgtgggtcttccggtaggagctgtgatcaactgtgctgacaacacaggagccaaaaacctgtatatcatctccgtgaaggggatcaagggacggctgaacagacttcccgctgctggtgtgggtgacatggggatggctacagtcaagaaagggaaactagagctcagaaaaaagagaaaagatggcgtgtttctttcttttgaagataatgcagtggtcatagtgggcaataaaggccagatgaaaggttctgccattacaggaccagtagcaaaggagtgtgcagacttgtggcccccggattgtgtccgatgctggcagcattgcgtgattctccagtatatttgtaaaagcaaaacaaaacaaacaaaaaaattttaaacccattaaaaagtatttgttcccagaaaaaaaaagagtagtgtcaaaacactttaatagaagccgatttgtaaatacttatgttattttaatgtcctacaaaattatttttgagggactgaggcaacagtgaacagggattctggtacttttcttaaaatccaacttttcttgataccatatcttgtttgaagtatgtaaacaagctgttgtgttctctggtgccaagtgataggaaggaagaggggaagtttagctttgtattctcctggctcctccccagtgtattgctaggcaggcca

SEQ ID NO: 477118 - DNA, 879 bp, Homo sapiens
gtttgcaacttctgatttaaagaagacttaaagattaaattcttttcaataaaattctataatgaaaatgaaagttactgtgtatggacactttttaaatcaagtgcccctaagaaacgatggcctgaattctgtgcttgggcctgagcttctggcctggttacacagtggccaagcagagtgttcctgttgcaggtaccaccatccactcttgtgtagacacacagctgaacacagcagcaggtgtttatgggtagttgataatactgttcagagacagagagaaacgaaaaagaacaacaacggatttggaaggaaagataataagtctgttcaggaaagaatcatgtttaagtcagtgcagaatatgcagagggatgtacccaacagaaggttggaaactcaggcaggcagtttacaactctaccttaaccttcacttcctacttgtgcagagcctcaaggtcatccagagggaaaatgttgccctgcagaaggcatctggttatcacagctggggaggtggagaggatgctggtatctacaaggcggaagccggggatgctgctaagcatcctgtaacgctcaggacagccccccacagcaaacagttatccagccccaaatgtcaatagtgccaagattgagaaaccagagctagattaaggtattgcctccatgtttttaaccacatggatgctggcaatagtttataagctatagaagctcagtgattaaaatcagtccttagatttccacacagtgaggagcaaataagatcaaagcaaaccagtagagattggctccctcacccttctaccacatggaggtcagatacctgtccttgagcttgtgagaagaagcctaaatatcaggtttc

SEQ ID NO: 477119 - DNA, 884 bp, Homo sapiens
tgcatttctcagccagtttgtctttgactgaaatgagctttttttttttttttctgaatacaatttatggaagcatcctcctgtggtaggagggccgggggctgtgattcaggccagaagttattccccctgcttaggactcttgatgcccatgaattgaatattgatctgactccaaggcaccagtgtacaatttgtctttttggtcagcttgcttctcatgtcttcatggtgcccgataaggagatctgctttttcctagacctgaatagtctgactaaacaaaaccaggttgccatttcctataaatatcaaattccagggaattgtctcctaggcaagagggatctctccagaaccacaggaattgctagttggcaaggccccaggattcgttgtggagaagctgtccttgtaatcccgggagataatctctattatctaagagaggaagggagcttgccagagataaaaatgctcacacaaggccaaaattcccccgaaagtaagtttaaagggacagtggtgacagaacaaagttttcacatgaccacaagaccacttaatccaatcccaagcctccatttccaaaatggctggctggctcagctttctgccctacaaaatcaaaaggcaaatattgttactggtgctccaatttcagcaaactcttagaatatttctacttatataaatgtaatggaggaggaaaaagtgtataccttcttttctttctaaaacaatcacttagtaactcattactcatcagctgacatttggaaatagcatggtagcctgaagtcaaatcttttttcgtttcttcaatcactctccttcacttacagagtgagtctcagttgtattttttaagcagactgtggaaa

SEQ ID NO: 477120 - DNA, 806 bp, Homo sapiens
ctcatctgccaccccagcagcctctttcctggaaattaagtgcatgtttcatttgcttgcagcaggaataagactacgtttttttttgaaatctaccaacaaaatgatctttctaaaagtcaccctcctggaacttgcccatgcatacgaattacctgagaattttgatcaagtgcagattttaatgcagttaagtcttgggtctaacctggagttctctgtttcctataagtactcctgtgatactgctgctactgctatgactgaaccgcaaggtggggagaggagggcagcaggagtactagtggtctcctgccttatcttgactgtccctgctgctcctcatgtggccctggtgtgtcgtgccccctcctctcgggactgcacctgggggaattggctaacttacaaggcaaaggctcctcctgagggtgtggggagaggcttttctcagggtgccaaaggtgggtctgatcaactgacccagcagccctgggaagaaagccccagtcagtcacctatctggaggcttataaatgctggatccgcaggtatggaaacccacaccacatagcatccagccagggacccaaatcataataaaaatgtgggcatgggtggattgtcgactattataatatgatgcgctacatcatccagaaggaaatagcctcacagagtgcagaaacagacttctaaaggcaccggggaagtaccattgtgtagccaatagtcttcaaggatatggcggcattttttaggatgcagtatacacatcaaattagagtgctttatatggtactgtg

SEQ ID NO: 477121 - DNA, 833 bp, Homo sapiens
cattagaagcattagaagcaacatgatgtggagagaagagtgtgaacaattggcatgcagaagctgcaaaaagcatgtggcagtaacatcgactcagcctactgtggtgaaaggtcgcatgagaccatgcattggcgaggacaggaaaagaggaaaaggcacagtgggagtgtccagctgtgaccttggagcagttgaagaggcaggagtggctcaggctaggagccccccaccccacaacaggccccagcgtgtgatgttcccctccctgtgtacatgtgttctcattgttcaactcccacttatgagtgagaacatgcggtatttggttttctggtcctgtgttagtttgctgagaatgatggcttccagtttcatcaatgtccctgcaaaggacatgaactcattcttttttatggctgcaatggacaaattctttagtggtgatttctgagattttggtgcacccgtcacctgagtagtgagccaatgtgtacactgtatccaatgtgtagtgttttatctctcacccctctcccaccctttcctctgaattcccaaagtccattatatcattctcatgcctttgtgtcctcatagcttatctctcacttacaagtcagaacatacgatatttggttatttggttttgccttcgtgagttacttcacttagtgaataatggtctccaacttcatccaggttgctgtgaatgtcattatttcattcattttcatggctgagtagtattccatggtgtatatataacacatttcctttatccactcattgattgatgggcatttaggttagatccgtatttttgcaactgc

SEQ ID NO: 477122 - DNA, 634 bp, Homo sapiens
atatcccactcctaacccaaaaccaatgtgtaacctccacatactgtctgtaacttctgcattcctgaaatgcacccctgcctttaaaaacctttccctgcaagccacgggggaggtcagttctttagcaagagctgcccgtattcttttgcttggcgccctgcaactaaacgccttcttttctgccactgcaaaagctcagtgtagcatagagaagctgttcatgcttgttcatgaaaaaggcccccttccccacttaagaacacatctagtagtcataaagaccttgctgataaaacaggctgcagtaaagaagctggccaaaacccaccaaaaccaagatggcgacgaaagtgacctctggtcgtcctcactgctacgctcccatcagcgccatgacagtttacaaatgccatggcaacgtcaggaagtgagtgccattaagcatggaaatcttatagtgaagttagaaattcttcagagggcaagtgagctgccatcttgggtgctaccagtttcagccagtttggtcatgagggagaactcctgaccttaagatgccggcattctgtttcttaaagataagcagggttaaggtaggggagaaagtcaggtaggtcatgtaggctttata

SEQ ID NO: 477123 - DNA, 1790 bp, Homo sapiens
gtggtgtattccaaaaggggagaaaggcatgctccttccaacagctgcaaagcagagatggtcatcaggatggggagggccacacagcagaggccctttggcgaacattacttgggactaacaagcacaggaaaaagtggagaacaattttgcaggagccgagaagccaagtctcagccaacagtttccttgtccccagggggcatctgtttccacagcaactacaacctggggagactgctgccttcagactgtcccaggaaaatatttagtctgcactatcaattctggatggccagaaagagcactgaatacaagatgcaaaactcactggggcttagggaggttgaacaaattgcttctatcaccactgaacctggtgcctcatcccagcaacctccacctgatgacaacaatgatgatgacaaaagtaataatgatcatgacagcaatgacaaagatgatgatgacagtaatgatgatgatgatcatgatgaagatgataatgaagacaaaagtgatgattataatgacaacaatgacaggataatgatgacagtgatgatatggatgatgacagtgatgatgatagcaatgatgataatgatgacaatgatgatgatgatgacaatgatgatgatgttgatgacagtgatgatgacaaagatgacaatgaaaaagatgatgatgactgtgatgataattataacaatgatgacaatgacaaagatgatgacaatgataatgatgatgatgataatgatgactgatgatgacaacagcgacaataatgatgctaatgatgatgacaatactgatcatgacaacaatgacaatgataatcatgggaatagcgatgataatgacaatagtgacaatgataataatgatgacaacagacaattttctaatagtgatgatgacaacaatgaccatgatgacagcaatgacaatgacaatgatgataatgatgatgacaatgatgatgacaatgacaatgatgataatgatgacaacaatgacaatgatgacaatgagaatgattatgacaatcatgatgataataatgataatgacaatgatgatgacaatgacaatgagtataatgataattatgatgacaacaatgacaatgatgacaatgacgatgatggtgacaatgacaatgatgacaatgatgatgacaatgacaatgatgatgatgacagtgatgaggatgaaagtaccaagctcaactgcaatgtgcatacaccctctaggcctgttggtggagttagtggacacttcaaaagatcttgtgcagttggggtatccacaccacattcacaaagcccctcattgtggcagtggatctggggttcagaagaggagcagcagcccaggaaccagaagcctggagcctgggctctctttctccataccatcaagttctatcagagaattcctgggaatcaaagtttttatggagatgtatttgtccagcgcaatgagaaattcagaaccatcccaaatcaggaagatgagcacagcaaagagaaaaccaaagaagggcatttggagaaagttctgagagtccaggccatcccttgtggcttgatttgccatttacaaattcctggactgctctcagtggatggattttatggcagtaccaccgcctccattttagccaaggcttgaaattctcaagatgatcaggaatattaattaattttaaattttcacatagaaagaggggacaatgaaggaagaggaactatcatgtttgagcaatgctgtatgccaagtac

SEQ ID NO: 477124 - DNA, 1034 bp, Homo sapiens
ctgcagctgcctcgcctgtctgctgcagctgattgcctgtgatctccatcatcctgcagcaggcatgcctgctgacacagcctgttgtgtcggagacctgattactgcaaatcccatttccacctcgcagattcctcggaaattgcagacgtccattcttaaccggtgtgaggtgatagctccttgtggtgttgatttgcgtttttccctgatgattagtgaagttaagaacatctttttatatgtctgtcggccagatccagcaattccacttccgggtgtttatccaaaggaaaagaagtcagtatctaggagagatcatgttcacggcagcatcattaacaatagccatgaaacagaaacagccaaaatgcctgttgatggaaactcttatctctcccaatacccacatcccttgcccaaaatactaccaccatcaaaggtgtttttgaaatacagaaaccctgaattatccaaaaatccaaaactttaatcgacgctgtcatgctgtggctctgttggctgatcaggtggttaaaagggttcgccaaagctttttaggtacatgcaaataaggctatcagacttgcagaaactgtaaggttctttcaaatgcaatatcaggatgaaagaaggcttataccctcaccctttcggatgattgcaaagctgttgtggagcaaaactctgtgcgtgagtctgattggttctgtggcatcctcaagcaaggttaaagccagatgctttgggatatacttagaagtaaagaataatagctggatttcaaatccaagatggtgactccttcctggctagaaaatatggacagagaggagtcctggcaagctgcctggcttagcaagaacacagaacttgaaaccaggaaatctggactccatgaataaatcattcattctccctaaacatctgtttcccaatctaaaaatattagcatccactccatacttaccactcacactgctgagaggttcaaatgggaagatcattgtggaaacacgtggagaattctaagc

SEQ ID NO: 477125 - DNA, 1535 bp, Homo sapiens
atccgagttcaaaatgggtcgtaaagcagcagagacaattcgcaacatcaacaacgcatttggcccaggaatggctaacaaatgtacagtgcagtggtggcccaagaagttttgcaaaggagacgagagccttgaagatgaggagcatagtgaagaagctccaaagcacttccaagagccaaacttgcaccaaaaaaaggtcatggtcactgtttggtggcctgctgttggtctgatccactatagctttctgaatcctggcaaaaccattacatctgagaagtatgctcagcaaatcgatgagatgtacagaaaactgcaatgcctgcagctggcattggtcaacagaaagggcccaattcttctccttgacaacgccccaccacaggtcacacaaccaatgcttcaaaagttgaacgaattgggctatgcagttttgcctcatccaccgtattcatctgaccccttgccaaccaactaccacttcttcaagcatctcaacaactttttgcggggaaagcacttccacagccagcaggatgcagaaaatgcttcttaagagtttgttgaatcctgaagcacagatttttatgttttgggaataaacaaacttatttctcattggcaaaaaaatgtgttgattgtattggttcctattttgattaataaaattcgcagtccaaaaccacaattatttttgcaacagtcaaccttgaatggtgtcctagtccattttctgttgcttttaacagaacacctgaagcttggtactttataaagaaaagtcatttctttcttactgttatggagactgagaagtccaaggtcaaggggctgcatctggggaggaccttcttgctggtgaggactctctgcaaagacccaaggcagtgcagggcattggtgaaggagctaagcatgctagctcacatctctcttcctcttcttataaacgaaacagtcccattcccatgataactcattaatccatgaatctatgaatgaattaatttattcatgagggaagagccctcatgacccaatcacctctgaaaggacccacctctcaatactgccacattggggattaagtttcaacatgatttttggaggggacaaatattcaaaccacagcaataggtgtataggttggagcatttaaagacttgtaaacaaagactaactgaatgttttctgaaggcccattttctgtcaataaaattctgaatcatactgagacaaagcaaatgcctcatgtatgcaaagcacttgtgttatgtatccctactcaaatgtatttcatttacttatgcattaataaaagcatttatttaacaaataatgatggctccagttactgtattatacaagtggacttcactaattacttctccaactatttgcacttgccattcttccatcaagaaatgaagtctctttgctatggtctgattgtttacatcctgccaaaattcttacactgaaacctaatttccattatggcggtattaagagaaggggtctttaggaggtga

SEQ ID NO: 477126 - DNA, 629 bp, Homo sapiens
cgggaagctctgcttctaggaaaggctcgggcccacctggacaggtgggaacccttgcaaactccaagttcccagatgccgccaagggccaaccttgtaagcatgtctttcaaaggacagcagttaggcctgctaaggggactctgttctgcagacaaactaaatggggaatgtgaagagtccaggaaagtgttatgtctgtacagagtcttgggtcttactctgtcacgcaggcttgagtgcagccaaagaaagagaaaagaggtctatcagggagaaagtggtatccaggaggctccaggagcctctcaccttgagcataaattggataagcagacttctcctggcagatttccaagttgggaggaagagcgtttgcatggaaaattgttgctggctaatccaacaaactcaaaagcttggcaggcccggtcctcttctactgaattactaaatcgagatactatgctagacactggggacaggaaagttggagacgcttctctagaggtatccatgaaggacacagatataaaatagtgattgtaatatgttgtgtgctgctagcaagccacttctgatttgccaagaaaccacagaagggagaataaccaactcaactttgcaca

SEQ ID NO: 477127 - DNA, 2759 bp, Homo sapiens
tctccagaagaaccctaagagtgtgtgtccggaattggggggtttttgttctcactgacttcaaaaatgaacctgcgaaccctcgcgtggctctcgcactgggtctgcaggtggagctgcctgccagtcccgcgccatgcgctcgcactcctcagcccttgggtggtcgatgggactgggcgccctggagcagggggcggcactcgtcggggaggctcgggctgcacaggagctcacggaggcgggggaaggctcaggcatggcgggctgcagtcccaaggcctgccccgcgggaaggcagctaaggctgggggtgagaaatccagcacagcgccggtgggcgggcactgctgggggacccagtacaccctccgcagtcgctggcccgggtgccaagtccctcactgcccggggccggcagggccagctggctgctccgagtgcggggcccaccaagcccacgcccacccgcaactccgcgtgcagccccggttccgctcgcgccactccctccacacctccccgcaagctgagggagtgggctccagccttggccagcccagaaaggggctcccacagtgcagcggtgggccgaagggctcctcaagtgccgccaaagtgggagcccaggcagaggaggcgcccagagctagcgagggctgtgaggactgccagaacgctgtcacctctcattagcataaattttctggagattcatccaaattttttcatttaaaaaatcaataatttattcccttgttattgctgcatagtacccacagtatacatataccacagtttgtgtaatcattcactgggtgaaatacactgggttatttccatagactgttactaataaagctactattttcaggattttttgtgaacgtaagtttccattcctctgagttaaatgaccaagcacacaatttctggattgtgtaacatttgtgtgtttaacttcataagaaactgccaaactgttttatggagtgactgtgccattttacatttgtaccaacagtgactgattcagtttctccatatcctcaccagcatttagtgttcttactattttttgatttggtcattttgctaggtgtctagaaatatattattgtagtttaatttggggaggattttaaattacaaattcaatttttgaatcattatggagctgatcaggtgatccacttcattttggttgagttttggcagtatgtggctttcaggaatttgtccatttctcctaagttgtggtttttggtgttctcttaatgttttaatggctacagaatctgcagcgatatcccagaatatgatattaatatactctatatgtacggtgttatatttttgatattgatgatttgtgtcttctatttttgtcagtttttcctaaaggtttatcaaatgtactcttttgaagaaccatcttcttgtttcattgatttttctgtattgtttttcttttcttaatttaattaattcctgatgtaatttttattatttccttccttatgcttgctttagattttgatattttggatttcctgaggcataggaacttagattacttattgagatctttcctttttctttataaatgtgagggtatgagaaagaaaatatgtggctacagtatgtttttctgcacaccaatgctttcataagctataaaaccatattctgtttcttaaagaaatcagtgacagggtattgaatgtaacactctgaacagaacatttccagcggtatgtagcattataagagtaaaacaggaagactctaccaacagatttaataattaaactggacttggatgtagacttggatgtaacatgattctatctgtcactgtactttaacttttgaccacttccctggttttttcatctccactaatgctacatgaaatttcagttaggttccttcagcttttaaggtcattcttgagtaaaaaaatgtccccctttcagtctcctagctcagcctttttgtggctgggaaacctgcagtggggagtgggagtgggcagtagatgatggtggcctccttccctgtttctccttccctctgtcactctctgactgtactttgggtccctgcgagttggaaaggatgagggaggagaggaaaggcagagccagccaattagtttagacatttctattagattaggagccaggaaatgagaaaaatcctgtctcacaagggagctcttctcagcttgggcaacagagcaagactccatcacaaaaacaaataaataaataaaataaacaagcacatccattaagatccttcttggtattcatcaccatttcctagatacctggaaaataaggaactctaccttttctgtgcatgaaaccaaactctgcaataagaacctcccttcttgagtccagatttattagaaaatctgcatttataacactctggttctctggagaatgtaactttcagtccagataaaaatatggtttgacagcaaaatcatgctatgaaagcaagatcatattccagactgcatataacacaaccaaatatgaaaaaaaatggttaagagcaaaactatacactggatttgagggctgaatctgctactcacttgttcagagacttgagagagttattaaatctcttaaagtttctgtttactcacctataaaatgaggccaataacactcaactcagtggggttactgtgagggttaaatgaagtaattcaagtaaatgtgttttgccttgaatac

SEQ ID NO: 477128 - DNA, 683 bp, Homo sapiens
taccattaagaacattcaagattcatgggaggagaaatagctttacggcctgtatggttcagcagtcaagagataaagaggctagagcttgggtgcttgggtcagaccacctccaattgctacctcatattttcctgtacagattcttcttctcttatggagcaaaaaaatattatccatggaccatgtccagctcgacatttgggatctctggatggagggccatcctttccatcaggacacctaatatacaatggtgaagaaaacgaagacaactgcaacaaaaactcctgctcagagaaaaggggagaacgggaaactacagcaattaccaatcttgacaaattatcaaatcctgctgggcaattactaagtcctgctggacaagatcttgtttctgatcagcctgaggttcacgggctatagggccatggtgtcccttgatgggtgggtttatgaagatttacgacggcatgtgaacagattgggcaagctgggacattatgtgtaatcacggttttttattggagagcctttattaacttttccacttggttcacaatatgggagggtattttgatcttatcacaatgaataatttggtgagtagctttctaaatttttgctatgcatatacaaagacatgtatacaaaaaaaaaaaaaaaaagaaaacaaggtctac

SEQ ID NO: 477129 - DNA, 4232 bp, Homo sapiens
ggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggctgacggcgactccttcatgcttgttcaccttctgtatttctttgtgattagtacgcttcaaccctccgtcccgttacattctgactttcctggcagtcgggtgaacttctcactgtataacagagacactgatgcctcatccccacgtttccccagctccgggaatcccagagtctcctccctgtcattctgtggccagtgctgcaatattgctgaggaagatgccggagctggttgtcgccttggtctgtgggaggctctgcggcatgtcctcgggggctgtgaggagatggaggtggtggccaacatgtggctcctggacacactggtcttcttggttctccctgatggaacagcccaggctcagaagccacatgccaagatatagagcccaggtgtggccgggagaggaaaggtccctgagcccaccagggcccacctctgtgctggaggagaagaggaatgcagccacattggattagggcccactcaattacctcattttaatttaatacctccctaaaggccctatcttcaaatatagtcaccacattgggttttagggcttcaatctatgaatatggaggggagggtcacaatttagtccatagcagccactaaacaacatcttattttatttcaaataaaagtcgagtgtatgatttaaaaataaggagatgctgcgtgtgagtcctggatgagtgtgcctggactgcctgtccaggaagccctgtatccctgagttcagctccctcttccatactatggagctggcccctcccagagccctggctgttcctcagatgccattattaaatcagaattccaaaaataatatgcagctatttaaagcacacactcaatttgttaccctaacaaggtaaatggaacaattttgagttctcatcatgtgaagaaatttatcaagagaaagaagacttccatttaagtgatgcagtatggatttttaaatggggctggccaatggacagcaccttctcaaacaactaccgttgtgatttatttttcatttttaaatggctttattgagtttatgtaccataaagttcaattaaataaactttgtccaactgaataaagttcactcaaatgctttttcctatagagttattattatttagaattatgcaagaatcttagtcttattacacattaatcttatttaatacatatgtcaaatgatcttattgtagaaaattagtatacaataatctaaatttaggatatttttattatcccccaaagacacctcatatccattagcagtcactctccatgtatacccacacctgccctccagcaagacataggcacccactaatttactttctgtctccatagatttacctgttctggacatttcatacaaatggaatcatataataggtgatcttttgtgactggctctttccacttagcataatgtttttgaggtgcatccagatcatagcatgttttagtatttcattcttttttatggacaaataatattccactgtatggatggatcacattttgtttatctgttcacggctgatacatatttgggttgtttccactctggctataataagtaatgctactataaaaaatcatgcacaagtttttgtgtgaacacattttcatttcttttggataaatacctaggagtagaattgctaggtcttgtggtaactctatggttagcattttaaggagctgctagactgttttccaaagtggctgcaccattttccatccctaccaggagtatgcaaagcctctagtttctccatattcagaatctttttttttgtttaaattaaactgtttttattttgaactacttgtagattcacatttagttataagaaataacacagagagatcccatgtgccctttacccagcttccccagtggcaacatctgcagaactgtggtacaatatcacaactaggatattgacattgggacagccaagatatggaacatccgtcaccctgaggatccctcatgttccctttaaatagccacatccacttccctccacaacaccttcattcttaagacctgggaatcactaacctgttacccatttctttaaatttgtgatttcaaaaaatttatataaatggaataataaaatactgtagacatttgggattggcttttttttcactcagcataattatttggaggttcatccatattgttgaatatatcaatatttgtttctttttattactaagtggcattctatggtgtggctgtatcacagtttgtttaattgttggcccattgaagaatgtcttggtagtttccagttttggcctattaggaataaagctgctatgaacattcatgcacaggtttttgtgtgaacataggtactaatttttctggctcaaatacctaaaagtacagttgctgggtcatatggaagttgcctatttaggttactgagaaatagtgaaactttcccagaatggttgtaccatttatgtacccagcaacatatccatgtcttttgcctactttctaactggattttttaaactgctgggctttgagagttctttatatgttctagataacagtactttttgggatattttgtttgtgaatattttctcaaaacctatagttgatcatttcattcttttagcagagtctttttgagagcaaatatttttaatattgatgaggtttaattcgccagtttttccttttgtacttttggtgtcaagtctaaagactttttgcctagccctagttcttatgtgtttttctgaaagttttatcttttacatttaaatctataacgtattttaatttaatttttgcataaggtatgaggtttaggttaagattcatttttttgtctatgaatgtcaagttgctgtagcatttgttgaaaagactacccttcctccattgaattacttttgaacctttgtcaaaaatttgttgcgcatatttgtgtgatctatttgtggattctagattctgttttattgtcttatgtgtttatctggcaacccacgtcacactgtctggattattgttgttttataacaagccttgaaatcaggtaaagtgatttcttttaccttgttgttctttttcaaaattatgttaagtagtattattccttttcctttatatttaagtgttagaataattttgtctataggtactaaagaatttgctgggattttgataggatttatattaaaactgtatatcaatttggagagggttgacatctttactaagttgagtcttccaatccatgaacatggtatgtctctccatttatttagatcttctctgatctctttaatcagtcttttatggtttttaacatacaaatcctatacatgttttgttagatttacacctcagtatttcatttttgagcaactgtaaatggtattgtatcttaaatatcagtgtccatgtgtttattgccagtatatagaaatgtaattgacttttgtatattgatcttgtatcctgtgaccttctgaacttaattatttgttctaggagtctttttggtacaattttcttttgtttctgcttttgtaacatccattgtatttcccatgtagaccatcatattacttttatttctttctttccaatctgtatgccttttctttccttttctgaacttactgcactaataagaccttcccatgagatgatgaatatgagtaatgggagccaacatccttgccttgttcccagtgaaagcattcaatgtttgttaggtgtaggctttttctgaatattccttataatgaggaggaaattttttttctattttcatttttctggaagttttcatcataaatagatgttgaattttgtcaaattcttttttggtatcaattgctatgtgatttttttttttattctgttgacatggtgtgttgcactgattgatgtttcaattttgaattagcattacatccctggattaaaccccatgtgtttggggtatatacttcttgttgcatatcactgaattgctatcttgtaaaagacttttatatctatgtttctaaagtgcattc

SEQ ID NO: 477130 - DNA, 1012 bp, Homo sapiens
ggtccgggaagtgtggagctcctctgccaggctgccaaccatctgggaagtgaggcacacctctgcctggctgccgaccatctggaaagtgatgaaggcctttgcctacccacctccaggaagtgaggagcatttctgcccagctgccaatcatctgggaagtgaggagcacctctgcctggttgccaaccttctgggaagtgaggagcgcctctgcccagctgcccaaagtctgggaagtgaggagcacctctgcccagctgcccaaagtctggcaagtgaggagcacctctgcacagctgccaacagtccgggaagtgtggagctcctctgccaggccgccaaccatctgggaagtgaggtgcacctctgcccggctgccaaccatctgggaagtgatgagggcctctgcccacccaccatctgggaagtgaggagcacctctgcccggccgccgccccatctgggaagtgaggagcatctctacccggctgcccacagtcctggaagcgaggagtgcatttgcccagtcgccaaccatctgggaagtgaggggcacctctgaggagcgcctctgccctgctgccagccatctgggaaaagagtgacctgcttgggccacagcaatgggcttcttcattctccagcttctgattggacacaggccatgggagagggcagagcagagtcaggggctttatcctctgggctccattcctgcaagattgccatggcctggctgcatccctccatgaaatgctacagctgagtcagcacttcctctctgagctctgctaagctctccctcccttgtgtccctaaaagtcacagttgtgtctatggttcctcttattcaattttcctgcaaagacccagtttgaatgtgccatctagatctagggcctctacgggatgaactaggtttctcaatcaggatcaattccggagaagagtggaggtgggatccaagatgcagcagtggacttgggggaaccagccagcctgaggggcc

SEQ ID NO: 477131 - DNA, 570 bp, Homo sapiens
tgactttctgattctgcaagggtacagaaggtttagagaaccttggcaaatggaggaaaacctaatcatcagggttaatgtgcaggacttgacgaaaaggggcctgctcttcaaatgtaaggataagacaagttgtgataagaaacagctggagatgcctgtcattcttcaaaataatgttaaaaacactgatttatctcctcccacgctgctcctcaacatcattcctggctttcctaccaatctaccacctacctcatgcctgaaggccatctctaccactgaactggcgactggagaaaggcattctcccctttttatgtatgaaaagataaaatttgaacctgccctctgccttaatcccttttctctcctgcgtattttcactaatttaaacattgccagaatcctgtgctgttctcatacttctatgattccttattttaagttcaaaatgtcatgatcttacccagtgtgtatgtttaatggattaatgtatcattttctttctggccattagccacatgaacaactaggcccacagctgtcagatttcttgcaaggtttttc

SEQ ID NO: 477132 - DNA, 951 bp, Homo sapiens
ccccagttcagaactccttggggagatggatttgagggtctcctcccatctccctgcttggctcccagcgatcctgaaactctttctctgctgcaaaccctgctgcctccgcgcattggactgtgactgcataacaggcactcgaacctgtgggcccacatgcagctcttccctcctgagtgtgacctcgggacaccccacatggcccccgggatctggctttgggaaggaagatggtgcctggattgcgaaggcctttcaatctcatgccctgcgtcatggggtgaactgcaccctggagcctccgacggggcggccacgggcagcgaagaacccggaaaaacaggttcgaggcagacacaagatccaggccccggcaggctccgtgtctgccgaaggcttcctggtacccttctgaggttaatccgcgttgatagaagcaggtgtggttcatctggaatctgttggtgtgaactgcgcggcggcgtcccccaccaggcaccacagcgggcgcctcttggtagcagccaccggcctcttctgggactcgccggagggtttccacgtcgcccgctccgacggggctgttcatctccccttgatctgtgggactccccgtccgtctcaggtatgacccctttgttggtgatctgggttgcagatatcccctctgtgtctgtggcttgtctcgctgcgttgtttatggtgcgcttttgtcatgcagacgtttctaattttgctctgtctggacttggcaatctttctgttcgtgatttgtgcttttggtgtttatgtacaaactctttcccggtccagaaagcataaaaaagtttgctttgtgcgctgaggtctctaatccatgtcacaggaatttgtggcgggttggggcagaggctttgcttagcgttttccatcaggtgagcccatttccccagattgactgcacagccc

SEQ ID NO: 477133 - DNA, 1145 bp, Homo sapiens
tgggaagacgaaagggtgcgggagaggtctgatgcccgctgctcgccacctccgggggtgtccaggctgggcacagcaagctctccccgattgagccagcccgcaactgtggggctcctagagatgtctctggaagttcttcaccaagctgtctccccactgccccctatgcaggcccaagcctatccccgatgcactgcctggaccagtggctgcacaaagcacgccagcccatcacctgccccagcatccctggtgcactgtggccagagccgagctgccagtcatggagccgacccctccccagcacgagaccagctgacccccgggccatgccgagcagctcgggcacatgactcgcctgccctgggcccccaggatggggagattatgaggactcccatgcacccccagagacccctggatcccccgtgggaggactctgcacccccagagccccctggatcccccgtgggaggactctgcacctctggagcccccgggatcccccatgggaggactctgcacccccggggcccccaggatcccccgtgggaggactctgcacccccggagcccccgggatcgcctgtgaatgcttttccctcgacctccacctgcctgccttctgctcggcactcaagcctcaaccgaaacatcacctcctcagatgctcctcctcgaaccacccgcccaggcacgattgcgcccctccacgttggtaccgtcgtggcgctgattgccggaaatgggctcacgcattgactggtgcgctcctcttcccatctgtccacacccccggatgcggccatcagctgtcttggcccccgaggtgacccagcgtggacacggcacctggcacagggtacctggttggggttggacagaatccgaggcagaagagaaaagcaaatccgatcaaatcactgggcttcctccctcagggctgtgtgctggggttaccccaacactgaatctctgcatttactgagtgagtgtctcttccaggaaggggtgggcacggccctcttgcccactggtgggtcccagcatccagcagctggggatgctccgtaaatatctgtggaccgaatgaatttggacaatgagtggaccagtgccaatgaggtgggggctctgtagtt

SEQ ID NO: 477134 - DNA, 1180 bp, Homo sapiens
tcaacgcgtccagcatccttgagggggaggctcccaggtggggaacaagctcaggaagtcgtgcccagctctcaggcccgccttgcctaacctccccatcagcgcccacccgggcccgggcccagagccacagcatgcacaccctggctgggccctcctggagcctgcctgctccccaggcagggaccttctggaccaaccgaccctgctcccgggtgactctgtcctgcagcctcaggcgtcacctctggagagaccatccccgctctgcattcccactgcagccacaggtactcctgccggcctcccacccggcctgcagagccccaggcagtcggctcagcgcgtgtggatgtcgccctctggctgtgtcgggatcaccgtcacggacaactatgaagtgacgatggctgggggcccgtttgaaggggctcgccggctgatcgaggcctcacccggtgctggtgtcacagcctctgcgcccgctgagcagaaaacagtgctggacgtcgcactgtgtgggcgcaagggcatcgccttaaagagtgaacactgtccactgtctcggccgcagcggctgccatgggccccgtgttcatcactcacagtgagcccacaggagctagctggatggcggaggtgcttagccttggtctgtgttgttaccggctgccaggcggctgtgaaggaggacctcgggagggcactggggggccagtctcaattatatgcccgtttcggcatcgccttcaaggcgggtccccttcctctggcggtgatcctgagccgccccccgacaggtccccttcctctggcagtcatcctgagtccccgaagccgtcccgacagatccccttcctctggtggtggccgagtccccgcagccgtcccgacacacatgctacccgctggggcctcgctcctgtgcagatgctcctccccttttcctcccattgactccttcaaggcccttaaaactgtgggctcaggggcagggaccacggctgtgggtgacccagcaggcaccatggcactgggtgctcagcaggtcctcaatctcctgaaggagtgagtccttgaagagtcagtttccttctgtcccatctttagcaaactcaccttccaaactcctttgaaatcggaccagcatctgaaacggcccctcccatcccctgtcctc

SEQ ID NO: 477135 - DNA, 722 bp, Homo sapiens
tgtcaggaccccacagcatgatgtttaaagtggctttatctgtgcagatgtgtccagcttcgacgctaccatttggattcaagctagcggactgtgcggtacgctgtgtgcagagacgcgcccatagctctggggaaacaatatggataaggcacgttttcctctctgccagcagctctgtgggtaatggtggccacagccagagtctgaagacttatttggacagatgccaggagtggaaggatattccagatctgaacaaaggctgttacccaggcttactgtgctttggagaattgattcacaatcagcaaacttgtgagagactcatggatcaacccacaggccagcgtcctagtgcccagacagcatctacgacccagattctcaatatctttttcggctgccctgcccctgagggttctgccgtgtcccagtcactgagacctggagggcctctgggagcctgggagcagagggcttgggagaggcgcacttacagtctgagcacagctccttctagctccacaacccaactgcctgtgaatgactttacactcaagatgttacacctagtaaattaacgggagaaagaactgtagaagcctaatcagtgtatttcttgttttatttggaaaattaagttataattgtttttgtatttaaaggttatgttttgccaagacatattaccattgtgattctcagacccacaacaaaag

SEQ ID NO: 477136 - DNA, 580 bp, Homo sapiens
gcgcctggaccttgtgggcaataagatcattaccactacttgccctgcctcttcatgtagtgtctggtgctctcctgggtccacagcctttactgacactccccagcaaccagccgccgcagggccacacctggactttgtcatgatctttggctgctccacctaggaaatgaaaagcagtcattcttatccaacctcaacctcatccaacctgactcactcgcctactcccaagtatccagacatcgctcttaagcctccaatgcctcaacttaccccctttgtcacaccgaggcttctccgggattcattttatatgttcggagctcagctggaggaagtcacagatccatgcacatggtaccctgaagagtttgtgatctttgatcctagtggggtcctcagtagcactccaaaccatttttcctgctcatacacctccagagacttctaccatcatcaccattctcttcaagcccaacccaacatgaccaccctctgtgccagatcaccttgcttctacatccctgcgaaaattagggctcaggctgggcatggtgttgcgtacctgtagtcccaa

SEQ ID NO: 477137 - DNA, 760 bp, Homo sapiens
ccatccatcaatggaatactacacagccatgaaaagagtaaatactagaagagctgatgctattcctatgagaagattacatgagaggcgttccgtgtcaggccgtgactgggctcacaagacaacaatgggtgtaaatggagggaagaggttgtgtctagacttggaaggaggacagacagccatcgtgctgctgaagactcagctgagcagtggagagtggcagccacagggtgatggtcccagcttccatttcttggcttgcataatcttctggattgcatatttgttcttatcactcaccggctttaccctgcagctgtaccccatggcatctcgagtgaagtctaaacttcccaacatgctttgcagggcctgcctcacagcctcatctctaacccctggggcttcccactctataattctgtactttggtcacactgaacttctgctgcctggaatggacctcacttctcatgggctgtcctctctcccagcctcagtgttgtcaggctcattcttccccgcccttcacagaaaggctcattaagtcttactttccatgggatgtttccttcacctttctgcttcatcccctcagggaaagggctgtcagggaatgcacagcctgcttccttccagagcctcatctgttcaggttacatgaccctctgtgctgacacccctattctgcttactagaggctattgtgatgtctctctgtgaccctgaaatgtatctgccaaactcttaaaacaac

SEQ ID NO: 477138 - DNA, 662 bp, Homo sapiens
ccctgactaatatagattttcgtaccaggagtggttctagaggaacagaatattaaggatggagttctttagttggttttggggtttctggagttggctgcttaatatgattagaccccaaaatgctaaggactctactgctaatagtacagagaacactaatagccattggtgtgaactcttcagagaattatgcaaaataaatgcatttgatactcctgattcacccctcatgagagatttcaaccagtcagttattgaagagatggtaggcaatgagtctggcacgttctatgggaagaaaacagaaacacgtacagcttgtccaactgaggcagaagaaactgtgatgggaacaattaccttcatgggttgggggcactggctgagctcccatcccaccactagcaccgactttcctggtgcaagaatacggcatcttagaactaattctccaattcccagtcgaaccaccccaggtcttcaggcagagagaaacaatttccaaggagcttatctcaatgaactgaacccaggacacaggagcagcacacaggataagtggatttgggttggatgtcgctgagggaaaaataagaagaaagtgtagtctctgtgcttaaagggcatcagcatgggatcagagctcttcaaatgcaatc

SEQ ID NO: 477139 - DNA, 781 bp, Homo sapiens
tgcctttggcaatgtggggtgatggcgacatactcagaaatccagaagaaaaacacatgaacaattctcaatacaattttactttcattaaatcaataatatatgaaaacaccattgagaaagaggaggaaccttcagaaaaccatcccatcaagtgtgaactttctgcattttttttcccctgtcctttttcccatttgcaaagaggaggaggatgggccaccctagtcaatcacggggaaacagtaggtgtgatcactgtcacgggaatccagcccattcataatagtctgagaaagcaggtgctccatgtcagtctgggtctcagaagtttgggacacgctgcattccatattccctctgtattagtccgttctcatgctgctatgaagaaatatccaagactagataattatgaatttctgcatcttatactcatgctagtggatgccttttcaattaaccactgacgatgggaaagagacagatttctgtatccatgaattaactgtcagtactgacaggtagcggggaacttgtgaagagtacagtgtgagtgtgtgtgcgcgctcacaagcaagtgcacaattggataggtgggcgggcttgaccctattcctttctaaagctactgtggtcctgatgtcatggtatgggatggtatagtttatcattataagcaacagagctggatttcaaggctctcatattgattgtctagggctactgtaacaaattaccataaagttggtggcttgaaattacagaaaagcattctctc

SEQ ID NO: 477140 - DNA, 624 bp, Homo sapiens
aggggtggaagcagggagtctgcggtcctgcggggatctctgcccctgggccatggagctggcagttctggggccctgcaggccctgccccttcctcagggacagccccaagtctggcaagggaacgaacacacacagggacccaggcttcagctgcacaggcctgtgccctcctccagcccagggtgctgtggcagccccacatcaagaccccccagcacccccaacatcacagcctcccctgatctatgatgctaagtacctagttagaggctgggggctcctgcagaggacgtggctcaagctgaccccaggctgggacagacccacttatgctcccaagaagcttggcagcaggagtgagggctgggcaaccacctggctcctcccggcctacactggtctcttgcaggtggatgaggagaagaagcaggtgaccatggaggctggcatcctcctggccaacctgcacccacagctggatgagcatggcctggccctgtccagagatgcaacaggtgccctccaggtatgtcactgccttctctggctgacagtcacgatgaggaagggaccctgctgcatgtcggtgctctgacagttgcacagtgccctcccaccttc

SEQ ID NO: 477141 - DNA, 612 bp, Homo sapiens
tgtctttgggtttctgcaaagaccagggtgcccagtggaaatctgatgactgacttctacaccttcccctggcatctccagaggaaacctctcttgacgctgtttaagcacttcacactccgctacctgctaattttgatggaaattgcttttgacatgtgcagttggtggccaggagcttggggtgagagaacacataaagctgaactaattctcattaacagtgagcaaagaccagagataggaaattggcagaaatggggcacctggggagcaggttaccactgggctccctcgggcagtgaacccagctttgaggaggaaatgagaatgtccatgctgggctctggggaatcaggacccacacatccctctatgctttgctgcaaagcctcttacctgggagggcgcaagaatgatggatgcgaatggcctcagtccttccccttccgcagccccatcccctcagatgctcccatgacccatgtggtctaacccctggcaatgctgaagcttctaagtcagcaccaagtgtgggctctggaaaagggcttgtcttataagcaaaaccatcataaacacttattgggcactaactgtatacactcttct

SEQ ID NO: 477142 - DNA, 589 bp, Homo sapiens
gcagtgctcctgggaccacacctgtcagcatcatgaggaaaatagacacagaacccatccctctccccacccagaagagcccacccagcgtgctagggtccgggtactctgtgttggaggggaccccccagcaaagacctaaggataggcctggagcctggttccctggatatgagacaattgtggccagagatctgaagggagccccggattccatggggccccgggggccagatgagcaacagattctgtccccctgggctgagtgcagaaagaagaccacggaggccctgctggagctgaaggccgtgctggaggcccaccctgaggtggtgtcccactacctggtgggggtagggctgcgggtgagagcctcgcggagcggcggggcagctgcggtgcaccatgcactaccatgtccagcagagggcactgctcttccctgtgcctctgccacccccggggctgacccaggagatgcagggctgagccccaactacccttctaccctctcttgggttcttgttccaacagcgcagtgactgcgatgcactcagagttttcagagaaatttctcatctttcagtct

SEQ ID NO: 477143 - DNA, 995 bp, Homo sapiens
ttttctagaacatcatctcaatggaataatacagtctgtactcttttgagtgacttcctctactcaatgtgcttttgagatttatccaagttggtttgcatatcactagtttttttgttttttttttactgatctgctctctgtgctgtggggaggttatgagatatgagtgggtcaccgctcagtgcattcccagcatcgcgttgggtcagtggcttagcttggaaccggctcaggataatcatgcttttcatcagccgctcccgtttcccttcctcgttcctcttccttgtgaacttccacccccagcctggcataaagccctttcactctcagcattctaggttctggggaaacaaaagtaattcccactgtctccacaagcccgcccttccgtcggaactgggggtccttagaccctggacccagagagtggctccatttcctgtggacacttccggaactggtttatcaaatctcacttcttcggatgcttttgggctgcctggacacacacactcctcccagactccgctttggatttttgggcctgttctgattgacttgctgtggtcactaacattttcaggatgtttcccatggaattccaggttctaaggaggtgccttgggggctgctgcagagagcctctttaaacacagagctccccagccccttcttataaaacactgtgaaatatatcatacttttaaaaaagaacaaaaacatacgcatgtatgtacagttgaaaaataattataaagccaatacctgtgtaaccttcacccaggtcaagaaataaaatattgtcagaaccctaaaagccccgtgtggccctccctaacctactttagatgtttaaagttgcagctaagagctcccttcctaagcaagtctgaaaaatgctgggttaagggattccttcctgaatgcccctatagccatattcactattgaatcttgtacattcctgttttctctccaggtctcagaag

SEQ ID NO: 477144 - DNA, 702 bp, Homo sapiens
accacttccttttggcaaccttctgattcatttcttgtaagacttcctggcccagatgacggacaccccaggtactgaaaacttgtcagtggagatttctcaagtgttatttgtgaactttgagcaaccatggaaagcaagactaggacactggtggtatccacactggataatactctgtcacctagagttccttccagtggctcatactaaatccaggaaaatcagaaattcacagatgatgaggactggagaagacccagagctctttctaaactgggctccgagccagagctctccagagcccttaaaaactgatagctcctggacaatggacagcccacagacaaaccttgtgagagctaaattgttgagacttcaccgacgagggctgctggcaaagtgggctcaagtctcagaggtggctgcaggtgtgccctttgtgactgggaaagggtgtgagattgtaaagacccagttgggaagcgcattccaggatcagacaactatggcactgacaatccttacagcgagcctgaagaacccacaaatgggtggaaaagaaccagccctggggcctctgctgcagtggggctgccaacagccaggttgtaagagtgcccgccatgaaagactctcctctttttctctgactcctgccctctgcccctgtcctagaggatccagcggctaatcctccct

SEQ ID NO: 477145 - DNA, 617 bp, Homo sapiens
agcattttcaaagtgccttcgcctcataaccacccttgaggtggatggtaaggccgggaaatagtaacccggtagtacagcatgtgaaaactcaggttcaaagaagttttgtgacttgcctacctcacagggctgaggagggtggagatgggagtcaagaccaggcttcatggctcagaatccagtgtttgcttcacgaagcttctctgaagtctaccatccatatcaccaaccgttctgtgggcttatataacacagggaaggggtataacatggatttgctaagggcaggatttacgtcaaggttgtttagacccaacggcaggattcacggactgatggctcctcctcagactccaccagtgtgggcgtcttttacgatgtggcacttggagcactatgggaccttgggcacatttcctaatataagtctctatttctgcatctgcaaaatggagcaacaacatctatccctgggaggtaatgtgagaattcagtgaaaccatgagcacaaagcctgagtataatgcttgctgtcagttgggtgctgggcaaagggtagggctgttgttttcatcatcatcatcatcatcatcatcatcatcaccatcatcatc

SEQ ID NO: 477146 - DNA, 1143 bp, Homo sapiens
tgaggagctctgagtccagaccctggcatctgggagaggtgcagctgcagctgtggagcaagggagcattcagactacttagcaaatggatgcaatacaatgtgtcaaagagataatggatgatagtgagcctgactgtgctgggggtgtcctgcaagatttcattgacttgggtcttgaagtatgacaaccctgagcaatctggattggactcctaccatctgggaaataccaatttcacttggaaaccaggagcatctcctacctcatctagaactagttacctccccagccagcagcatgtcaaggagaaacagaaaaagtatagattatctatcgtgcaaaacagccgttttcatgcccacggcttctgtgtctcagttgttttgggctgccataacaagctaccagagactgggtggtttatcaacaatggaaatttatttctcacaggtctgggggctgggaagtacaagatcaaggtgctggcagattcattgtctggtgagggccacttcctgtctcataaatggtgcttgcttactgtgtcctcacatgacagaagaggggagggcaatctcctggatctcaagatttagatgttctatttattgaatgtatgctagagcttaccttttaaagcatctgatcctagtgttttctttgtgggaagatttttaattacagagtctatttccttatgtgttattgcactattcaagtttttttccttgattctgtcttgatatttaaaatatatttgtagtttaaattttcccaacaaatacattggcataaagttatatatatatatatatatatatatatatatatatatatatatatatatatatatatatatggaaatgtccctatcctgtgtgcctctactttgtcctcatttatattcctactgcttttaatttgtgtcttctgtgtttcttttttgatcagttttgcttcaggtctgtcaatatcattagtctttttaaagttccaacttttagctttgttcatccatgcttctgcctgttgtatggatatggcacaatttgtctgttcattcacctgctggtggatgtttacgttgtcccattcttgtttattacagctttatctgaacatttgtttgcaagtctttgc

SEQ ID NO: 477147 - DNA, 3022 bp, Homo sapiens
agaagtactgtgaagctcgcagatggccttgtggactttagcacttcaggtaaagactcctgttatccctattttatagatgagaacactgaggcacagagattataccagctgggctagcgagtgaccgggggaagcctccagatccatgcacacaaccgccaggtttatgacacctctagaaatgtggccagtgcccctggggtctatcagcatctcttgctagaccagcagagccctaaaaaagaagacaacagtctcccagcaaaatgttgcaagcagcacaggctcaggaatggacagactggcaggcaagacacagcaagaaggcagcagtctgcacaccaggaggagagtcctcaccacaactcagccctgccacaccctgatcctggactttcagcctccagagctgtgagaaataaatgcctgctgtttcagcagctcagtctatgatgcaggtgcaacctgcaggggggtcttcccaggagtcactctcgccaagggaggatgctgcccaaagaccctgatgtagggcctctgggtggtagacatcatctggaagctacatgcatctgtgattcgaggcttctcataaaggaaggtccttctcatgtctccacctccttcctcactgcctccaccctcgtcagcagtgtgagaacagacgaatacacccacccttctggtctcttagtgtaccatgggcagagcccccaaatctcagagctagaaggaggtggggagatcctcgtgcacaatgcccctgtgggagcacccggagcctggtcaggtgacctctgcccactccctgggcactatcccccacctcgaactgtggttcccaaggaggacagaaccttctgtagggcactgtctgtggcctgtgccttgcacacacccagcaaacaatcaggatctgaagaatgactaacgtgtagtagcagaagtgccatgacatctgttgttccaagaggtacccaggttagctttttcacttctcaactttctacaccatctcatttctcatcttttctgtcaccaaggcaggccagggcatggaggtggctgggacaaggaggagcagggtcctggggtccctgctcaggctttgtccactcatctagcccactcccctcatgctcccctcagtgcagttgctcccaccagaagcatcttcccagtgggacgaagggtctgggaccaggcattcaggagaagcaccggggttttcctggggatcagccaatgaggggaaacccatgccttctcccttccctgatcccagaacacatgacggggtaggggacctgtgtgggctggaatccaggaactgatgtgccaagagcaaattatgaggacagctgatgagcctggcctggagccagcagtacagtcaaaaccacccccagaaccatgctaaccacaggccggctgacagggtagagtggctcagcaaacagctccacttccagtaccctcaagtcaccagggcctggattctgagcccctatcacctttacaattgtgaggtctctttttttcatcatttaaggcatctctctgtgaccctgagaagtggacaaggcaggcactgtcagccccatttcacagccgaggagactcaggcccagaaaggtgctgggactgcccttgctaccgtcctccgagcccccaatggagggtggtgggcggggctgggggcaactccacccacttcccagcagagtccgtgtggaaggagatatgagagcttggctcaccatacaacgtcccagggacctcagcccaggccatgctcctcagccctcagtagaacagaaaggccactttacctgtcactccactcagagatgttccccactttcagcaggtccctactacccagaaaccagagtcccagcattagcctggaatccaaagccccactctgtgacgtcatccctttataaatatttgctgaactggactctctaatagattgtgttttttctcacgaaatcagcccacagacaaatctgctttgcgaacttgttttcatgaatccagagatgtattttttttgtcccagccaggtcactggatggttttgtgacttcagccaatcatctcccctctctggcctcaggatcctcaactacaaaacaaaaagagtggactggatgatttcagatgtattgccactccatccaaatgctgtgattccagaaaacctgcatccttgccaaagagagccatctgaatgtgactttgttcaggtttccccttctgggctgcctcccctctctggttacctttcccctcctgggctgcctcccctctctggttacctttcccctcctgggctccttctcctctgtgatgatctaagttctctgcttctttcaaacccacaggcagatttcaacagacctgattaatgctaaaaatccaaaacagaaaatagaacccccactgcagatattcacaagagaaaaactggagacaaagctcatcaaaaactgtataacaaagtaagagaataaaaaccatttgggtcaagctcaggaataatgtaaataagctcatatttgaaaaaatacacatagttgagtatttgtgacttctcagccaggaaagagcaaagcgtgagagtgtggtgagtgtatgtgtatatgtatgtgcatatatgtgtatgtgtatatgtgttcatatgtatgtatatacatgtgcatgtgtgtgtacatgcacatttgtatgtgcatatgtatacgtatatgtgcaaacgtgtacacatgggtatgtgtgtttatgtctgtatatgtgcaggtatgcgtatatgtgtgtgtgtgtatatttgtgtatgtatgcaggtgtggatgtgtgtgtgtttaaaaaccttaatagaggaactagataaagctagggcagaaaggccactgcagacagcagtatgggaatgcctggaagcttttctagtgacctagcccttgttcaaaagccagggtagagtttggtcctgttaaggctgcatggtaaatac

SEQ ID NO: 477148 - DNA, 876 bp, Homo sapiens
cacgatcccattttgtaagacatgcacgcgtaagacaccacccactctggcttccctgtgctgcagtggtgtccagttcactgggctcccaattccggccctccacccaatgcctccacccaggcagggcctctaggtggggccgcgggcagctccagcactgctaagttgcaagggaccctccctcatttcatgagcactgtgtgcggcagccctccctctggcttcactccttgcggggctgtgaagcaggaggccaatgtctcttttgcctgcaataaccctccctctgccaaaggcaatagcctctgcttcccagaggccacacagagccagacagggcgctgcccctggggagtggagctggtccagcaggagcccaggggatctgctggggagagggactggggccgagcggggccagatatctcagcatttgccatggtggccagagagctggctgccaccacgctgagagccaggccgcccctcggaccgcgtccccacagccagccaaatccagatggagtcatagaaaggggctgcaggggcgcccagggacgagtctcagagcaggaccacaggggccacttctgcaggaggaccagccctgtgaggtaggcaagtcacaaaacttctttgaacctgagttttcacatgctgtactaccgggttactatttcccggccttaccatccacctcaagggtggttatgaggcgaaggcactttgaaaatgctgaagctcttctctaatgtcagccttactgttatttttcagacttagcagcccctgacaaatggagtattaatcacgatgatggggctccctatccagagtccagctgctgacagctggcactgagtccaagacagc

SEQ ID NO: 477149 - DNA, 693 bp, Homo sapiens
tcgtgttgagaggctcagagagaaggaaggacacctctacactgacgtcagcaagatgcccagtgcatgcctcttctgtgccccaaaacacaactcagttacccccttcccacctcccttccggggccatctgagctcaccatggtcctgcgagcattgccaacgctactccttagtgctgcagtggggcagagcactgatcagccctcgacagcccactgtgggaaagtccccaagccacctgctgctgggggacccattcatccaagcccgaccacccgaggccaggagactgcagcttagcccacctttcccacaatttcggatctgtttctctggccatggccccataggatggctgctggctgaaccgaagttggcagtaaccttttccccaactcagtggctaaagtccaggacactgacaacaccaaatgctgatgaggatgtggagcagcaggaactcccattcattgctggtgggaatgcaaaaccaaacatcactctgaccatacctcccccgcagtcattcatcaattacagcaaagcaccactctggtgcgggatgctgataacgcggaaggctgtcggggtgtaggggccggagaaacatggaaactcactgtactttctgctcaatttgcctttgaacctaaagctgctctaaaaaatgaaatctattttaaatatctt

SEQ ID NO: 477150 - DNA, 618 bp, Homo sapiens
cagcagggcaacagaaacacatccagccatggaagattcaggcgctgattggccaggaagcaggccaagaacagaaccctggagaattccaatggcagcactaggaatgctgatggacggcatggccattggcaacgtccacctaccagaaagcagacagctgcagcagaggaggctgcacattccttgtgttccgggaccacaaggaatggtggccgaaggagaccatcttccctcagcccatcttggagggacgagaaatgccatagtctggatgggtggtgacagctaccaagaggagaggagagcaggggaggccctggggcctgccatggtgaaaagggagggctgtgaggagcctgcctggacctgtgaactgcccggggactcaggagaaaggggttttgcaaatgcagtgacagataagcgttgcatggtattatttttatcttcattgttactaaaagagcatagaggaagcttcctgtttattttcttaccttatgctgatcttgaaacagcaatgaaaatacttctgctacagggaccttaaacaacaccgaaaacttcaaacgagggaagattatttactcccatctcttaccccttttccttttc

SEQ ID NO: 477151 - DNA, 676 bp, Homo sapiens
ttctttttaaaaagctcatgtgagattactgagcagaaaagaagaggcgggacgtgatcatgacagacccctcagcaccagccctgccctttcaggaccccatgtggccccagccccacaccaggaccccagtctcctggtttgcggcgctgggtgctcaggtctcctggtttgtggcgctgggtgctcaggtctcctggtttgcggtgctgggtgctcaggtctcctggctcttgctggtgctgcgccgcttgtcccgcctgccaaagtcagtgacaggtcctcctgcacccgtcctgctgcctgaggccactgtgccgcacctggatgctgcccctatggcccttgggccccccctgccctccccacctcctggctgctgcctagggcggcctgggaaaggtgaagaagccggccctgacctcccaagtccattccatggcttgctgatgggctgggtcacagctctaaacccctcaacctggcctgtcctggagcaggcggctttgtttttcaacatcatactgatcattgtgttcatataaggaaactaccagagaacaggaaggattagagggaacagtaagggaacacctggaaggattagagggaacaaataaatgctgctctgctgctgtgtgacaatctcagaagcaagagtcaacattttcagttt

SEQ ID NO: 477152 - DNA, 705 bp, Homo sapiens
gccttagaacttgcaatgccggccattcgcgtcggggtggggtccccagaagcagaccctgaggtgaggcttcctgtattcttggcttattgggaggcgcaggctcggccagtgaggactgggaagaagaggaggccagcccgggtgagcgtcgtgcagaggccgcggggtgaccgggtccagtcctgcaggggggtctggaacatgttcggatcggacctcagcgcggatccctcccgtcggggtggagggagctgggccttttctgcctcagcggctttaggactgttccaggaagaggtgagcagcggcggccctcgacccagagaagcaggggccacaaggaactgggtgcaggaaggtggtgaagggcccaaaggacgcgtgcgtggcctcaggaagtgccggaagaaagcctgagtctgaatctgagaatttctccaggtttaccttcttgaggggtcgccaaactgttttccaaagcagctgcctcattgtaccttcccattctgtatctgttcatccatacagccatacatgacagtttctccacatccttatcaacacttgttattggcctttttttaaaaaatcatagtcatagctgaatataggatgagacactttttagttttaaaatatctgattctagatgtttttagtatctccagatgcttgcttgagtatatttacttctgttgtgtt

SEQ ID NO: 477153 - DNA, 962 bp, Homo sapiens
aggcctgtaatcctagcactttgggaggccaaggcaggcagatcctttgagtccaggagtttgagactagcctgggtaacatggtcggcagggggatgaagaggagctgcccggtgggaactcaggaagcagcacagcccacagctagggccaggggctgaggggcaggactggaccctgggggcagggtgaggggttctggggtcagcccaaaattggcccacaggcccagcctgtccgtcactcctgaacaaatctgcttctctggaggagcagaaggagagttgggtgcgggatagagggacacaaacactgcggaaggccgcagggacctctgcctaggaaagccaggtattgtccaaggtttctccccatgtgatagtctgaaatatggcctcgtgggaagggaaagacctgaccgtcccccagcccgacacccgtaaaggtctctcgttccaccttacgagaaacacccacagcacaggatttacatacaatttttggacatccaagttcaccacaatacccatattgtctgaaattatgtgccatggccctgaggggagtcatgatccctcccccaaagatggttgtggctgtcaggacacagcaagtacccacaattccctcctggtgaagagtgcctctgtcctacccagcctgtgcctcactcctgagcaaatccgctgtcagcagtgtgaatgcaggagacacccttggtcccccaaagaatctgaggaacctaggggcatccagtcctgggacaaggatctatgtagacatcatacaagtttagcaccacccatagtggagtgctgggctaagcctacttagacagatatcaccctcctcacccagtttcccctgtccttgtgaaaaggaagaaaatgatggttcctggtctgtcttgtgctcaaatctgacccggctcccaaccagctgtggctctggatgagtccctt

SEQ ID NO: 477154 - DNA, 1966 bp, Homo sapiens
gaacagcccgcctcgcctccaggagcatgaattgtaatagaggtagcccctccctgaggacatgcactccctagacatgagcaaacacaaagcagcagtaacttaccgctcctagtccaagtcctaccctagtcctgggttgcagttcttaccagagtggagggtgtgcaggtgctccttccccaaatccctgatagcctgtggagagggcgaggccaaggttgggacccccttcctggtaaatctctctccctcccccaagttcagtttttccctcttcctctctggggcttctgctgagaatgaggccgctcactcggggggtgttgggctgccctttctctgctgggccctgtggatgcagcagtgggcagcaaggagagaggcctctagcagatcatgcaaatgtttctcatctgctgggttctcaccgagcccttgactgcctggatagcagagtatgtggttgcaggaggcggttgtgttcgaggatgtggctgtgtacttcacaaggatagagtggagttgcctggcccccgaccagcaggcactctacagggacgtgatgctggagaactatgggaacctggcctcactaggctttcttgttgccaaaccagcactgatctccctattggagcaaggagaggagccgggggccttgattctgcaggtggctgaacagagcgtggccaaagccagcctgtgcacagattccaggatggaggctgggatcatggagtctcctctgcagagaaagctctccaggcaggcaggactgccgggcaccgtgtgggggtgcctcccctgggggcaccctgtgggggggcaccctgcaccaccccacccgcatggcggtcctgaggacgggtcagataaacccacccacccccgggctcgggagcacagcgcctccccaagggttctgcaggaagacctgggccggcctgtggggagctcagccccccgctacaggtgcgtgtgcggcaaggcgttcaaatacaactcgctgcttctcaggcaccagatcatccacaccggcgccaagcccttccagtgcacagagtgcgggaaggccttcaagcaaagctccatcctgctgcggcaccagctgatccacactgaggagaagccgttccagtgcggcgagtgcgggaaggccttccggcagagcacgcagctggctgcccaccaccgcgtccacacccgcgagcggccctacgcatgcggcgagtgcggcaaggccttcagccgcagctcccggctgctgcagcaccagaagttccacaccggggagaagcccttcgcgtgcacagagtgcggcaaggcgttctgccgcaggttcaccctcaacgagcacggccgcatccacagcggggagcggccctaccggtgcctgcggtgtgggcagcgcttcatccgagggtcctcgctcctgaagcaccaccggctgcacgcgcaggagggtgcccaggacggcggcgcggggcagggcgccctgctcggagctgcgcagaggccccaggcgggggacccgccccacgagtgcccggtgtgcgggaggccgttccgacacaactccctgctgctgctgcacctgcgcctacacacgggcgagaagccgttcgagtgcgcggagtgcggcaaggccttcggtcgcaagtccaacctcactctgcaccagaagatccacaccaaggagaagcccttcgcgtgcaccgagtgcggcaaggcgttccgcaggagctacacgctgaacgagcactaccggctccacagcggcgagaggccataccggtgccgcgcctgcgggagggcctgcagccggctgtccaccctcatccagcaccagaaggtgcacggccgcgagcccggggaggacacagagggcaggcgggcgccctgttgggcttcctgatgacggggacgacaggccgaggattcacgctggaagcccacccaagcc

SEQ ID NO: 477155 - DNA, 667 bp, Homo sapiens
gtctcgcccaaccccatggggcagctgcctgagacatgtcatgaggcagcgccagaagggggctggcacccagggattcctggggtgctggtgtgtgtcctttcaggaggtggtaacatttggcgatgtggctgtgcacttctctcgggaggagtggcagtgtctggaccctggccagagggccctctacagggaagtgatgctggagaaccacagcagtgtggctggactaggtgaggctgcaccttggggccccttcccctgcatcatcagtcagcacccacccagccaggcctccatcagaggctgggtctcctctctgaactccaccaccgccacaggcagccactgcggtgctctttatgtccatgcctgtgtcctcacaagctgtatactgtcgttggattgcaacttgagaacaagaatcctgggcagtagccgggacatggtgggggaggctgaagggttgtccctgagcatccccaacatggagctcggaagtctgggccatgggcaggaaagcacgaaggtcagggccagcctggggaaccaagagctgtgccacgatcccttccacctggggcagctgcccacatgcccgccactgggttccatcacctgagactcctggcaggtgcctctctgagtctttgtcctgtgctggaaa

SEQ ID NO: 477156 - DNA, 905 bp, Homo sapiens
taagcggtcactgtttttctgctcccttctgggcaaagtggacggcagggcttggccgatggaccggccatgagggaaagtttgttccagaagcagctcaggcacccgaaaaaccctttctccagagtggacactgggccccatttacaggagttaaggatgaggagcaatagttctgaggcctctgggccgtggcttcggactgccacccggtggcagcattcccgctttacggctttgccattcgcgggtccccggagccttactgcaagccagggaggtgggcagccgacacgcggcgttctagcttcccagagcggcccggacggcgcctcggacccagacagtcggctgacgtcacttccggatcggttccgattggcggggagggagggccgaacgggcgaggttgggctgccgtgctgctcggcggcgctgagaccctcccctgcgcgttgcccctgtgcccggtcctctcgcggtgctgcaggcgtgggtccgtcccgccatcagcggcacttcctgttcgagggaccccccggacaaggccccgagtacggactgcgcctcgccgctctctgccagccctggggtcgctcctcacggggctccttccgctctcgagcccctgacaactcccttgccccacgcggggtcccctggactcctgccgcacagagcggcttctgcgtcccgatgcgctccagaccccttggtcccagcggcccgaggcttcccatcccggctccctcccacgctcctctcctgtcagcttttcaggggcggggctcacctttctaaggtacttcaataaagttttataatgttgttcattacatacatatctttttttaagacttaatgtactgtatagtttttgtagctattgtgaatggtcagttttc

SEQ ID NO: 477157 - DNA, 688 bp, Homo sapiens
gaatatttcggttaagtgggtggagtcgtggtctctgctgtccatgaggcagaggtggttgaggtgacatgcagccaattatggcttgcccccaaccccctgggcccagctgctggggagagacccctgctgaccacctttccagggtccagctcaggccgtgcccctccacctgcaaccatgatgccatggtggcttcttttgtggtggcctctttcgagggggtgcagggaggctgcagagctgaggcctcaagatggacagggctgtgggccagaggcctggtgagaaggtcttgggcacacgtgcccttcatgctgaaggaaatgcagggtcaccagctcctaagacagcttgttacctggggccgctgcagcagtcagcctctgtggccctcagccaggggcagctcagatattctagcactgaccattatcttcttgatagacaggtttttcagtgtccacactcagggttatctcccagcaggagcaggggaaaatgccatgggtcattgctctgccagggcctccctgcacagtttgcatgctgcttgcatgcaggcattcttctaggtgctggggttaagtataagcaaaaccaagtccttgtcttcagggagtgtacattttggtttgtggagaacatcgtagtttgtggaagaattatttatcctgcctgatgtcct

SEQ ID NO: 477158 - DNA, 689 bp, Homo sapiens
agctacagacatttgtatatgtgacttgctcctccttgccttccaccatgattgtgaggcctctccagccatgtggaactgtatgtaacagcagaggttggaacagtttggagggttcagaagaagacaggaaaatgtgggacaatttggaacctcctagagacttactgaatggctttgaccaaaatgctgaaaatgatatggacaatgaaatccaggctgaagtcatctcagatggagatgaggaatttcttgggaactggagcaaagggccaagaaggcacttgcagtttcctggctctaatacttgtatatgtgaaaagcaggtgcaactagaaggcaaaacacttagatctcccaaaatcaaggattccattttacacagaatcctgcgtcccccaaaagagggcaatgccacgggatgggatagagtgatgcttccacagtgcacctcacagcaaagacattccctgagtctgagtggccgatcaccaatcagcccatcccccacaggaggcttatctctcagtgccatctccaaaactgcagccctcaccagggacttgtcaaccaccatacatccaaaggtcctggttatctcgcagtataaaataattcccggtatcccccaaagctaaagggatcaggaaatcaatgccaaagacagcagaactttacacttgagagaa

SEQ ID NO: 477159 - DNA, 676 bp, Homo sapiens
tcatcagttaaggcaggaacaggccattttcacttcttttgtggtggaatgtcatcagttaaggcaggaaccggccatctggatgtgagtatgggaggaacacgaaagtggacaaggagcgtgaacattgaagcacagcaccacgggggtggggggaggcggtttaggcctccggatgactgtgggcagccctggataatatccagccttccacaagaagctggcagagcagactgttccctgactcctccaaggaaaggagattccctttcacgatctgctaaaaatgggattctgagaaagaatttgtgcgagggaatgaaaatgtggacccttcttctcactctgctctgctctcctggggatgacccatggatggagctgggtcacacttttccctcatttcccaggtctcctggagtttcactacaggaagcaatcaaagttggtcgatattgggaacaatccacactcccctgcaaagtgacagctttaagaataatgtgtgtagctgcagccgcgtatgagagtaactgttgctaaatatatttggtgtcattctctgtcagatctttaatttttgccaacctagtgagggtaaaatgacatcttgtaatatcattttgcatgtctgtgattaataatgacctttgcccctcttttcatacaggttggt

SEQ ID NO: 477160 - DNA, 1716 bp, Homo sapiens
cccgagtacgtccacggtcagccttccggtaaccttgtgcactcagaggaatccagggtaacaatggggcaaactgaaaaaccatttcaaacaggagaagatagcgtttcagtttctgatgcccctgaaagctgtgtaatagattgtgaagaagagacaggaacagagttcaagaaaggaatggaaagttcacattataaaaatgtagtagagtctgtaatggctcagtcaatgcaaaatgttgactataatcaattacaggaggtaatatatcctgaatcatcaaaattgggggaaggaggtccagaattattcgggccatcagagtttagaccacgatggccaccaactccttctcctgtggttcagatgcctgtgacattacaacctcaaatgccaatacagacacagtatctacaatatcagctggttgaaaataaaacccaaccactggtagtttatcaacactggccgccagccgaatttcaatgggatcctgtgccaaatagtagggcactatatcaacaacccacggcgatggtgtttgatcctacagtaccagctagtggacaagatagtgcactgcatgagaccgttgatacagccagaaaacagggagatcttgaggcatggcagtatccggtaatgttacaaccgataccggccgggaaagggccaggaaagggagtcaagcaggagcgtctgtccgaacggaggctagaaacaagagacaaattaattgacttttacatgtttctgcagacagaggttgcaaacacaggcctgacaatagcatctgataagattcagacctccactccttttaattatttgggaatgcaggtagaggaaagaaaaattaaaccacaaaaaatagaaataagaaaagacacattaagaacattaaatgactttcaaaaattgctaggagatattaattggattgggccaactctaggcattcctacttatgccatgtcaaatttgttttctatcttgagaggggatccagacttgaatggtaaaagaacaataactccagaggcaactaaagaaattgaattagttgaagaaaaaattaattcagcacaagtaaatagaatagatcacttagccccactccaatttttgatttttgctactgcacattctccaacaggcattattgttcaaaatacagatcttgtggagtggtcattccttcctcacagtacagttaagacttttacattgtacttagatcaaatggctacattaattggtcagacaagactacgaatagtaaaattgtgtggaagtgacccagataaaatcattgttcctttaaacaaggaacaggttagacaagcctttatcaattctgctgcatggcagattggtctagctgattttgtgggaattattgataatcattacccagaaacaaaaatcttccagtttttaaaattgactacttggattttacctaaaattaccagacaaaaacctttagaaaatgctctgacagtgtttactgatggtttcagcaatggaaaagtggcttacactgggccaaaagaatgagtcattgaaactcaatatcactcagctcaaagagcagaattggttgctgtcacttcagtgttacaagattttaatcagcctattaacattgtttcagattctgcatatatagtacaggctacaaaggctacaaagctctaatcaaatatagta

SEQ ID NO: 477161 - DNA, 1046 bp, Homo sapiens
ggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaacatgtttctatagctgcttagcaaagcctgtgtggagcccagagcatggacctgccctcggtcctcaggctgacctctcgccgtctctcattgggaatctgtgttt

SEQ ID NO: 477162 - DNA, 3515 bp, Homo sapiens
aagtaagcgttagtgtactgtctattagatggagcaatgggaagttcagctaggtccttggtgacggcctgtccgaataggtgggggctgtcccagaacccctgtgggagtatggtccatgttagttgggtggacatgtgggtattaggatctgaccaagagaaagcaaaaatactttgggaagccgaatttaaggaaatagtgaaaaaggtgtcctttaaatccagtacagggaagtgtgtggtagaagagggactatgggagagtggagtatgtgggatgagagtggagtgttggatgaattggtattaccacctggttaacaactcagagatcctggaccaagtggtccaacttacagcgggtccagtgggtccccagactcatcctgtggtcattttccaagtgccaggatgcataattggcatagacatacttagcagctggcagaacccccacattggctccttgactggtaaaggctattatggttggaaacgccaaatggaagccattagagctggctgtacctagaaaagtagtaaatcaaaaacaatattgaatccctggagggaacatggagattagtgctactatcaaggacttgaaggacacaggggtggtgattcccaccatctccctgttcaactctcccatttggcctgtgcagaagacagatggatcttggaggatgacagtggattatgatgagcttaactaagtagtgactccaattgcagctgccgtaccagatgtggtttcattgctggagcaaatcaacacatctcctggtgttgggaacaggccccccaaaatctggccataaactggccccaaaactggccataaacaaaatctctgtagcactgtgacattttcatgatggccataacgcccacgctggaaggttgcaggtttacaggaatgagggcaaggaatacctggcccacccagggcggaaaaccgcttaaaggcattcttaaaccacaaacaatagcatgagcgatctgtgccttaaggacatgctcctgctgcagttaactagcccaacctattcctttaacttggcccatcccttcatttctcataagggatacttttagttaatttaataactatagaaacaatgctaatgactggcttgctgttaataaatacatgggtaaatctccggttggggctctcagctctgaaggctgtgagacccctgattttccacctcacacctctatatttctgtgtgtatgtctttaattcctctagtgctgctgggttagggtctccctgactgaactggtctcggcaagtgacgtccattgtgggggctcgaatccaggttgaagggtcactggagcaacggagaatgtggaactaagctggaggacacccaagtactcttaaagccatccctgtggtgagtaaggggagctcagaagcatcagggtaacagtgggacaaatgtggggtctggtgcgttctcccttggaactttttcacactgatgatgaggaggaaggagagtaaaacgaagtaacagaagaggttacagagcaggtttatttgccaatttgccagctaaagctcaagcggcaaaggagggagaggttcatccctacccttctgcaccccctccttattattttgaagaaaaagaccctccagatctttcttttccagaggacattgggtgaaaagtagttgccccagtgactgagcaatgccttgagcaactgctcttagttctattcaggcaggaattcagcaagctagatgagagggcgatttagaggcttggcaattccctgttagaatacaccccccagatcaacagggaaatattatagttacatttgagccttttccttttaaattatttaaagaatttaaacaagctgttaatcagtatggaccaggttctccttttgtaatgggactgttaaagaatgttgctgtttccagttggatgattcctactgactgggatgctcttactcgagcttgtctaactcctgctcagttcttacaatttaaaacttggtgggcagatgaagcttccattcaggctgctcgcaatgcccaggcccaaattaatataactgaagactaacttttgggggttggcggctgggctggtttagatgcacaagtggtcatgcaggatgatgccatagaacaacttagaggagtgtgcattagagcttgggaaaaaaatcacttcatgtggagaacaatacccttcctttagtgcagtaaaacagggaccaaaaaaaccatacatggattttatagctcggttacaggagtctcttaaaaaggtaactgcagattcgactgctcaggatatagtgttgcacttattagctttcaacaatgctaatcccgactgcctggcagctctgcgacctatcagagggaaagcacatttagttgattataccaaggcctgtgatggtattggaattaatctgcataaggctactctgctagcacaggcaatggcaggactaagagtggataaaggaaatattctatttcctggagcttgttttaactgtgggaagcatggtcatactaaaaaagaatgtagaaaaaatcagcgagttatgctgccagataggggaaaagagaaaactgttgagcctgaaatatgtccaaaatgtaaaaaaggaaaacactgggctagtaagtgtcactctaagtttgataaagatggtaacccgatttcgggaaacgccatgaggggcccatcccaggccccattctaaaccggggcatttccagctcaggccattccctcacccctgtacaatgtctgtcctctgccacagccagtagtgccacagttgatttatgctgcacaaaagctgtgagccttctgcctgggggacccccacaaaaggtcccaacaggagtctgtggacccttgccagcagggatgataggattacttctaggcaggtctagcttaaatttaaaaggggtacaaatacatacaggagtcattgattcagattacaatggggaaattcaaattgttatatctacttctgttccctggaaagcagagccaggagagtgcatagcacagctcctgattgtgccatatgtgggaatgggaaaaagtgaagttacatgaacaggaggatttggaagcacaaataaactaggcaaagcagcttatcgggtaaagcaagttactgataaacgtcctacctgtgaaataactattcagggaaagaaatttaaaggtttggtagatacaggagtggacatttcaatcatttctgtacagcagtggccgtccacgtggccaattcaacccacccaatttaacatagttggaattggtaaagcccctgaagtatatcaaagtagttatattttgcattgtgtagggcctgatggacaacctggtactatccaaccagttataacttctgtacctataaatttatgggggagagatttattacaacaatggggagcacaagttctaattccagaacaattatata

SEQ ID NO: 477163 - DNA, 787 bp, Homo sapiens
gtgagatccgatggttttaaaaatgggagtttgcctgctcaagctctcctttttgcctgctgccatccatgtaagatgtgacttgctcctccttgccttccaccatgattgtgaggcctctccagccatgtggaactttgctgaaaagatacccaaaaatgtggaagcaactttggaaccaggtaacagcagaggttggaacagtttggagggttcagaagaagacaggaaaatgtgggacaatttggaacctcctagagacttactgaatggctttgaccaaaatgctgaaaatgatatggacaatgaaatccaggctgaagtcatctcagatggagatgaggaatttcttgggaactggagcaaagggccaagaaggcacttgcagtttcctggctctaatacttgtatatgtgaaaagcaggtgcaactagaaggcaaaacacttagatctcccaaaatcaaggattccattttacacagaatcctgcgtcccccaaaagagggcaatgccacgggatgggatagagtgatgcttccacagtgcacctcacagcaaagacattccctgagtctgagtggccgatcaccaatcagcccatcccccacaggaggcttatctctcagtgccatctccaaaactgcagccctcaccagggacttgtcaaccaccatacatccaaaggtcctggttatctcgcagtataaaataattcccggtatcccccaaagctaaagggatcaggaaatcaatgccaaagacagcagaactttacacttgagagaa

SEQ ID NO: 477164 - DNA, 2804 bp, Homo sapiens
tgagatttgggtggggacatagatccaaaccatatcaacttctatattttcaacatacaatgggtttttcaggacataaccccattaactttgaatatgttatccactgtcttctgacctccattagttctgataagaagtctgctgtttatcttattggggcacccttgtacatgataagttgtttttctcttgctttcaagattttctccttgtcattaacatttaacgtttttaccatgatgtttctgagtgttggctgtgattctaggattgaaaaagaggaaatgattccaaagcaggacatttctgaagaattggaatcccagagagcaaaatcagaagatcatgtaaggaatatttttaaggaaactgaagagatgagtaaaactgagggaaagttagagaattgctggagaaaatatgcagtagaaggagttaagaactcattctcccagaagagcaatttcagagaaattaccatgaggtatgtgaaaaccctctctagagagaatggccagaagttcaatgctgttggagaaaactgcattacagactcaaatcctgccaaacatcttagagggtctagagaggagagtctccatccaagtgtgtcaagtgtagaaaacttgcaacaacatgaggacctcattaacctccagagtttccaattaggagaaagagcctatcagacagatgtgttagtgaaagtgcccagacagagctcagttcttagtgagaatcagaggatgaataatccagagagatggtttgagagtactgggtgtggaaaaacttacaatcagaacagagcttttaaccagcaccagagatttcatagtggagagaagacctatgagcacaatgaatgtggaaaagctttcagttggccctctatcctcagtaaacatcagagaatccacactggtaagaaactctacacatgtgaggattgtggcaaatctttcagtgttcactcatactttattcagcattgtaaaattcacactagagaaaaaccctatgagtgtattaaatgtgggaaagcttttagtacacattcatcttatgttcaacatctaaaaattcatacaggagagaaacatcatgagtgtaatcagtgtgggaaagcctttagtcatagctctaatctaattcatcatcagagaattcatagtggagagaaaccttacaagtgcaaagaatgtgggaaagccttcaacagacaatcaaaccttattcagcatcagagaattcattctggagagaaaccttatgactgtaaggagtgtggcaaagccttcagtacacaattatttctcattcagcatcagagaattcatacaggagaaaagccctatgaatgtaatgaatgtgcaaaatcctttagcctgaaccgaactcttactgtccatcagagaattcacactggagagaaaccttataggtgtaatgaatgtgggaaatcctttagtcaatgctcacaagttattcaacataagagaattcacactggagagaaaccttatatctgcaatgagtgtggaaaatcatttggagagaaaccctatgaatgtagtgagtgtggaaaagctttcagccagagttttaatcttattcaccatcaaagaacacacaatggtgagaagtcctatgaatgtaatgaatgtgataaagccttcagtttgctttcttcccttgttcaacatcagagaatacataatggagacaaaccctatgagtgtcacaaatgtgggaaggcctttagccaggggtcacaccttattcagcatcagaggagtcacattggtgagaaaccctatgagtgtaatgagtgtgggaaaacctttgggcagatatccaccctaattaagcatgagagaacacacaatggagagaagccctatgagtgcagtgactgtgggaaggccttcagccagagtgcacaccttatccaccatcaaagaattcacactggagagaatccctatgagtgcagtgaatgtgggaaggccttcaatgtttgttcctctctcattcagcatcacagaattcatactggtgagaaaccttatgaatgtagtgactgtggcaaggcgttcagtcagcattcacaatttatccaacatcagagaattcacactggagagaaaccctacatgtgcaatgagtgtgagaaatccttcagtgcatgcttatcccttatccaacacaagagaattcacactggagagaaaccctatgtatgtgccaaatgtggaaaatccttctgacaaagctctcaccttattcaacatcagagaattcacagtggggagcaacctcatacgtgtaatcgatgtgaaaaaaccttcagttagagaataactcttagtagtcatgagaaaatccatacaattcacattagagagcaagtctatgaatgtaatcctgcatacttttaagaccactgactgagctggtcggaaagatgccacaaggagctgaccacaccaaagaatgcagtttccacgtcctgatgatgtcatcccctttgccctggccaatcaactacccccattttccagcccctcgccctccatgatccccttaaaaaccccagatggatttgagggtctcctcccatctccttacttggtgccctgcaataattaaactctctgctgcatccctgctgtctcagtgtcattgggctgttactgtgcagccagcatacaaacctgttggtcctataacaggcttaatcagtgaacaagtgacaactggtgcccacccccacccctgcccactctggtgctgccaat

SEQ ID NO: 477165 - DNA, 1495 bp, Homo sapiens
atccaaggttagaactcagtcctattcgagtccagagcccatgcgcctaatagcagcattacatgcctgccacatgcgtttaggagtgaaggcagagtacactaagaggtgtgcctcagctggagactgtgaagacatcaatgagcttatgttcagctgccagtcagaaactctgcccacacctcaggacaagctcagagacctagtgatggctgtcatgcagctccttcttggtgggctccaaggctgcatcaagatcttgtcattccacatcgtggtttcctttgaggatgtggctgtacccctctcccaggaggagtgggactgtctgatccctgctcagaggggcctctacaaggatgtgatgatggggacctatgggaacctactctcattagtaggtgaatggttaagcaaactgtggtacatccataccatgggatacgactcaacaatcaaaaggaactgcccagacttcaccacgatgcaatatatgcatgtaagaaatctgcacttataccccctaaatatataaaacatttttaaaagaaaaaaaggaagaagatacatgcaacaacttggatggatttcaagggaattatgctgaatgaaaaaaagtcaacctcataagattacattctatatgattccattcatatgacattcttgaaatgacaaaattacaaagatggaagacagaacagtggtagccacaggttggggtgaggggataagaaagggatgtggctgtggctgtaaaagcgcagcacaagggatccatgtgatagaactgttctgtctcttgtgatggtggtcacatgaatctacacatgataatactgcatataattgtctaaaatgacattttcttcaagagttatctacagtttaaagctcacttttatgaagtgtcacatccatcaccattttaagagacataaaatcatgaaaagatatcaccagaagctacgtaaacatttcagctaagggtaaagagaaagttaagagtgttttcacaaggaaattgaaagaaggcaatccgaatgaagtcaacttggtcacacaaaaatcttggtaaaagaactagaatggaagcccaaactgctgagcaagtgggagaagaaaagaaaacttggttcaaacagatcacacaagggaacccaggacaaatgctgactttggcattatctaggtaacccttttttttgtcataggtgactctaataatagacctgttgttgcaaaaccagtcaaaatcctaccaaattaaaaagaagtccctcattgacttgttgggtgtaggtggtaccccatgtcctcgcacaccaaaagagatcatttctggcaagaaagctcctacatgccttgatggtgctgctggtaggatgccttaggccaggcccatcccagcgatgttctgctggctgtggtaaaaggtgggaggagaatatgccttattcattactcaatcaacttcttagccttgaagaagcat

SEQ ID NO: 477166 - DNA, 850 bp, Homo sapiens
tctctcgttccaccttatgagaaacacccacaggtgtggaggggcaacccacccctacagtataaaagctttcctatgcaagagggctgatgttataacagtagattattatgctacagtgtattttcaccagaagttggaagagtttggagacttagaagaagacaagaagatgagggaaagtttggaacttcctagagactggttgaatggttatgaccaaaatgatggtagtgatatagacagtgaaggccaggctgacgaggtctcagatgaaaataggaacttattggaaactggatctgtgggttgtgaagaccatgggaaaagtgtggtattggggccagataacactgtccctcatggcacagtcactcatggcggcttcccttgtctaggggaggaagttccccaacttcttgcacttcctgggagtattgatgagaaaaacaaaatgagaacatctttcctaattttaactcttccactttctggtcatcgatccttactggcctggttttgtcatccgtaagttggttttttattctgtatttagaagctctattattaatctgtatgcacataataaattttgcatttaaaaaaataagtggccaaatagtaaacaatttaggttttgggtgtcatactgtctctgtcacaacccacatctgtctttgtagctctaaagtagacaaaaacaatatgtaatcaaataaggatggctgcattcataaaacttcatttaaaacagaaacaggtacaacaattaactcaagatggattaaagacagaaatgtaaaacctagaaccataaaaaccctagaagaaaacttaggcaataccgttt

SEQ ID NO: 477167 - DNA, 470 bp, Homo sapiens
tgcagctgatgagcatacaccccaccatgctgctgctgccgctgctgctaggacatatgaatgaggatgcaccctgctgccactgcgttggggaagttgtcctggataatatcctgaagagtgtttttcaacttggttccgttctccccatcactttcagcaaatgcagaagaaatgaaatcataacaaccactctcttggactacaccacaataaaattagaaatcaagaataagaaattcacccaaaaccatacaattacctgtaaatcaaataacctgctcctgaatgacttttgcataaataatgaaattaaggcagaaataaagatgttgtttgaaactagccagaagaaaaataccacataccagaatctctgtgacacagctaaggcagtgttaagaggggaatttatagcactaaataccacaccaaaaagttagaaagatctcaatttaacaatgtaacat

SEQ ID NO: 477168 - DNA, 736 bp, Homo sapiens
cacctctgtaggctgggaagtccaagattgatgtgcctatatctggtgagggactccttgctgtgtcataagacaacagaagagcacactgggtatggcagactgtggccagattgcctcttcaggccagaccctgaccctccttcctcactggtgtggcaatactgctgcttcttgtaaagagaaggctccatctttggaccagtgtgagtgggtgtttgttgtggtggtgttggctggttgggacagcctgacctcaggccctgaggctagggcagctggcactgggctgcctgttgggctccctgtgggcttgagcggtgcctgtgcaaaaactgcaggagtctctctgtgtcactttagaggcccagagaatttggggggttctcccatggccaggattgtgagggtccatgtgggaagtgtggatcccctggggactctcactcattcaaccttttcccgtgttagagagcttctcctggctccatgccagtcctgggtgtgcagctacctggctttgctcctctctgttctctgtgaggcccctggcttccttggtggatccagaggtgatttctaattttcttgaagaactactctttactagccactttgattcttcactgtgagagcagtgcacattaactgcttctagtcagctaccttgaacctcctctattgttttcaagtgaaacttcttttttattgcatactgtttcacagatttaatatc

SEQ ID NO: 477169 - DNA, 749 bp, Homo sapiens
aggagtcagcttaaatcgggctccgtgacagccaacgcagtgaccctcgccccttccttggcagcacatcatgcttgtgcagcggcagatgtctgtgatagaagaggacctggaagaattccagctcgctctgaaacactacgtggagagtgctttctccaaagtggatgcttgcggcagcccacactctgatttaaaatcatctctggtagatgaggcgccaactctaggacatctagctgtgattgctcccttggcagtacgccctccaatgagtgttaagtgtcacaggaagtatgaagatttcaaggagaaagacacaggctgtttcggatgtgccttctggctcttcaccagatggcccacagtcaggaagaaaaagggagaaccaacaagctctcctctcatgtctgatcctgaagatgcaaatgttttcccagagtccctgcttcccagcatacttccccttgcatctcactggccagaattcaagtcacatggtcattgctggccactgggaaggctaggaaacaagtgtccagcagagaggagtaaggttatcagggtattctcagtccaacactgagtggtacattgggtgtattgcaaactgaacagtggcagagtcatgttagtaagaggagagtactatttggggaggcaatggacagtgtagccacatgacccccaaagtacctgtgaagaaaatctgaagttgagctaaaaacaatatttgctgcatcatacct

SEQ ID NO: 477170 - DNA, 1553 bp, Homo sapiens
tgggaacccacttcttgcatcaatggctgaataggaacagctccagtatgcagctcccagcatgatcgatgcagaagacgggtgatttctgcatttccaactgaggtacctggttcatctcattgggatttgctggacagtggatgcagcccatggagggtgagctgaagcagggcagggcatcgcctcacccgggaagcccaaggggttgggggatttccttttcctggccaagggaagttttccacatagcacctggaaaactgggacattcccacccaaatactgtgcttttctaacggtcttagcaaatggcacaccagattatatcctgcacctggctcggaggatcccaagcccacagagccttgcttactgctagcgcagcagtctgagattgacctgcgaggcagcagcctggcagggagaggggcatccgccattactgaggcttgagtaggtaaaaaaaagtggccggagaagttcaaactgggcggagcccactgcagcttagcaaggccagctgcctccgtagtctccacctctgggggcggggcacagctgaacaaaaagcagcagaaacttctgcagacttaaacatcccagtctgacagctctgaagagaacagtggttctcccagcacagtgtttgagctcagagaacggacagactgcctcctcaagtgggtccctgacccccatgtagcttaactgggagacatcttcccgtaggggccaactgatacctcatacatgagggtgcccctctgggacaaagcttccgggggaaggatgaggcagcaatatttgctattctgcaatatttgctgttcttcagtctccgctggtgatacccaggcaaccagggtctggggtggacctccagcaaactccaacagacctgcagttgagggacctgactgttacaaggaaaactaacaaacagaaaggaatagcatcaacatcaacaaaaaggacatccacaccaaaaccccatctgtaggtcaccaacatcaaagaccaaaggtagataaaaccacaaagatggggataaaccagagcagaaaagctgaaaattgtaaaagccagagagcctcttctcctccaaaggatcacagctccttgccagcaatggaacaaagctggacggagaatgactttgatgagctgacagaagtcggcttcagaaggttggtaataacaaacttctccgagctaaaggaggatgttcaaacccattgcaaggaagctaaaaaccttgaaaaaagattagacaaatggctaactagaataaacagtgtagagaagaccttaaatgacctgatggagctgaaaaccacggcacgagaactacgtgatgcatgtacaagcttcaatagccgatttgaacaagcagaagaaagggtatcagtgatagaagatcaaattaatgaaataaagcaacaagagaagtttagagaaaaaaagtaaaaggaaatgaacaaagcctccaggaaatatgagactatgtgaaaagaccaaatctacttttgattggtgtacctgaaagtgac

SEQ ID NO: 477171 - DNA, 1058 bp, Homo sapiens
tggaaacctaacaacaggtcctaacccaggccatggacaggccaaccgtatgggtgtggatgtaggacatctgcatgtttctgcgaagagcacatgtggacaatcagaaagtcccctctgctgggagaaggtcacggtccaagatgacagctcagctttgccctctcaccctggtgttgcaagtggattctgcgctgcttctgaattacccaggtgggctgcccgggttctgcaaagcactgcaatatcgctcagagcaggtgctcttcagacctctggttgcgattactctcagcgcagggtcaccaccacccagagggacacacttggagcaaacttagtgaagggcgcttgccttaatcagctgcaaaatccgtgtgcatccaataggatttacctgcagaccagcccctcccagaaaatagtcccaacgtcgccagtccactctgatcttagcccctcactgagctccggctgtccctgtaatcctgaccgtgctttcacgcttttcatggctgaagagtcctgcaaaatatggaaacccagagaaaaatggttaacaaacactgactatgattttcctgattgcacagctcaagagattgagttcaaccacttaaactagctcagatgtggcacctcttaatcaaaccctgtctttctttagccctttcttttctctttttcttccaataaaagagtacttaacattggatcttttatcttgatcagcaaagttttatatttaacttttttcccccaagacgttttagaggtactttatttttttctattttctagagtgtgaaacatggtatcttaaaatttaccttaaaatttatcaacatattttgttttggattttcacaacatacttattttagatcctttgctttcactttaaaaaataaaacaatgtcaacacttcatactgaaacaagagggcatattacagaaaatgtcttctatttctcctctgtaattgatttctaaaattactttgttactaaatgtgctatcttaagctgactaccagcttttgcaggcatttcctggaa

SEQ ID NO: 477172 - DNA, 790 bp, Homo sapiens
cggagaaattcacagaatcttgggaaaagagagcttgggaaaatcctgaagaagaggtgacatgtttatgttcttccacgcgtctgataaggaaaaccagcagacattccagaatgtacaaaacacgggtgaggacaggtgcaaggaccacagctggaaaccagcgaacacaacaaaccgcagctgtctgggccatgccacgctggtgtgggccagaggggaaaccaagggcgtgtactccaacatgaaaacggagcatgcatgtgagctgagtagtgacatgcaacatgcatgtccattgatccttgctgctcattcacatacagtgttcgcgatgccccctggacacagaattccagtggacccaccacgtgtggggattcaggggagactcaaagcaaatacaaggaaacatgaaacagagttccttgctaaaatgaccttggaagacatgatgagagatcagaatgctagggcaagaacaggagatgagtctacaaacctggggcaaaactggaagagttctgagggccagctctgccacgtagtggatttgtggtcttgggacctattgctagcaccattttatatattaggaaaatatgacccaggaaatcctgaaccatccaagtacgtacccaatgttaagtgtaaagccaactcagttccagtgaggttttctggctcgtaatctggtgatatttagctacttagatactgtttagatattcagattctcagtgagtgactcacaagattatgtctgcgaactgtggctagatttcatttt

SEQ ID NO: 477173 - DNA, 693 bp, Homo sapiens
actccccagacaggagtgccatccgttatggccagtgttctacgatcctgtatctacagtgcctagaatatggcagatgcttaccaaaaaatacgtttttccatctatggaaatgtgttcatattcatctccttttacctcaaaatagacccaattgaagtggcaacttctggatctggcctgtctcagatatgtctttatcagcagtgtgaaaatggactaatacagtggaaaaaggcgaggtggggacaggtaaatcaggcttttgactttaagacttcaagtgcttttcagatgagagatgtgttaaggggaaggtcttccatcccagagcaatcctttaatcatcctcatacaccttcccaaaaggtgtgccatgaccacagggtggccaggaaggctccctctagaactggtgaaaatgggagccctttgggagcaatatcctctgaacctgttataccctctagggtatgaatggagttttgacacaacaggtattgacataaacctgattctcctcttctttgcatggaaaagctgtgctctttgtagccagaggagcagaattctttactacccctttcaaaatattcttgcctagatatgagaggatcatctcatcttcactaaaaagttaaagtgagtagcaaacttagtgttcaggcttatatggggaatataaaatagcct

SEQ ID NO: 477174 - DNA, 727 bp, Homo sapiens
aacaaagacccgcacgtaacagtgggaaatatgcactgctgtttagcaaaggggtcaaacccatttggatggaattccaggctcagcaggctaacaatggcaggaaactgggccctcaagccggctgcaccggggggctgttgagcgatagcttgttgaaagaggcggccctggggcagtgtgatagtgtcatggcagaattttacacgtttcatggcctgcagataagaagtgaagaatattcccagaagcagccacaaacctttccttccagaacattgtccagaactgaaacatggaccaatattaaaacagtcactgactgtacttccaatggagccctggacttcttgggccagcaagtaaactatcagaaccactctcagctgccccagctaacaccactagatccagaatcgtgggtgagtgcacagtgcacccacgtttaccctgatcaaagtgatgttccttcctcttgaccaatagccttcaggatgcctttcctcacatattcccacatctttgccaatataattaagtcctgtttttgtttacttatttatttattttagtggtgtttttaacatttactatagacttacagccaagttgtaaaaatagtccacagagctttcatgtactcacctcccagctcttccacaactgtaattgtagtgcaattgacagaccttattcaaatcttgccagttgtcacactaatgttttt

SEQ ID NO: 477175 - DNA, 519 bp, Homo sapiens
tggaaaagagctgaggttgcggtgggagagaatggatggagtgcactggaattgggtattttccttctttcacatggaagaatctgatcaagctcctagaggtgaaactcacaaatatttggtagtcgctctagactgggttgctccggagtttttaactctcaggcttgttcgccctgattctccagcaatttgtaaattagagctcaggttttcctgccccagcaccggtccccacagtggtttccacagatcagtggtggcattagattctcataagagtgacaaccctattgtgaactatgcatgcgaggaatctaggttgcacgctccttatgagaatctaatgcctgatgatctgaagtggaacagtctcatcccaaaaccatcctctgcccccttctggtctgtggaaaaattgtcttccatgaaacctgtccctggtgccaaaaaggttggggacggtggtagaacatctttcaactgactggaaatatgagatcttcacatttgtgcctt

SEQ ID NO: 477176 - DNA, 680 bp, Homo sapiens
ctcttaggctatttctggatgaggttttttgtttgtttgtttgttttataagataccccacaataggtaatggcagaatggccaggcctagagcctagaaccttctccctctggctccctgcttcctgtaccacctggccaggagaacatgcagacacagaatttcttcctccaaacatacttttcactattcccaatgaaaagactctccaaggccctggagcacctggcccacctctccttgcaccggctcctgtatgcttgggccccctccgaggcctgacttcactgagcaagaggcacaagagggtcaacacatcagaacatctcgtgagccacgtgttctgcgtgggagtgaagggcagacctatgcagaggagctggggagaagcagtgggtgcagcgccacgggatgacggcttagtgggcagcctagtggggcttttactgtcagcaattcagtgctgctggtgcctgaaggaggcagcagtggaagcagtggacatttctgatatttctctatagtaatccatgtagtttattcgtattaactgctctataacattccatgatatgaatacactaaatgtctttatatatctaatttcagtattcatttcattttttactatttaaaaatagcaaaaataactgtaatgagcattctgtctccttgtgca

SEQ ID NO: 477177 - DNA, 646 bp, Homo sapiens
ttctgtttctagacttccccccatgggttttcttatggaattcaaaggcttgcttttaaatggtgcgatcatagcttcatcatcatccactgcttctcaagtatttcctctagttttgaatattaatgctgtttccagtaatttgctgttacaaacagttcaaatgacctttcctgagttggatttcagcacagcaattttgcagggacaccaacattcaggccatggcatccagcacacaagagaacagccttcctggatggtactgaacaatgatgttcttctagactatccaaatactggccaccttctgagcacagctcaggtgcctcctcctccagttaagatgaatcatcctggagaaaaaggtggacccttaatgcaacatgagtggtatccttgtaaagaagaagggagagacacagggagaaggcggccacggaaacagagtttgggctctcaccagcatccatcctttcactgtgtagccccagggaatggatcggggactctgtgatctttgctttcctttaaaaagtttgtttttgcacgtccactggagccgatcattttctcctattcgccttggtgacatcttagccttgaggtttatctgaaatgtgattgttgctgattgattgcttct

SEQ ID NO: 477178 - DNA, 901 bp, Homo sapiens
ggaaggaaagaattaaatgatctcggttggtcctcccaacagctctgagagacagacactctgatttctctctgctttacagatgtggacctgggactgagatattcagtaactggcttagtatcacacaggtaaacaaggcttacccgggtttctgcaaggaagcttcatgcattagcgtagcagatgctctatgtccgctgcacctgagctcacttctgcattggcagaagtcaatttctgagcacccgacaacttctccctcagcggccctgcctgggtttttctcaggtgcccaagtcatgccagcttgcccagccagcatgcgaggcagcgggactgctgaggatcaagtatgcaggtgaactggggcaaacctgggttcggctgcaagtcagtgccagcctgttccgtgtgtctcattctggggtccaggatgaagtcgcagtggctccctgaggcatacactccttgtgtcggggtcaaaacacacaaagtcccttggtttggttctctggcggcacctcacattaaggggccagataccactatggtaaaatctcggagcggtgagaggccactctcaaagaaaaggtccattctggaaggcagtgaagataacaaaattcacagtaccacagtcagcaatggtgtgggctcttttgcttcttggagcaggacaagtcagcccctggattccttgctggccgccccggctgacaaacctagaacaacagcggcacagacatcctccctgtgcgtgcccggctgttccgttttgcttcaaagccggtgggggacggaggggcggtaaaatattggtaactcgtgtgatagaactgatggtactagtcagccatctcacccacctcctaaaggcgcctgcccagctgtaactgcc

SEQ ID NO: 477179 - DNA, 657 bp, Homo sapiens
gataaaacaggaaaagcagtttatgtttaccactcacagacatgaagatctttgtcctggggatatggtccacagctttatggggtttacaatctggtgtggactccagacatatcaacaggctgttataatcaagtggaaaggtactatgataggggaagttcaaggttctattggaacactcagaataggaactcgaccagatttggcagagtggagagtgaggaaaggtttacaaggagaagtggtgtctaaactcaataggaattggccaggcaaagggagacggaagaagagcgggtaccaggcagagggaaacaccctcaaggtgagaaagcggctgacccagtatttgggaattgcaaatgctcacgtggctggatataaaaagcaacaaatgagataccagcctggagagataatcaacagttaaactacagagggtgacattaaggagttctggacaatgggatgccaaaggtgttttacacagaataatgttataatcagatgggtagactgaaagatagtttggagctccccatggatagtagatttgatgaaaacaagcaggaggcaagggaaccagttagagggttgaggtagaaggccaggttggatatttttatctttatcttctaactttataattacttg

SEQ ID NO: 477180 - DNA, 613 bp, Homo sapiens
atccaggtctggttcctgccttttgccatgagctgctgggacagggcccagccacctgcaaccctgaactggaagaagcaaggtacagcccccttggctgctttcatgggctggtgttgtgtgcctgtggcttttccaggtacatggtgcaagctgttgatggatctaccattccagggtctggaggttggtgactctcttctcacagctccactaggcagggccccagtgagcactctgtgtgggagctccaaccccacatttcccctccacactgccctagtagaggttctccatgagggctctgcccctgcagcagacattccagagcagttgcaggaatgttttggccaggttgatgggagtcctccagccaaagtgcaagaagacctgcatctcacaggaatggcatctgtgctcagccactgggaaagagcagtttggaggaagtgtggttctgacaaggaggttggggatccagaagttagcggctgggccagcattcagtgctccggcagcacttagaatttttaacagaacagaaaaaaatcttcgttgaaatgaaagtgacactctagtgggaagggggagaaagacggtaaacaacataaat

SEQ ID NO: 477181 - DNA, 634 bp, Homo sapiens
cattacccatagagcacacaactccagccctctctattcacagatttagctgctgtagaggttcatggtgtactgccccatgttgctctgtgccagtcctgagtccaccttggacagccctcctctccgacggaagactgctccttcgctttgctacttatggcccctgagggattcagctctgggctacggggaaggcttcattggaagcacccttctggaagccccagctatggaaagcgtctgtgcagacttgttcatgtgtccgccctctggagaaggggactggtctgcagctggggaagcacataagatcaaaactctggcagtggatccaggtactgacaggcacaagcaggcaatagtgggcatcacatgtaccagtgtggaagagcagggagggctgctgctgagcacatgggaggaccaccaagggaaccctacaaataactgggagagatctggggtggacacagcttgtcagagaaggggcatgctgggtggagagagaggagaggctcagagtctgtgtcagtcctgaacaagtgaagtgaataatgtgaacgtcatttttcatttctatgacatttgccctcctcagaagattttggttactgaaatgacttaagatggt

SEQ ID NO: 477182 - DNA, 760 bp, Homo sapiens
tgaatcatggactccaatacccaatgccacaggactctgacccagcctggtaggatctgtacagagatgttactggtgaagcttctttcttcttcacgtccttttgtacatgtttatttccatgggggtggagaagccctctgagagagaaacacacgagtcccattcaccattaggctttgggtacagtgacagatctgatggatgggtgggtagcgatggggaacagggaggggaggtcctggacagggcttttcttgatggcttggcacttatgcttgtcttggcaacagagaggaatggccaaaacgtaaatggagaagtggttcctgagtttgaaaaatggctctgccatttacaatatgtgagacctggagctcagcttccacttctgaaaaatgaggatgagaagagtcaccatctcatagctcgaggtgaaatcagaggctgggttatctgagtgatccaagcccacactcacattccctagttcatgctgttcctctcttttcccttgttcatgctgttttctacacctgggatgctcctctcttttctgcccaaaatcccccttgtctttcaagtgtcctcacttttgtgaagacttctgtaacccctcccctttccctactcttagtcagaattacaatgaacgctgcctctgaaatcccctagagcttctcaaatctttctatggcacccctcaaagaagagtaagcttgggtcatcatttatctttaccagccctccacccaccctc

SEQ ID NO: 477183 - DNA, 586 bp, Homo sapiens
ctccccatgctccttcagtgggctccacgatggtcctgccctccaagcccactcactctctgtggcccaacatggctgacatgggaacattgatttccttaaggaggagaaagtgccacctttatctacaaggagagtctgccctcggagtcaaccaagatcatatcagtgatgctggcacttggatctacaggcaactcacagtctgtctgatgtggtttggctgtgtccccacccaaatctcatctccaattgtagctcccacagttcccatgtgtcgtgggagggacccagtgggaggtaattggatcatgggggcaggtctttcccgtgctgctgttctcgtgatagagaagaaaaagaatcctgtggcattgtctcttctttcccgcaattctgactccaaggctgtgcagatctttgccatctccctgcgttgctaaaaccagtgttgtgaggacctcattaccaatttggttacttggtgaggggcccctaacctgggggctcggaatttggatggggaaaatactttattttcactaacctctgactgaaatttactatttccttcaattatgaatgt

SEQ ID NO: 477184 - DNA, 896 bp, Homo sapiens
tctaaaatacgtatgtatgtaacagaaaagtgcaccaatcatcacaccttggcaaactattacaaagtaaatacgcccttgtttttcttgatcctctccctcttcccacccttcgtcctccaaagggccccagtgtgtgttgttcccctctatgtgtccatgtgttctcatcatttcctcccacttacacgtgagaacgtgcagtattcagttttctgttcctgcactagtttgctaaggataatggtctccagctccatccatgtcccagcagaggacaccatctcgttcttttttatgagaagcctgtctctttggtgtcactcttccatcccagggctctactctgtgcttctgtttccaaagcttggcttccaagtcactgtctcggaagttgccagtaaaagtcctacactcttacctctactgagcattctaaatagatgctgtgattaccgttcgactttgtgcccggtttcattctagtgagtgttttttccctgctactctgaactattctactgacccttatacaataaaaccgcggcctcgttgtgtttctgcaacctgggcaagaagagacaggtcacctgcttgacactcagtctgaacagaatccttcacaagttgaaaattgagagcaaaacttatccagagaaggaagagattctgagcagttgaagggccaactaattacaaatgaaaccagtgcttctaaatccggagtcccttgaataaataacatggaacgccactcctggggcaagctcctgcctttagtctgggggctcagtggtcactggcgcacagccctggcaggagccaggccaggtaacttacacagaggatgatgtgaacacctgccctgggatatagcagtaaataaaccaataata

SEQ ID NO: 477185 - DNA, 686 bp, Homo sapiens
ctaagcataaccccttgttagcaccttcagtcaccatacacaggttaccagtgtaacttgatgaaatcaagtaatcttgccagtctccaaatcaatacgaatggtatcattcaccttgatgaggggatcagggtagcagatggtgtgagcatcatgagtcaccacatgagggattccttttgtgcccacaaagatttttctcactttgcacaacttgtacttggcttcctcaggtgtaatacaatgtacagcaaagtgacccttggtgtcatagatcagacaaaaattctctcccatcttgtcaatgctgatgacatccatgaatccagcaggatgaactggaaaaactggatttttggacgttctcaaatcaaactctggactgacaaccccaccaagattccaccgtcctggggaagtcctgtctatgaaggcagcctgcctctctttttaagagttcccaccttaaatccagtgttcttctgtgacagacaccctgccccaaatgtcaacccactcgatgctctgctcagcatcctctctcctgtccctccaggggattcctccactatcatgtgacttgggctttagtctgtcccttatttattgtgtgatcttgaacatactgcattggctcttgagccttcatttccttaattagaatactgtatagggcttatctaagc

SEQ ID NO: 477186 - DNA, 599 bp, Homo sapiens
tcagaggggggcaccagaggaggcaggaaacgtggtgggagagatgaagcagacctgcgtcggaggcagcggtgtagcggaacagagacacgagcccccgcaaacgttggcatccacggagggagcacggagccttgggatccccaaggttataacaatcctgactttatgccatgttatatgtttttgggcaaggtctgctgctgctacaattcaagctgcattgacaactggaatcttccggattgtttcttttgtgattataaagtgtctttggagtagcgtgatgtgggtggatgcagtttatagaactacttggaccaatcagcctcctcctcaaaggaacactggctttccactcttccagtggattataatgcttactgtatctggtagcgtgctttcagcggcaactaacggaaaagccaactcaaatgagtttaaccaaaaaggaaatgtattggcctatgtaactggaagttcacagatgggacaggctgattgaaccctggtgtcaaggacctaggttctttctgcatctctgctttccatcctcagtgtcagctgccttttaagcctggctcccttcatagtcagaa

SEQ ID NO: 477187 - DNA, 1020 bp, Homo sapiens
aactcagacttgtaggaagtcggatcactatgcctagtaataatccaggaaggcaaacaataattcttttcattcggccaaaaatgaccaagataaatgtctgggtccagacagtgtatttctggaaagccagaccatgtgaaaaagttatgacttgggcatttagcatgtttttcagccagccggtacctttgaaacatcctttctatgtttggggagttaactcagaaaatgctacccaaaaggcttcttcgcaggcaccttgtaacctaagctccaccaatcagacgtctaaatcagaatctgattcagcagtagaccagggtaggcaggaggatccacgtagaatctccttgctggtggtaaaggtatccagccttcagaagcagcagtgtctgcaaacttggattcctaaggtgcagaaatggctgcagtggctggagtttgtggaaatttcagttgtgctgacttgctggcagcagtgcaaactatagcaactaatgctccatgacgatagtgacagtggaaggacagctttctcatcaaatcaggtctgccacatggtttgggacactgttcctggaaactgaacttcagaccaagttcctaataattccatgatgcaatggtattttaattaactctatttctgcctaatcagccagagtcagcttctcttttgtgcaagaacttaggcaaatgcaaatacaatgacctttctaaaatgcaaactaatcgtctcttgtctttgcctaaaacatcgccatgataaagtctaaactccttatcttggcatataggcactgctgcatctctggcctcacctttcaccagtaggcctcccactccaccataagctgcagtcacaccaaactacttgccattacccagcatttcatattcttccttacctcagatcctttgcatatgctatttctggaagccaacaaagatttctgaacattgaaaataatgacaactgtctaagattggtgagtcagtgggtttgccaacactgtg

SEQ ID NO: 477188 - DNA, 1254 bp, Homo sapiens
gaaaaggggctcccagtgcagcagtgggctgaagagctcctcaagtgccgccaaagtgggagcccaggcagaggaggcgccgagagcgagcgagggctcatgctggcatctctcgcagccctcgttagctctcggtgcctcctcggcctcagcgcccattctgactgcgcttgaggagcccttcagcccgccgctgcaccgtgggtgcccttctctgggctggccgaggccggagccggctccctcggcttgcggggaggtgtggagagaaaagcacgggcggaaaccggggctgcgggaggcgcttgccttgaggagcccttcagcccgccgctgcaccgtgagtgcccttctccgggctggccgaggccggagccggctccctcggcttgcggggaggtgtggagggaaaggcaggggcgggagccggggctgcgggaggcgcttgcgggccagatagagttcggagtgggcgtgggctcggcgggccccgcactcggagtggctggctggccggccctgccaccccgggcagtgaggggcttagcacccaggccagcagctacgaagggtgcgccggggtcccccagcagcgctgccccaccggtgctgcgttcgatttctcgccgggctttagttgcctccccgcagggcagggctccggacctgcagcccgccatgccttgagtcccaccccgccttcgctgttggctcctgcacggcctgaacctccatgaacgaacggcgccccctactccaccgcgcccggtcccatcgaccccgaagggctgagatcgcgggcccgcaagccgcgggactatcaggcagctctacctgcggccccagtgggagatccactggatggaaggtgtggctggccagcattaccatctcagagctggccgtgacaagtgccatctgccatggcggttcagctctggcctttttccagaatggcaacatcaatgctatagttccctgtgaaattggagaagttaattatactttaaaacttttttctgttgccttaaagatgctggctttggtatatagcctgaatcaaaggcttggaggaggggtgaacccagaaaataagggactggagagaggcgaatctgaactagcaggaactgtttactgcagctgtgaccgaaatcggaggtgagtcaagaggatgggacacagggcactaaaacaggctgctacaatttccccttaatgtggccacttgctgtctcaccctgtttgggacac

SEQ ID NO: 477189 - DNA, 4713 bp, Homo sapiens
gtgcaggactgcaggagcagctgagcttaccaccagataagacatggctgctcagaaggagcacccaggatgggccgtcctcagggtgtggccccaggagctcctggcttcagaatggcagagccagtgtggccttactgctcacaaggtgcaggtgatgcccactgcatggctcatggatacagaggtgcaggtgatgccccctgcatggttcatgggtgcaatggtgcaggtgatgccccctgcatggctcctgggtacaatggtgcaggtgatgccccctgcatggttcacgggtgcaatggtgcaggtgatgccccctgcatggttcatgggtgcaatggtgcaggtgatgccctgcatggttcatgggtacaatggtgcaggtgatgccccctgcatggttcacgggtgcaatggtgcaggaatcctgccttgcacctgctccctgatcgctctcacccctggcgcagagcctgcaggcagccctgggctcgagctagggcccaatggatacacccacctcgaggccggatcgtcgtagtgttgcaacggcactccctgtcttgggatgccctttgggtaagacagctcctgcaaggtgtggtgtctatacacgttggaataaaaagtacctttgaggtctgtatattggatgttctaccctggtgtagctccatttggtctgccacttggggaaattgggtccgatcagaggtctaattttatcagacgtacaaagctcttatttagctttttctttgttacctttgcttatttatttagcacactcaaagtttaaaaacgtaatagactgaagaaaaatcacctatggcaggggttggctaaatatcaatcctgttttctcttccaggcaccctgggagattgcatttcccaaattccattctacttaggctggggccagatgactgggttttcgccagtggaatgtggctgggagagattcaagctgcttctgggcctggcataaaaacccgacatgctccttcttccccttctgtgacaacgtggaagtccacgtgtttaagatggtggcagcataagatggaaggaacttagattcctgagtcacctcctggaagtgagctaccaaactgctttccatgtgatttgagtaaggaataggcctatattgtaccaagccactgagatttgggggttgttgttgcagttatttatcctaacatactaatacagcagtagatcaaggtattcttctatgacagtaagacctctcttctgctgattttctgtattaaaacttgcctgctgggtcatgggctcatgagaggacagacaggacatcgtacaacttctctagctaagctcatcagcctctcattgtactactttgaaaacagaatgcacatattttaatgtgtatatgcacacagacatatttctaaagctaattcttgaagtatgcactggctgacaagtacatgcttcgaaggaatttgtaaatactagaccacagtcaagaaaaacagagttcaaaaaatctgtgtgcttccagacaggattttttttcagaattggaagtataatgacgacccctcatggggcataccctgaaaccaaccctcatctcagtacttctcttttggagggagcgacttctgttgtaccttaaatattctcccctgtcaccatcatcacggggacagcttggcatatctttccctccctgctcaagggtcagcatgtaagcagtggggactcaaggttaaaaacacccagctccaggttttagtcaacccgtgtatatataaatgagctgtggtactcctcatttctaagtataaagtcgttctctctttttctggttttaaaaaacttttcaggctaaaatcacagatttgggatttaaattttgtgtgttgttactagaaaagcctctgaaacatgtggatttatgctgtgtatgccagatgggcggtagttggaaccagagctgactcatggtttggaagccacatatttccagtttggggttgtgttgttttgcttttgtttttaaacccggcatctttcaatagagcttgggagaggaattagcagaagaggattccaatccattcaccatttgggtgatctggatccctgaattttgcagctctggactgaatctccaagtgatcacctagttcttgcattcaaagcttcttggacactgactgaccctcactggggcagagccgccctaatttgtagggtgtgttttgctcctgtgtgccggacactgtgcacacaggacacatcatctcacctaatctgtaccataaccctgcagaagaggccaagttcccatttcaagttaagaaaatggagactgaagaagtaaaggaactaccagtaagtggcagaactgaaatcacatccagtagcagagcattgtatatctgtttgccctccatctctctggctagagcataaagtacataagggtgggggctttgcttcgttccctgctgtaattccagcccctggagcagcgtctgctacatcgcagctgctcaataaatacgagtgaacgaatgagtgtgaggagacaagtgtgattttccacccttcttctaaaggtacagcttgaattttgaaactaggtccctacagtttgatcctatcttgtttgacttggaagaataactcataacacagctgatttttaaaatactggtaggttccttaagactctgagtgtgatgtctgctcagagcaaattgtggagatgctaagattaggctctgagctcaactgttgataaaaaataaatagaggcaggcaggcagcctggggtggggtggggtggggtgggctccttcacggaagctggagagcagcagggaggaggcacgctctcccccgctctgtccttccctccactgcctttcccccaggggtcatagcccacacccactatcacctgtagcttaggcctctctctcctctgagccgctgacacttgtggccagcttgttacccagcagttctacctgatgtcccgccaccctcttcacactgaacgacggaaagggagcccattgctaccccgcatcatcaactcccgtcctgctgtgggtccccctttctttctttttaactgtctctaccgtctgtctccactgtctgtcccactgccaccagcttggctcaggccctcatgatttgtcacctgtattagcacaatcccctcctttgaagacacagtccctgcctgcagcccagcccctcacaatgatccatgttctggtgagctgcctacagccttgctactgcacgtggggtgcccagaccggctgcttcagcatcgcctggaaatgtgtcagaaatgaagaatcaccgcccccgtgttctcgatcagtgagggtcctgtctgaagatggaaagctccattaatgtgaataaggaaaatttgatataacaaatgggcaaatggataaataaattgtatccattcatgcaaaggaaacttattcgggaaacaatatgaatgactcccaagggcattatgccaaatgaaacgctcaagtctcaaaaggttgtaggcagcatgattctatttataggacattctagaaaaggcaaaactttaggaccaagttcagtgatttccagtggctaggaggagggggaggattttattacaaagggacaacatgaaggaattttggggggtgtggaagtgctgtgtaccttcatttttaggttgggtacacttgtctacacttatattaaaactcatggaactgtacaccaaagaaagccaagtggactgcaggaagattaagaataaataaataaagtaatgcattataaaccattgacttaaatcagaaaccataagttcatattgatagaactaagtaaatataaaatatcttcccccaaacactacaaagcggggaaatattaactttatagtggagaagcctggtcaacccactttaatagagtgactaaaggtaacatcatcagtaatgtactaaggagaatcatttgccatctggtgagatgcaacgtgaagatcacagtcagggccagcttcatggacttctgcaatagcacagggctcagtgctcagaaggggcatacgtttggtttaatgctctgttgtcagtttgaaagtcttagtaattgtttaatgaggggtccatctacattttcattttgcagtcatccctgcgtgtaatgtagctggttctgaacacagtatcctttctgtgattttcctgccacagatgtataacctgaatttgatcatggtgaaacatcagacaaagccaaatgaatggacattttacaaaaccagttgcttggtcccttcccaagtgtcaaagtcacaaaagtcaatgcaagatggaggagctgtttcatgttggagaatgctaaggtaacatgacaagtaattgcaatgcaggtttctgtattgggtcctttggcaacaaaaagtgttgttgggacaactcatgaaacttgactgaggtctgaagatgagatagcaggaatgtaccagagtcagctttcctattctgatggttgaattgtgattgtacaggagaatgtctttgtttgtagaacttccaaacttaaatatttaagggtgatggggcatcatgtggatgtctaacactgaaatagttcagggcagaaattctttgtgttctctttgtaagttctcatgaagttt

SEQ ID NO: 477190 - DNA, 977 bp, Homo sapiens
gagaaaaatcttccctctttgggagataaagccctggcagcaagaactgaaggaggcggtcatgtgctgagtgaggcgggtgaccagcttggaagccagggcgggaagttcgcatggccctctgggtgaatcctttgcttccctgctttggaagacagctggctgcagagcaagagttctcttgtgtgaggcccatggcagtcattgctctcttccttccatttcggcttcatttcaaggctccacatgatgccaagagggctgctggttactccaggtctactacctcccagatgctagtgcaaggaaaaagaggaagatggcctctaacagtggcagctaaaggctatgaaaaatcactgactcagttgctggcctccttgtacagatctactttctggactcatgtacccacacaagcctgcctttggaatggtagagagttgactgtgctatcatgtttgaatcttcagggaaggtctattcggctggccatgagacatgagaaaggctgcctttacctttgcgacatcataatcttctcatctgcgctcaggtctgtgcacgtgggggagaccttccctggccttcctcagaaccatcatgtctgcagcatccccagggctacaagacagcaaggaagtgaggaagagcaagcaacaacctggtgctaaacaaatatcagcttacaagtgacttgtctcaggaataattcttgcacctgtagagcagacagcccatatcaggaccagtgactggggaataaacaccctgaaaggcagtcgtaggacttactgacagctctactgtgtccacagctgatgtccaccttagagaaaaaactaggtgctgatgtccatagcttttagtcacaaacagaaaagaagcccacctctcgcttttctgtttcaaagagcaaaattctgcaaacacagttgagggtcagtgtttggggcaatgcctagtgaggggtgagc

SEQ ID NO: 477191 - DNA, 1014 bp, Homo sapiens
cccagaaagatccaatggacaaagcttcatcaagcccttatcatgcctggcattgaggatgtaacaaagaacaagggagacccctgttctcaaggagctcccatccctcccctctctgcctccctgtgtgagaaagaatatcacattctcttcctgttccttctaccaaatacccaccgggaacaaatagaaaagacccccaccaataaaaactggccaaacaagcatactcaagtcaaagcagccctggttgaggtgtcctcaggcacatttctacacggttgtcaaccatgcctatgtaacgtcaatcatgcctatcggaagcctccagaaaaacccaaaaggacaaggtgtttccctgagtcctgtgagctgctccagcaagttaatcaaatcctaagagggggctatgagaacgccaacttgaagacagtagatcagaagttccagaggcctgctcatgtcacagatgtgtgaagtgggggcagtcttggggactgagtgagccctcaacctgtggaatctgacactatttccagcctcgtacaaaaggatatgaaaagcatgtaagaatgggttgcagcatctttgctgcagggatttggtcttaaggctgtggggtcagtggcttagctccagcctgaacaagaaagaaagagatcaactaatagctcaacagggtttaacctgggcttactgagaagaatcaaattttttttaaagaaaataaaattgtaatatgagccagtcatacattcatattcatcaacatatggaaagtgtgactccaaagaaaggtttggggaaagaacatcacaatacaagaataattaagatcagatcccctattcattgcatatgtgtatggtatatgtgcctgtgtatgtgtatgtatatgtatatgtatatgtatatgtatatgtatatgtataagtatatgattgatatggttttggcctgtgtccccacccaaatctcatgttcattgttggaaatgggcctggtgggaagtga

SEQ ID NO: 477192 - DNA, 1329 bp, Homo sapiens
cccgtgtgccggcaatgtgacatagtgttctttatgttcatatgttctttatgtccttatgtgagaccctgagggccaatgggtggaggccagtgggtcgaggggctggcagagcttggtggagtgttctgtcatcctccactgtgatcgagcacagggagaaatgcccttccctcactctgcctgccactttgtcacctggcttggaagcaaagcctcacacggaaaccaccccctcagcttctctctctttcaagggctcagatgaggaaggcggcagaccccatctgatcctcttgtgttttctctctcttcctacagatacccctctacaagctgtcttcctcacgggcatcctgtcctcaagaaaatctaacactctaaaagattcccacagtccattggcccatcaggtcatctggcaggaggattttgatctcattctgggcttatcctgaaaacctgctcaatgcataacacagtttggatatgcctgtagggtcttttaagttggccactccctgcccctgccgcaggtctgccttatgggaagtcctaatagatttttttttccagtatacttttctcacgtctaagaattctaatttgaatattcacaaacgtctcttggtccctgataaaaatcaattaaaagaagctggtagtaaggaaggcaaaagacaggcaaagggagggtagggcagagagagtagcttttgcaacctggttgtgtccatctgctgaggtggtcataacaaagtatcccaggctgggggacttaaagaacagaaacttatttccacgccgtctggagattgaaagtgtgagatcaaggagttgtgagggttggtttcttctgaggcctctctccttggcttgtagaagggggtcttctttctgtgtcttcacctggtcattcttcacctggtcatccctctggatagtatctgtgtcgtcatctccttttttaaaaaaacaaaataaggatactagtcatattggattagggctcacccatagcgcctcactctactgtaattacgtctttaaataaactatcttcaaagttacattctgaattatattctgaggtactaggggttaggatttcaaagtatgaattgaggagcgcacaactcagtcataatgttggccctgggggagtcaaaagaagacaagaaataaatggaaagccaatcttcagataaactaatcagtgctaatggatgttaatgatttaaggggtttacctctcaaagggatttgaattttaataggtaaattccatttcttagttcaaaaaatatcgagtgtccagtgcctgtcaga

SEQ ID NO: 477193 - DNA, 1604 bp, Homo sapiens
gaagtcccacccttcttgcgatcgaggccagcaacattggtgttcatgatgtcagccaaggatggaagctccaaatcgctcactgcccagacttacctgaggcactacagtcacactacaatctacagtcatactatcatcttcagtcacactaccatctacagtcgcactgccatctacagccacactgccacctacaaccacactgtcatttacacccactgccacctaagtcacactaccatctacagctacactgccatcttcagtctcactgccatctacagccacactgccatctacagccacactgccacctacagccacactgccatctacagctgcactgccatctacagccacactgccacctacagccacactgccatctacggccacactgtcatttacacccactgccacctaagtcacactaccatctacagctacactgccatcttcagtctcactaccatctacagtcgcactgccatctacagccacactgccacctacagccaactgccatctgcagccacactgccatctacagccacactgccatctacagccacactctacactaccatcttcagtctcactgccatctacagccacactgccacctatggttgcactgccacccacagccacactgccgtctacggccacactgccatctacagccacattgccacccacggccacactgccacccacggccacactgctgtctacagccgcactgccatctacagtcgcactgccacctacagtcgcactgccacccacggccacactgccacccacggccacactgccatctacagccacactgccatctacggtcacactgccacctacggttgtactgccacccacggccacactgccacccacggccacactgccatctacagccacactgccatctacagccacactgccatctacggccacgctgccatctacagccacgctgccacctacagccacactgccacctacggttgcactgccacccacagccacactgccgtctacggccgcactgctgtctacagccgcactgctgtctacagccgcactgccatctatagtcgcactaccacctacagtcgaacagccatctacagccacactgccatctacagtcgcactgccacttacagccgcactgccatctacagtggcgctaacatctacattcacgcggccatctacagtcacactaccatctacagccgcgctgccacctacagctgcactgccatcgttatcacgtggggagggactgcaaggccacccagtgctctcccaccacacttcacattttccttccttcacatgcctcgttcttgcatgaatgaagttttcacactgcatctctacttcaagagaaacaaagaaaaacagtctcactaaacaaaatcaccaacttccctggctgagagctcagagcacttaggatctaaatagaagactgttccatggttgctgttcaacagtgacatgtacctgacactaccctacttcgggaggtcagggtccaaggtaaaccagagaggaatctaattaagacttgttaatcagtgaataatcaa

SEQ ID NO: 477194 - DNA, 1985 bp, Homo sapiens
caggggagttacatccagatgtagctgacaggtcagggccccttctcctccaccatgtctcagggttatcttttccaaatggaggaagtcaagggtccagaaggcacagctgtgctcagggtgcctgtgttttgtgaactaactcaacaacggacagcgcgagatacacagagccacactgtggctgggagcctggccgccgtcttcctgatccctggggccgatggccagaagggctttcttaccaggtgcttcccaggagcctgggaggaggtgacgctgagcacagacaccacatcctgcagccgtccttggtcccgtctcagcaggcattcccaacagagaccccaccgagagctgctgggaaggcaaggagatgtgggtcatcgtcatcagctaaatggagggtggcattctgcttctaccatccagccagtgccacagatcaaagagaaataagctcggcaattttcctgccatcattttgttttgagataaggaaattatccacaatccaattatgagctgaaatctaaaaatggaaacgctctgtgtgagtcagcatcagatgtacaattgggatgtgttcgcacagccgcttcattccggcctgagaacaagagcactttgtttcctgtttgctaaggaggtcaaggtcccctggccgtctgcgtgtgggtttccctgtctcagacaactgtgctgtgaaagtttcttcagtgcatgatactggcccccctcctgcctctggacagaagcctgtcattattgtcaccggctctgccctgcacagggagctgggaaggaccagcctcctggcatctgtgtgtgatggtgcccggcacatctgtttcctgccccagtgcacctcaccggcctgggcacagaactgctaaacgtgactcaggaaaaggaactttcccacatcgcttcacttcattgattttcaacagcaggaaaaattttgctcactggtctggcaaataaataagtggttatatctgagcgtgtctgtgtgtgtgtgcaggtgggtatacagcatgtgtgtgcacatgtgtatacgtttgtgtgtgcttatgtttatatttgtgtatttgtgtgcatgtgtgcatgcatttgtgtgtgcacacatctgtatatacatttgcgtgttcacgtgtgtgtatatttgtaagtgtgcatgtttatatttgtatgtgcatgcatttctgtgcatgtttatatgtgtgcacgtgtgtatgcatttgtgtgtgcatgtttatatttgtgtgtgagcatgtgtatatgcatttctgtgagcgtgtgtgtgcacatgtttgtgaatgtgtgtggatgcatttgtttgtgcatatatgtgcatacagttgtgtgtatatttgtttgcacatgtgtgtatttgtaggtgtacatatgtgaatacatttgtgcatgcacatatgtgtatgcatttatatgtatttatgtgtacatatgtgtatacgttttgtgtgtgcatgtgtatttgtgtgtgcaaatgtgtgtatacatttgtgtgtgcatgtgtgtacatgtttgtgcacatgtgtgttaaaatctgtgtgggcacatgtgtatatgcatttgtgggtatttgtgtataattctaagcgtgtgtgagcatgtgtgtgtgcatgtgtgtatatttgtgtgtgtatacatttgtgtatgtgtatttgtgtgattgcatgagcatatgtgtgagcatgtgtatgagggtgtgtgtgcttgtgtgtatatttgtgtgtgcatgtgtatatatttgtgtgtttgtgcacatttgtgtgaatttgtgtgtatattcatgcatgtgtgtagacgtttatgtgtttgcatgtgtgtatatttgtgtgattgtgtgtgtgtgtgtgtgtgtgtgtacacccatcttgtcctttgtcccccactcgaggacagagtgtggctgtggcctccattctgaccctgctgcctgctggctgccctgggac

SEQ ID NO: 477195 - DNA, 936 bp, Homo sapiens
gttctttaaggaaatgcacgtggtgctgctccagccgtcaggcttgtgcgtgttctctgcggctggcgcctcccgcgtgccgtcctgtggcctcgccctcctcctactgctgctcggcagctgggggcttctctccaggaactgggaggagtctctccggaactgggaggagtctctccggagctgggaggagtctctccggaactgggaggagtctctccggaactgggaggagtctctccggaactgggaggagtctctccagaactgggaggagttgctccggaactgggaggtgtctctccagaactgggaggagtctctccagagctttgaggagtctctccggagctgggaggagtctctccggaactgggaggagtctctccggagctgggaggagtctctccggaactgggagaaaaacaagttaattgtaaagcagctgcaggcaggtcctgtgggaggtgtccagaagaaggcattgtcatcacaggaggtgacggctctgtgcgtgtcattgcccctgcagaccttccagtgggaccagatgttggggggaagacagtgacaccgaggaccctgaccctgtgtgggcctaggccactgtgtgtttgcctctttgtttttaacagaaacattttaaaagttaaaaaaaaaaatgaaaaaatagaaaaaagcttatagaatgagaatataaagaaagaaaataattttgtacagctgtataatgtgtttgtgttttaagcaaagtgttataaaagagtcaaaaagttaaaaaaatttaagtttataacataaaaaagttacagtaatctaaggttaatctactatttcgaaaagaaaactattttgcataaatttaatatatcctaagtgtacagtgtttataaagcctgcagtagttatggtcacgacctgggccttcagattcac

SEQ ID NO: 477196 - DNA, 1200 bp, Homo sapiens
gatcgggttggatggtgaaggagaagccccagagctgcccgcagagctgcgggatcgaggccgccatggccggcttcatctggctacggcgagtccgctggtgggtggaaggtgtccgagttactggcagcgaatccgcacgggtccgcagcaacctcaattcttgcctccttagaagaaataattcgaaggaggggcataaggcagaaaaagaccgaggcaagtttcagagcaggagtggaagtttattacaaagccttagagcaggaaagaaagtacattcggaagagatccaagcaggattttatacgctggtccacctccggcgttctgagcccctttcccgtgactcttccctgagggtgggctgcccgcctgcgcagaaccctcctcacgcttgggaagtgagcgtgcgcagtgggctagaagtgggacgcatgcccatccgaggccttcttccctcttccgtgtgtcgctgttgagatttgcatttccctgatgacacgtgaggttgaacatcttttcatttgcttattagccatctgtatatctcctctagcgaggtacttgttaaggtctttggcccattttttaatcgaggtgtttattttcttattgttgagttttaaacgtttttgtacattttggataacagtcctttattaaatatgtctctgcaattattatttttttcagcctctggcttaccttttcattttcttcacagtgtcttttgcagaccagaagtttttgaatcacgtccagtttatcaattatttctttcataaatcatggatttgatgtatctaaaagtcattgccaaacccaaggtcatctaggttttcttctatgttaccttctaggagttgtgtagttttttgcattttacagttatgtctatgatccactttgagttaatgtttgtgaatggtgtgagatctgtgtttagattcattcgttgaaggatgttcagttgttccagcattgtttactgaaaagattagctttgcttcattttattgcctttgttcttttgtcaaagaccagttggctgtatttgtgtggatatattttcagactctattctgtcccattgatctatttgtctctctcatatatatatatatatatatatatatatatatatatatatatagccaataccagagtgttcttagagtaagatgtagctttagagta

SEQ ID NO: 477197 - DNA, 585 bp, Homo sapiens
ggcaattcccagatgaagatggagtcagcactctggcagggtggactggggtgggctggatgacatgttcgaaacctgcaggcagacacgtgcattttcaaaagctgcccaagagatgtttcacggccctcgcctcccagcctgcctcgcctcgggctttggggatgccgacacgcaggtgcagcttctgagagacagagggacctgttcggtgtgggggatggcctggggctcaggtgccatttcaggcgtcaggggcaaaggcgaggaacagtgcctgtctgcagaaatatttccccacggaccccatggacatgtaagagtgggctcctccccatcctccacactgctcgtcggctttgggaacggaaatcacgtcaaggcccagcccaacaaagaccctgaagtcaggaaagccttccctgtggagactacctgtctgtctgcttcagatcagtttaccccaggtccagacagggtcattctggtactaaggggcatggaatgacccagatggtcccactccattcctggcacccacccaccccacctcaccccaccccacccacatacagataaagttgt

SEQ ID NO: 477198 - DNA, 876 bp, Homo sapiens
aagagacagcgggaatggaacagtctggagcaagccagggtggacatgctgcagagacagtctcctgtttataactgctccttcaggtatacagggaatggaattaaaggtgccagagacgtgggtccctacagctatcttggacctgcaccgaacactggatcatgtcaacaagcagccggcaagttccggggaatctcggatgcgaaggccccggaagaagactctaatccttgtggaaggaacatacggcatgaggagtgtattgttgaccttcctgaagtggttgccctcaagaagaaacccgaggcatccttgcatctggatgaggctcacagcacgggggcccgggccctgcagctgagctgctgtggaatacctcagcctggatccgaggatgcggacgttatgatgggagcatccgcaaagagctcccgtgcttcaggaggacacattgaaggcaaggaggagcagacggactctccgtggacaccttctctcagtgcgacgcacgccaccctgctgtcaccacctgtagtgcagcgatccctctatggagtgtgtcatggagcaggatggcacggccctggagacgcacttctcacctatggcaacaaagattctctgacgctctgcgggatgccaaaattggtgcctttggaccagctgctggagcagaacctcgtttataggtgaagacttgaggtctcggggctttaagcatctggtacaggcaggttagtctgacttcaaagaacctgcgccaacgaactgaaagatgttgtttctgcccatttctagttagggcatgggcaagcgtatggcagaaggacgctatcagcctccatgggaaagcactccatgagccgttgtggg

SEQ ID NO: 477199 - DNA, 723 bp, Homo sapiens
cagactgccctttgctctccagccttagggatgaatggcagccatgtctatactcagctcatttgttcttttctcctcgtcctccttgggccaggggcctcggaactcagggctggcagagcctcagagctggtgcttttgctggagaggaagtggggctcaggggtctgctctaaatgtggttacttgtaggagtcaggactgccgtcctcatggtctgcagagtcctggcaggtggggcaacatcgctctggaagtcccggagcagggacgaaccaggtacaaaaagccacacactgtctacttccatgtgcatgaaagtccagaacaggcaaatccagagggagagaaagtcaggcagtggctgccaggggctggaggatggaaaggaactgccaaggagaatgcagtttctcctgggagactggaaattttcaggagtcagggagcggtgatggttgcacaatctcgtgaatgtactagtaccactgaattatacactttaaataggtaaatttaggtgtcggagaaaaataatttccatgagaaacttcttatgtagaatacattaggtatgtataaacagtgtcagtgtaattgtgtgaagaaaatatgtcatttctgccaaatttttataaagtttcaacatgttttaatttaagttgtctaattttgattgtctactcaatttagactaatttatagtctgaaatgactgtattc

SEQ ID NO: 477200 - DNA, 568 bp, Homo sapiens
ggacagctctgcaggaccgtttcaaaatatggcaaagaaacatgcttttgggctcatcttgacagaagccccactcttggtggttgtggccaaggagacagggctcgctctcccctcagctcccacccgagggtccccttatctcaccaggagggacagatgccagcatttctcaccccagcacccagttgaagaggctaaattcctggtgagcatgacggacagcccccttcctccagccagtccctactcatcggatggggctctagcccaagaacagcgggctaagaaggctgggatccagttgctgtgcccagctccactgagcaatgaattggtctgtgagggctgccagaacaaagcaccacagactgggggcttaaacaacagaaatttctccctcacagttctgaggcggaagcgtctgagctcaaggcgttggcaggtttgatttcctcctcttgtaaggacaccagtcacattggaatacggcccacccccatggactcattttaacttaatcacctctttaaagggcctatcttcaaatagaatcatgttctaatac

SEQ ID NO: 477201 - DNA, 701 bp, Homo sapiens
tgaggttttctctttggttattaagagtcatgctgccaggacgttcacgtacaagctttgtggagaagtgttttcaatctcgtgagactcattcactatcacgagaacagcatgggaaagatatctgctcccatgattcaattaccgcccaccaggtccctcccgcaacagtgggaatccaagatgagatttgggtggggaaacagccaaaccgtatcaactgccctctgacttccatcattgctgaggagaagacagccatcagtccttttgggttctcttgtacacggcaactcgttcccactttctgctttcaagattttcatgttggcttcaaacatttgtactatgacatgtgtgagtgtgaatctctttgtatttatcctacttttgggattcattgaacttctttgagagattcacatttttaagcaaatttgggaagttttcagcaattatttctctgaatgtttttctgcccctttatctctcttctctccttttgctttcattatgcatatgctggggggcttaaagggttcacatatttctctgaggttctattcctttttttcaatctatttttatctccgtttttaagataacataatttctaccaacctatcttaaagtttgctgacttttcagttcaaatctactcatgagccctgccagatgttttttggcatttcagttatttt

SEQ ID NO: 477202 - DNA, 1083 bp, Homo sapiens
acattttcctggaactcatctcatctgggcggattcctgggcactgatgctgttggagggtggataaatctccatgacggtgcttcgggattgacagtgatgtatgtgttgttaggcccgagggctctctgtgcacatggcttagaacatctggacggtacatgcatcaagcatctgggcttctgagcaaggcatacctcctggtcacaaggtggctgcagcctgctgaccaccatgtcggcagccacccttccccatcacctttgccactgccccgccctgtgcccgtggccttgcttttcctctgcccgggatgtcctttaatgcaattgcagctgccatggacggctcctacgaggcaagaactgcaacacagcgtgtgcaccagggggatgcgagatgcagcaacacagggtgtgcaccggggggatgcgagatgcagcaacgcagcgtgtgcaccgggggatgggagatgcagcaacacagcgtgtgcaccgggggatgtgagatgcagcaacacagcgtgtgcaccgggggttgggagatgcagcaacacagcgttaaggagcggaaggtggtgcgctacagaaaatccccaaagctcactgaaactggaggccccgccacccatgactgttgtcaggggcctggacaagggaagctactaagtcccccagttaccattgcactggcccaccatgcaaaccctgcagttaccatcaaactggcctgctatgaaaaatccccagttaccatcgcactggcccgacatgcaaatcccccagaaaccatccagctggcctgccatgcaaatcccccagtgaccatgcactggccggccatgctgtcccatccttctgccttgtgcatgcccacactcgcctgctgtgactttttcagccacagaacgaagttctcaagagaaaccacattcactgccgtctaatccacgagcacacgtgtcatttcattgttgtaggttcacccctgcagatgatcagcttaacactttgctgaaaggccctgttttacgtacatatcaatggtgcctctgtggaaacaagtctaaaatatttgtaagaa

SEQ ID NO: 477203 - DNA, 998 bp, Homo sapiens
tgatgtaaatgccatggctggttccaggcaggggcactcatcctttttctccagcttctatcgaatggatgaagacacaacgcggctgtgagagggggcagaagtcacagctcaaatgatgggcatcccattttccaaaccactggggtgggaagtcaacgaggcagctcagcaggtgcctcggggagaaagaaccggctggcgtggctccgtcggggctcttcaggcatttggactttgcagtggcatctcccatgggggaagccaacgcgatcccactcacaatgggcctgagggggtgctgcccatccggattcacctgtcctccagggtccacgaggggctctcagagctttcatcctcagatccccggatccgtgctgcccatcacggattcacctgtcctccagggcccacgaggggctctcagagctttcatcctcagatccccggatccgtgctgcccatcacggattcatctgtcctccagggcccacgaggggctctcagagatttcatcctcagatccccggatccaggcggtggctctgtctggggaggggctgactgcagagagaaccccctcgccatggagctgcagcctccaagatccgggccctcacccagccccaggctgatcctcggtccccctgggcatgaggacccacatcaggtccccggccaccccagaaccacaaggaaacctccagaaccccagcaggagggtggcatttacaccttcaggatgaagtccggagaagcctccctgaccctccagatgcccacgcaagtgtagaccccgcccccaccccacacaagtgtagaccccgcccctgccccacgcaagtgtagacaccacacaagtgtagacgccgcccctgccccacgcaagcgtagaccccgcccccgccccacacaagtgtagaccccgcccctgccccacgcaagtgtggaccctcctgctccctgccccctgccccccacgcacgctgtgctac

SEQ ID NO: 477204 - DNA, 3601 bp, Homo sapiens
gccaccaacatcaaagaccaaaggtagataaatccacggagatggggagaaaccagtgcaaaaaggctgaaaacttcaaaaaccagaatacttcttctcctccaaaggatcacacctcctcaccagcaagggaacaaaactggacggagaatgagtgtgatgaattgacagaagtaggcttcaggaggtgggtaatagcaaactcctccaagctaaaggggcatgttctaaggcaatgcaaggaagctaagaaccttgaaaaaagggatgggaagtcgctcccacagaaatccaggggagcttgcattggctatgacagtgtgatgggaacccacgtttccacagcgcagttccgctgcaaggactgtgggttggttcgtggtctgggagatgggagctcccgccagaatacagactctggaatccaggaattcccatcctgagcaataacaaaatcaccccaaaaaagaaggtggcttcaccatgccttcccttggaaaaggcattttgctgacaaatgtgtgttttttagttttccctcaatacctcactgctctaaatcatcataaagaattttaattgctgtcaataagtagttttgaacatggcttcccagaatgactgtgtattttgacaagtttcaaaaaaatgccttaccctttctgaccttaattttttctctactcttaataccttaaaaatagctatagttttattactattatatcagtagttctgttatttatcatcagatcaaaagcaaatgttctttgggaagaagtccttgatgcatttattaagtgaaaaacttactttacaatagtttcatcatccagttcctcatttgtaagtatgcgcatgcttcagtgtttgagtattagtacctagagcaaaatgggagctgctgtgtcttctctggctagtgagaccacagaggttttccttttccttccttctctccctttccattctcttctcctccttctccttctccccctttccattctcttctcctccttctccttctccccctccttctttgcttacctgtactttctaaatcttctacaatgattacatattcttctgtaataataaaaaatcaaactgaagagaatgtttacgctgaattgaaaaatagaaaaagagaatcaaaatatccgggactttaaggaagtggcgtttttcttttaatcatgtaccttttctcattctttctgttgatcatcatcatcttaatgttttgtagttataactatttaattgttcaatctcttagcaaacttacaaaactagattgcacctcaagtgacaaagcatgacctaaattctttgaattctctttcaatcttttgtggacaaaattgagagagcaaattaaatggacactcagggttctggagcattgccttcccatcaaacactttatagtaggcattcgatctttcaatatcaccaaaggttttgccctttatgacctgacataagacttcccaaactctcatactaagagtttttaaggatttagggagggagagtttatcagaggcttgggctgcttctgtgtttctttgttgtgcttctttgggagggagagttgtgcctttctgcagctgcaggcatacaaccccccaccccacccctgagtatgcctttagcttccctatcttagtgcaccggaagggaaagcaacgtgcttattaaggcccactgttttactggggcccattgtatgagggtgaagtttggccgttacccaagagactttcccccacctcccttggtgccagagctgtcttatctgtgttttactgtctgctctttctggctgcttgtagttagaagagaagtgatttccttgaaatgcaggaggctggaaagggaactggaactaaaaggggcagggcttgtccgagatgatggtgcttctcctgctctgacactcggaaatagcaacttgaggtgaaatgacataaaacaaaaccaatttgccatcggttaattgacagaaacaagagttacattcctacaacgtatttctggccaaaaaacattatcaccatacctcgaaacaaagaccaaaacactcctcatatgaaacatggaaataagtgtgagctatacagacatttaagaaagattgagaaaaacaagtaggacaatgatttccctctgactccaggccagggtgatgggtggctggagcctgtgcacatctgtgggatgtgggaggaacccggagagccctgagctccacccagagagtggccccggtggcaattcgatttttttcacatcaacgttacaccaaaatgacattgaacaaaatgacatcatctgaggacctgctgcatctacactgcaggccatggatgggccttctgggtctccctagtccagctctgttcccacaagcagcacgatgaccaattcctaacatcgcgtcaggaagcacaagtttccaaacataaggaaaagctgtgtttccctctctcccccaggggctgtgaaggacatgaacggccaagctgaaaagcaccaatcaggagcagtgtgcccctgttgtgataatacaagttaggcatgtaagtcacaggatatcagggagatgattaaatgccactaaaggactttgcctcctcttctggggagggagtttgtgcatacttggttgcatgtaggatggttgtaccattttaggcaaaagtgtagccttattattgtttttacctggagattgggcatggtgtaaggaaatgtgtctggtgccaagttgacatgggatggacttgtgacagttaattttatgtgttaacttggagggtgattttgcttattgaatatgtatatttggccaccttgctcaatcaatccctgtcttattcttcccaccttctacatgtctgtttctagcttctgactggaggctaccctttccaagtggtcagaatggccacctacaggctacagccctttatgagaaataaagctttcctttccaaacacaatttccacatccctggatgacccacgcagattagcacgctctcaggttagtaaccccagggaaagacgattcttttttaatctagaaaacgtctgtttaaagaattcttaattctgccaggatcacaagtttacctgtcggggtgatctatacagttgtggaggactcttccatgatagacgaaggtctaaacatggcggtggttttagggcgttgtgcttgttgagggggcgacggaaatggtgaggaaaagagttcattcaacacagcgagtttgtgtcactcagaatcatggtgaggacctgcaggcatgcacgtggacgctgacccatggagggaattggtgttctctgaccatcccttcagtgcagaacatcagtcacaatttaagttctgtttaggtaaacaaatgaccttttcctatggggcattttcattttataagggacatacctaaagaagatagcatccatggtgcatggagcatgtgcctcaccaggcatcaccatacccaccacagctcatgcgtgcggatgcctttgctacccaggacggccatacaaggaagccattgggtcagtcctgtgcacaaac

SEQ ID NO: 477205 - DNA, 850 bp, Homo sapiens
tcccccaaagcccagggcagccccacgttgagcgcagaccatcctggcgccatggattttcttagaactgccgttccacgccgggtgagtccccggggctctggaaccgtggattttctgggatttgccgttccacgccgggtgagtccccggggctctggaaccgtggattttctgggatttgccgttccacgcccggtgagtccccggggctctggaaccgtggattttctcggaattgccgttccacgcccggtgagtcccggaggctccggaacacggtttctaacgcgcaggctgatgatttctaacactcacgtgcgtggccccacggatccgccggtgcccttggcggcctcttcaccccccggggctctggggagcctcgctcctctgcagttctctgttaacacctttccgcttctgaggagcttcacacggagaatacggcgattttctgacctaatcgcaccccctccgcggccgcagcgcgcgaccccgagctcacacgcgggcatcgccgagtcacacgtgggcatcccgggcctcacacgcagcccctcttccaggacgttctgcctccccgcacctggccgggaccctcaggctcagccctggggatgcctccccgacggctcctgtggctccgtgccccgcgcgcccctggatcacctggagttgtccccaccgtgttccctgctgcagtgagtcccatgcaggggtggtgtcttctcttacgtgggcaggtgcatctgggacaatcagcaaccattctcttctcagaggaaagaggagaggttcagctctcctctgcttcagcttcgaggttttaagactttaaattgtcttt

SEQ ID NO: 477206 - DNA, 1611 bp, Homo sapiens
gagagtcttggggccgagaggcagcaggtacaatgtttgtgttatggcgtatggacagacgggcagcggaaagagctataccatgctgggacgccattcggacgacggccctgttctgccgcttgacccacagagtgacttaggaattatccctagagtggctgaggagctcttcagcggggacaccacggtggaagggggcgatgtggtgtggcagcacgtcccggacgtcggcttcgcagtgttcccaaaacgagaatcggagcagacacggaccgtgtcctccctcatcacatccacacacgacctggagaggggtgcactgggccagggctgggggctcattttggaaaatacctcaagaagcccaaaggttgaagtctccatagtggaagtttacaataatgacatttttgaccttctggccaaagacagcattgcagcagtgtcgggggtcaagcgtgaggtggtgacagccaaggatggacggacagaggttgcgctgctggcctctgaggctgtcggcagcgcctcgaaactgatggagctcgttcatggaggtctgcagctcagggcgaagcaccccaccctggtgcacgcggattcctccaggtctcacctgataattacggtgactctaaccacagcctcctgctctgacagcactgggcatgcggagcaggtgcaggctcgactacagctcgtggactcggccggcagcgagtgcgttggtgtgtctggagtgaccgggttggccctgagggagatggcgtgcatcagccgcagccttgcggccctggcaggcgtcctgggggctttgttggagcaccgtggccatgccccgtaccggaacagcaggctcacccacctccttcaggactgcctcggggtccgccagagcagctgagggctctctaggctgctgctgcatgtgtggcctgggtccctccggctgtgtagacctgcttaggccccaagttccttgggtcttttgggggcaggtgccagaagcctggacgcaacagattaagcaccagtgccaggtgaggggcgctagtgaccggctgctgaccctcccggacccaggtgaggggtgctagtgaccggctgctgacccttccagagggtgaggggtgctagtgaccggctgctgaccctcccggagggtgaggggtgctagtgaccggctgctgaccctcccggacccaggtgagggatgctagtgaccggctgctgaccctcccggagggtgaggggtgctagtgaccggctgctgaccctcccggacccaggtgagggacgctagtgaccggctgctgaccctcccggacccgggtgaggggtgctagtgaccggctgctgaccctccgggacctgggtgaggggtgctagtgaccggctgctgaccctcccggacccaggaaaggactcagccagtggggctgaaagcagagacatctgcttcaactcatggtttttaatataattgggtagagatgatagacagtagataggtgagatgatggtgagatggtagatgatcagtcagtgaacagatggcagatctgtagatccatggatgataaactcatcagcagatagatcagattt

SEQ ID NO: 477207 - DNA, 607 bp, Homo sapiens
cgggtgtcgggctgggggacggtcaggtctttcccttcccacgaggccatatttcagactatcacatggggagaaaccttggacaatacctggctttcctaggcagaggtccctgtggccttccgcagtttttcagagctcgagcgctgtgcttagagatccgctgctgtcttcagagctggcagacaggaatggttaagtctgctgaagctgtgcccagagctgccccttcccccaggtgctctgtcccagataagcccctgactggggctgctgcctttctttcagagatgccctgcccagagaggaggaatctagagaggcagtctggctacagcggctttcctgagctgcagtgggctctgcccaactcaaacttcttagcagccgcccattccaggggagcaaatggttctgtcttgctggctttccaggagccactggggtatgaaaaaaaattcttgcagctagctcagtgtctccccaaacagccgctcagttttgtgcttgaaacccaggacgttggtggtgtagacacatgagggagtctcctagtctgcagattgtgaagaccgtgggaaaagcatagtatctgggctggaatgca

SEQ ID NO: 477208 - DNA, 689 bp, Homo sapiens
agcagcaaccaggatggaacgagctggaggccattattctaagtgaagaggatgcaaaggcataagaatgatacaatggactctggggacccagggggagcgtgggagcggggcaagggataaaagactacatattggttacagtgaacactgctggagtgatgggtgcaccaaaacctcagagatcaccactaaagaacttttccatgcaaccaaataccacctgttccctcaaaactacatttgggttgtgtccagtttggatttactgtgcataaagctgctatggatgttcttgcacatgtccttttgtggactgcgccactcatttcccatagttagagctaggagcaggatttcgggtcataggataggcatatctttaaatttagtaaatattgctgaagaatttttccagaatggtggaaccactttatattcccagagcaatagtatttttagtgctttgtacaccttaaaatatattagcttcctgaaggtcatgaagataatttataagacaaatttctagaaggaggtagtttggtttgacttggcaaagatatgaggaagcggtaggaagaaaatcgagcttactgtatatgactattttcttttcattctattgactttatttctcagtctctcagttgactgataactgagaggaatgttggtctgaatgatac

SEQ ID NO: 477209 - DNA, 520 bp, Homo sapiens
gactaagacactgcccagaccagccactgcaaaatatcagccttgaggcagagggtaaaactgctagttaccccatcacggccatgaacaaaaatctcttatacatatttttaggcgaccaaatggatgggttgctactgagtgaatgttgggagtacaactgccaagaactaaaactggggccttccatgaagaagactgaagccttggtccaggtctatacatccaaggtgcacgagcaatttgctaagaagagcaggcagacaacatgggtgataactcgggccctaacctttgcgaatgctggttgggctcaggagcagaaaagctggtgccagcaatgttcccatgcatggaagcccctgaaggctgtggcgggttcatcagagtggggaggtgaccctcacggaacacagaaatgcattctcccggggcttgaggaccccacctcgtgtggcctgtccataccagcggtgctgccctgccagccatggcagagccgaggggagctttgctgatc

SEQ ID NO: 477210 - DNA, 1194 bp, Homo sapiens
cacatcaacagctgctgaaactacaacacgcagcccccacacttagggctctttagccctctgctttcccaggtcacctttctcctatccatggctaaaagggtccaaggcatagcttaggccatgacttcagagggtgcaagccccaagccttggcagtttccacatggtgttgaacctgagggtgcacagaagtcaagaattgaggtttgggaacctccacctcaatttcagaggatgtatggaaacacctggatgtctaggcagaagtttgctgcagggggaccatcctccagaccccggaatggtagatccaccaacactaccaacaacttgcaccgtgctcctggaaaagccacaaacactcaatgccagcccatgaaagcagctgggaggaagcctgtaccctgcaaagccacaggggtggagctgctcaaggctgtgggagtccacctcctgtatgagtgtgacctggacgtgagacatggagtcaaaggagattattttgtagctttaagatttgactgccccactggatttcagacttgcatggggcctttagcccctttgttttaccggtttcttccatttggaatgaatgtgtttatccaatgcctgtactcctattgtatcttggaagttatccaaatgggcttcccataggaaaggcagtcatactgtaggaggcttttcacttacctttcaagtaatcagcctaagaaacagatattttatattttaagataagttcttgtgcttggtgctgtctttattagttttttactacttagaaaaactaggtcatctctagtacaggtctaagttttttccctctgaactatgtaactttttatatttgcttttgaagtcttttaataatcactctgattaaataattatctcacaatgacatctgattatattttaattaaatgttttaagtttttttaacatctttaacaaacttccccaaaatcaaattctaatttaagtacttttaagcttaaattgactttgggatttttcagttgggccccaaaaaaacatcaaacgatgcatctcccatgatgcttattcgatgggttgtataaaggcactgtcaaataataaagtgacactagctcttactaaaattatatttagatggatgcattattgatgtgaatgctttaacatttataaaatttataaagg

SEQ ID NO: 477211 - DNA, 526 bp, Homo sapiens
tctgtggcacaccggggcaaaccacaggatttgggagcatctgcagggggcaggagggagaaaatgccttttttatgttatcatgctgactctgcaggctcatcctggggcctgcctgagcagccgtgtgggcaccgggactgcagtcctttcccctgcctgccccagccccaccatctcttgcctggaggtcatttggccaccctcttagtgtcaaaggcagaagctatgagaaagaaggataggagagggatgcggaccagttttcaaatccggcaggaggagcaaggtcctggggagcatgtggtggaagctgccagcggggagctttggtggtgccaaatcccctggagagaggaggctgcagccccaggcagcagggagccctggaggaagctgcctctgcagactcgcgggaatgccagctccgggtttcattcctttgttcactgctgcttcccaagtgccagacggagcctggaactcagtggctgctctaaagatactgttgaatgagtaaatgaac

SEQ ID NO: 477212 - DNA, 699 bp, Homo sapiens
tcatggcttctctctgtggcacagctcttgataagtatttggaaaaacccatgggcagaggccacggtcaccacacagaacccacgggcagagaccacggtcaccacacagaacccatgtgcagagcccatactcaccacacagaacccacggacacagcccatgctcacgacacagaacccacaggcagaggtcacgcttaccacacagaactcatggtcagaggccacgctcaccacgcagaacccacaggcagaggccacactcaccaagcagaacccacagtcagagaccatgctcggcacgtggaacccatgggcagaggcctcaccatgcagaacccacgagcagaggccacactaaccatgcagaacctagggaagaggccaggctcaccacgcagaacccacgggaagaggccacactcaccatgcagagccatgtgcagaggccacgctcaccacacagaacccacgctcaccatgcagagccatgggccgactaatcagaagaccagagccagttaggactgttaactgctttattttcactgcccaaaagaaattctctcttttttcttccaactctaattatcaaacaaatactatattatgttttattgaaagatattttgttttaactttaccaaattctgtgcagaagtactggacgccatttccattttcccaatgaagggga

SEQ ID NO: 477213 - DNA, 771 bp, Homo sapiens
cagcgtctgtttccgcttagcaacatgaggacgtttccatcgggaagttggagcacctgggttctcatctgcctctgctcctggctgctccttgactttgcacgaatgaacggaacatctctgcatctgcaccaggttcacactccaaaagacgattatgctgccatccccaccgaggtacagagggtgcaggcagttcacttgagctccgtgactgggagctctggcttgcgagtctgtgttgctcccacctcagtcacagtgctgtctgtgtccccttgttacatttgctccctgctagcctttaagtttgtttttcacaaagttaggaaaagggaaaatggttggggagttctcctttatctgcaaaacaaacagaatgcagaagtattacaggacaagggggtttcaatgacatggctggtgaatggcactgccaggattcaaatccaggctgctggacccagtccggtctgctcagaattgctgtgctgccctccagtacccatgggcaccaggacttgcttagggaataatgaaagcatgaaggttctcaagaatttggattgtagagaaaatcctttgagaaatctccagactgctttccacagtggctaaactaatttatattcccaccaagaatgtatgagtgttccctttctccatagcctcaccagtatctgttgtgttttggtatttttcttacaaaaaaaaaaaacctttttaagttcaggggtacatgtgcagatttattatataggtatatcatat

SEQ ID NO: 477214 - DNA, 538 bp, Homo sapiens
cgggaccctgcgaatgtggtcggctcgtggggcagagctcgcactgcttctggtgccctgcgctcggaatgggcactgcatctgcctgcttctctcatggagggacatcgggttgggacctgccaagggttgggcttccatccgatcgcatctgatagatgggcttgcaaggaatccccgatctcaccccgatctcaatgagagcatccccactctcatctatcctgtggcacagcatcccaggaaagagcaagtccaagctgatttgcaggctctccacgacgggtgcagtagacatgaccagtttatcggcagtcaacgacttttattcccgtatcctttctcccggatcctggtagggttttacgccctgagtgttgttcctctggcagaggcatgtgctgagcatctcacatcgtactcgcagctggccggaacaggaccgtggaagtgtttgacctcaacgccggctgcagtgcagcggtgatagcggaagcccactcacggcctgtccatcaaatctgccaaaataaagtga

SEQ ID NO: 477215 - DNA, 803 bp, Homo sapiens
acaggtgtacgaaataaacactgtgcctcatcgcctaccttagtttaatatcagagcagcacacactgctgatattcagacacctgaagaccagcattggcgctctcagaaatcagcatccaagcagccattgtcacgacggggcagtgaatgccgtgtgctggagccaggaccggaggtggctgctctctgcggcccgggacgggaccctgcgaatgtggtcggctcgtggggcagagctcgcactgcttctggctctccacgacgggtgcagtagacatgaccagtttatcggcagtcaacgacttttattcccgtatcctttctcccggatcctggtagggttttacgccctgagtgttgttcctctggcagaggcatgtgctgagcatctcgtcaagtttatgaagcacgtcacggtcacctgccgacatggcactgtctgggttgtgtctcccatcgtgaagcctgccccagacatcgtactcgcagctggccggaacaggaccgtggaagtgtttgacctcaacgccggctgcagtgcagcggtgatagcggaagcccactcacggcctgtccatcaaatctgccaaaataaagtgactaaccaattttctaatattttcaagagaattattttggaaaatgatatgatgctatttggtgtgattttgtaattttatttcctttcctctctgttcccacttcataatagaagagtttctaaccttttgcatatataaagcttttctctgttaaagggttaaatgtatgtaaatctcttagtatgtgctaagtccatt

SEQ ID NO: 477216 - DNA, 569 bp, Homo sapiens
gactcgtactcgtgtgggtgcatgtttgcagttctgcgcagcctgtgtgcacgttgaggcatctgtgcaggtgccatgcacaggaggtgctcagcgggaagttggagcacctgggttctcatctgcctctgctcctggctgctccttgactttgcacgaatgaacggaacatctctgcatctgcaccagggtcgggaaatgacatggctggtgaatggcactgccaggattcaaatccaggctgctggacccagtccggtctgctcagaattgctgtgctgccctccagtacccatgggcaccaggacttgcttagggaataatgaaagcatgaaggttctcaagaatttggattgtagagaaaagtcactatttttagagttagatgtgatttactcctccttttgcaaacttggaagatggctgtcaatgaataaagaaactggtctcagtgcctgtgaaaacatcgaggaaaaggacagctttaaaaacttgccttctggccaggagcagtggcttatgcctgtaatcccagcactttggggggctgaggcgggtggatcatgagg

SEQ ID NO: 477217 - DNA, 898 bp, Homo sapiens
tgcaactctggtagcagtaccctcggatcactaggggtgatggtgagtggtgccgctgccacttccacactttgattcctggacccctgaatcatggctatggaagaaacagtaccatatattgacactgattcagagcatacacagcattctggaaactttgccccaggcctgcaaagtattgtcacctaccgtaaagttagtgccttggtcagaggcaatgctgtgtggaataccatgatggtggataaggcattccgtgagtccccggatggtagggttggaagaagcattgtgtgcaggacaggcaaacccgtatctgccctttacatcatggaagaagtccaatataatcaacctatcacaagcaccattggatctgctgggtcatgtggcccaaatggcagagcagctgcacagcagcctggacctgttgcagagccttctcctatcctggaccccactcaaagctggcagtgttttgggtcactcaataaacgggcacgagtaacacactgaattctgccagattttcttttacgtattttgcagctctgttcttaagcacatcacttatgattgctatgtgttcttgatgaattggcccttttaatctaacctccatacctttgtagtaagccttattttaaagtatattttctctgatattagtatttaacgttccaaatttcttatgtttacagtttgtgtgatacacctgttgttctattgttgttctttgctttcagcctatctgtgccttatacttttaaattcacttctttaaccaataatatagagttgagtcatgctttttcatagtcttataatttctgccttttaatttaatattatttaacttatgcctatcattttgttatgcatttttcattttccc

SEQ ID NO: 477218 - DNA, 763 bp, Homo sapiens
tgggggagtgagtactgattaatccgtgggtaggcctggaaaaagcaccatttgattggacaaaagaaaactattatcatatggttcccaagcaaagatggccaaataggaacagctccagtctacagctcccagcatgagtgacgcagaagatgaatgatttctgcatttccaactgaggtactgggttcatctcactgaggattgtcagacagtgggtgcaggacagtgggtgcagtgcactgagcatgagccgaagcagggtgaggcattacctcacccgagaaatgcaaggggtcagggaattccctttcctagccaaggaaaggggtgacagacggcacctggaaaatcgggtcactcccaccctgatactgtgcttttctgatagtcttagcaaacggcacaacaggagattatatcctgcacatagctcagagggtcctatgcccacagagcctcgctctttgctagcacagcagtctgagatcaaactgcaaggtggcaacaaaacttccagaggaacgatcaggcagcaacattggctgttcagcaatactcgctgttctgcagcctctgcagctgatacccaggcaaacagggtctggagtggacctccggcaaactccaacaaacctgcagctgagggtcatgactgttagaaggaaaactaacaaacagaaaggacatccacaccaaaaccccatctctaaaggaggaagtctgaacccatagcaaagaagttgaaaaacttgaaaaaaga

SEQ ID NO: 477219 - DNA, 1005 bp, Homo sapiens
atttacacttcttttgtggtggaatgttatcagttaaggtggggcagggcatattcacttcttttgtgattcttcagttacttccggccatctgggcgtatacttggtgcaagtcacaggggatgcgatggcttggcttgggctcgggctcagaggcctgacaaaagggctgcggtttgctgggagttctctccagacccaattcagctgggtccctccttcacctgacgatgtcaccagtggaggcagcagaatatcaaagatggctgcctgctccttcttctggaagctctgtcccaaagggacaccaacctgatgctggcgggaatggtcctgtgcagtctgcagctgagtggccactgagaatctgcacagctctgtgcttgggacccaaggccctggtgccgtgggctcacgaggcagatgtcctgatccatgggttgcacagatccatggaaaaaaacgtggtttcccagattattgagaagggcccatcatgccacacagtagagtgcatgtcatgtctggaagtagaagagaagaggcttgatgaaaaactaagtcagcaccaagaaagacggcatgtttctgtttgcatgaatgattgtgaccctattcatatgcaaaaaagtgggatccattcactaaatagtttttcttaagcaagaacacaagataagagggcccataactcactgtcacgctgtagtcctgacttttctaaatacccctgagtaatggagagtcattttgattcttttcatccttcactgtacaacccaaacttgaatatcccagagcattccataaagaaaaaatgctagagaaacactgaaaatatgtctctaattttgctttaagatgcaaaatggtaaaacagtatagaaaataaggtgtctgtccttgaggaaattacaattcacctgcagacatgaaatactgttacagtgtaagaatactggtgattaggtgaaaaatctagaaactagtacttctgcgttatac

SEQ ID NO: 477220 - DNA, 864 bp, Homo sapiens
aagtattccaccaccgaattgaaaaccttagtccaacgtggaggccagtggttctcaagaaaaggtgattttgtccctcaggggacataatgtctgaaaatcattactttctttcaaaatttttctccaactatgaacagttaactctcatgttcttaagagaatttcttattcatgaaagtaaagctcacctagtctccctaccgacccatctagactgcagtgtgctggagcctgcttgcaccgcttgcaaaaagttattggtaaaatttcaggaatttggcaatgtcacattgacatcagtcaaggtctctgtacccttcaaacggaccctcttttttgctgcagtgttcattcagtttctcctggtttcagcaaaagagcaaagcatatccccaaatggtagaattcaaataggcacaagtacgaagctttggtcttcttgtgcagcagaactcatcctgggagagctggctgggagcaagcaggaggcatgctagagtcagcaccagaaactggtgaaggggagggggcaggacagtggcaagaggatagggcagtaaagggagggggaagcatgtcacacaagggaatgagagtaagtattataattgtatatatatttatatatattttctttcaatttaaaaaaatgtctccatatttatgatcgtattctttccaaaaaattcttaatgtattttatttgttcttttattttcacttgaatttgtcagattttatattctcaaggaaccaactgtttttttttgttgtttgttttctgtgtggttgatttctgctttatcttcagtcctttaaagaaattttttgatttatctaaacagaaagaaaaaagctggc

SEQ ID NO: 477221 - DNA, 516 bp, Homo sapiens
tgcaatacggttatctgggttactagcagcgagtgtgtacagggtgggctgcctgcatgcgcaatgccttccttgcacttgggaggtcttaaacattcctcaggatggtcttctgtaagcttccgcaaccccacttgtcaatgtaacttgaaatttgttctttgtgccctttgcaagaaaccgtacctggagaacagccttaggggagattttttggctgcaggatatcagagttctttccataaacctgtggctggagttgctgcaattcctgcagggaggaccctcctgtccaaactgcccagtcttcctgataccagcagagaaaaatggctgattggagccacagtgatggcggccacccctctgcctgggaactcagtagccttagacagtgtccagcctgctgctgctggctgcagcccaagcaggttgcacagctctgtgcttgagacccaaggccctggtggggtgggctaacgaggggatttcctggtccgtaggatgcacagatcc

SEQ ID NO: 477222 - DNA, 1038 bp, Homo sapiens
agcgacactccaaagatcctgatttaccatcaagtcattgtgtcacttcctatggaccctatgtgatggttaatattgattgtcaacttgattggattgaaggatgcaaagtattgttcctgggtgtgtctgctagaataaagcaggcagaagaaggtaaaggagcagacttgctgagtcctccggccttcatctttctcctgtgctggatgcttcccgccctcgaacatcagattccaagttcttcagcttttggactcttggactctggacttacgccagtgatttgccagggactctcaggcctggcaagactctcaggcagaccgaaggctgcagaggacaaaggagcacatgctcaaaaagaagtagattgggagtgcctgcggacccagagactgaccatcaaagaagatttattttacaccttctggcacatgaataacggatcaataagtctagagcagttactacttctcactcactatgtccatcaacataatgtcatcaatgtaatggatgagtgtgatatattgtggaagggaaaggcaataaagatccttgcaaactaaattatggcatagggctgaaaagggctgagggaggatggtgaagtgtactgctggccttgtaagctcaaaccaataattttggtgggccttatggacagatatggagaaaaagtgattttccatatcaatagctacataccaggtgaagtgtgttttttgtaggcaacagattgttaagtctttttgtttttttaaaataatccattcagccactctatgtcttttgattgtgaaggtgattttctctggaggtatgatttcatttattgctttttatatatcctgtgattggttcccagttccttattaagtttgcttgctaaggttgtgttttcctggatggtcttgatgcttgttgatgttcaccagtgtctgcgccttaaaaagttaggtatttattatagtcttcactgtccaggcttgtttgtacctgttcttggaaaggctttccaggtattcagaagga

SEQ ID NO: 477223 - DNA, 628 bp, Homo sapiens
gcttcaggggcaaggttctcatggagaacctctgctagggcaatgcagaagggaaatgtgggttcagagcccccacacagagtccctactggggaactgcctagtagagcaactgtctccagaccaccgtcctccagaccccagaatggtagatccactgacagtttgtaccatgcacttggaaaagccacagacactcaatgccagcccatgaaggcagctcgaagagagactgtaccctgcaaagccacaggggtggagctgcccaagaccattggaaaccagcttttacatcagtgtgacctggatatgagatgtggagtcaaaggagattattttggagctttaagatttgactgcccctctggatttctgacttgcatggggcctttcccagagattaccactactgatatgttagaatggaagaaaggcaagaagcaagatggcagaatagaaggccccagattgtgccccactatgggaaaaccaaattcaacaactagctagataaaaatagcaacttcataagaatcaaaaatcagatgagcactaacagtacctgcctttaactttatattgctgagaaaggcactgaatagggtagaaaagaccgtattgaattgct

SEQ ID NO: 477224 - DNA, 500 bp, Homo sapiens
tcatcagacttaaggaaaggcacgagccctgtcatcaaaggcagacatgaagaatgaaagactcaggaaaaacagtcaatttttatgcttgggtttgttgaagaatggacagccttgcagaaatgtgactggactaaaagtggcagaagaacttttccccatcactgcttcagggttacatcaagtactgcttggctactactggtgttccctcaaggcccaaggcctcttcagtcagcttgtggtaaatgccgccaggcctaggattctcctttcagggcagtgggctcctctctgtcccacagaaggtccagaaatgctgtccaagagctcagacctgaaatcaggtacccaaaaagcctgtttggtgctctaccccactgtggctgagctggatcctaagctgaaagacaaaatcctctttactcttccctctctttttctcaagcagaaggggtctctccctgtagccacttgagctgggaatgtgctggttcaca

SEQ ID NO: 477225 - DNA, 1826 bp, Homo sapiens
ctctgcttaggtctgacaccatgagctggtacactctcaggcagctgctcaagtctctgcacctgttaccttgtcccacacttgaagacaccctggtcatcccacttgagcacccagatctttccctggactgctttctgctgggtgtttccaccactctgtttgagctcagactctctggaatagaccattcctctgtgaggccccctcacaccctggttgggctccaaaatgatgcagcaggctgcactcccttgagggtactcccccaaccccacacagctacctttccatgggatgccaacgtggagataccatcacttctcagaaatagctcctctccccagtcagcctccctcactcttctcagcatggactccttatttggcttggcacctcctaatagtctttggactgtgtcttatctgacttcctttccttaaataggacaccacaatgaagattatataaaggtaacaacctgtgaaagtcaaatcaagtattagagctggaacaaacagaatgcatccagacccagtgtggtcaaatgacttgcccacgggcattgcattcttagagtcaatattcggaaacgaaatttacttgacatgacacttctctacaccatattagaattcatgaaaatataaatatgtcttaaacacttttttacgttaggcgctccacacctgcctctgtaggtctacttgtcggggtcacatattgttgccgaccatctctgccagcagatgtcagcaccacatgcatatactgacatttttattaggctaagagacacctcataaataaaggcaagaaaggatggttaaaactcatgaggtaaatctattttcatctataatacatacagttagctttcatgtggattttctaattataaattttgataatttatgtttaaaatgttaaatgcttttatcacttgcctattacgtatgtatgtctgcatttgtacccttaattttcagtgtttaaggcatgtttatgaataagacagtagaaaaaaaggaagaaagtgataggtattgggtcacgcaccttgtggggatactcatatatagtatctccaattaaaaagtgaaatatcacaaataaattagtcatcttccaacttcgtgtggcagttttacctttaacatactattttttaaatctacttttttgttaatataaagaaaattatgaatcatgactttactaattcatacatgttaagtgtttggctaaatgggggaatgtaataaagtatagtgagtttttcttaaagcaatttcaaggtttcacatgaaagtttcaacatagaggctttatatgaaaaggagctcaaacaattttatttcaccagtgtatacaggtaacatgtaattttatactaaaagtaaatttagagatttttctaatctattttcatattatagataaggaaataaagcccataaaaggttaaagactcttaacaaattttccaaattcccaaatcatggtatctgaagggggcagagattagaatttatttctcctaggtccctattctgagtccatccttgtgcaccaagcctcaaggccaacatattacctgttaaatgaatcattctatgtcatattaaaaagtattgcacaatcacctctttttcaggaaagtgtgtttttagaatcaagaccatgaattgtatcttattaaaagctatttaatagcaaattatattgcctattactttaatatttatattataggcactttatcacttgtaaataaataaaattgtatagcactaaataaagatgcctattctcttaggcaatcc

SEQ ID NO: 477226 - DNA, 636 bp, Homo sapiens
aaaagtatctggaggcaacaataatgaggaaagaggagacaaattcacctctaaaatggatggcaggaggcaggtggggaaaaacctatgattatttgataggatcacataggaaacagacacagcagaaatctggctttaggttagagaaaaaaggtgaagactgttcactgaaaatgacacttcagaaagagaataggccgtcaagtgactcaaagaagaaaactgagaaagagggagcagaagattgtcttgacatcaaaggtgctaaagaaaatggacctaataatattgcctatttgagagagttgttgtgcaaattaaaaacaggaaaatgttgtaaaagttttagtgtatttgctggtactagtgagcactcaataaatgtgaactattgttggcaaagcaagggttaaaaggagaaaaggaggagacttctaagttaaaggaatattataagccaataacacagcagcagagcttagccagtttcttagctctacccagagtctatggatatgcaaagtctcagaaacagctggaaaaaccatctcagctctacctgtggtttgaaaactatttatcccttaggatggatcttcatccttctgtgcattacttcagctgtgatcacaa

SEQ ID NO: 477227 - DNA, 586 bp, Homo sapiens
tataattaccctgctaatgctgtacgtatggctcacacccagactcactcctggccagagagagagtaaatcaatgtcgaaactttctacgattcctcaagtgtttttccagctacctgccactcgcccaccaactccccttgggcctcagttagaacctgacattagcatttggatcagtaagaagtcagtgtttgctgactttcagtctctgaaattccagtcaggcagtcctcagcacgaccaaagtttcttcattgtaaaaggtaatggacttggaatagaactaccactcttccagcaagggcctcagccctttcgtgtgaaaccctggctcccaagcaggtctctgatccttagagctgccagcgtgaggagtatgctgatagggagacctctgggattcagggagaaaacaggaggagtcagtggacttcagatacaagttcctggtgagataggattaaatagatcagaggaggctttgtaatattatcgaaggctccatggagaaggatggctttcattttaatttgaatgctggaaaaacatagaccaaggcatggatgcaggtcatttcatctct

SEQ ID NO: 477228 - DNA, 1535 bp, Homo sapiens
cagcgatatttctcttacccatgttcaaaccatcagctctcatgagacttattcactatcatgagaacagcatgggagaggcttgccgccatgattcaattacctcccaccaggccccttccacaacacatgggaaatcaagaaaatttcagcaaggactggctgcaatccatgagtattcatgtttccaacaggaggagaagccaacaactgaaagaaggaggaaaagtcactcaactgttcatcaagaatgcactgagcaactgctatatgcatgcactgacagccactggatgggcacaaagagaaagcagcaaaaatacctgctgtgctctcttcccaggactgttggacaggatgaaggctgtgaaacagcagtgccctggactcagcagcatcagagaggctggaagtagacacagcatcatcaagtttatgattgcagagaagaaaatcaaggttacaaaacagcaagggggaatgatcccagttctctgctcctcctgcacatgtattcccatgtccatgcagcccgaggctcctacggagtctggagggaaaggcagagccacggggaacacagcagagcttttggataaattttcgatcctttttgtctctcttgctccatcccatgtcagagctacaaaattatccaagaattatccaaggcatcttttatcaaaagctgagaagctacaacttacatcaccagaacccaactcagctagaattccagatgtcatttatatcctaggtagggagaaggtttattttatcttggtgaagaatatttggaaaaactttgatgtgcatacttttaagaaagcaaagaatctgggcaagtctttgggaataatactcaccacctaaaccacgaggatgcctatattttcacaataaaatatctatttaagaacttttaacttacaataatgattataatagccaacatcaaatggtgcttactatgtgcaaagactgttctaaagctttccatttattaactcatttactactattaactctattagataggtactattattacccctattttacagatgatgaaactgaggcacagaagtaacttcagcaacatcacttatttagtaaatggcaagtccacgttttgaatctaggcagtttagatccagagtccctgcttgtaactactgtatattgtttccttttttaataaattaattcattgaactttaattcatttcaaaattcaaacgactggttttcataatcatctagatttattagcaacctctttaggccttttgtttctaagtagcatggtgcaaagcaaaggactgaaaatagaagtgtgctagaaatctgtaacttcagatttatatgatgtgctgactatcaaggggttaagctaggtactgaacattcaatgtccttgtaatagtatagtgctatcatgaaacaaatgcagatttttacgtacaagccttttgtaaattaaagagatctattttttaaagtggtcctatgttatttatgtatatcattgtttt

SEQ ID NO: 477229 - DNA, 1341 bp, Homo sapiens
tagtgtctacaaatcctcttcggaataatcccttccgagtaccggctcgccatgtgtagtgtggtcctacaaggacttcttcagtccagacttggtggatcagatgatacatagaaatggagaatgggttgcaaagtgcttcccacagcactgccctggagcagagagggtatagagtacagggagacaaagtagggagcagaaaacactgcacagatataaaaaccccactcctaggaaaacaagcagctacagcaggcattttgctgaacgtgttgtcagggagaaatacagctgataaagaagcaaatactgatagaaaggcttcccatgctctggaactgacaataacagctctgaatgttccagaaacaggaggccagtgtgagtggagtggagcaggccaggaggatagtggaaggagaggcagtcagggcagcaccatggaggatcagaacagcagggctttgggagcccttgtggtggcctcttgctgctgttactggaagggtgctgtggctttaactgtaagccctgaaaccctgagcgtgttgtgacactgttgtgacatttaagaagagttacaccagacaatttagatttcactgtgacatatgctgtataaattctttaatgtttagcttatcttgcactaaacagcagaagaatacttagaaaaggttgattgaggaaaaaattatagacatctatatttggctatattcacaccgatctatgtaaataagaaactgtctactcgtattcataaatatttaattcagcaatattataaatttggattcttacctgattcttgcctgctcctcacaatctctgccctcaatttgcctgatttcctcaagaggtgcatggtagggaggatgcatctcctcactcctgatgtttccttccaggtggaaatgttccatgagtaaagccgtcctggtccccttccctcttctcacttagtcaaccctttggttggcagagtaagttactaaacaggtatatgattatatagtcaacatcccttcataacaaaaatcctcaacaaactagcatcaaaggagcatacttcaaaatactaaaagccgtctatgacaaccctacagccaacatcatactgaacgggcaaaactggaagcatttgccttaagaactggaacaagacaagtggtttaccagtaacacctgagatatagtttgactctccggtgttctttcagaattcaggaccttgaagtctctatgggaataattcattgtgacaagtgagggatctaatgtagatgtcacagtcactgatttaatcataaatcgtaaattgcaaggtatctcagg

SEQ ID NO: 477230 - DNA, 662 bp, Homo sapiens
gaggcctccccagccatgtgaaactatgggatggccagagaaattctctgagaagtggatattggagcgaaggcctgaattatgtataggagttgtaggaaggatgggctttccaggcagagggcacagcaagagcaaaggccgtaaggctggagtgtgcttggcatgtgagagctttttcaatgaggccagggtggctgcagctgaagacaaccagtctgacttttgtactagttatattatgatgaccccatcagaagcaccactatcacaaacagaatggcagttaatatcattgagtccatgtttctatgagaaaacgagccctgaggagtgtatgcagcttctagttaagacaccttggatccactttgaaaacctttggatccactttgagaacctttggatccactgtggtattcttgctaaggtcacgttctctccaggttgctcctaaatgatgattgactttattgaagtataaatgacaaataaaaatgtatatacttaaggtcatacaatgtatatgcacatagtgaaatgattacatcaagctaattaacatatccattacctcacagttacctttttttgtacctgtggtgagaacgcttaagatatattctcttagtaagcttcaagtatggattactattaactat

SEQ ID NO: 477231 - DNA, 733 bp, Homo sapiens
tttctgcaaagcttggtggatttactacggtttattttcattctcatcagttaggaggaaatggaagaaagagcagccaactctgaggagcttgcagccccgccccctgccggggtttgcacttcggggcccacaattcgcacattaccacgggataaccaggaagatagcagtgccgcgcctctctgcctcgggggggggggctgcttttcctgtagcggaaactatttgtgctccccatgccaagcaatagatgttgtccagaccttaactctaaggagattctatggtatttctattccattaccagatgatgagaaaaagagccctattgacacggggctgtccatgcaccatggtagccctggggaggaaagctggggacctgttcctactggctgtcagcatttgctcaatttagagactgtcagtgaggaagggagaagggtgtgtgagcaggtggaagctctgaggggacagacataaaggagaacttttaaatacttgggactgactgaaagtagagtaggcttccttgagggatgatgagtacctaaacattgtccattgacgattttggggaaaatattgaagagagaatccttgtgcattaaattcacctaagccacatatgcttatgatgcaatctgttgtactgaatgaactttcttccttgttgtcgtgtgagtgttggcaaccaaggtcagaccatgaatgcaaattgcaggtgacc

SEQ ID NO: 477232 - DNA, 703 bp, Homo sapiens
tcctaagccatgcgttcctgcagctggcagagttttgaagggaaacagagcctgttaaccacaggaaagagagagaagtggcagggttttggaagggaggtggacccaacagattcacattcattcacactcaccttccaggatgccggggcgaggccccggttgaaacaggaaaggttccctcgtccactctcgcacgccctgcgggatgacaggggagcctttcccgtttcaggcattgccaaccacagattgggtgctgactattttgcagccaatgattcagatgcgggtattgctgcatctgttttgcgtaatgaagttgagctgtgtgtgatatgtgtggtagctagttatagagaaagcaacaataatatacagggtgctgatttgcatgacttgtctgaggagagagcaattcaaaaacaggaatttcaagaggatggagcaagccataggcccaactggatccagtggctttatggatatcaatagaacattgttgctctcccagattttctttatttctttggattcattttcaggtttagtttttctattttgtggcaaaagatatgcctaggtagtttcaaacttagatattactcatgaatagtgattgaaagtaaaaggtatgaaatcttctctttctgtatctataggagttcctgaaaaagatttgaattgactgtgtttatgtcac

SEQ ID NO: 477233 - DNA, 654 bp, Homo sapiens
agcagcagtggagagagagatgatgaaaatgaaggtaatgcttaggctcctaccccaggagactggggatgtagtgatgctgctgtcagacatgggaaatgtggaggaaggggaatgggtttgcagggaaaatggagtttcagctgtgacactcactgtgaaggtctgtggcttcactcctgaaatcagcgagaccatgaacccaccaagaggaatgaacaactctggacgcgccacctttaagaactgtaacattcactacgaagcaagaccacaaacccaccagaaggaagaaactctggacacatctgaacatctgaaggaacaaactctggacacaccatctttaagaattgtaacactcaccgcgagggtctgcggcttcattcttgaagtcagcaagaccaagaacccactggaagggaccaactctagacacattttggtgacccagatgggactattgcctatcgccaagcagatccctcctcagaaaagcaggcctaacaaaagctattcctgaagctaggatttggggagcctcagaaattgtatccttcctattcgtataagtgaggacaaaaggcatcactcttctaactctggagatcccttccctccctcagggtatggcccttcacttcatttttgggg

SEQ ID NO: 477234 - DNA, 3497 bp, Homo sapiens
ttttctgcatctgagtagtgctttgaaaaccccgaaacaatgctagtatacccagcattattaaaattcttgctctggttccttctcatctgcgatactggcacttgtaatttttgtaaatttttcatgcaggaatataaaagggaactaaaaggaagtaaggaaatggaaaaagaaggaaggaaggaaggaaggaaggaaggaaggaaggaaagaaggaaagaaagacagacaaacaggaagagaaagaaagaaggaaggaaagaaaaagaaaaagaaaaagggagggagggaaagaaagaaaaagaaagagagaaaagagaaaaagaaaggagggagggagggaaggaaggaaggaaaaagcagaaagaagagaagagaaaaggggagaagaaaaggaggagaggagagaacaagaaagaaaggaagaatgaggaggagatgagagagaaagatttaaagtcagagtgacaacaaagaaagattcagaagagatggcaattttttgattcataattatagttatgccttttttaggagattctgttggaatgcctggactggggaagaagagagatatagaaaaagacttgcatagaaacaattatataaaagatagtaaatttcttaaacatataataattattattatacattatattagcaagcatattaaaacttgaaagaaaatcatttatgctgaataaaaatcaatatttagtggtagagataagatatgagaaaacttgattatattgattgtaacatcaataaagttaaataccaatcctttctgctaagttttattatgtaattttatcttttgaatactaccttccagtaaatatggatttttaaaagaacaaatcatgagtcattgtctattgataattgccaaactgaacagttattaatttaacaatacaaaataaatgtaattttataattttaaatatgttaacatggatcccactgagaaagcaaatattttttctttgtacattgtctttttggagaagcatagaaaagaagcgtttaagtgttcttttgagaatcttgtctaaatttacacagtaattgaattaatagcaaacattttaaggtgggcaaaggcatgaatctatttagcacagaagaaagaataaatgatgaatacacataaaaataggtaacaatattactaataaacaaatgcagcattaatagtattttcagatcccttatgttgtgtattaaactggaagattatttacaacataataatcatcaattttgttgtaattcaagacaatgacatacttctactcccacaatgttggagggagtctacggtggtatagacatcctggacggtgagttggcaataagtgtgtctcaaattcctggcaggtattaactataatatttaattttaaaaacgtgacagtggaataataataccaatttaatgaagcgggactaatctaggaaggaaacctgaaaatatgattccaaattcttctgattttgtctaatatgacgatattaaattgctagaaagattgttttatatatttttcaaaagttatcaagtcattcactttaaatatgtgtggtttattcaacgtcaattatacctcaatgaagctatttttaaaaaataactagatccagctcctggggaaattaatatctcaccttagtatctgtgaaataaaatattttttaaaatatttatctatttttgttgctttttaatagcaaggtttttcaggatttgtagtttgtcatattgttagaaatggaaacatcttcctagatttttttttctccacaattttggccatgagctattgacgaaatatggctttcaagcctaattataagagcacagttgtacctgtcattttttttctagtttttcttcctcatgaatatgtgccctggacttttgaaatctttattattttttaaatcacaactcattaactaatcttaccactcttgggaaccacctctcaactaaatattccctctgtgcttgtgtcctgttcaccagaaaaatgttaaacaggacagagacatggagaaaggctaaagaattccaccaactattaccttccattggaactgaatcatcagaatgtttgtttaacttaattccaaattgcctaacacactattgccatatcctttatagaaatttgcttatctatattaatatgatgatataccaatgtattaactctgaaaaataggaagaggattcgattattgctttaacagcctctggggtaccctacttaataataaattccagaatttgggaaatcttatttgctaaatcattttccacaattcatgaatattttcttctgccattaccctataatctttgcttaaagattttcggtagcattgctcttattatcgtgttatttgcctggaatgaaactagccaagaccaatatgtctactccatggaattaccttagtgccccagatttcaatatcatgactccctgaaaactctttagttatacttaatggtcaacttgctatgcttagactaaaattctcctatgaattggggggatatttaaaaatgcaacacaggtgcagaaaatattacaagtttttatcacgtgggataattcatttagatatgaattcacatatctaattcaaatttcttaagtaagatttttgatttgagatggatttttccagtattaattatgtctttcttctttagattgaatattgacattatttattttaaaatctttgttcacacttacactcacattccatgaatataagttatggaacttgagatacagcatttttgtgtttcctgtctaagaaaatctattgagtaaaaggaactatctggaaaataacatacatcatcttttgttattttgtaaaacctattttaacactcagccccaagcagagatggtatctacatttaataacagctacttcaaagatatgcagcaacatatttgcatatgctaccactagaataatttatctgcttaatttacggatattaaaattaattgtaaaatgccactaagggaatttgtcttttgatgttctctgtaggggcaaatttacattttgagattagacattaaaaaaagaaaaacaaagcagaaaagaatgtatgttatgtttttatcgtgtgattagtgagtaaggcacccgtatatctcaacatattattaattgagtgttcttagggatctgtgtttggaatataccagaggaagatattttcagtactttatgaagagctcaatttcccttcttaatacataatgctatggctgctgcattttgctctaaaggacattatgccaggcatgtgaatattatggaggtatttgctggtaatttatcatttaaaggttaaaaaaccttttaattagtaagtatgtaataagaaacttaatgaaaatgtctaatgaatttcatttcacataaaaggatttttttgtccatgagag

SEQ ID NO: 477235 - DNA, 579 bp, Homo sapiens
cagataacaatggcgggtggaggcccaagggctcttaaatccccttgtgttgaatgctgccttgcctggagctcgcccttcaggaaagtgggctcccctctggcccaggccaggtccggaaaagctgtccaagagtcaagccctggaatcaaggaccccaagggtccacttggtgctctgccttccgaggtcatgctgatacttaaggtgcaagacaccaccgagttcagtgtttcaaaattgctatgttcgttctccctcagtgctcaagagacactctctgcaagctgtggctgcctggtgttggggaggtgtggcattggcaatcacaactgtgtttgctatctattcagtgcctctttcagtgataggaagaataaagcaggaaatgtgggctgcagccagattactaagaatctagcatgccagccgaaggtgtttgctatttattgagaagctattgaaattttagagtgtaaaaaatgacacaatcagaacagagtttcaggtgacactcatcattttttgtttttgttgcaaatacttttggaaatagtcacaaattatttgccaaggttg

SEQ ID NO: 477236 - DNA, 589 bp, Homo sapiens
tcttctcgccttagcagctgaagactgacactgcccgattgcctcagaagccccctagaccatcagggacgcggagcttcagcttaacccacaagtataggacatctctactccttccctggcaaccgatcacatgcccattaccatcccattaaaacctaatcacccttaccccgctcaatgccaatatcccatcccacaacacgcattaaaaggattaaagcctgttatcactcacctgctacagcatgggcttctaaaacctataaactctccttacaattcccccattttacctgtcctaaaaccagaaaaggcttacaatttttcaattcatacaaaaccgtatccaggccatcaccaatcattctatacgacaaatgtttcttctaacaaccccacaatatcaccccttaccacaagatctcccttcagcttaatctctcccactctaggttcccacaccgcccctaatcatgctcgaagcagccctgagaaacatcgcccattctccctccataccaccccccaaaaattttcaccgccccaacacttcaacactattttgttttatttttcttattaatat

SEQ ID NO: 477237 - DNA, 2595 bp, Homo sapiens
atacacatctgctgctgattctgctacttaaatactcccaaaaaggttccactcctactccccctggaccatgggagtccctgaacacatccccttccttcactcctttcacaatggctccaccataggctgccatgctgcaccggctcaaatgcctgctgccttgaagaacatggaacaaagtacaaatctgggcagtggcttctgtggtataacactggtgactagaaagaatgaggtggtctcagatggagatgaggaacttgttgagaactggagtaatggtgactcttgttatgttttagcaaagagactgctggcattttgccctgccctcaatgggtggaactttgaacttgagatgattcaggcactctctgtacaacttcacttggagcacaaaactggacgatcacacgtggtttctctggaattctgctatatgcacattttccctttgcttattttaatatgtatcttttaactataataaccagcaagcacgagtacaatagttttctgagttctgtgggaattgaacaatgagaacacatggacacaggaaggggaacatcacactctggggactgttgtggggtagggggaggggggagggatagcattgggagatatacctaatgctagatgatgagttggtgggtgcagcgcaccagcatggcacatgtatatgtatgtaactaacctgcacattgtgcacatgtaccctaaagcttaaagtataataataataaataaaattaaaaaaaaaggaaagaaagtggctttcagtgggaaggggagctggaaaggagaacatttcgcaaactagaaaagatgtaaccagacactttaaattcaaaaattgtatgatggcttaaggttacagaatattttctgaacccctatactttacacatgaattcttccataaataatttttatctcagaaaagagcctcaatataaagctccaatataaataaaacagagaaattatcttccactttaaaagtttattataaaattttatattagtgtacctggtttgacattgaaacaaatgcttatattttaagaactttattatatatacagttgtaactgatattagaatttatagtatataataaaaggcaatacacatagaaggtagcatttttaatatatattttatctaaaatttactgtaagtacttgattattaaaacatttttcctctttgtgatgcaaagatagtgtcaattctgtaatttttgttttgctagtactctaatatgttatttaaagatgttgtaatgagtaaaagaacaaatttacacataaagggtaaactttaaaaatcataaatattcaaaaatatctctatcagcacaaaattaaatgccaattagtatacagattataatacaaatatattggtaatttaatataaataaataaataataaaaagatgatggtatttggaggccagaatgtcttactctacatcaacatgatttattaccataacattattcaataaaataagtcatctactatgtataaggctttaaagctttatatagttgctttaagtaacaaaaaaaatttattatataatccctactttttctatgttaaagctgcttgaagaaatgatatggattcctaaaactttaataacagaaatatgtatactttgcatacacatttgtgtaattttatgaatatttatcagtttttaaattttcataagagccttatatatagttaagattatcctgctttactgaacactgaaatttggatctatttgttagggcaattttacctactgaaatacatacaacttagagccttaaagtgttaatttaaaggatgttcattttttgcttatgctgttttgatagcagcttggaggatgggatatgagaggatgttttctggttcacaacgacatttcagaatgcagttttacagagtctctgctgctttcaatatgtggcttctggatttatcctgtaagttaacatctaaccagcagataggataaagaaggtaatggaggacaattcatgggaagattctattagccagaactggaagaggtgtacattactattgcacatatttctttggtcaaaacttagtcacataaatgtaattaactacaaaagatgctagaacatatgtagtctaactttatgccaagaagtaagcaaaataaatttttgaagccaaatatcctacattgcagaaatagtgactcactcaatgacatatagttaatagagacattcagaacccgtaactgtcttctgatccagtgaaaagtgctgcatccacatcttaataatttgttatttggtcattttagtgctttctaactcataaaaattcactttcattattctgtttgaaccatacaaccattccatgtgaaagtgatattctcatagaaatttttattgtaaagtattactaacacaaattgtacaggcacacaggattgggcataaagccttgttctatcattttccagctgttaattttatggagattagactttatcagttactattttcttagaggctaaaacactaccagcatatgcat

SEQ ID NO: 477238 - DNA, 2166 bp, Homo sapiens
tctcatcacaggcagcgaaaataccagtatgtctggagctatggtggcagaggaaattgtgatcagagaagttcagctggaaacctctgcagccagtggcgcttttgctggagttttgctcggtcccactgggcccagttggcctggcaggctgtgcttggcttatgctaccggcctgataagctgccaagagcaatcggagcggctagtggtgtgtgagcgagtgagtgtggggtctggccactatacacagccagggatgcagtgggcagctctagaactttgtgtgggggcaagagggaagtatgctgcagccacaagcacaggaactagcaatggcctggccttgcagagatacagggaggagagtggcctgaaagccgtgattactatctctgcgatgaagtgtatggcctgcggcaggagaggcagttatactctcttctcaaacattaaccccagtggcctgagaaccaactctatcccccacagggaccatggcctgctccgccgaaagagagtctgagctcagacccgcctaaccttgcccccatctgggaaacttcaatgatataataattaacagcatttcatgatgctacaatctttcagcacatattttttaacattttaaatgttagcctctttccaactcagaggagattcacttgcttaaagagaaatactcagaaattatgatacttttgaggtgattaatactattcatattaaatatctcttaaccagaatgaaagtagtaatttggaaattatatagaaagcattatttttgtgtttgtgagaacagattaactatttacttttctctaaaagcaataatttattattttaaactaatcaaatatttctaacaatgtattctatgggaatgttaataaatgttttacagaaattattttagaattgattttttcaattgccaaataaattatgtacacttattaaaatactaaacacatatgtagtcagtcattagtctttgtttataaaagccttttttcccattatagtcacctttcttagaagtcttttaaaacattattttctggacttcctttgaaattttaataccagagatatactgcatacatatacagaaattatattaaatggatgaatttctgtgttgactatacacttatgagcgttccaaaatgctgggattacagacaaaagctaccatactcagctaagaatttttaacttgaatatatgctgaatattgtctaatacttttttatgcattaaatactgtgatttaattatgtgaatatttaaagtctattaaaatgacaaattatattacattttaaaatgaacttaattttatcatagttttagatttacaaaagcattgtgagttctcatatgctccaaacttgtttttctgtattgttaacatatcacattagtatgctaaatttgtcacagctaatgaatcaatactcatacatcattactaattaaagtttgtactttttcaaattaccttagtttttacctaaggccatttttgtgttctaggatcctatccaggatgccacattacatttaattatgttaaatctcagcctcattttggctgtaacagtttttcacacttttcatatttttgatgaccttgatggtggggaagaacactgctgaagtgttttatggaatgccccacaatttggatttttctgatgttttcctcatgattaaatggtatgagggatttggtaaagaaggccacagagataaagtgccatactcaacatgtcacaacaaggatacatgctatcaatttgacttttcatgttttatattctccttattccattggctgaaatagtattttttcaggtttttttactctaaaataactctctccttccccctttttaatattgtactcaagaaggaaatcacaatgcccagtccacatttaagagtggaaagttatgactcacctcctagagtggggaatatctacatattttatttagaatttttctgctgtgttttgtaaatattctatctttttaaaaaatttttctgtagtcattttttatgtcagtatgggttaatggatatttactttatagcaacatattaatataaggtagtacaatctaataccatattacatatattgctgttcaaa

SEQ ID NO: 477239 - DNA, 912 bp, Homo sapiens
ccagcaagactatggacaatttcaatagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaaggttagcgtactaacctttaccaagggtagcgtactaacctttaccaagggtagcgtactaacctttaccaagggtagcgtactaacctttaccaagggtagcgtactaacctttaccaagggtagcgtactaacctttaccaagggtagcgtactaacctttaccaagggtagcgtactaaccttttccatgtaaaatgttacatgaagcaaagggttgataccttcagtattttttaatatacttctcctcatctgtgtttttcctgttgtttttattcccccaattgattgcccatctagctgcaaattcagctctaattttggacatctattttcttctgctagctattggggacactaatgagtcataggtttggtctctttacatgatctcatatttgggggag

SEQ ID NO: 477240 - DNA, 719 bp, Homo sapiens
cggagatggggggtcaagaactgtcttgattctcactcccctctgctgtgccttggtgtctgtacttggttccttcttggcttgatcacaatgagagatgttaacttttctttaaactggagtcgcttttctccaaatttcagaggtggaggtgaatgtggaggtgaacgtgaaggtggagaacgactgaatgaagccacaattgctcagaagactagcaaggagccttccttgagtgccttcactgatgacagtgtgctcatgcgagcagaggcctcccaagctgctcgttgtgcgatcagacttagatggctttctgcctcgtttgcaggaccattttcagtaatactggaaaagaagaacctgaaagacttctttaaggattctccaactcttagactagcaagccatgtcaagaacttgtcgtcaaactttgccagcaatacctatacgtttaggtacctatgtttgtttgttcattactctgagggtctccatcagcaccctggtcctcacttatgacaccagaattgttaaaagatctcacagcctagtggggagaaacagtattaaacatagaattttcatacactaagataaacaaagcagtagagttatatataaaaggtataggggaggcagcaaaaaagggagtaatacatatttccttttttattgattatttgattgtattactttacttcatttctgctgaagaa

SEQ ID NO: 477241 - DNA, 1654 bp, Homo sapiens
tcatcagttaaggcaggaagaggccattttcacttcttttgtggtggaatgtcattagttaaggcaggaaccagccatctggatgtcattccgcaagttacttcctccttcctttgttctcctctgcctttgcctcttttaaaaagttctaagttgctagccatcaggacaaatacagaatatgaggtcccattccagccaatggaaaccggacacagcagtaaggtggatgcatcaaattataaatgaccctgtctcctttgttcggtgtactctcatggcaaaactgctggcgagtgtaccccttctgcagaaaacctttctggtagctctctatcgcatcgtcaacctaattaatcttgccattaagaaaagagatttgtggaactttgaacttgagagagatgatttagggtatctggtggaagaaatttctaagcagcaaagcattcaagaagtgacttgggtgtggttaaaggcattcagttttaaaagggaagcagagcataaaagttctaaaaatttgcagcctgactacgcaatcgaaaagaaaatcccattttctgaggagaaactcatgctggctgcagaaatttgcatgagtaatgaggagctgaatgttaatccccaagacaatggggaaaatgtgtccagatatatccagtgcattggcggcatcgtgggactagaaggcagtgacccccctggacccagctttcactatcttgtgtgtgtctattatttctcgacctgccgatccgcctcggaaggaagagaaagccctgttgcattgcgggctgctggccagatcccgcaatagataacaatttaaaactcttggcacaagcaaacaaacaaacaagcaaaaagaaaactaataaagattatacaccttcactttatccccctgctttttaactctttgtttttactatttatatcttattgtactatgttttgaaaagatgttgtagttattatttttgattggttcattgtttagtctttccacttaagagtagtttatacaccgccattacagcattattatattctgtgtttttctgtatacttactattaccagtgagttttgtaccttcaggtgattatttattgctcattaacatccttttctttctgattgcagtacttcctttagcatttcttataggacagagctttaaatagccacttctttccttgcctgtaaggtttccactgaaaagtctgctgccaaacatattggagatccattgtatgttattagttccttttctcttgctgcttttagaatcctttctttatccttcacctttggaagtttgattattaaatgccttgaggtagttttttgggggttaagttggcttggtgttctataaccttcttgtacttagatgttaatatcttcctcagggttcaggttttgctgtgtgtgtaatgaccaaatttatcaaattaataaaaataatccttttaactatttagaaagtttataacaattagtatgacatgcaatatttgtaacatttttcatggattttggtatttttattgcatattgaggtataacatgaacacagcaaaatgcataaatgctaagggtatattcaatggattttaacatacatatatatatatatgcctgttgaa

SEQ ID NO: 477242 - DNA, 659 bp, Homo sapiens
tttgaattctagagggatcaggtatgtcttgcaagaggtattccagaagaagccttatcatcataggagacagcagcttcatgcatgttattaaccatgaaaaacttccagtgggacaagatgtggaggtggaagacagtgatcttgatgatccttgccccgtgaagcatggctgcagaggcctcaggaaacctataatcatcgtggaagacaaaggagaaacaggatccacccctctttcccaactagtagaaaccatccttgaatatggtgaacagctttgctacaggaaagcatatttcagttcttataatcgggccacagaagataccagaaggtgggagagcattgagccacactttcctccactctccttgccctttcaattaccattggaggtccttcagggcaagggctgcatcttcaatattgcgactttccctcccggcatatttgacagtctttgcacacagtggtaaatcaagcctaccctcttaactactgccctcctgtatttggtccagactttttctaatctattatagaaggaagagggattttggttggagggagagggatagataattttggaatacagaaacttgattcctggaaggcttagattgttacttccctttactccatcatactgtgattac

SEQ ID NO: 477243 - DNA, 3448 bp, Homo sapiens
acagctcctcttctagatttctgagcctctttatagttgagatttctgtgctggccagcagcctgtgaggtagcttgatacgcgactcctgtccaagatgatgcggggcaccagtgactttgccaacctgtttagatcctgtcacgtggcacgtttgaaggagacgcacagagaaggagtctggcaattgggtcaacggcagcaaaaaggaggcagtagaaggaatggtgaggagcagaagcccttgctactatcctcctccttgtctcctgatgttgcgtcaggaaagcctaaatttaaaccctggggaaagacaccttcatggaggaggagggccaaggagaaactgagtaaggaagataagtgcaaagaagatgaaaataaaaatctttgttttactgttaaagcctatactggagaatgcagcccaagtgcacaatgcaatgatttcctaacactgagccctcaaattgggcatatttaccaacccagacataggcagctcaaacagccacaggcctcccagcactatgccttccctaaagggctcatgacctggtggagcagatctaaatgcgctgcaggcagatcctaagcgaaagctggacaagggggctcagctgtactggacacagtttctcactaaactcacaaattaggcaactcaggttagtaaacagtgggcaagaatataagaatgtttaggaaaaacccttcctgatggaagcaaaagagagtggcaataacatccccccataacctcaacattataaatgtatcataatttgattagctcgtcacttattgatagacatttaaggtgcttccaatcttttgctattgcaaaaatgtaacaaacatgaatattcaaaaatgaataactgtatacatacaaaatttcatgaatatgaaatgataaaatcctgaataactttgtacatataaagtttcatggatatgaaatgataaaatcctgggggtgaaattgctgggcgaaagagtatgagcatttaaaatcttgctagatgttgccaaattgccctatctatcaatctcctaagaaatttgtgaaaaggccaatttctccacacactttccaacatgaggtattaataaggtattaacaagagctttcatcatcgccagtctaatatacagaatctggtatcattatgatcccataatttgttttctgttattatgagtaaggttaaatacttatcttaaatttaagataagtattttcattttttaaaaaatgtgaactgccttttcatacccactgtccatttttctattgaattgctgtggggtatttttatattaatttctagatttttttatattttagaaacattttaattatcatataaataccaaatctttttttctgagtggttgtattcttttcatattgcttatgttggttttgccatgttgaatttatttttaaagtaacctcatttataatacttttctaatatgtcttctgaattttgtgtcatttctagaaaggccttctttactcgcaattattcaatatttttcccatatttctttaagtacttttatggtttcattttttgtttatattaaaatctttgaactatttgattccaataagtaagaatttgactgactgttttccctcctgaatgactatcccatatcatttattaacaaatacataataattttttcattattttgaaattctaacagttattgatcccaggttaatggagtcaggtaagtgaatgcagttgaaacttgcagataaaacctttcaaactggacatcatctacctgaaaatattgtccatatagattttttctttacacttttaaacgtaaagaaatttacctggattcaaattcttactcatcttcttataggttatgcaactctcggcaagtaaatttttctgagaatatggctttgggtttgttgtgagggttatatgagacaatatgtaaagtttgggagaatatagcagtcatttgtattaatttattgtttaatattataaagatctattttagctcatcctgttaccctccccctgcaatgacctctgatcatggtaacagtgctatcaattgtattgcacttagcaaaccttaaagaaggaccaaaatctttcagaaatcttttccatgggcatactgaaacagagataggtctgctccaaattttgggggggaatgcttacatgagttacatggctgagcttagatatagcttagtagaaactgtgtttaatattcttatttaagacacagactcagcagcagagacttaacttttgtagaagtaaatagttagaaaggtgtgtttggttacctattaaatataccaagatagtttgaaggtaggaagtagtgaagtgatactggaaaatacaaaacagaacttgtgaaaaatattggtgtgccccccaaccccctacctctcatttctcaaataaaacaagaaagaaacattaggcaccacaaatatatctcccatattctgaaatgcatctagaacaataggtttgccaatttttcttagtatcagattctagagaggaacgatggtgaaaactcctttggtaatcacaaccttgcttcctgtttagatttgttttctctcctttgtgtaaatgcaaaatagctgatcataatctgtggcttcatattccagaaaataattactaagtgtatctcagtctttcctcataaaaataacaggttttttttgatgttcccctcaaatatttgttggagattattctgctagggaagaacgagggaattagaacaaattatcataatgagacacaaggtgagttaatcacagcaaaacaaaaatgaatcatcattagtgtttggtgagtgtactttgtaatgaattcaatattcagaatttttaattactcctcgacagtgactcttgacaaaatatagcacttgtggataataccagtagatgttgcattaattatgtgatataatttggtgaactaaagattcaaaagctttgagatatatattaatgatgaaaggcaaaatgaatattttgctattttgatgcttaatatgttttctgttcaaagaaattcagtgttaatggaaaagtgactgacgtagaattacaaaatcatagaatttcaatactggaataggctttatatatcatcctgttctacctgcctagctttacccattagggagtcaaaactcagattcaaagaggaatttgctcaggtcgtccagtgtgttaatggtcatgattaaagtagtatctagtcctgagtcttagtctagtgcttatttcatatcatattgtgtactttttaaagcaaatgcttatttgaatgacagtggcgtagtatatattttgcactaattttttgtcttaactcctttacttatgataacaggtttcaatagcattttctgacac

SEQ ID NO: 477244 - DNA, 799 bp, Homo sapiens
atctgaagagtgggggagtcaggagaccccttgaggcctccaacaggactcagctcaggccatggtcatcttcatgctggaagaagctggtgagccgcccggatgtgacactactgcatggcccaactgtgagggcagaggtgccgccatctgccctctgacaggcactcctgttttcatgcccaaatattgcattttccaagatcactctggcccaccacgcccccaatcctgtgcctataaaagccccgagaccctagcaggcacagacacaagcagctggacatcgagaagaacacacgggcagaacacactagcagaacacaccggcacacaccagcagacaccagcaggtcatatacagtggtgccatgtgaagttcagccagaggagagcgccactactgggtggcctgactccaggggaagaccactttcccactccatccagcttctgtcttcctcatccacctccctgggagctattaccactcaataaaaacctcgcacctatcctccaagcccctgagatcctgcagtctgctcaggctttaaaggatgatttctaaatattgtgcattaggcaaagagaagactttgttaccctccttgggaagaaaaaaagaggaaagggagaaaaaaagagggagagacttagccattgacatggtaaatggctgtgctttgaaaaaatgtgattatttcttacgactctccctgtttggtcactgtagccaaactcaaaatactttgtgtggatagaattttattgaaaccagggagctgtttaaatcttttgt

SEQ ID NO: 477245 - DNA, 1757 bp, Homo sapiens
tgcttttttctgaatataaagaaaaacagcatgaaccctggaggcattggacaccaggcctatagacgcagctggcgttggtcaatgggttttcaattccgagagctaaaaaaatttgttcacgtggatgtagagagtggagtgatagacactggagactcagaaggctctagcgtcatcttccctttgaagcacagccagaaggatgtcactggaaatgctgaattactgtacatgaaagacacaaagggaagtatgaactgggacatccagtctagaagagggaaggctaaagagaagaaatgtggtctaatggctttgatctttattgcaccatctcaaccacctcatcagaagtacagtgagggtgaggtggatgcaactggagcttttatgagagatcaacaatgggggagcttttcctatcatcagagattttattttcaagagaaatcagaagaagagaggaagctgagggaaagtctggaacttcctagagagttgttgaatggtggtgaccaaaatagtaacagtgatatggaaaatgaagcccaggctgaggaggtctcagatggaaatggggaacttattgggaactggagtaaagaagatgtatggaaaagcttggatgtccagcctgctgcaggagcagaggctttagaaagagcctctaccggggtaatgcagaggagaaatgtgggcatgaatgtttatgatataaagattccctgctatcctactctatacaactgataaagcaagtcaaaaaacatgtagctttacaaataaaggctttgggcaatattctaagaatgaaagaataagtatttgaattcattttgccagtaatttatgagtgggcttagaatgcctgtatgcagaaaaaattatttatacttctgttattatctttagcatattaaatgaaatcatctttacctgtttgctttccttattagatttgatatttctgaaaataaggaagccttacttatctttaaattcccagtatataacacaatgttatataaagaatatacaataaacattgactatatataacttaattaataagcattttcccaaatctaatttattctgaaaatttacctcagtatctcttcttttgtgggtctctgaaagacaaaagttaaaaagtagatatttaattttgttcaagtgggaagggaaaagccgagacagaaaaacaaactgaatattgaaagtgtggttaagcatccacactaaggaggaaagagtgctatcagcatatactagattcaaccaataagacaggtagcctggaaaatacttctaaaaatgcgtatattctttatctgatataatttgtaggagaaaaattctaatagtattttctaacagtgacttatattggcttcaagtactttacccaactataccaaaggggaacgtgaaaagttaatattttagacattcttaagatccagatgacccatggagaactgagccaagcagcagctaaaggaatttggtgctagaagacagaatcaagtaatttggtcttaaattttggcatgaaatcataaagatgtgaaaagacactagcattaagagctctgtggcctaagtagcatcttttcccttggtggtcctcaggggcaggtagagcatcttgctcgcattctccttatcctccttacttatcagaagcctaaataatatcccaatgtagtcattcgtatggaaaagaaatctgtaattaccccaggatagac

SEQ ID NO: 477246 - DNA, 2517 bp, Homo sapiens
aagtccaggattgctgtgagtttattcattggctggaaggtagcatgatggacgataggcaaggggtgtctggcttggggaaacaggaaacacccaacgtgagagactactaccatccatggacggttgctcagaaactatgggatttaccacgtagaatacataaggagaagtttgcccagtttgctccaataacttcatgtccacgcattcagaggcctgtgggcaaaggcttaattgcagcttgccagagaggtacaaagcctgttgttgatccgattcccagaccagccaggcatccccctcaccatgctctggctaatgcctgtgctgtgatcctgctttctcactatacagcaacctcaatccacaagcacagcaaaatcaatgtactggagatccggtatctctactttgtggtgattgcaggtttccttgcgtccctgaatctatttccatacatataagtctggaacaaacaaacctaccaccaaggttggagttggacttaatgtaataatgcatttgaggcacccacactcagagactgctcccagctctcttctctgcttctctcagcacaggtctgtgttttggtggtacatctcacaaagcttatcaattctttatttcttgtgtcccactagaagaaatttccagcattaaaacaacgtagaggatcaatctgtataacactatttaaggaaccctaaacttaaagcccaggtccgtgagctctactacttactctactacttgccaggcaaatttgggggaacattggcttgtctccctgatagggttctcatgaggagcataatagatgatatgtaaaagtttgaaaaaatgtgatatgcaatataaagataggatgttatatttcaagtactaaaataaaaacacaaagcctgtgaaaaagaacacaagactgctttgtgcttagagttacctattttctctaaatactacaaaagacctttgcaatgggaaagtctctgaatcttacatttttctttttaaaagcaggaaagtttcttctcctatctgacatctggattataactataaatcaacctaacccaataggtgctagattgtatgtttgattaattggcataaatgttcaaactacaaatcgaaatttaaactattctttgaataagtttatcattttttaaaaaactatttaggtataagatctaatgtaaccaaaagactaactgattggctgactgaaggactaacatcatgaatgttgagagcctaactataaaatttcagctaaaggcaaataggaggaagtgaactctattttctattttttgtgcatagagcttagttcatacagctcagtctttcaagccaatcaactaattcacaagagaataaagttcttacccaagaatacagaactttgttcctgtagcacaccataaccacctaagccttacatttaatgtaacgttttcttttataaagtaatcctaaaatccattattagaaaataaccatatattttcttttgttctacataatcattatttgttatgtggtgcttattttcttagtactacctactgtaactaattttcacagaaagaaaaagtaaaaagtcttacactgtttatttttttcattttgttatttttgtttgtttggtttttgtctaagcatggaagaccagtttatcctagtagtacaagaaggcagaaatggtttccgttcagcaaatccacaccagcaatcctcttacagcaaatttccaagaaacatggttggataacagtgctggacctaaaaaaggtgttggcccacgagtgcctctctctccctgcctgagctccctgaccagcatgcgtgtggcctccaggtgtgttgtctaccccccaggacctgccaagcacggtggctcatgcctgtaatcccagcactttgggaggccgaggagggaagatcacgagctcaagatatcaagaccatcctggccaacatggtgaaaccctgtctctactaaaaatacaaaaattagctgggcgtggtggtgcatgcctgtagtcccagctactcgggaggctgaggcagcagaatcgcttgaacctgggaggtgcaggttgcaacacactactaactccagcctgggcgacagagcaagactgtctaaaaaaaataaaaaaagaaaaacacatgagacaaagtagcaaatgtaaaaagtcacgtttgttcatttttgcttgccaagataatttcacaaagccgctgactctgggacgtgcagatctctgaaaagacgctttgaagacaaaaaaggatagatcacaagacccccccatgtctcttgcctgaatcactgtattctttaaaagataaatgacgctattccttgcctcttcctacacgagataatgtctgatagggttagtgattgtacctctgtattctataacctttatacccagaccttcatgtgattctgcattaatgtaacttctgagcaagtttgatgtgattttgcatgta

SEQ ID NO: 477247 - DNA, 920 bp, Homo sapiens
aagcatccagcacgggaaaaagaaggaagccagaagattcattaagcaaagttatcccatcttcttctgcatgctttgttctagcctggttggcaacccaaggagagggaacaaaacggccttgttcctttggatccataaaatctccctgaagtcagacccaagttgctggactaactccaggggcagtggcttttgtcctttgaccctgcccctctcctgccagccctcggagtctccccataataccaaaccctcccccgacataagactcctgcttcaaggtaaaaatacttattttcaagtgagatatcaagaactcggtttccctggtaactcgggcagggaaagagaatttaagatgatcagaaatattcattctgaccagctagatccattctcctccttactcctaaggctttatctgcaacacaaggcagggtcccaagcctctccaagtcactatacatttaaagttaaacgaaaagtgaagtctgccactaagtttagctctcctgctgaaatccttgggagattattacttccttctggctatatcagccccccttttcccatacctatcagacggctttgaagttttacttcatttgaaatactgtacagatgttcatttaatagagttgactacttgtagaagatgaagaaaaaaatgtctgaaaaaaatcttgactttcttccctgtggaggaagctaagatctcccacagtcatgaaggaaatgggttgcatggctctctaccttcttaggtctttcctgaaatgtcaccttttctgtgacatcttttccggcttttctacttaaaattttactcatcctttcccacccttcctctccaacacaaaatataaatgtattccctatttcctttctctgccttatttttcttcaaagcacttatc

SEQ ID NO: 477248 - DNA, 908 bp, Homo sapiens
cgatagactagttgaaaacatagtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcccatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgtagcaagtaatactatccaacctactccacagactatacctgccattgatcccgcacttttcaatacaatttcccaggaaggaagaatagttaattatatatgcttagtctaccatctagaaccagaaccctagaattctttatctaaactgtcaggcaggtgttagggcaaaataatttttaaatatgtaagaactctcacattttgcctagcacataccttttttaaggaacttaactcaggatgtactccatcaagataagggtggtaatcaagcaaaatagaaatatgaaatat

SEQ ID NO: 477249 - DNA, 599 bp, Homo sapiens
agattgacaaacatgaacttttgcaaagcagaaacgtttagtccattgcaagcagccaaagtaaatattaaatatattaaatttaaatttattaggcttatatatagtataacttacatagtttatgtagtatttatgtatgtatgggccatgcagaagaaaaatgtggagttggagctcccacacagagtccctactgaggaactgcctagtgaagctgtgagaagagggccaccatcctccagaccccagaatagtagatccactgacagcttgcactgtgtgcctggaaaagcttcagacactcaatgccagcccatggaagcatccaggagaggagctataccactataccctgcaaagccacaggggtggagctgcccaaggctgtgggagcccgcctcttgcaccagcatgacctggatgacgtgagatttgggagggggtggttggaatgatatggtttggctgtgtcttcaccaaaatctcatcctgcatggcagctcccttaattcccacatgtcatgggagggagctggtgagagataattgaatcacggaggggggtctttcctttgctgtacttgtgatagtgaata

SEQ ID NO: 477250 - DNA, 538 bp, Homo sapiens
cgtaattattagtaaaatgtctctcccgtgacacatggggattatgggaactacaattcaagatgagaattgggtggggacacagccaaaccacatcaccaagacctggaaggttgcaggtctaccaaacattggtattaaaatctaccaaacatttaatagagcagtcattaagaagctagtgaccagggctcagaacttgccccaggctacaagtctcataactgagaagcaagccaactcgcagttccttggctgttccacagagcttacagaggaaatccacatcattcaaagggtctgtgaattcttttggctttcctggtatgtttctgcagtagttcctggagtaaaagttcacgaccatgcaagcaccaaggaaagaccatgtgaggacgtaaggagaagacagctgcaaactaggaagagacccctcaccagatctgctggcatcttgatcttggacttcccagactccagaactgcaagaagtaatgatctattaattaagtcacccagtctataaaattttgttgta

SEQ ID NO: 477251 - DNA, 652 bp, Homo sapiens
gaaaggaaagtggaattgggccatgaccccatttgaaaatgttcatgctgttctcactacaatctttatgggccacttatcatgtccaagaccctcaaggcaagacctctatgagtctgcaaaaatcacagcattactgggcttggggtgtcccttaaataaaaacagcttagatctcaataccaagtctttgcaaatatctgaaaagcctttccaaaaaggacaggcacacgtggcaagctggcggtggatctaccattccggggtcaggagtatggtggtcctcttctcacagttcatactaggcagtgccccagaagagaatctgtatgtggactctgaccccacatctcccttctgcactgccctagcagaggttctccatgagggccctgcccctgcagcaaacttctgcctgggcatccaggtacttaaccgagagcaatgaggacacatgttcatgtaaaacctgtatgccaatatttagagctgctctattgataatatcacatactagaaataacatgaactggtggattggccaataacacttagttttgcccttttaagtatattttttagatcttgtaggtgtgtttcattttttaaaaatctttttcattttgtctcttctgaatgtatattttcaaat

SEQ ID NO: 477252 - DNA, 897 bp, Homo sapiens
tagtatctgggccggagtgcactgttcctcacagcacagtccctcacggcttcccttggctaggggatggagttccctgatgccttgcacttcccgtcatggaggaaggcaaaggagaagcaaagtcatgtcttgcatggaagcaggcaagagagagaaaaagagcacatgtgcaggggaactcccctttatgaaagcatcagatcttctgagacttactgtcacaagagccacatgggaaagacctaccttcatgattctattacctcccaccaggtccctcccacaacacacaggaattataggagctacaattcaagatgttatttgggtggggacgcagccaaaccatataattccatctctggctcctctgaaatctcatgccctcatatttcaaaaccaaccatactttcccaacagtctcccaaagtcttaactcatttcggcattaactcaaaagtccagagtccaaagtctcatctgagacaagacaagtccatctgcctatgagcctgtaaaatcaaaaaatggttcataagaaagaaatacatattcaatgcagtcatgattttgtttcatttcctattatgtctgcatttggatctaaaaatattaatgttattctatattcaaaatcttcagtaaatgatgagagaattctcatttccatgcattatttgtacatggaaatatattgaaaattatttttaaaaccaggcattaagttgaaggaaatggaaatggaaattagcagactaaaggaaaagagaaacccaaaaccaggaagacatccaggaatgaaatctttctttagttagacatctaaagcattcattcactcatccatcatttagtcattcatatagtcatatattttttcaataaatacttatt

SEQ ID NO: 477253 - DNA, 986 bp, Homo sapiens
aggaaaaggactttcacaaggtaatgtcatcacttaaggcaaggaccggccatttacacttcttttgtgttacatcaggccatctggggatatacgtgcaagtcacaggggatgctggtggcttggcttgggctcagaggcctgacaccctgccccacttcttatttgatgaaaataaggttgcatatcatatctgcagctctcttggggaagaaaacacatgcacaaatcctggtgttaggaatattttaagcacatatcttcgatattattcatccaggaccgaaactttgacagcattgctgcaatggctcattgctgacaaatcaattggtattcaaacatccaggaagcaaccagctacaaaagctgctaaaagtgtgccctctgctggaatggtggaggaacctcattctcgtttggtagttgggtgctttctgaaatctaatacaagaattccactgactaataaactttacttctgggatctggtgcaaaaacattgcttgggttttatagtcatgcttgtagaacactattgttggagctccacacaagaggaagaaaaaatagtgggaacagatgatcctgaagggaaagtgaagaagctgcttctggtgcaggtttggaacggaccttgatccatttggagaagtggtttaagaggattgggatggggaaaaatggttcatctctgtattccttctcatccttcccacctcacccccctccacctttttaaagcttttctttggttaaagccacttttaaaatttagtcattgagatttcataagctttgtcttgggagaacattccctgggggaaataggagttacctagtcatcatttaatctcaaaatctcattcataattttattataagggatggtgccaaagtaaatgacctctgtaggctaaatttactttactgaaattagtttgaatgtgtaaacaagttggtatcactactgaacttaatttaac

SEQ ID NO: 477254 - DNA, 574 bp, Homo sapiens
cctcacaatcatggtggaagacaagcaggaactcgcaatgcaagctatgaaaacagctgaagcagggagctgtaccctgcaaagccacagggttggagctgcccaaggctgtggaagcccacctcatgcatcagctgaggtgggcatgattagatttcagacttgcatggggcctgtagcccctttgttttggtcaatttctcccatttgcagtgagtgtgtttatccaatgccggtactctcattgtatctaggaaaggatgacccaaaacagggaattgtgaaatcaagtttagccaaaagctgtttccttatatattttaaggttgacataaaggtttctctgtacctagtgaactatcacctgaatagaagtgtaaacagactggaacctgctcttgtgctaatcattgagactggtccaatcaaagaggcccaattattcaaaccatgttcaaataaggcaaatgctgatctataaccaatctggttgtttctttccttcacttctgttttctgtatatcacttttctttttctgtccatataattacttgctgattttcatggttggt

SEQ ID NO: 477255 - DNA, 780 bp, Homo sapiens
agatcaatgtacagaacatttgcataatgtcagaaaacatccttgtgttccttcccaatgaaaactttccagccccattcccactggaagaaaatactattctgcttcctgtcaatatagcggaggaaggaaccttagcagtgattgtggccaagggtcttttactggagctctaccccagagagatgcagacctgcaggttccccagtcgggatgtatgtttggggcagatgatctccctttcccacttccacagtttgggcactcatagtatttggggtgtcttcagggtcctacaggagcaatccacttccttcagaggatctgtggttccctcagttttcctaatatattcctacagtcgttctggagcaaaagttcatgaggcaagcctccacatgctgcatgttgtccgagccttctctggatgagagaagccccaccagttactaaataaacagtgggtgagaggaagcaagacagaaagcaggatcccagaaaggacatgatgtggaccgacctaagatttggggatggagaggaatagatttacttaagtgggaagtcactgagttcctattattaagcatgtgggggttatctagtcaacagtgcttttgtgtcttgatgtgagtcctcagagaaagggccttgctcattctatgtaccacagagggcttagcatatttttggcactcattaaatgttaacatcaacaagaggatcatgaagaatgattacacaagagggaagtaaacagaaaggcaagagttggcaagc

SEQ ID NO: 477256 - DNA, 932 bp, Homo sapiens
cggcgggcaacaccctcagagtccctgtatataataacctaaacaaagaaaaatgatccttaaagttaactgtcagactatccagacaatgttcctgctacaacgacacgatggataccaacccgtctctcaagagtacccccaaaattaagtttttctttttccaagatgctcatgccaccccctacgtcacgactgaaaagcaggaagagagccgctgggaagacacctaccctggatggaagacacgtacccctgaagatcgagaaagaagccgtctggatattcatcactcggatataaccaatatcgatccacaaaaagatgactgctttaacccactcacaatcatcctctgctccaggccctttctgttggactctcagatccatgctcttcaagagcactgggtgccccaagggacctgcctccatgtctacatcaaagactcccttgtcacctggcttctgttggttcagccacaggaggcactggcaggaagtcagggtgagaaagaagactacggccaggcaaacctcagtaacaactactatatcttctttagttaacttttctcctatcccctttgccccttagctctaaggttgaaatcttcattgtcctcattatccaagaggtgttgcctctttcatctttctaccttttattcatatatctaatcaattactggtccctacattcttattgatgaaaagttcttcaaaatagctaccatattattgctgataaaggctacaatataagaagactgtttcatttttaagaggcaatcagccagtgtgccattctgaaaactgtcaagaacagcattccagaatcttttaaaaataaatattagctgccaggataataatatgcatgtgacatattgataaaataaaataatttaaaatgaatattaaggtttttta

SEQ ID NO: 477257 - DNA, 615 bp, Homo sapiens
tgccaatttgtcccctcaggagtgataccagtctctgcggggaccatgaggctagccggagcttgggggaacatcctcttgggagtgagaaggcggtctagagtgagagccaacattgtggcagggaaagcagtgcccgtgagcaaagggcaatgcaaggagaggaccagaggatgtatagccagagataaggaaggttttctgcactgttcagagtttttagatagaccactggaattttgcacaagatacagagcctgcagtcctaggcagaacagacaggaagctgttcttaaggtgtcatcagccactggaattgtttgtcaggacctgggaaacttagatagtcgagattgctttgtgcacctgatagaggctgctgtgtctgaatggcgcctgattgggctcccagcttccacgtttgcacaccctggagaacattgtctacagggtagccagaaggatcttttaacatcctgttattactttgtgaaaggcaagaaagaatcttgaaatgatggattggaattggaggtactgatgtggattcatgatttgtaaaatgtgtgtttgtgtatacatttgtatctacatgcatgtaaaatgtgaacacac

SEQ ID NO: 477258 - DNA, 592 bp, Homo sapiens
gtctgttcaggtcagttgagttgagattgccgaatacttcaaatggattgtgcattaggaaaattaaaatggcactaacacgtagagaattgtacagcaggggctgccgatctacagtgaatggatcccttggaccctaccaaagatcactcctcacacctggggcacacaaggaaaggagcgagggactgacaggaacatccgtcagcttctgcaaggtctcaaaaagatcatcacccacagaggcagatgtctcaaggaaagactgtcctttgaatcgatgctgggaaggttgtgtgagtggaaagggggatgaagagagtctggtcaaagggtacaaattacggttggataaaagaagaaagctatggggcacaggcagctgtcagaataatccattcagatcagactcccaagtcagagaacgggtgggagggaggtggaaagtggattggaggggcaaaaggagatctctgacacatgctgatactatacaaatctagaatttattttctctcattattatgttcacttatggtaacaggtgtttacaaatcagagtagtagctttataaacatgcattagacaaga

SEQ ID NO: 477259 - DNA, 694 bp, Homo sapiens
ctgcatcgtctcccttcagccgccatcatgattatctaccgcgacctcatcagccacgatgagatgttttccgacatctacaagatctgggagatcatggacgggctgtacctggaggtggaggggaagatgcagtgtgagagcagactaatacactatgcttgggtaggacccaactggagccattatgagctgacccctgctactcaaaacaatcttttaccaatggtgagaatgagagcagtcgtgcacttgaaggaagatgagtctagcttggatgccatctgcccagggacgttgcctactcatgctaacagcacgtgggaatcttgggtgatgttgacactctgtcggctccttatcagtcaaactaaagagggctgccagagtcataagcagtcaaccatctctccacaaaggtttgacaattatcaggataaggcccaagcagcagtcgacctgcagggtcagcttcagcagggagagaacttgcagctccaagcaagggcagtttagggtcctccattctctccttggtcttcaacgcttgtaggaaaagaagacccttgctgttactgttctgcacaatccacaggctgttagacatttttgtattgaactgaccgttctcctgcatgatctgcttcttcccaagcagtctttctccagtcccatgtcccctcccctcaccaag

SEQ ID NO: 477260 - DNA, 622 bp, Homo sapiens
tttgtcaaagatctggtagttatgctgacaaagcaatgtggggggtggccatgggcccagaggaagctacagtgcagggaaggagtgggtagactgatgtgtggccatggagaccaccccactgcagctctccactagtcaggcatggtccaccagtgcaaaagctatagagtgggcccccagggcacccgaggctgccctgcaagcagacattgccaggttggggttccagaagggaccagaagaccaaggattattcaggtcagaccagtccagtctaatgggcaagaccaccctgcagagttcaagtctgacagttcccctaggactaaagtctcctgtgggagctagtggggcctacagagatggctatccctggctgtgctccaccacagatgctccctcaccaaacactctgggctgcgcatcagctggctgcccctaccagttctctaagcagctctccttgccaattcaggcgtccatggtggttgaggggtctctaacctgctgggattccagaggctgtgacaaaagcaggttgctccttaccagttcagctcacccattaccccagagttgctgggggccagaaacgagccctgatgcttggtagcctcat

SEQ ID NO: 477261 - DNA, 1954 bp, Homo sapiens
gttctgctttccttttaaatgtgcagtgccacaggtcaatctcagactgctgcactagcagtgagcaaggctccatgggcatgggacctgttgagccaggcatgggagagtatctcctggtctgccggttgctaagactgtgggaaaagtgcagtatttcatcagaagtacgctgtttctccaggactgaattcttcccttcaatgcagaagtttcctttttgccttggggtgtgtctagaaatggtatctatgagcttgaccctggaacaggggcctcacgactctgctgggtgctctgtcatactgtggctgagctgctatccaaaatgcaagacaaagttttctctaatctttgatcttaagcagaaggaaggggtcaccttcattgctatgagctgtactgcctgtgattgggggatgagtggctcaagcactcccttagctgccctagctggtgtctccctaggtcaaatacaaccctagtttactggctctgagcccatcccagcactaggagtttcctaggagttgcagtttttgtgtcctagactgcctttcaagtttacctagaaccccagagcacttcggcccatggtggcaaagctgccaagaaactcaagttttgacctctgggatgggcacattcccctctggctaggtgtggtccaaatgcttgcttcatgcatgggtgctggctgaacccagcatggctttgctctctgctgtgagagggcatccctgagttcaatgtaaagtgctcctgtcactgtgttgtcccttccccaactgcctagattctgtgctgcatggctgctgctggaggatgaagaaggggtggcatcagcaattcaaggctgtctgctaccctcttcaatgcctctttcagtgatatgaagttaaaccaggtactgcgtgtgttcacctgatttttggttcttgtgatggtgcttttctttgtacagatagttgtcaaaatttggtgttcctgccaagggaaaaaatggtgtaggcttcaattctttcctcttactccattctccaatgctttttaattgttaaattaataccttatcatcttttgtgtctttaaaaatctcttaagttatggaaataaagttctcctctttacttatttttcacaggtgaatactgaagcttcaaaagaaagaacatagacaagatttctacatcttttacactggttattgtataaaatgaaagagaattcatgctgaatacatattgactcctggtaagcatcactttattttcctaattgctcatggagtcttttattcataggagtaatagtactagcaatactactaataatgacaaacacaatttttggcgcttactatgtgccaggcattattaatccatagaatttttgcaactatcctataaagtagttaccattattcttatttacagacaaagaaaatgaagcacacatatgttaagaaatatgacaaggttatgcatctattaagcggttaatttaggatttcaactcatgttgtctggtaccactacactatatatcactgcattctcaccttttatttataatgaattttataatttagaatcaactttttcatgcaattatgtgacattgccatatgatgatactgcatttggatttaagtctttgtcttctggttttaatgcatattttgaaagctggaagaagagctaaaatactttgtttaaaaatttgtcaagatatggagaatttattacatgctatctgggttctgagagaaacttagggtctccttattggttattatactagaaatcaatttatatttactgctatcatgacattgaattcaacttcattgaaatgccaagcaggaagatttttgcctcttgcttttttatgaagcaggagtttacacaattttatgtgattgatactcatcagcagtaagagagcctgaaga

SEQ ID NO: 477262 - DNA, 1152 bp, Homo sapiens
ttcctctagagtttggaaactctctctatgccctgcccccagaggtggagtctccagaggcaggcaggcttagttgagctgcggtgggctccacccagttcgagcttcctggtggctttgtttacctactcaagcctcagaaatggaggatgcccctcccccagccaggcttgcggccttgaaattcgatctcggactagcagtgagcaaggctctgtggccgtgggacccactgagccaggcacaggatataatctcctggtgtgctgtttgctacaaccgtttgaaaagcacagtgtttagttggcagtgtcccaatttttccggtacagtctgtcatggcttcccttggctaggaaagggaaatccgctgacctcttccacttcctgggtgcaagccacttttacacccatggcagtgcctgccaaggtcaccaggacttggggatgcaaggacagaagagggaaagaggatgctcctccctctctccctcatgtacccattatctgcaaggaagagaagggaaccagagatacctgctcccctttttctagatgggtagccattcatcttcagtctgtaattgtgtctccatcctataggtcactcccctcagatgcatcctccaaactagaaagcgctaatttcccaaaccataaactggttggcttaagattgggctcaggtgaagggaacccagaagcccaacatgtcggcaaaaggggcatcaaactccaaactctcatgcaactggagcctctgatgatgcccctttctgctgggaacccttaaataggcctctgagaaagctctgactaccatttccccaaaacttattataaatattactgagatatatattcttattcttataactttgtgcatttcactgattatttcttaggatgaaagggaatatgaaatatttaaaaaaaggttttagtaaactttgttaaaatctcccccccagttttagatgtatttatactcagttctgctttatgttaaataaacttttctctgaatgcttgcttctgaacaaagacttctctcattgttgttaaaatttgctaatttgacaatcaaaatttggcatcctgttttataatttatagttatttaatacatagtattgaatacagttacgcacc

SEQ ID NO: 477263 - DNA, 567 bp, Homo sapiens
cggcttaggaggaatcctgggctgcaggcattccttggcctggtggtttatcaaagatcagatggttgtagatgtgtggtgttatttctcaggcctctgttctgttccattggtctatatatctgttttctatcaatactatgctgttttgcttgcatcttgcacctggaaaagctgcagacattcagcaacaatctgtgggagaagccaaaggaactgcatcccacaatgccacaggggcagagctgcctaaggtcttgggagcccattccttgcaccagtgtgccctgtatgtgggtcatggagtcaaaagacattattttggagctttaagaagacaaatcgaaaaggatcctaagcagcttgtggtcagtcagcgtagctggagagaggaaagtaaagtaatttttgagaacacttggatagtaagttgtaaagccacgaatggaatcctgatctatctgactccaaaatccaagcttgtaacaactatgttctcatttgacaaactaatacatggaagcactcaataaatattctattcagttaatcattcaacaattatgt

SEQ ID NO: 477264 - DNA, 673 bp, Homo sapiens
actagagctgtgagaagagggttaccatcctctggatcccagaatgatagctccattgacagcttgcattgtatgcctggaaaagccacagacactctttccgctgtccaaggacagctgcagtgtgttatcagctcagtgggccccttgccatgtggcatggggtggctgccctccaccattgagggcaaagggccaatgtgacagcctcttttgggtacccacaatttgtgggccccaagctcttgtccggcatgcaagaagaacgaggttgcccggatacttgaaggataatttaacggtcattagggcacacatggctaccaaagaatttgatgataggtctgagctcattaagctacttggatttttgttgaccagggaaaatgtagttgcaaataaattctgtcatggagagatccgttcttccaaagatttgtgtcctactataacttttctataatgttcccagaaacttaaaatggaatataacaacatgtgttgccggtctgaaataattaaattgtttttagatcattctgataactggtgaaaagcagaatgttaaataagctgtgttcattttcattcaaacatcatgtccaataagtattcttcctacacttaaattcttacccaaatgggttaagatttattttggagatagaaaaga

SEQ ID NO: 477265 - DNA, 750 bp, Homo sapiens
cttctcaatggcatatgccagtcaaactttcaaaattcaaagacaaaaagagaaaaacagcaagagaaaagtctgtagtcatttataagggaagccccatcagactatcagtgaattcttcagcagaaattcagggcagcacaaaccatcacccccagggcacagatgaagatgaagctagggaaggactaggagatgaaaggcagctgaacttcgttttcctctgtgatagaaactttgatattgccatcagacctggtatgagtcacagttgggtacaccagggagcagcccataaaggccctgctggtaagaacagcaacgaggaagatgctagtacaactctcaatttggtaatggcaagaggagagtgttgctacctctgctacacagaaggttttgtgcagggaatggggagtaagccccatggggtggtaagccccacagttcccacacacttagcaaggcagatctactcccacagtgttctaccggcaacagtgaactgagttgaaacaaatttgcacatatttattagagtaccctaataggctaaccctcaaatagcatttgctttattaacaaaatgtttaatcaataaaaagaagcagttgatgggaagtactgagggttgctcttagaggtattcttgaatagctctcaggtgtgggacaacagaaaacatgagaagtttttttttctttttttaatttatttgacttctgtattagtctgttctcacattgctat

SEQ ID NO: 477266 - DNA, 596 bp, Homo sapiens
ggaaagggaattccctgaccccttgcacttcttgggtgaggcaatgcctcgctttgctttggctcacactcagtgcgctgcacccactgtcctgcacccactttccgacactcgccatttaaaatatcccaacaaagaaaactctagacttcgagggtttcactatcaaattctaccaaaatttaagaaagaaatattaccatttatatataatctattccaaaaattggaagacagagcacttgacaactcattttatgaggccaggattactattattaaaaaaaaaaaaaacagcttgcctactggtggtgactttcgatgtcttcagctttatgtgggtgcctcagctttaaaatttcacattgtacagctaacagcttttgtcttctaccttgtgttgaggcggtcagctttttataatggacatgtatcatttcatgccactgaacatgtcaaattatctcctctggttattctcgtttctttatctgggtgattatagagctgtagtgcataccgtaaagtagaacagatatttagcggtgcctggaatgccaaagtagcaacttagtgtgattctctgtaatggtact

SEQ ID NO: 477267 - DNA, 683 bp, Homo sapiens
atcaatgggtttaattttatgggatacgtttcctcccagttggaggctcaggaacctaagagttctgaaagtacattaacttcgatggaagattctggatgtgatttgtcgaatgagcagagaactgaatcctcagacctgtcccagcactttgtggaaagctgtacccccactcactttccaccactgcctcttgtgaaaagaccttgtgctatcctgcaaaatcctttgtcttctcacatgcaattcttgcaatatctacttgaattaaagaacttgacagaatcaggtaatcttaaaagagacttaacccactttgaaaaagactcttccacagtctctgattctgtttttcaattgctggatggcctgatcactttttaccgtaatcccaaacttcctttttcaagattttggacagaagctgttggtactttagctagtctgatcagtgactataacttatctagtcatattcttaaaaagtgttccaagaagttggaagaatttgagaaaaccctactacatgctattttaggaaacaatcatataaatcagttttggtaagttgcatatttttaggaatttatccatttcttataagtcatccagattgttggcatataattgttcataatacttcccttatgatccattttatgtctaaaccatccattgtaata

SEQ ID NO: 477268 - DNA, 3037 bp, Homo sapiens
gaggacaagtcgacgagagatcccgagtacgtctacagtcagccttacgggtgataatggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagtatttcagtttctgatgcccctggaagcggtataatagattgtaatgaaaagacaaggaaaaaatcccagaaagaaaccgaaagtttacattgcgaatatgtagcagagccggtaatggctcagtcaacgcaaaatgttgactataatcaattacaggaggtgatatatcctgaaacgttaaaattagaaggaaaaggtccagaattagtggggccatcagagtctaaaccacgaggcacaagtcctcttccagcaggtcaggtgcctgtaacattacaacctcaaaagcaggttaaagaaaataagacccaaccgccagtagcctatcaatactggcctccggctgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatactaaaagatatgaaagagggagtaaaacagtatggacccaactccccttatatgaggacattattagattccattgctcatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgccgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgggagcccccacaaaaaatccctacaggggtatatggccccctgcctgaggggactgtaggactaatcttgggaagatcaagtctaaatctaaaaggagttcaaattcatactagtgtggttgattcagactataaaggcgaaattcagttggttattagctcttcagttccttggagtgccagtccaggagacaggattgctcaattattactcctgccatatattaagggtggaaatagtgaaataaaaagaataggagggcttggaagcactgatccaacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtatggagattttacattgcttagggccagataatcaagaaagtactgttcagccaatgattacttcaattcctcttaatctgtggggtcgagatttattacaacaatggggtgcggaaatcaccatgcccgctccattatatagccccacgagtcaaaaaatcatgaccaagaggggatatataccaggaaagggactagggaaaaatgaagatggcattaaaattccatttgaggctaaaataaatcaaaaaagagaaggaatagggtatcctttttaggggcggccactatagagcctcctaaacccataccattaacttggaaaacagaaaaaccggtgtgggtaaatcagtggccgctaccaaaacaaaaactggaggctttacatttattagcaaatgaacagttagaaaagggtcatattgagccttcgttctcaccttggaattctcctgtgtttgtaattcagaagaaatcaggcaaatggcgtatgttaactgacttaagggctgtaaacgcc

SEQ ID NO: 477269 - DNA, 2173 bp, Homo sapiens
cagggccgaaagaacgagagaaaatcagcttcctgtttggatacccactagacctttgaagttctacaatgaacccatcagagatgcaaagaaaagcacctccgcggagacggagacaccgcaatcgagcaccgttgactcacaagatgaacaaaatggtgacgtcagaagaacagatgaagttgccatccaccaagaaggcagagccgccgacttgggcacaactaaagaagctgacgcagttagctacaaaatatctagagaacacaaaggtgacacaaaccccagagagtatgctgcttgcagccttgatgattgtatcaatggtggtaagtctccctatgcctgcaggagcagctgcagctaactataccaactgggcctatgtgcctttcccgcccttaattcgggcagtcacatggatggataatcctatagaagtatatgttaatgatagtgtatgggtacctggccccatagatgatcgctgccctgccaaacctgaggaagaagggatgatgataaatatttccattgggtatcgttatcctatttgcctagggagagcaccaggatgtttaatgcctgcagtccaaaattggttggtagaagtacctattgtcagtcccatctgtagattcacttatcacatggtaagcgggatgtcactcaggccacgggtaaattatttacaagacttttcttatcaaagatcactaaaatttagacctaaagggaaaccttgccccaaggaaattcccaaagaatcaaaaaatacagaagttttagtttgggaagaatgtgtggccaatagtgcggtgatattacaaaacaatgaatttggaactattatagattggacacctcaaggtcaattctaccacaattgctcaggacaaactcagtcgtgtccaagtgcacaagtgagtccagctgttgatagcgacttaacagaaagtttagacaaacataagcataaaaaattgcagtctttctacccttgggaatggggagaaaaaggaatctctaccccaagaccaaaaataataagtcctgtttctggtcctgaacatccagaattatggaggcttactgtggcctcacaccacattagaatttggtctggaaatcaaactttagaaacaagagatcgtaagccattttatactgtcgacctaaattccagtctaacacttcctttacaaagttgcgtaaagcccccttatatgctagttgtaggaaatatagttattaaaccagactcccagactataacctgtgaaaattgtagattgcttacttgcattgattcaacttttaattggcaacaccgtattctgctggtgagagcaagagagggcgtgtggatccctgtgtccatggaccgaccatgggaggcctcaccatccatccatattttgactgaagtattaaaaggtgttttaaatagatccaaaagattcatttttactttaattgcagtgattatgggattaattgcagtcacagctacggctgctgtagcaggagttgcattgcactcttctgttcagtcagtaaactttgttaatgatgggcaaaaaaattctacaagattgtggaattcacaatctagtattgatcaaaaattggcaaatcaaattaatgatcttagacaaactgtcatttggatgggagacagactcatgagcttagaacatcgtttccagttacaatgtgactggaatacgtcagatttttgtattacaccccaaatttataatgagtctgagcatcactgggacatggttagacgccatctacagggaagagaagataatctcactttagacatttccaaattaaaagaacaaattttcgaagcatcaaaagcccatttaaatttggtgccaggaactgaggcaattgcaggagttgctgatggcctcgcaaatcttaaccctgtcacttgggttaagaccattggaagtactacgattataaatctcatattaatccttgtgtgcctgttttgtctgttgttagtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagt

SEQ ID NO: 477270 - DNA, 775 bp, Homo sapiens
ctctgtctgaggtcacatagctggtgggtcctacaggacacaatctgcaagaaggcgttatcaaagtacaggtccatgcattttattgcccctgaagaccttccggtgggacaagatgtggaggttgaagacattgatattgatgttcttgaccctgtaaaaggcattcagaggaagggatatggaaatggactgtggaaatggctgaagtcaatgggctcagtggaatttgggaaagctgatcaggaagctgttgttgaatcaatggtgtattttacagttgaagatgtctcagaattgcagaggatggatgttcaaaaatggtatttgagaacttcaaagctggctctggccttggcaattatccgctcaaaaccagcagacaaaagcagcagagaatacacagagcaccttgctatgttgctgtctgaggagcagtcaaaatggagatcaaaagttgaaatcttggaagctgaagttatgcaattacgtcaaaaacttcttgtgagcaggctttgttcaggatcctttaagagtgatttagataaatggagtaactgttaaaggggagagaaaaaatatacaaaaggggagcatacactgacaggaaaataaaggaagaacatggcagttatgtaaggatgacatgaaatagtgataatccttgctctaagaaaactccatacctgaaaatcaaaactatattaaagtgtatttatattattacatattttttctagaattttcagtgttgttttatatgtgcaactgtcgt

SEQ ID NO: 477271 - DNA, 604 bp, Homo sapiens
gagcttgctcgtctgaaagtcttcagatgaactctttcaaccaactgacaatcagaaaacctttcaatccactgagccagcagaagggagaagcatctggatgtcagggactacagctggaccttagagagagaagtggcttgacttcagagaaacaacttgatgggataacttcagagaagaatccagccagagacagccgaacttcaggaggagattacctacccaccccaccccctttccagcactccttcccactaaaagccactttcacttgcaataaaatcccccacacttactatccttcgattcgttcgtgtgacctcatttttcctgggcgctggacaagagcttgggagccaccagtgcggataaaaaaggctgccacgctggccctttgcccttgctgggtagagggcagccgccttgcgtgaaaaggcaaagggcttttcactgaaaagccatccaacttaggttagccttaccatacatgtataactttgctattatgtctatatttttagttttcaaatccatacagagcacaaaatctgtggctaggcattgttataagcactttacacatgctaatacatttaataat

SEQ ID NO: 477272 - DNA, 719 bp, Homo sapiens
atcagttaaagcctttgtaattgaccacagccagacctgaaaaatcgcacatagattttaaccggaagccaaactcctcatagataaggcttctaaagtcagctccttgatctgtcatggcactaggaaactctctggcctgtttcctgtctctcccagctagattcctaactgttggattaaggatttataatcctttggaggagaagaggtgttatggtttctggaattttcagcctttttgtgctggtttttcctcatcttcatggatttatctacctttggtctttgctgttggtgacctttcgatggagtttttgcatggtctcctttttgttgatgtcgatgctactgctgtagcaaaggctgcagaacagcaaagactgctgcttgctccttcctctggaagctttgtcccagaggggcacctgccagatgccagccagagctttcctggagatgaaagttttgtctataagctgctgactggggctgctgcctttctttcagagatgtcctgcgcggaaaggaggaatctagagagccagtccggctaccatgactttgtggtgtggtggtgggctctgctcagtcaaaacttccaagtggctttgtttacactgtgaggggaaaactgcctactcaagcctcaataatggcagacacccccacaacccccgaccaagcttgagcatttcaggttaacttcagactgctgc

SEQ ID NO: 477273 - DNA, 556 bp, Homo sapiens
aaggaaaactggatctgagggatccagaggaagatgacagcagaagtcaaggggcacagcgtaggatactttaacatattcagttcttgttttataaaaaaagcactctttgtacaaatagcaaagacatgttggtcagatcaattgaccaaaataaaacgtacatttacatattatcagttcttaaaagaaaacaatcaagcatcagttaaaaataaatatcaaagaatagaggtacccggaaatacagaaggcctttatctgtttttgaatcccctcctggaaatagctggcactgtggacttcaaagctccgggagagctttccattgttttagccctggactcacctcttcataatttaaaccttggaacctccatttgtcctggagttagttatcatattagaccaagtaacagattcctagcttttcagctcaacagaatttcactacgcttacctgaaaaatgactaggttatgtttactttatgtgactgattaagaactttgaatcagaaattagactgattaataaaaaataaagttacctgtaat

SEQ ID NO: 477274 - DNA, 1443 bp, Homo sapiens
aatcaatgtgtcagcagcctcctgcaacactttcccagcaggtaatgttacgaggtgatgttgcaaattcaggctttccactgatggtagtgacggaggagtgggaagcttctctgcaaggagaggagaaagtggaatgcacatcccataccccaacgtctgcagctgcatttcaagatactggcttctatcacactacactcaaggggaagaagatgcaagtggctggtcatggagaggactttttgacgagcgccggcaaaagagcacagcgaagaaatcccaggatacggaaagccctctgtacttgcaacaagggcaaggagggggatcctgctggcatccagtgcatgtcagccaaatatgctgttaagctgtctacaatgcagaggatggtcccctacaacaaagaattatatggcccaaagtgtcaacagatctggagtctaatgacagaagattcaattagttcttagattgctagattactgtcaaagggactgatataacgatatatcaactttaacataaacatgtagaatttgggtccagtggtttttcttccacaaactagggcatttgttgtcttaaatgtatgccactttttgcttgctatagttggtggactgagatttgttacatttgatgtaatgatacattctaattattcaaagattaaacatttccctaacctcaaggtggtaaattatgtcagagctaatattaaaaccccaatctgacacataattgcccgttatcttggtagtttataatcaacctttggaactttctctgttatccctccaacctcccagctactcctttcccattcctaaccagcctaccttcagctgtgacttctttcagaatatctgctttcattgttgcactatggatgtcctagggaaagaaaaatataataattcattcagtgaaccgtaacaatctgagagcatgttttgcctaaagtgataaagtgaaaaaagttctgtttttattctattaacataccaaactaatgaaacaatccaaaaaaggcctaggtaataccagccacttgtataggtaaacgtttatatgtgtataatatattgaatcaactgtgtgtttggcttcatgaagaaacagtgacagagcagtaatggaatttggttgtttaatgcataatatacatattgctaatctttttaaattaacatatgcttcaaatgcatatggttgttttagaaatagtacagaaagttcacagttaaagcacatggatggattttactttagttttaattgacattttgcccaaaagcacagaacggtaactatttcaatggtttaatgttacaagattacaaaattcttaaacagttacagtattctacatcaattatttcacattaaatacctgattaaaaaaatcagtgcttgaatgaagcacaagataaacac

SEQ ID NO: 477275 - DNA, 920 bp, Homo sapiens
acgcccccctgaaacatgcccttcagctcactgtgctccaggcagcaagaaggagagaagagctttggcccttctggggttccagaccttggggcttcccaagcctgggctgtgacatactgtaacactgtctttgggggtctaccatcctggagtcttcgagctttggggcatgagcaaacccaagcagaggtgccgccagccacagaagtttctggctgggcagcaagcttcctctggccccagtcaagtccagagatgatgactggcagccaaggattagaatcaaaaaccttagaaatttacctgatattctacgttactgtggctaaactggcattcaaaccacaatacaaggtccttcttgcccttcccttccctttccacaggcagaggaacctctccctgtggccaccacgaccagcagcccatgggagcttctgccatgacactgccgaggttcttcagtcagctcgtggtgaatgccaccaggcctgtgattcacccttcagggaagtgaaatcccctctggtccagggcaggtccagaagtactctctaagaggctatgcctggactcagggacaccaagagcctgcctgttgctctaccccactgtggcttagctggtacctaaggttcaagacaaagtcccctttacctctgcaattgtcaaataggagtctttcacaatcaccacagttgggaatgtgatgggtcatacctgaaataagcatgtctcagagtccaaggtctatggtgtactaggtctatgacgtccaagacctatggtgtatagtccaaggtctatggtgtatcccttaaagtttatttaaagggataataacaaagaacttcccaaaactagacagcaatatcaatatcgaagtacaagaaggttatagaacatcaagcagattt

SEQ ID NO: 477276 - DNA, 872 bp, Homo sapiens
attgctagcacagcattctgagatggaactgcaaggcagcagcaaggctgggggaaggggcacccgctattgctgaggcttgagcaggtaaacaaagcggccaggaagctcgaactgagtggagctcaccgcagcccaaggaggcctgcctgcctctttagactccacctctgggggcagggcatagctgaacaaaaggtgcagaaacttctgcagacttaaatgtccctgtctgacagctttgaagagagtagtggttctcccagcatggagtttgagatctgagaattgacagactgcctcttcgagtgggtccctgattcccaagtagcctaaatgggaggcaccccccagtaggggcagactgacacctcacacggctgggtacccctgtgagatgaaacttccagaggaacgatcaggcaggaacatttgctgttcaacaatattcgctattttgcagcctctgctgctgatacccaggcaaacagggtctggagtagacctccagcaaactccaacacacctgcagctgaggctaaaggaagaagttcaaacccattgcaaagaagctaaaaaccttgggaaaagattagacaaatggctaagtagaataaccagagtagagaagtccttaaatgacctgatggagctgaaaaccacggcacgagaacaacgtgacaaatgcacaagcttcagtagccgattcgatcaactggaaggaagggtatcagtgaatgaagatcaaatgaatgaaatgaagggagaagagaagattagagaaaaaagagtaaaaagaaatgaacaaagcctccaagaaatatggtaatatgtgaaaagaccaaatctacatctgactggtgtacctgaaa

SEQ ID NO: 477277 - DNA, 807 bp, Homo sapiens
agccagactgtggcctgcccggacctgtctttccgtaccagggatggtcaccctcacctacttcaatggaggccaagccatacgacacaaaagatctgtgcccttcagcctctgccctgttgttggggactccaagaatgtgaaagaagagagatataaaagcagcatgagaagcaagaaattgctaagcccattttactttgctgagaatgacggtttccggcttcatccatgtccctgcaaaggacatgaactcatcctgtttaatggctgcatagaattccatgctttccttctaacaggcccctctgctgcaggtctgctggagtttgctggaggtccatgccagaccctgtttgccagggtatcactagcaaaggctgcagaacagctgcctgttccttcctctggaagcttcatcccagagggcacccaccagaggccagttggagcgctcctgtatgaggtgtctcagagctcaagcactgtgctgggagatctgctgctctcttcacagccgccaggcagtgctttgtcccagggagatgagagttttatctataagcccctgactggggctgctgcctttctttcagagatgccctatccagagagaaggaatctagagatacagtctggctacagcgactttgctaagctgcagtgtgctcctcctagttcgaacttcctggtggctttgtttacactgtgtgaggggaaaaccgcctactcaagcctcattaatggtggacgcccctccccctatcaagcttaagcatcccaggtcaactttagacttctgtgctg

SEQ ID NO: 477278 - DNA, 582 bp, Homo sapiens
gaactaatttgcattctcaacaacaatgtccctcttctataggactgctgtggtttgctgggggttcacttcaggccttattcttctggttcactcccatgcctggaaatgtcactcagtgaggctggaggacagcaaaaatgggtgcctgctccttcctctgggatctctgtctttgaggggccccaacctgatgccagtaggaaagctcatgtataggatatctgacaacccctgttgggcgtctcacccagctgggtggcatgggaagcaggacccatttaatgaggtactttggttgtccactggtggagggggtgtgttgtactgggggaaactcactcatctgggctgcccagattcctcagagctagcaggaggaaagagtaagtctgctggtccatggggactatggccacccctctccctagaggctcaggcccagggaaatcagagttctgtccttgagctcctggttggagttggagttctgcagggaggccatgcagcctcagtgttgtctgctgccccgcaccaacatccccccaccgtcaaccgccaaggagctcagatggcttaaac

SEQ ID NO: 477279 - DNA, 848 bp, Homo sapiens
agccacagtgaacgatagatgaatgattggaagagagcctctaaaaggcaaaccccatggaaccatcagaggacctttttagaagcaagtcttcaaagcattcctttagcagagggtgtcagtctcataatagggactcctaaagtccctcacactcgatactcaccctatctgagacttcaaaggggactcttgacccagaggaagaggaggcagaagcaaagttcctgcaaagacaaaaaggcaggaagagcccctgacctgttagccagagatgacacgagctctagctcatgtgaggcagctccgtggggtcaccttgaaaccactttctacagcgaaagaagtcagtgcccttcgcccctaaagagaccctctgaccttcgccagtcctccgctctgattccggctctcatatttctaaaatgataggatacatgtttctgttcattaattccattttagttgtgtttatctgatgttaagcacatttattgagtttttaggtccagtggttatgcattttcttttacttctacaagttttatttacgtttccaaagctttttattatttgcatgtaatgttttgtgtttgtttgatgttttgattcctttctttaactctcattcatcttaaataagattactttatgttctttttcaaactgtcattcaaatacctcaagtttctatgacactaatcccactgttattttgtgtgtggactctaagccatttaaattgtttcttcatatgctttcttataacaagctcatcgttaggtgatatattttgttattgttttaactgagtattttgtgtgacctgaattctagaagtttctttc

SEQ ID NO: 477280 - DNA, 700 bp, Homo sapiens
gaatattgtggcctgaatataccttgtgtgtgaggacaaactcccagcagccataggcctgcatggtgtctgcgtttatgctggagctcagagggaagcagcaggtgtctaataggcctcgaagcaggagaacctcagcagccaacaacagatactccctggaaagcacaggggacccaatttacaacagcttcagaaactgggaaaaggtttacaggaccaaaagatgctcccatcatctaggaaattccaagaaatataggagctctgtgtcagacactcctatcacctcctatcactcagggaatgacaaagatgttaggagctctgtgtcgggaactgggggtcaaagaccaaatattagaacaaaagattctcctagcacccctatctacaagggttttaggaactgtatatcagaaaacaaggacaaagaccaaatatatatttcacaatgtcagggtagtattacaagagttttcattgcataattacttgtgtatttcttttgtatatacctttcatctgtatccactgttctattaatatttgctttgtgtttctttaaataagcatgatgtggcaattcatccactgtgaagcaaaggacagaattgctaccccttcctttataccactgatattaaaaggtggacacattaatcatgatggcaataaataccagggaatacaagcatgg

SEQ ID NO: 477281 - DNA, 1088 bp, Homo sapiens
cacagtgtttgtgactcgatgttggtcagagatgcgtgaaagtggaagacattgcagggaacttgaagaacagttctgctttttagcacttccccagagtgatgtagcccagatatatcagaatggaataagtaccagagcatctacattgaagatactaggaaatcctcttcttggaatttatatgtttagacatgttgatattgccttgaattattctcatagtcaaagcattactgtagaaagtattttaatttttaaggttctctttggaaaagtgaagaaaatccaaccttctgtggataaaaataaagtttctttggatccttctcctaactttgattgccatatgtcaagaaatgcaccttctttgaaagataccattgaactgcaagcctacagttcagcagtgtacttctatgaatacagtgtcctttcaaagcctgtagataaacctaggcaatgtcttccatatgctgtagtaacagtaaaatttcttggttcaaaagtagataatggacgccttatgacatctttgagattcctctcaacaggatttcctaagagagctggttattagctgaactttcaattaaaattactggacacaatgtacctgtattaatagttgtctatagaaacactttttttcaaatttgtcttccttattatttccacagaaaggacatgctctctgaataactgtacagtggccaaaagatttggaaaaggaaaagatgctactgtcacctttgtgcatttcaagaaacctgtagatccatttgttcaagaaaactgtttatgcaatgcactaaattcagagataaatcctttcatctcaaatatttctaactcctatggaaatgtacaaaatggaaacatttctatacctgaaacatacagtggacagacagagcacagtttagcagaaattagagacacttctcaagtacttgcacatgattcagacatttcacttatgcccagtgatgccaaagacagtgttaatggtgaccttttgttaaattggacaagtcttaaaaatattttaagtggtcttaatgcttcttttcctcttcacaacaata

SEQ ID NO: 477282 - DNA, 702 bp, Homo sapiens
gtggttattgttaatgaggcctgacccttctctcacttaatgatttctgagtccctcttgctggatctgcaaaatgaaaattcgacttacctcccagaggctttacataccttcacatctgctggattctgtggccacagtggaagagcagcttgcacagcaactgcgcttgtggagctgcctctcactccaggcgtcccaaacctggcagctttccggatcctgcagggagctctggagcagggttggcccttcacttgtcctaaattgaagcaagaagagaggggtgcagctgtgaaaatcggcaggcagtgtgcccagcatctggaggacagggcaccggacctgaagagggattggaggtggagcaccacagcatccactgcacatgagcgtttcactctaaatgaaggaaacagcaccgtgctggagaacggggagggcactctgaaatttgacaactctcctttgaggaaacttattactagatgagctataaatccagtaatgtcataactgttgccaaatatctgcttctctttctcctcagtatttgttctaagtgagggtaaacatagttctgctcgggcatcatctgatggtttaggttccctttggtttatttattcacaaggactctgtttctcatcctgcctgtaggcgataatggatgctttggcctggagcgtgtagttcatttag

SEQ ID NO: 477283 - DNA, 768 bp, Homo sapiens
gtgttgatgatggtgaggggggtcgtggtgatgttgatggtggtggtggtggtggtgatggtggcagtgctggttgtggtggtggtgatgactgttgatagtgctggtggtggtggtgttggtggtggtggtaatggtgatggtggtcgtggtgttgttgttggtggtggtggtgttggttgtggtggtgttggtggtggtggtgtgctggtggtggtgatgatgatggtgatgatggtggtagtagtgatggtggtgatgactgttgatagtgctagtggtggtgatgatggtattgatgatggtgatgtgatggtggtggtggtgatgactgttgatagcagccctgcctctggggaggcttttgtagcttccagcctggccgagggtccaccccgcacccctgctaacgtcacacagggcgcactgaccgctgtgctcaagtcactgtgactctccagcaactcccatgggctccctgagtcggggcttatcccgcctcatctccagtgcctctacaggcaggcccaggaaagcagacaagtgtattgtgtgttttatgagggagtaacagtgcattatatagtttccttatttactacttttttgtctctgttactggaactgtcccactaattacttcatactctctttcatgttttttactttctctttaaaccaacccttctccagtgtactgtataatttccttatttatgatgttttgtgtcttccactagattgtaagcttcacaagcagagattttc

SEQ ID NO: 477284 - DNA, 1681 bp, Homo sapiens
taacttgtggaatttcttggcacacactttcattgagtctgcggctgaacgggcttgctgggcgctcccaggagttcagcttcgagggcagccacatgtccgcatgttaggactcagagcacgcgaccgactggaccccacggctgtgaacatcctgcagcagatcattgagctgggcgccgagacccatgacgccactgcccttgcctcggtggttgccatggcaccagggacggtgactgtggttaagcagggaggtggcccagggacccaggagtgctgtggggagcaccaggggcccgtgtacctgggtctggggtgggggcaggtgctgagcagggaggccttagtaatgacttgcctggttgtaacatgggccaaggattccaagtctcggaagtatctcagcctggtctctcccttccgcccttctgcccacttggagtccaagcagtttatagccttatggcatgtcctagggcataatgtcctttggccatgggcttcctgacctatgttaccctcttgaagtcatgttggcgtttttaacaaatgacaatttcttggttcttgcaaatagtgaacctgcactgagcattcctgccccttgatatttagcagaacaatcagtgcctgtctaagactgtcactgacatttgtcttggcctcttgttcctgggttcaccgagccagctactgcaccgtgccctttcttctttccctgggggtgttttaagtaataagtacaccttatgatgacacagcatcttctttttaagaaggtcaggatgattgaacagtttgcctttatgataatcttcggtctttctgagttttgtgttaattttgtattgtttttactgctgagggtttgccctaaacagcagactgggggtgctagggcattgtggggtgtcagcctctgaggtgggggagggagttgggctcccagtgaagtggtgtgggtcattcgttcattgtacaagttacttttcagtccatgtgcacatacgaatggccaggacactcccctgtgtacaagagcttacctgatgcagtcttgtccaagtgaggctgtccagcagcatgcactttaccaagcctgcttctctgtgactcggccaccattcctgctttactgagacctgataagaaatacgttgtgtttgtcagagtttcttagagaaacagaactcataggggtgtgtgtgtgttcgtgtgcgtgtgcgtgtgtgtgtgtgtgtgtttgtgttcaaaagaaggaattggctgatgtgactgtggaggttgacaaatcccaatgtctgctgtcagcaagctggggtcccaggagagccaatggtgtgactccaatttgaaggctggcaggcttaggacacaggaagggccagtgtttcagcttgagatcaaaggcaggaaaaaccagtgtcctggcttgaaggctgtttggaggaagaattccctccttttcaaaaggggagggtcacctttttaattctatttaggccatcagctgattggatgggccccacccacactagggagggccatttgctttattcagtctgccagtttaaatgttaatctcatccaaaaacaccatcacagccatacctagaataatgtatgaccgaatatctgggcacccatggcccagtcaagttgacatataaaatgaact

SEQ ID NO: 477285 - DNA, 1082 bp, Homo sapiens
gttcatgaccaagctctgcaatccttccttgccagtgtttctcaggtgagtaatgatttgtcaatgtccttcttaaaattgggacctgtagttgatcacgatattccagggctggcaccaggccagcaactttgttctctggtccctccaagtcaagcacctgctgtgctagaggcatcaaggtgttcacagtctgctggcaacaacactctgacaggagatgctggcaaaagcactctggcagggtctgctggcaagagagatatggcagtggtcactggcaagctgaggctgcactgcaagcagatgtggccacgcagggaccctggaagaggctggaagacagggggtgctcaggtcagactgtccctatcccagggacaagacagccctgttctgcccaggtcagacagtcaacaaaggctagaaccacctagaagaatatggcaagcctggggaatgggtgcccatggccgtactctctactccagccactcccatgccaaacctttggggctatgggcaggctggagttctgtctctgccaactctttgggcagttcctcctgccagctcagatgtttatgggggtcttggggtctcctgtggctaggataccagaggtccattacaagagtgggccactccacacctgtttcactcaccttttcagtaggagttgctcagggccaggaaagagtcctagcgctcaggaatcttgtgcgaggttcccagcttcccctccccacccttcagcccacggtccatgtcctcccactgtccactctcaatgccatccctctaaagatctgtgcagagtgtgccagtctactgggcagtcttgtctctttttgagggagaagctcttcctggctgcatctagtcaaccatcttggctccccctctaattatttttaagtaattaaaaaaataaattcaatctgcaaagttttctttgtagtttagggcaaatgtatctagacctaaacatttgcatgtattttaggagctagatgccttttgaaatgattcacctatcttgggcttcagtttctcctttacagtgtttattttatccttcc

SEQ ID NO: 477286 - DNA, 646 bp, Homo sapiens
aaaaaacttcatgtaaactaaatgcatggcttgatcctcccatgtaccagaaggggagcagcatctttgagctctcttcccaaatcctctgcttggtctgggcgtatcctgtgaatgaggagagaatctaccccacagccagatgcttgcatttggccacagttcatttccaggcagcctggaagagagcatcccacaacattgaacagaggcagccaagatactgtcgggtgatcaggacagctcccgcctctgtgttcctgtggagcctccttcctctccaaggaatttgtcgcatgggactgcataattcagttgtccattcagtcaacagtgatttactaacaacctactttgtgttaggcactgttccaggggagcccctctggctgctctgtgaaaatagggcaagggaggaaataggagacctcctgggagataactggagtagtctgggtgagatacttcagtgccagcatctaagtgatatgggaagaaaacgttctgatacacagaacacagaaatggctcagaaatgagaaactgactgactactaaattgttagtaaaagcaacagaataaaatttctccattagagtttctcacctgcaaggtgttgactttccagttacctggcatttcatt

SEQ ID NO: 477287 - DNA, 528 bp, Homo sapiens
tattgttaggcttaaaggacgagacagatgcaaagtactaagcatgtggcctggcacaggggaatttatccctgtgccggtgttgctcccaaacacggtgaccgtggggcacatccatgcctgtctcacataccaaggcactgtcagcatgtgctcctgctgcaggacccttcggccaagggattcatcctgcggcacaggctcgagtctaagtttacccgtgacctgtggtcattctgtggacggcagaccaggcatgactgcacgcctcgtatcagaactcggaagcctggtggtgacaggaaacagtccgactgctttagagaggcctacagacacgtgggtcttttcacagaggcataacgaaccatgcagaaaggtagaatcctcagatgctttatctaataatcacagaactgaagatccagaaggatccttgggggctgcgtgttgcactgtggttgtttaatagaagtaggccccatgaggtgaggggacctgcatgtcgggtgagttagggctgactgt

SEQ ID NO: 477288 - DNA, 508 bp, Homo sapiens
ctgaacagacctggcttttttttttttttttttttttgagacagaaaacaatactatgacaagcttacccaggaggaatgtgttcacagagaagaggacaagcagggacacagtggccctgaagacaaggacaggcccctggggacgaaatgaagcccaaaggacaaatcgaaagcaggatggtgactgtcaggggctgggaaaggcagaaatggggattgctgttcagtggctaaaagcaatagcaggaagtgctggcaagtggagcccagaacaaggtgggcacacaggaggtgggtggccgcagcatcatccgtcttgcttacagctgccctggcataaaaagcagagcctgaggcaaggattgagtcttgatgcttcacttggcaggagcagtcccagagtagtgagagtgaaagaggaaggaaatgaatccaagaaggaaggaaagcaatgcaagctcttgcatgctacagtactggccaggcctcacaacgagctgtgatga

SEQ ID NO: 477289 - DNA, 662 bp, Homo sapiens
ggtccagggcgatgacttgtctgggaaatgtggaatacaacaaaggagtctgtgtagacaacttgcctagtttggtgctgatttttagatcccagagaagcttcctgacaaaacataagggctggctcccagcagggcacattcccaaagcaacatccatccaggaccgggaaggcctggctgtgttagaatgggactgggtgttgattgcattgtgtttcctttctctgcttgcttccaatccatgggctagaaaacgagggcagcccttgtggattctgattagaagcttcacaaatcaagttgctaaatttgcagaacattttgacctgaagtttgcctctcccacctccctgcgggatctcattgcagcgggagctaggatagtcatgattagactagtgatgggaactgaagagaggccatttgcactgcctgggcagagtggcctgggcacagggccagagggcacccatctggctgcagacccgcaggtgccctgtgagaaatctagacaggccaggggtcagagccagagggtctagcagagtgacacggtttggctgtgttcccatccaaatgtcatcttgaactgtagctcccacaattcccatgtgttgtgggacggacccagtgggaggagccatagctgtgcctgctgc

SEQ ID NO: 477290 - DNA, 833 bp, Homo sapiens
gctggcttcaggagtgaagctgcagaccttctcgattagctagatacagagtgtccacacaaaggttctccaagtccccaccagagtaactagatacagagtgtagattggtgcattcacaaaccctgagctagacacagggtgctgattggtgtatttacaatccctgagctagacctaaaggttctccacgtccccaccagactcaggagcccagctggcttcacccagtggatcccgcaccagggccgcagatggagctgcctgccagtcccgcgccctgcgcctgcactcctcagcgcttgggtggtcgatgggactgggtgccacggagcagggagcggcgctcgtcggggaggcttgggccaagcaggagcccacgagggtgggggaggctcaggcatggcaggctgcacgtcccgagccctgccctgcaggaaggcagctaaggccctgcgaaaaattgagcacagcagctgctggcccaggtgctaagcccctcactgcccggggccagcgcggccggccggtggctccaagtgcggggactgcccagcccacgcccacccggaactcgcactggcccgcaaacaccttgcgcagcccaggttcccgcccgcgcctctccctccacacctccccgcaagctgagggaggcggctccggccttggccagcccagaaaggggctcccacagtgcagcggtgggctgaagtgctcctcaagtgctgccaaagtggaagcccaggcagaggaggcgccgagagcaagcgagggctgtgacgactgccagcacgctgtcacctctcactagcactttgggagtgtgaagc

SEQ ID NO: 477291 - DNA, 2174 bp, Homo sapiens
cccccagtgggtcttagagactggtgcttcatccatgtccctgcaaaggacataaactcattttttatggctgcgtagcattccatagtgtatatgtgccacattttctttatccattctatcattgatgggcatttgggttgcttccaagtctttcctattgtgaatagtgcctcagtaaacatatgtgtgcatgtgtcttttatagcagaatgacttataaattttgggtatgtacccagtaatgggattgctgagtcaaatggtatttctggttctaaatccttgagaaatcgccacactgtcttccacaatggttgaactaatttacgctcccaccaagagtgtaaaagcattcctatttctccacatcctgtccagcatctgttgtttcctgactttttaatgattgccattctaactggcgtgagatggtatctcattgtggttttgatttgcatttctctaacaatgagtgatgataactttttttcatgtttgttggcagcatcagtgtcttcttttgagaagtgtctgttcatatctttcacccactttttgatggggttgtttattttcttgtaaatttgtttaagttctttgtaaattctggatattagccctttgtcagatgtacagattgcaaaaattttctcccattctgtagattgcctgttcactctgataacagtttcttttgctgtgcagaagctctttagtttaattagatcccatttgtcaattttggcttttgttgcccttgcttttgatgttttagtcatgaagtctttgcccaggcctagatcctgaatggtattgcctaggtttttcttctagggtttttatggttttaggtcttacgtttaagtctttaatccactttgggttaatttttgtaaggtgtaaggaaggggtccagtttcagttttctgcatgtggctagccagttttctcaacaccatttattaaatagggaatcctttccccattgcttgtttttgtcaggtttgccaaagatcagatggttatagatgtgtggtgctatttctgaggcctctgttctgttcctttggtctatatatctgttttggtaacagtaccatgttcttttggttactgtagccttgtagtatagtttgaagtcaagtagcatgatgtctccagcattcttctttttgcttaggattgtcttggctatgtgggctcttttttggttccatatgaaatttaaagtagtttttttctaattctgtgaagaaagtcattggtagcttgatggggatagcattgaatctatcctatccatgagcatggaatgttgttccatttatttgtatcctctcttatttccttgagcagtggtttgtagttttccttgaagacgtccttcacatccattaatttccaatagtatgttgaataggagtggagagagggcatccttgtcttgtgtcagttttcaaagctggtcatgcaggatctcacatacagtcagagatgatgtgatgaatgacaagggagtctgcactacttgcttatatagcttactcatgccctctgggccaggtctgctcttcatcatggatggccataactttaaatacacgacggtaatttacaatcaaacacatccagatggacggctcccccaaagccaaatctatacccaggacgcagatttctacaggaaaatgcagccaagccagaaaaaaaaacaactcagggaacaaacagtccctaccactgtaaagccatggttccctctgctgctccgaatggagcaccacatgaaggaggctgcccttgtttggtaacatcccttcctccaaaccttcacttctgtcttccaccagcctttattcaccccgtgtccacattgtctggagccttctcttaggggctaaactactggttaaactgataatgaattatgatggggagagtcaaaaataggttgtttctttcctaatagcaataccaatagttaccatttattaagcaattatgcacaaagttggggcatcagagtagctggagatcacgctggagatatggatacagttgaggagaaggggcaggctaaggtgaagtcttggaatcttatctttataagtcttcataagagacaacattgaaggactgcaaaatacaatttagttttttaaaggcttatt

SEQ ID NO: 477292 - DNA, 490 bp, Homo sapiens
gaggggctcctcacatcccagatgatgggcggccaggcggagatgctcctcacttcccagacggggtggcggccaggcagaggctgcaatctcagcactttgggaggccaaggcaggctgattctggagcctgcactggcctactggaagccttttggagagaaagatacaaccaacagtcattaccaaccaggacgagctgacattgacagactacaaatgtacaatgagcccaatcagcaccacttggagcagaagaactgcctagtctctccagccctttcctcctcccacagaggcttctgccccagaagggccaaacactacccttcagctttgtccccaggaagggctatgcccatccctccttcctccccctatggagagagggtccagcagtttcaaaggcaactggtgaagaacaagtcatgcgaataagaaataaacatttgttgtaattgtaagccttcatgatttgttacaggagcac

SEQ ID NO: 477293 - DNA, 647 bp, Homo sapiens
tgctaacggcagccgactaatatagtctacttgccatctgtgtgctggttcttcacctctgggaatatgttccattgcattttttcagtggacaaagtgataaaagaaaatgatgaacttggggattctgtctcccagcttcagcagcagttactgagcctcaaatctgctatgattgccctgagagagagtcttatctcctgtagagaagaagctgaaattgtgggaaaacagacacaagctcttatcatgcgagtggctgacctgcaacaaaagatgcaagaacagcctcaccaggtgtctactgttaaagcagagaacccaaagaagaaagaagttaagcttttcaaaaaagtgggggctaagttccatatggctcgcctggtgagaaccagatggccggggccatgtgctggaagagctgacgccggccagcaggcagctagcgagagtgaaataaagtggcatgagaacagatgtgaaaaaaaggtagaatcgtctctcaataggcctactggtgccagaagcctaagggaacagctctggttgctaaactagaattccaacatctccagaataaaagctaatgtttgtgtagtgccttctatgccagatttttgaaacgtcaccatcgtattagggtgggg

SEQ ID NO: 477294 - DNA, 708 bp, Homo sapiens
ctccaacagacctgcagctgagggtcctgactgttagaaggaaaactaacaaacagaaaggacatccaacaccaaaaccccatctgtacatcaccatcatcaaagaccaaaggtagataaaaccacaaagatggggagaaaccagagaagaaaagctgaaaattctaaaatcagagcacctcttctccttcaaaggaacacagctcctcgccaacaatggaacaaagctggacagagaatgactttgaggagttgagagaagaaggcttcagacgattggtaataacaaatttctccaagctaaaggaagatgttcgaacccatcgcaaagaagctaaaaaccttggaaaaagactagacgaatggctaactagaataaacagtgtagagaaatccttaaatgacctgttggagctgaaaaccatggcacaagaactatgtgacgcatgcacaagcttcagtagccgatttaatcaagtggaagaaagggtatcagtgatcgaagatcagatgaatgaaatgaagcaagaagagaagtttagaggaaaaaagagatattatccaggagaacttccccaatctagcaaggcaggccaacattcaaattcaggaaatacagagaatgccacaaagatactcctcgagaagagcaactccaagacacataattgtcagatccaccaaagttgaaatgaaggaaaaaatgtt

SEQ ID NO: 477295 - DNA, 959 bp, Homo sapiens
aagccattcagactcatgggccctcggctgggtgatggggacccaaagtttaatcttcacacgagaactaggagggagaatcctggaccacacaggtaccacacgagaactaggagggagaatcctggaccacacaggtaccacacgagaactaggagggagaatcctggaccacacaggtaccacacgagaactaggagggagaatcctggaccacacaggtaccacacgagaactaggagggagaatcctggaccacacaggtaccacacgagaactaggagggagaatcctggaccacacaggtaccacacgagaactaggagggagaatcctggaccacacaggtaccacacgagaactaggagggagaatcctggaccacacaggtaccacacgagaactaggagggagaatcctggaccacacaggtaccacacgagaactaggagggagaatcctggaccacacaggtaccacacgagaactaggagggagaatcctggaccacacaggtacacgtaagaaagaaagggaagaattacacaggaaaacacggatttgattctctcctttagagctgggctcccaaagagttccataaaagggaagacatctttgcttccctgccccttatctctcaagccttctggacactctgtttcaagttccaggaaaggaaatcttcggcctctccttgagaagcaaagagaattcagtgacaatgtgtacagaaatgtctctgactttccttagatgattccatctttcttcctgcaactcacctcctcacaaacaaacgtcctctcctgcatttgggttaatttattttcagtaaacactcatcaaatgaccaccactaagcacaagacctagcagggtcctagaaatatagtttctgtcttctagatctttgaaggaaagacataaaataaagtaaagtgaaattcacaccaagt

SEQ ID NO: 477296 - DNA, 3415 bp, Homo sapiens
gactccgtgctgatggactgcagggtggcggtagatttgctctacatgcagcttcggccaagtcatggaatggtcagccggtgctgccgccaacatacacacccaggtcaccagctgccccaggtgttcacactcaccacaccgccatcttcggagacctgatcttttccaggcttggctccacaattctgggaagaaagctcagaagcttctttcacagtttttggagctggcccgggaggtacggcactatggatacctgcagctggatccttgtacctgtgactacccagaatcaggctctggagctgttctttctgttggcaataatgagatcagctgctgcatcaccctgcctgacagccagacccaggacatcgttttccagatgagcagggtgaagtgctggcaggtcactttccttggaactctgctggatacggatgggccccagagaactctcaaccagaacttagagctcagatttcaatacagtgaggatagttgctggcagtggtttgttatttacaccaaacagaattggaaccattatcctagaacaccagttctcagtgtgtggtccctggaccaacagcatctgtatcacgtggatcttattagaaattcaaattctcaggccccaaacctactggatcagcagctctgggggaaggccgcagcaatctctttaacacgcccaccagacaaatctgatgcatgttcaagtttgagagccactgtcctaggacaacagataacactcagcacaactgtgatcagttcagttgtcctctcggatgagtgcccctttgggccctatggagggaagcatgtgcaggctttgattgaagagctgacagcagagaaacatgctacagggagtggcagtgcccagaagagttccccaataaaatggaaattgtttctaggggatcatgccacctggggaatgcaagaaggagatattcatgagcagggagcctctttacccccaggactgacacagactgcacagaatgccaataagaactgtcctgtttgtcagcaagagagacagaaacttccagtggctatggggcagattgcctggtgggaaggccctgaccagagctggcaagtgaaactgatgctgcttttgccacatgaggacacaggaagaaggcgctaccttggaagcagagagaagacttcaccagacacagaatctgctgatgccttgatcttggacttttcagcctccagagctggagattattctggattatccaagtgtgcccaatataatcacaagggtccttataaggagacaggagagtcacagaggaaatgcaaggacagaagcagaagtcagaggggtgtaaaaatgctctacactgctagctttgaggatggaaaaaggagccatgagccagggacccacagttttgatgctttccctaattcagagcaggctttcccggagtctctgactcagagcagcccgagccaccgtgaggaccgcccacctgcagggggcgcgccgggggctgcagcgcgagaccgctctggcccagcggggactccgactacccctgtctggcccctcccctccgcccgtcaccgcctccttgaagctgccgctgtcgctgctgctcgttcgagtcgcaggtacttggcccggggcctgtgggcagcgcctgggctagagccacttgatatctcctgcaccgtccctgtagcactggaggtccagtaggcctggccggggccctgaggggcgagggtgcccgggcttcccacaccttccgcggcgactggagggagccgggccgaggaagcgaccgcgggtccgtgatggcttcttcgcggtctgtgtgttcacgagggccgggcagaggcctgcgagggttctcgtttgcgcttgcgggttagggctgtggtccggggaacccctgggcagcgcgggcagccctggctcgcggttaatcggggggtggagcgcggaagccacgccgcaggtccagctgctcggccggggcgagacggtgctttcgcggcgtgtgcttgcaggagcgcacagttcaggcgccgggacaagctgttggggtgtgagtgagctctccagaatggcacatggctccggggtgcccgggttaaaaggaaggatttgcacaccttccacttagggctcgggtaatcgcaaacttcctcccttaattggcttgcagtgctaaaaagcagatcgttctctctgaggttttcccaacagtacctcaagaaaataacatctgttttttgtaacgttccacggtattcggaattggctacagaacataataagtatttctacccatggcaaattccaccacaccgtcaaggctgagaatgggaagcttgtcatcaatggaaatcccatcaccatcttccaggagcaagatcctaccaaaatcaaatggggtgatgctgaagctgagtatgccgtggagtccactggcatcttcatgaccatagagaaggctggggctcacttaatgggggagccaaaagggtcatcatctctaccccctctgctgatgcccccatattcataatgggcatgatccctgagaagtctgaaaacagcctcaagatcatcagcaatgccttctgtaccaccaactgcttaatcccccggccaagcccatccatgacaactttggcattgtggaaggacttgtgaccacaatccatgctgccactcctgcccagaagactcgatggcctctgtgggaaactgtggcatatgtctgtggggctctccagaacatcatccctgcatctactggtgttgccaaggctgtgggcaaggccatccccgagctgaacaggaagctcactagcatggccttccgtgtccttctgcaaacgtgttggttgtggacctgacctgccatctggagaaacctgccaaatatgatgacatcaaaaaggtggtgaagcaggcgtcagagggcccctcaagggcatcttgggctacactgaacaccaggttgtttcctctgactttaacagtgacactcactcttccactttcgatgctggggctgccattgccctcagtgaccactttgtcaagctcatttcctcgtacaacagtgaatttggctacagcaacagggtggtggcccatatggcctccaaggagtaagactgctcgacaaccagccccagtgagagcacaagaggaagaaagagaccttcagcttctgggcagtccctgccatgctcagtcccccaccacactgggaatctcccctcttcacagtttccatgcagaccccacaaagagctctatcttgtcgtgtaccatcaataaagtcctctgtactcaaaaaaaaaaaaaagatagaaaatgaacaacctgattttaaaaatgagccaaagatcttaatggaca

SEQ ID NO: 477297 - DNA, 1287 bp, Homo sapiens
tctctcactttctcaggaaccctgacatcctattcaaaatgacagtccctcccccagcgtcttccagggcttcccacctcgcaaagtcaagcagaaagtggtttgtctgtgagtttcaaaatttcgtggccacagcccacagcaagaaatacattttacattgcaagccaaagcctgatccagggcaaagtcctaactctcttcaattctatgaagttgagagaggtaaggaaactgcagaagaaaagttggaagccagcaaaggttggttcatggggtataaggaaagaagccatcttcataatgtaaaagtgcaaggtgaagtagcaagtgctgatagagaaactgcagcaagttatccagaaaatctagctaagatcattgatgagggtggctacactaaacaacagatttttcagtgtagacaacatggccttctattggaagaggatgccatctagaactttcatagctagacagaagaagacaatgtaaatttaaggttgaattgaaattcagcgctcacccagctcgactggcattttacctctactcaaggatattctcacaatttcaccacatgaacaagtttgttcttgtaactgtccatgagtagctcatctggttttggggtttttagctaaagttttctttgtaaaattgttctagttaattcattatgcaaaaggcataagggatacttgcacatgtaatcttactaagaattaatagaagggccagaaccaaacctgtgtgtttatgcagttacatgaactcatctaggcattttcagtgccttactttagtggactgagctacatcgacttatatctagaaaattctgtcctggggaaaaaaactgctaaattatgtgctatgttagcattgggggctcttttggtaatcttagtaagaaaaaaacttttagcctagaaagcctaatttttaattgatgtttggatttttgaaaaatgctttaattaggagttgggttaatgctagatgaacttataactaaatttaatagcatgtgagtatatataggagccttagttagcagtcaatagatacaaggtttcttatttgggcagggttggcaagaataaaagacttactcagatactataagagcttaaggagggtagaggggtttacaaagttaatcatacatggcaggaagaactgcttgtatgtgtctgtgtctatatcttgtttttattacgtccattgagatgaatcaattagcaccaaatgattttatgtgagtaaagaatattccatttaagc

SEQ ID NO: 477298 - DNA, 891 bp, Homo sapiens
acagtgggctggcacacacataggaaacactcaatatgtggtagttatggagaggcgtaaggagtgtggttttgaccaacaaatcctgttgtctgtgacatgcctcccccgggcgccgtcagcctggtcatctggttcgggctgcctgtgctccttacctgcgtgggtactctggctccagcctgctggctacttccagggccccacccaagcctggagcactggcctcaaccctggtgtgtggctccagcttggcattcttgaagctgagcaggacttgacctcactacccagttgtgggaggcgagggcttgggtgcattgaagattcagctgccgtggctgaggggggcattgctattggaggcatcgtgggcattaatactgctttacaagaggtgctgaccactctcatccataatggcctagcatatgtcctgaagcctcatactatcaagatgcaaaggaacaatgcacagctcagcagaagaaaggaaccaaaagaggggctgtgtggggaaaggggacaggatagaatgtccagggcaaaaggctcttcctccaaagggaaggagctgccacctggatgccggagggtcacaatgaagcccttgttagtgagagaaacccaagaagggcaagctgctgagagaggagcagaggagcaactccagactcttggcccctttgcggtctatcgggtgggaatgttcaactcctgggccacagagtgagactctatgtaaaaaaaaaaattaaattttctctatttttccttatttgatagaaagaaattaataaactccaaataccaaaatggttttttaaatgacgtatcctgtctccagaccaaaatgattaaaaaaaaaaaaaaatgtttagagccaggaac

SEQ ID NO: 477299 - DNA, 573 bp, Homo sapiens
gcgggactctgcactgtgagatgtggaagagcacaggctttagagccaaactgctgggggaggagtgctactgccttttaactgagaccaagttaggaatgcttaatgttcaaaccaaaacctttgtcctggagacagtacatcaggcagctccagctacagccacaattcaaagggatccaggtacaactcgggcctctgctctagctccagagggtgtaagcagtaaggcttggcagcttccacatgatgttaagcctgtggatccacagaatgcaagagtgaataaggcttggaaggttacccctagatttcagaagatgtatgaaaaagcttgggtgcccaggcagaagcctgctgtaggggcagagccctcacagataacctctactagggcagtgcagagaggaaatgtggagttggaggcccttcacagagtccctactggggcactgcctagtggagctgtgggtagaaggccactgtcctccagatcccagaatggtagatccaccagcagcttgcactctgcacctggaaaagccacaggctaccaactctaattcatgaaaa

SEQ ID NO: 477300 - DNA, 746 bp, Homo sapiens
ggcctgagtatgaatggcccctgctcctgaaaggcaaatcttcacctccaggcctctaaagcagtgtttctcaaccttttacccatcagggcacactgagaagatacttttgttacgcactgtgacaaactggcaagatttgaagccccaggggaagctgcagaagctgaatgtgaccagctcagggctccagccacccagagtcaatgtcttggggtctgcagtagatcttcatttgttccctggggcgacagaatttgctgccccatactatcacagtgtcacagccggagtgtcagagctggtgtacggaagtaaaggacggctgcagtgggttgtgagagtcaaaggatttgtaaagccagaatatttgatggtagttttcttagaccttgatggagcaaaagataataatggtacagaaattggagggtggaactttggtacctcacattatcctcaaggaatgaaggaatggaataaagagatcagatgccagagattggctcatgatgatgaagatgaagatgaagttgctgatgactgattgattgatgacagctatgctttattaaggacttaccatgtgccacgaatattatctcatttaatctccaccacagccataataataagggctgttattctcattttacaggtgagaaaatcaatgctcagagagattaatttgttcaaggtcacatggttggtgagtggcagaaataggattcagactcagtatgctc

SEQ ID NO: 477301 - DNA, 1425 bp, Homo sapiens
ggcctgtagcctctttgtttcggctgatttctctcttttggaacaggaatgcttacccaatgcctgtactcccattgtatcttggaagctttgatgatctatattggttttagtttcaaaggaaaaaatacttcttccaagagatacaacaatgatccatggacctggaagttgagactgccgcccagtcactttgtgctcctcatggctatgaatccacaggcaaacagttattgtactggctggggtgattgggcacacagtggagaagtcaatggaaaactacaacaacacaattcaggcaggactactaatgtctcagatcctttaggaatgaaggcttgggtcacactaccaggtaaagaactacagccagctcaggtgcttgctaagggcaaaaggaatatggaatgggcagtggaagaatgcagtcataaatactatgaccaggttataacatatcatcgcttctgttttgctagcagacttgttggctttgatgagcaagctgccatgttgaagaagcctatatggcaaggaactgagggtagcctcaagccaacagctaacaaggaacaagcacttagtccaacagccctcaaggaactgaatctttccaacaataagaaagtgaatttggaagagaatcctccccagttgagctttcaggtgagaccctagccctggaagatttcagccttgtagaagttcctgaagaagaggactcagtttttgaaattttttagtattccatttaagtttatctattggctttttgactaaatctctgtgtatcatttaaataaaaactggttgttctaagaattacaatatacatttctaaccttttgttttataataataattaacattttatcactttgggtaaaatatagagacttttgaaccttatagcttcctttattcttcaccatttatgttacaattttcacatgtattaatctatatacattgaaaaccctaccagacaatgttatagtttctacttttgacagtcatgcatattttaaaaacacttaaaaggggaaaattatctattatacatttttatcataaacataacctgatttaaatcgcacaacctgaaattcattgtttcctttctttctgtttccccttcctactttctaagatttgtggaaacactgagctcaacctgtcgttactcaaatctttactatttttgtttcctattttatgcaacatccaagttaaatagcctctctcttatgacactgttgatgggaatgtaaattggtgcagtctcttttgaggacaatttaactctgcttatcctatttgtaaaatgcatagtccttttgatccagcaattctaattctatgaatttatcttacaggtatgctatggtctgaatgtttgtgtctcctcaaaattcatgtggt

SEQ ID NO: 477302 - DNA, 618 bp, Homo sapiens
cctccacatctacagtggtggagaactgatgttgagttcccaccgcctcaccctttggaagccatgatgaccatttccatgccaggccaaaggacaagcagtgagaaccagaagtccattctagcctctgaagtttcttgggaaagcaacaggaagacatttaaagaatatgttccctggacctttggtgctgttccctctgtatcattgtcctcacaattatcaaagacaaagatccacaaagaaaaagctctgatggctcgtttcctcttccagggagccagtgttaaagagaactactgtgaggcatttaaaacacctgaggacttgaccgatgcatatttgataagctcaaatggtcttagagatcttcagtgtcagtgtcctctgtttctaaataactacacttttcagccccaacttctcttcctttgggcatttaggttactcgactggtcaaccaggatctaaaaataaacctagaaactttgagagtatttttccccccttggctgattgatgtgtgtttttgtgtatgccaaactgtgctgtgtaactatttacttttgcattatgtatagcacttagcaacccacagtggaaatgaaagctaagagc

SEQ ID NO: 477303 - DNA, 568 bp, Homo sapiens
gacatcccgggctcaagcgatcatgaagaaatggaatatgaccagcacctcacaagccttcttgatgccccctcctggtcactatctttaccccaagggtgttggtatcctgacttctaacaccatagttgtgaccagtgaaatcatgatgaaagggacatcagcccagccttctcaggacctgctgctgctcctctcccaacaggctctggtctcagtgctcagggcttcagccagttgtgtgctggtggaacagggagtcggcttggcctacatagcctctaggagtctaaacagagaaaagaccttaaccaagatctggaactttacccaaaaaaggaacggagtatctgggacaatggtaaattccacatcgctggatgttcaaagagaagctggtaatattgcaagcaggagggatattgttgaaggagttcaagcaccaaatgagtgatgaggctggatgactttttaaagggccctttcagccctcaagttccataattcaaattcaaataagacaggggcaaaatggtcacccaacgagcgctctgtattcataggaagc

SEQ ID NO: 477304 - DNA, 734 bp, Homo sapiens
tctagccctatgcacaagaacatttttttccccatgagaaacactgcaatccgtgttggaggtggggttcggtgcgaggtgattggatcatgcgggcggatttctcatgaaaaatttatcaccatccgccttggtgctatcctctcaatatctctacagaatggtgcatatattcaagaaggcttttccactctggttggcgagagcttgaacattccctggcccaaggtcttcagcactgtgacccagtcttgctcagattctgacgtctttctctttggtgtgtgggaaggtctgtggttgagtcaaggtcagagcttctttgccttgtttctaggccattcggagaaactacaccttaagactgatctctttacttcctctgctagattctttttttgctaccctctggattcctgggccaacttttcgtgatgccaataattgccaggcactgtgtgaggcacttaacatagagaaggtatcaccacacacatttgcagatgaggatgcatttgcaagttttctttttctattctcttcaagtaaggcaagacagtttggctgccgggattttaggaggtgtgcagggtctccatggagaacactggtgagagaatgcactggtaactttacctcatcatgtgaagaatctcactgaattttaaacaattattagattacctaggtgacttacaagcacttggaaatgtgcatattaaaagtaccagcat

SEQ ID NO: 477305 - DNA, 1037 bp, Homo sapiens
atatctcagagatgcaccttcatgccctaggtggggcaatagtctgcgagaagggcctgatgaaggaggagcttcgaggcgtcctccttggcagcccaggctcagcccatctcttcctctctcccttcatggcagttcactgggcatcacacttggcagcctttggttctccagagcactttccaccatcccgcttgtcaccaccttctttccgtgttgatgttgttcacggactgtctccctcagtagaatatgactctggttacggtcaccaccagagtgctcagtgctgtttactattcaactccgcaggagccagaatccagacgctgggaaatgtgaatgttccaatatggctgaccatcatggaatgggatcaacagatggaaataggaggcttcatcttcttcatcttggtcctgaggctccatcagccaggtttccagcacacattaaacccagagaggacactgtgtgaagacgaagacagagattggagtgatgcatctgccagctggggaatactgaagtctgccagcagccaccagcagccaggagagggacagggtgcaaattctccttcacagccctcagaaggaaccaaccctgctgacaccttcgtcttggactttcaacaatatgattctgttgttgccaccctttccctgggaccagcagacaattgtacccattattttctggttctaaggaaggataaacttccttctaaggcttcagggatgacagatgccttcttgggacaacattcctgccacactcctccccaagctcagacactagaccatgtactccctccttctatcatcacttgaatttcaggaagcaaatcctttgactcaaccagaagaggattacttagtgctttcttcattcttcattttaattttcatctaaatgcatcaacactctaccatctgaggctttgattttcttttaactacaattcaagtgtttttaagatttaaagactcatctttctgtctcctgtttttattttgccatttggattagtcaga

SEQ ID NO: 477306 - DNA, 590 bp, Homo sapiens
ggaggccagtctgaggatctagaccaaggacagacatgctaaggagagagaaccctctctagtccaggctttaagagtcaggaaactttcatttcctgttgctcagagcacgggctctgggagccctccatgaaagaagctcaactgctttgctggagagacaacatggagaggctctcctgggagaagaagaagggctcagctgagcattgccttccagctgtccctaccaaggcaccagcaaagcggaaatttttcaagactgaattccctgacattcagagattctaccctcaaaacggccaagccccagaaccaagggagaaagtgggcaggaaggagctgctgcaatgtaagattcaggaagccacggtcaatctggggcaggcagggctgaagttcaatgcgaagtcattcccagcttggaggcgagaagcgatgccaacatgcagcgacaaagtccaaacaagtccaagtggagaggccacatggggagggactgatgacctcagccaacagccagcatccaccaccagacatgtgaatggacaaaccttcagaagattctagcctgcagtcttcagggcttt

SEQ ID NO: 477307 - DNA, 943 bp, Homo sapiens
aaagtgcccagcacatagagaagcagctattatggcgctgcgtgctctgtgggaacttctccccgtttgtttaggggatagtaaagaatggggggtgggggacccccagctgcgggtctgttggagttttctggaggtccactccagaccctgtttgcctgggtatcagcagcggtgactgcagaacagcgaatattggtgaaccgcaaatgctgctgcctgatcgttcctctggaagttttgtctcagaggagtactcggccattcagtgtgacttggcattctgcaggactttcaatggtactcctatgccttgtgatggatcaggagcaagtgttttctctcattgcccctgataaagttgtggaggccacaatgcggtgtttttcaccaagcacttacatgcatagaaaggccacacggcatgaagatggcaacagatttttcaaatgttttctgttgaactggcacttttcaaggtggacacaatagcttctcattcacatattcatatatggtgccaattattttctattttcagaaagaatagaagagtttaaacattccattaaacagagtatataatagaataaagtgaagagtaaaggctaatttttctctttttctcttaactccaaaacttataaacaaatacactgtacaaaatgatccatcattggcattgcaccagacacataacagatatctatatctatttgagcaaggacattgtgatcttattcactgctatgtgctccggctcctagaatactgcccagcacaatcaataattgaggactgaatggaggtttaaggcacctctcatttggtgatggtttactggtcagtgggtaaagaggaatggcagaaacagttgccggcatatgtaagccattcacagaagttgtggtgagcattttacatgttcatttccttaagctca

SEQ ID NO: 477308 - DNA, 641 bp, Homo sapiens
tatctgcattccttatcactatggtttgaatgtgtcccctccaaaattcagcatgttgaggttgagtggcctgacacaaggtggggaacagaggagaaacctgtgctgtgtccaaaagccccaggggttttccaaggtgtatgcagacctctgtctctcccaggctatcaggccctttgtgaatgaattcacaatgaccctgccagaaatatggaagctgagcaaagacagatcaagtaatctgacggaggtggagccaggattcaatcctagtttcctttacttcggagtccatgctgtaaaccaccatgctcagctttctcctgatcctccattttgtcatcttgacctccacaatggaaaatctgagtcgcgggcagccggggagggatgtgagcgctcgcagcagccgggagatgcagcagaggaagtgggaaaccctcccgctgcagcggcgctgctgcactcacatgcttacatggcaacaaatatgaataaccaactgtacgctgaaagactttccacaaggggatatgaaaatgagggcacagggacaccgcccttttgaaatgatttatcgatgtactgaaatctatgtatttgtgacatcaacgtactgaaatctatgcatctgtgatcac

SEQ ID NO: 477309 - DNA, 792 bp, Homo sapiens
ttatttggctgctgtgcagggaggtgtttctctcccgcgagctctgcccccatcccaggaaaggcagccagaagctgaacgcccagaccctgcgctatacaaatatcaatggctggagagaggttttccttgttcgcctttaatggccattgttaagggacagaaagaaaggccctgggatgtcttgaaggtactgagccagaggcagaactcacagctcacctcagaggtgaaggcctcttcctctccagattcaagccgacaaagtgaaatggtcattgatcctgtatttaaaggcctctggggacaggatttccacagccttccttggagggcttatttcattgccattgcagctcaaaaatacttcctggtgtctgccgagccctctctccctgcctctgaagcctcatggaggacatgtgagggtggaaagcccaagaacatggcaccagcatctggtgaggactttgttctgtgttatcctatgacagaagagcaaaccatctcatggacagagagaggaaactcatccttttatcagaaacccactcccaagatatggcattagtccatttatgagggtagagccctcatgaccaaatcacttttaaaaggccctacctcttaatactgttacagtggagattaagtttcaacatgagttttggaggggacattaaaaccatagtaagagcgaaaagactgattgcctgttatattcccaggtactagagagtctgtaggggttgaacggagaaataagactcaaaaggaaataaatacaaacac

SEQ ID NO: 477310 - DNA, 743 bp, Homo sapiens
agtatctatacacagaacctcagaggctggcacacagatatagagataggagtggccgcagaatgggcgaggagacaacaaaagggcactaagtggatggagccccctctgggccctggtattgttaactgtaaggattacataaatctagagctgctggtcattgcctttgcctttacaaggagtggtgggaaaaatcttcccaagaatggcgctgagaaatggcaagacaattccctgatagtatcttgtgagcctctgggcctctcttttgagggtctgctgcagtctgctggaggtccactccagaccctgtttgcctgggtatcaccagtggaggcttcataccagaggggcaccggcctgatgccagctggagctctcctgtatgatgtgtctgtcaacccctgttgggagttctctcccagtcagtatatacccaaagaaatgaaggtgtgtatcatagacttctgtaaggctgttcatagcaggtttcttgatgatggttaaaagtattagtgactcaaatgtttatcagcaagagaagggtaaacacattgtggtgtattcatgtaataggatactagcaaccagtaggaaaaaatgttagagacatagaaaaaacgaacctcaaaaacatttatgttgaataaaaaagtcaagtacaaaagaatatacatactgtttctatttacatgaagttcaagaacaggaaaaattatagtgatacaagtcagaatagc

SEQ ID NO: 477311 - DNA, 636 bp, Homo sapiens
tgcctggagaccccaaggacagggcctggaacagtagtatgagctcagtaaatggggctgttacaagatctgtgttcacagtctggggaatcccaattcctcggcacacggcttctgcggtgccgtttcttctcatccgctttccccggtcaagttcttccaaccacccccttgattctggaactttaccagaaccatgctatccttcatgtctagaggaccctggcataccagtcaggcctgatcctcaacaaggatatgaagtgggtgaagctcgtcttgtgcctgcccacgaaggaatctgggagtggactgaggagggtaagcgagccaaggcgctggggacttcgtggaacagagaaagggagagaggagaaattcagaagcagacagaagagtgtgttttgaggagtagagagttattagcagtgtcaaatgctgctaggagtgccttaatgctaagactggaaattgtgtgatttagcaagctgttgaaaactttcctgagttgtaggtggcaaagtagaggttgaggacaacttgaagagtgaggaaagagggacacattaagtgaaaatgaattatttgagaagttggtttttcagagatgcaaacttcagccaggaacatagggct

SEQ ID NO: 477312 - DNA, 930 bp, Homo sapiens
gttagaagatttccagttgttttctgaaaaccctcgtgggtccggaattggttccttccggtgggttcttggtctggctgacttcaagactgaagctgcggaccttcgccgcctcaacttccctgagagcctgcagaagactctgtcccaccagggtctccccgctccagcaggtggtctagttctggatcctgaccctttattgccgcacagctacatgccaggccccgataaggagcgtccaccctttccttagtgacaacagaaagtcacagtgagagccatgtcgatgtgtcattgtgagtggtcgggggaggaagtttgggctaagagtgtcagccataggacagccaccttggacctactccccatcccacctcccctgtgcttcgggaacttcaggctcctggcctttatgaatagtagtgcagttcagcccttccagcatcgaactccacatggagagacacaggcgacccctcagttgatgggaccttctcccagggagcatttactgggcactgtcagccctgagttagctgatggtggaaacaaggacagctcagatggccgttcaaggcaggtggccaaggagcgcacaagaatggtggctgatggtgtgcagggggagctgaatgatgagaacacatggacacatgaggtgcagggggaacacacacactggggcctgcaggagtgtggggaagcagatgctggcaccatgcttcttgtacaacctgcagaaccgtgagcaaaataaatctctttttaaaaataaattatccagcttcagttattcctttatagaaacataaaacagactaagacagtaggcttcagtaataaataggcccccaaaactttggtggcttaacccaatcaatgtttacccattgctcatgaaacagtccaaggaaggtattttgggtt

SEQ ID NO: 477313 - DNA, 678 bp, Homo sapiens
tctgtcaacttgaagcggatgagccttaggcttgtttgtggacatgttgccctttaatgttccgtcctttgctttcatcaagggcggacatagaaaaatgccaatacagagaatgtctccatatcttctacacaatcactgcaaagagatttcctcttatattgtcaacctgaatgacagagaaatgctttctaaaataaaatatttatttgggtatagatcattgcaatgggaatatgcctgccataactgttgtaaaacagagtcagttacctacgaaggcctcttctggttggtagcagtaaagccaccacaagggcaagtgatgagagaagggcatggccacggtgtcggggtagaggtggtgactaggacatcgcatagattaggaacagccttcacagtggcaacggttcaagtctattgaaccagcaatgtctcacttttcatgaaaatgagttcctaaaatgcagtggtggctacctgaaacgtgcacattcttaacatttggatttaatctggaaggatgtctaaaccatgtaaggaatatatgaacagctctcagaatcttgttaacctggtatcccacagtacagaaatagcttctgtaattcagaaatgcaataatcacctgttaatttctctgatgggtggtttaggcattttcagtgtttaatt

SEQ ID NO: 477314 - DNA, 644 bp, Homo sapiens
agcttcactgaccaatataggatggacagtgacaaagatgaagaaggcttcgggtggctgatcattcaacaggagtggaagacagaatacagagaagatgaacatgctgaactgtactggaagacatggccagactatggaagagacaaccagactttgggcaacctcattattcctggatgctgggcaagagcttgggacccactgagtgtgggtacccggaaagggcgttacactggccttttgccctctctggcggaaggcagctgccctaagcaacaaggaaaagggccaactgaattgctaacacaccactgtccgcagacagcaaaactaaaagaacactgtaacacactctgggatcttggggtcatgggcaccctcacccaagtgccactacaagggggtcacaggaaccctcacctgggtaccaccaggagccctccatggagcttgcttctgccggcgcctggagcagctgaccggatctcgcactcgctcactcatgtagactttgaaatgggcccccagtttgtttgtgatgagctgtgaataagcctgcattcctgccacgatgaattgtggttgtgtatgcttttggatgctgtgggacagaacattggggttatatttataagcagatt

SEQ ID NO: 477315 - DNA, 622 bp, Homo sapiens
ctgcagagattagtgccaccatcaaggacttgaaagacgcagaatggtgattcccgtcacatccccgttcaactcttccatttggcatctgcagaagacagatggatcttggagaatgacagtagattattgtaagcttaaccaagtggtgactccaattgcagctgctataccggatgcccaccagaagcaatttgccttcagtgggcaagatcagcaatatacctttactgtcctacctcaggggtgtatcaactctccagctttgtgtcataatcttattcagagagaccttgataacttttcgcttccacaagatatcacactgatcatttacattgatgacattaggctgattggatccagtgagcaagaagtagcaaacacactggacttactggcagctcttggcttgttactggactttggtgaaaactgaatgtttgactatgggtcatcaagtcaccatgcgacctgaactgcctatcatgaactgggtgctttctgacccatctaaccataaagtgggtcatgcacagtagcattccatcatcaaatggaagtggtatatatgtgatcgggctcgagccggtcctgaaggcacaaataagttacgtgagga

SEQ ID NO: 477316 - DNA, 807 bp, Homo sapiens
accaagcatacgcctggtactaaataactccaatttaatgggctacgtgacaaatcagatggtcaaagaagccaattttctgaaaaccctaaaatcactacttagtgcatattactacctggatgatctgcaggcaccgaaaatcgacatcatcaaaatgaacctcattgtgtctctccaaactttatattctcagagcccttatctttctgaattgtgctcctatctttatagaccagatgtgtctgctttttgcctctttccactcaaccaggctcctcaactgtctttttcaaatgtgcatctctccatttccacttctactagtgatgcctgtgttagagtctacagctgtaataaggactatgttagtagaaatatgtgtgtccctttatgtttctttgttaaaactctctttgatactatgaaatatatcattctacagcacagatttgcacagatccccaaaagaataaacttcaggcctttaaaaacctagatctgtttctgcttcttggatagtcttcattttcattaatttcttcttcatatataaatgcttcattttgcagaaccccttgtaatccccaaatatgttatataaattatttccctcacactttaattattctatgaaaatcatttaatttgtgtttctctttccacttgcacctgggaaactactttagcttacctgtagtgataaattcataccagttttgtcaaataaagaaaaaaatcttctaaaataattcgacaactttattgaagagaaacatctatttttgaagtcaagaaacattgtgc

SEQ ID NO: 477317 - DNA, 458 bp, Homo sapiens
ggtccctggaaaaagagagcagactatggacaaaatgcaaattcgagtgattttcttattcgagttcaaaatgggttgtaaagcagcagagacaactcacaacatcaccaatgcctttggcccaggaactgctaatgaacatacagtgcagtcatggttcaagaagttttgcaaaggagacgagagccttaaagatgaggaacatagggaccagccatcggaagttgacaatgaccaactacaggagaagttgtcaaggaactcaacatcaaccattatacagtcatttgcatttgaagaaattggaaaggtgaaaaagctccataagtgggtgcctcatgagctgagtgaaaatttaaaaattgtcgttttgaagtgtcatcttttcttattctatgcaacaaaaacgaaccatttcctgaatagattgtgatgaaaagtggatttatatgacaacc

SEQ ID NO: 477318 - DNA, 695 bp, Homo sapiens
tgccaccactgaacagcatctgagagtgatgagggtgacagcagttgtcctttaccctgtgcacctaaggtggccgtcctatcctctccagaggctcaatgccatgtgtcaggcattcagggtagtgggcgcccttgcctgggtgctgccacattcccctggaaatgatatgcctgctctggctgcaagcccctcacagagcttgctcctgtgtcagcagagtggctggctggatcttgcactcgcttactcatatgctgcctcctgcaaggagcctaggaccatcaaactccaaatggtcatgaaactgaagcctcagaggatggcttgccttcactggggactgttagataggcctctgaggagatctgtgggctgctttcccaaaacagcaccccctgccagcaggaagcagttaagatccatcttcgtccctattctgacagcagctagagacatacctcttcagaagggggaattgatagtggctggaggcaggcaaatacctagacagatagggatgcctccccggtgaaatcacaccttcaagccaaaaaacagcttgaaggctgaaagtctggactgctggtcctggatgaacccacaacccagagtgagaacttctgttcctgtttacccactcttttctgatttattctttctgaataatgcctttcaaccaatagaatattgcc

SEQ ID NO: 477319 - DNA, 806 bp, Homo sapiens
ctcttatatttgttccttcttttcatcctcacagcaactctttatggctgctcggcggcccgggctctcctctgactgccccggacaaactctgcgttgttctgccggtaggtggcctgctggcttgctggtgcctgctggtacgctcctctcgacgtccagctgcctgtgtatctgcctgctaggagatatgccgtcacagcgttacttgttaatcaaaacaggtttcccaaatccaaatgcaattaaagccgagtttttagaccgttatctccttcctcctggagaagacggaggagggaagctggcctgtcaattaagcgaaaggaatctgaaacaggagaacagacacagtggcgttctgctgcagggacagaaacctctgccagggagactcgccccacacgctaatagcagattcagtctctcctgtgggacagggacaaagttcacaggctggtgcccatccgcagaccatgcttggagcagcatgactgaggataaggaaccactaggaatatctaagcagggaaataacttcatcaaattttgccctaggaaggttacactggcagcaagatggagaaaggtttttgggcagagactgagtcaaggagacaattcaagacaccagaagcatcaatgcagacaagagatgcgaggatctgacccggggccctgaatatccttagggggagcagattatgcatctaagaaccatttcagagacaatgctgcgcttgttgagtgttgagtatatgagacgcgggaaagggaagattcaagatttctggaaaactgtgggc

SEQ ID NO: 477320 - DNA, 557 bp, Homo sapiens
ccgccatgtatccgccatgggcattccaggggctgactttaacacagacaccaccccagccactaacgtattcagatttcatttccaggaactaaaaatgtcctctgactgtgccatgagacactgggtcttttgtgaatcttgtgttttggcagctccctctgacacaattccagtgggagaaggggaactacctcatttcaccaagtggggttggatgcccagggcttccactaggcctctgttgacagttggagggatgggctccttgttaccacagaccactgtcccgggtaggggtgaattccagtctcccctggtcattggcgcctaccctgtgagtgcagggcgattgtctaacataaatttgcttgctggcactgcttcttctacaccttcttcctcatcatctggcactggtttgaagcacttatttccataaaattttcttctgttaaacattctggggtggtgactgttagctcttgaatttccccaagttttatatcttcaaacccttcactcctcacttgtttgccatatctacaatgtctttc

SEQ ID NO: 477321 - DNA, 746 bp, Homo sapiens
cctctggctagggctggtctaaatgttccttctgtgggtcctggctgagttctgcctggttttggcagcactgcatcctaaggcaaagagctcttataaggcaggtctggtggtagcaaatttcctcaaaattcacttgtctgaagcagatcttatttctccttctcttataaagcttagcttcactggatataaaattctggcctggaatttctttcttaaaacaatgttaaaaaacatcctaacatgcttctggccactcttccacagggctgttgaagtttcctggggatcttcttcagatcctagtcatcttggtttctccagtacttggagggctgatttggggcttctggactcattgcatgtgtttgcggctcgtgcttcctgtagagcatctgtggcagctgctcctctgggggcggtcacaggactgtcccttttgttggaattgctgcttctggcagtagcaatggtcttggggaattatatctcttactaaactagctaaatagcagtttgagacaataagttgtagaatgttaaaatgctgaagtcgattgcccttgaatttctgcagcagagactgattagatttagtggttgtgttttgttgttttttatatcactgcctagtaatctgtgtatccaaaatattttatacttaaagaacagaatttgcaattaaaagtaagacttttaattaattaattatgtatatattaaaacacagggctcgaagggag

SEQ ID NO: 477322 - DNA, 511 bp, Homo sapiens
ctggaacagctgagtcactgaagatggctgcctgcctctccccctgggaaatcaaaactctctttgccagagaatacaagagggggtggctggaggccctggttgggaggtcctgcccactgaggcagaatggatcaggatcccagttaaaaaagcagtctatccatgttttggtagagcagctgtgctgtgctgtgctgggggatccctttgtgcccccagtcttaggaaagtcagttttgactctcctaagcccacaggctggaacagctgagtcatgcaaacagcaaagatggcagcctgcccctctccctgggaactacatcccatcccaggtaccaggcctgcaccagtgccatactagccactgtggactcagattccaggcatacctcaatggacccaggctttaaacccataccagcgcctggtcagctcctgtagactcaggctcaaggcctaccccagtgccaggtcagcccctatggacccgggctccaggcctgccctc

SEQ ID NO: 477323 - DNA, 516 bp, Homo sapiens
gcttctcagaaaccttcgaagtgctaagcagcgcttggaaaagtcaagaagcagctcctcggagccttgctcaagatggcggaaggagattcggggatccctccagctcccctcacagctgagctggcccttgaatttaccatcccactcagacgcggcactgtggagaagtatttctccaaagagaaattggatagagaaggggccccagggtcccatccaagagagctggagttcatggaaagactcccatccaccagagagctagagcacacaccagaaccaatgctagggacagagcacacacagagagctagcaagaaagactcacctcaaacaccagatactgagacccagagcaggacactaaggctagtgcaaccctgttgggagggactgagtttgaatacactccctaacgtgacctgcagcggccatacaggaccgcacagagctgagcctacaggaggcaattcttcaatttttctgtaaagcactacatttgcaaagtaataa

SEQ ID NO: 477324 - DNA, 628 bp, Homo sapiens
aaaacggaccaatcagctctctgtaaaacagaccaatcggctctctgtaaaatggaccaatcagcaggatgtgggtggggccagataagagaataaaagcaggctgcccgagccagcagtggcaactctcttgggtctgcagcttcactcctgaagccagcgagaccaccaaccacctgggaggaacgatcaactccagacatgccaccttaagagctgtaacactcaccgctaagatctgcagcttcactcttgagccagtgagaccacgaacccaccagaagaaagaaactgcgaacacatctgaacatcagaaggaacaaactctggacacaccgcctttgagaactgtgacactcactgtggggaaatcagcagacacagccaagggagagcaggtggctaaagctttatcagcacccttaggctgggttcttctcggactagaatgctcatccagccctgccactcccaagatttaccatcaagctggaatgtatcctccaggaccatcctgagaaaaccttcatgagaagtatttcttaagttttgcatatcttaagatacgcaaaagatgtccttatgcaaaatgaagtttgaagtctactggtgtgaagggtactgtttc

SEQ ID NO: 477325 - DNA, 809 bp, Homo sapiens
aaataatcttggatctcccaatgctaaatattttattttaatcatggctgaaacttctgttctcacctgtttggatataaatgccaaagtcatcctctgtagccaggcagccctcaaaccagcaatgcctccggtgatcaagagccagcctttcaacattttctgggcagccccaacaatgtattgtatgccttccttcaacgtggatataaatcttcaagtatttaacattatatcaaatcctttagagactcagagtgggtcaaaaattgccatattttatccaaatgaattagggtattacccttacttatctcaagatggaaaatcctttaatggaggaataccgcagaatgtgagcctttctgaacaccttaggaaaactgctgatgacattggagaaggtgtcccttggtggagatcagaagaacttgttgttattgactgggaaagttggaaaccccaatgggatagaaatcagggcagcagaataatatataaaaaccactctttagccttcactagaaaccatcatccttattggtcagaaatgaaagtggaaacagttgcccgagaggaatttgaaaatgctggaaaaaatttcatgaacattactctcacattggctttagaaatgagaccaaaatgtttatggggcttttatctctatccagactgctacaattatgattacagaataaatccagagacgtacacaggaggacttagtgcatgcaattggcgaaagtgcagcattgggggcagcaggagtaatattgtggggaggatatgaatattctgcttcaaag

SEQ ID NO: 477326 - DNA, 602 bp, Homo sapiens
cagtgtgcttgtgctccctccatgtccttttcgacctctagccacttgtgtcttattctgctgacttactcctctcaaatatcctctaaagatcatctcaattttggcaagcacgtgttcttcctccctttacatggccattgccagttttacaccctctttcatcagtggctgcccaaaacccctggccttttgtaccccacagaaaggaaaccacagtttttcactgggcacagaccaccaagaatgaagactgcgttttctatccttctttatactgggtgtggtcatattaatgtgaagaggcttgctacttttaaaataagtgacatatacctaatagaagaagaaaatattaaatgtttaagattaacattttatactctctcaaataagttggcacatagtgacacctgtgctgatagaatgatcacaaaagtagaaaactctgcaggttctctgtcttcacctcttcaaaacttttatatggagctttaagaagatttagatgcccaggtcatacttcagacctattgacgtaatcttccaggtagaactccagtatgtgcatttcaaaagttcatcaggtagttttgttaaac

SEQ ID NO: 477327 - DNA, 588 bp, Homo sapiens
caggggtggagctgtgcaaggccatgggagccaacctcttgcatcagcgttacctggatatgagttctggagacattggtatgcaagatcatgcccctgagactatttgttttccaaagctccttcatagcatccagtcctcaaacaacaaacattcttttgctattgaaactggttcagaacagaacagaaagaacaaggcttgctggttgaagcattggaggcttgctgtaaccactccctggctactgcctatgttcactgaaggctctggggctctacaatcagcaggtggcaaagcctgccagacctgtgtcttccccttcagggcggcccagggtctcttaagtcagcttgtggtgaatgctgcctggtttgggactcacccttcagggcagcgggctcctctgtggcccagaaaaggtccagaaatgctgttcaagtatcagaaacttcatgagctaaattgatgtgtatcatgtgtcacttaatgatggagatacattccaggaaatgcatcattagggtattctaagaaattcatcattaggtgattttatcattgtgtgaacatcatagcatgtactt

SEQ ID NO: 477328 - DNA, 1490 bp, Homo sapiens
gccttttttgtcttgaagttacccaaaggaatagctctggtcaacagctcccagcgtgagcgacgcagaagacgggtgatttctgcatttccatctgaggtacagggttcatctcactagggagtgccagacagtgggcgcaggtcagtgggtgcgtgcaccgtgcgcgagccgaagcagggcgaggcattgcctcacttgggaagcgcaaggggtcagggagttccctttcctagtcaaagaaagtggtgacagacggcacctggaaaatcgggtcactcccacccgaatactgcgcttttccgacaggcttaaaaaacggcggaccaggagattatatcccccacccggctcggagggtcctacgcccacggagtctcgctaattgctagcacagcagtctgagatcaaactgcaaggcggcagcgaggctgggggaggggcgcccgccattgctcaggcttgcttaggtaaacaaagcagctgggaagctccaactgggtggagcccaccacagctcaaggaggcctgcctgcctctgtaggctccacctctgggggcagggcacagacaaacaaaaagacagcagtaaactctgcagacttaaatgtccctgtctgacagctttgaagagagcagtggttctcccagcacgcagctggagatctgagaacgggcagactgcctcctcaagtgggtccctggcccctgacccccgagcagcctaactgggaggcaccccccagcaggggcagactgacacctcacacggccgggtgctccaacagacctgcagccgagggtcctgtctgtttgaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagtgcctctcctcctccagaggaacgcagttcctcaccagcaacagaacaaagctggatggagaatgactttgacgagctgagagaagaaggcttcagacgatcaaattactccgagctacaggaggaaattcaaaccaaaggcaaagaagttgaaaactttgaaaaaaatttggaagaatgtataactacaataaccaataaagaaaagtgcttaaaggagctgatggagctgaaaaccaaggctcgagaactacgtgaagaatgcagaagcctcaggagccgatgtgatcaactggaaggaagggtatcagcgatggaagatgaaatgaatgaaatgaaggctacaagccagaagaaagtggaggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagcgcctgaagaagcgctaaac

SEQ ID NO: 477329 - DNA, 797 bp, Homo sapiens
aagttccctgaggcctcctcagccatgcagaactgtgagtcaattcaaccactttccttcataaattacccagtctcagctcgactcttcattactgccttgtgtgacctggggatggagaactgccctcctgactcgccctgcccaggatctgaaaacaccagggagagcacaagatcaggttcccagtgccagaatgatggtcagggaggcatgatgggtgtagaattgccatccaggagctacggtctggaattcggagctttaggaatttgtttgttgcttcattttactgtggctgagctggtacccaaggaaatgatgatcaatgactgtaacatcataaaaagagataatattggacatgatgtgccctttgatgacaaaaaacaaccacacctacgaagtattccagacaaaaaaaaatgaatcctgattctgctcaagcttttagatcaactatcaatatatttaatgtctttgtgttcattcctctttgttatttatggaagacaggtagatgtcagactttgttgttctcacttatttccatgacagaaaagatggaataaactaatttatattggaaagctttgcaaggagccacattaaagaattagtatattttttaacagaaacacttatcaaagttttctcaatgcctacaacacagcaaacttccaaacttcatatttcagtgtgaagcatgtcaataacagatatcatagttatcaaatatgcttagcatattactaattaattatacttttaaatatttaaagctttatgtcaaggct

SEQ ID NO: 477330 - DNA, 741 bp, Homo sapiens
gcacacaatacacttaaacttattcaatgattcgtttttacttttttcaaggtcaccaccctggaactgaagaggccaggctcctccccgctgcaaaaggcgcgaacttcccgaagctccaccccgtcttcccagcgaacaggaagatgcacatagtcttgatctcatctatactgctttttcctgatgaagaagtattgctgttcccactcaactttatagcttggaggccatataactcccagttcatcatgggcagctcagaaactttagggccaatgataaagaattcatctctatttggccccactgtgaacaatggtgatagatgtgggatgtataccagtgcctataatttacagattgatgaatctggattgggtaaagtgtctgctattctggggaagagtataatgttttggctaatggaaatgaagaaagagttaaattttgacttgagttttaaagagataaagacatggcatttggaagagaagcaaataagaacatttgtgtcatcagataaaagtccagaaacagccaggggatagagaaagagagagagatggagagggggagagagagagtgagggagagagagagagagagagactccttgactaaaaaagtgaattgaaggcttagtatgggaatcattcagggtacaagcaatatgtttctgtgggatggtattcatattcatgtgtgaagtaactggcagtcatgggaaggttaaagtaa

SEQ ID NO: 477331 - DNA, 1599 bp, Homo sapiens
tggcttcaggctgggacaactgatgcagcagagaagggcagagcgcccggggggagaaagcaaagaggcgctacactccaaggcggccctttggaaccgtccttggcccgggtgcacctactttggattcgcccagactgcaaatttttctttccttttgctggggccacgggacagagcacctgggcagagcaagcggagaggcgccacatccccgagaggcgcttcaaccagtctcctcctttcccctgctcagacaaagggcacgggaagggctttgctggggcaaaggggggtggggggttctctgtcccacgacagatgggtcgcggttaagactttaattgctgacttttgggccggatcagattccttttcctacctgccacttcccagcagcgaaaaatccccctcctgctgcactcctccgccaccgggctaggttgaaaggaaaaagccaagaagcgcgaagcagcccggctctggaaggctttggagagtccagctgacttgtacacaattcgcggcctctggagccttacctgccttcttgactgaatgccaccagttcgttttacgcttgtggcctgtgaggtgtgtccctccagactgagaggctatgactcagggttggactttatggaaaaaaagaagtttataaaacaagtaacccagtttctccaacctttactgtggagcaacagcgtcaagcaacaaaacccagcaaagttttgcttgtcacttacaagggtgttactgaaatctggaaggcgaacaattagaagatagcccaaacatgctctattgctctacactgaaatacttgcctccaataatagaaaaaacctgttttcgtgcaattgattgattagcgttctgcagcagtccctggacaattttaaagacattttgtgtttgtggccaaaattagaaacaagcagacacacacacaaaacaaccatattcaagacacggttcgactgtttccttgacactacccacgaagtttaaagcattttttatgttattttcaaactttcttaagtgatcccatgaaataaaagtcgataatagaaattaaaacaacacagagcaaagaacgagcttagtgaaatggagaagcagtagaggtaaataaaaatcctcgagctagaaagctctaagaaccgcttataaattcagttacctcctgaactccggccgatggccactccggcccgggagtgccccgcgccgacccgctggccttggccgtctcagccttcattatcgccacggccttggcgccccctgcccccggctgcccaggggaaccaagttcccgctgctggagttggggcagaggagccccgcctcattcaggattcggtggccagcgcagagccatttgaatagaagaagcccgaagtgaaacagaaaagctgaaaactccccggctgggctctccacttctcggttcttgctcacgagttccaaacagttaaagtgacgttggcaaggccgagggccaccgagctctgtgagactcccttggaggggtcaggaaacttagctcgagaagcttggaggcggctgggagttggggcgcaacttcagtga

SEQ ID NO: 477332 - DNA, 833 bp, Homo sapiens
tattttacaagaaagcctaagggaatctttttttaatctgagtttggtatgcatagcatgattccattaccaaaaggaagtgaacttaagggaaaaaaaaggacctcgttatcaaaagaagaagaagaagaaggagaaggagaaggagaagaagaaggagaaggagaaggagaaggagaagaagaagaagaagaagaagaagaagaagaagaagaagaagaagaagaagaagaagaaggagaagaagaagaaggaggagaagaagaaggagaaggacaaggagaagaagaagaaggagaaggagaaggacaaggaggagaagaagaagaagaagaagaagaagaagaagaagaggaggaagaagaggaagaaaatgctgtccaagatgcaaaggggggaagcggtaaccagtgcaccgtcaacctgcttcacactaacaccagagaagaaagaagaaagaagaagcagaagcagcagcagcagcagcagcagcagcagcagcagcagcagcagcagaagaagaagaagaagaagaagaagaagaagaagaagaagaagaagaagaagaagaagaagaagaagaagagaagagaagaagaagcagaagaagaagaaaagaagagaagaagaagaagcagaagaagaagaaaagaagagaagaagaagaaaagaagaagaagaagaagaagaagaagaagaagaagaagaagaagaagaagaagaagaagaagaagaagaagaaatgctgcccaagatgcaatgggctgaagcggtaaccagtgcactgtcaacctgcttcacactaacaccagttagaagtgaaaccctgaagc

SEQ ID NO: 477333 - DNA, 899 bp, Homo sapiens
aagaaccattagatctgctgggtcatatggcccaagtggcagagcagctttcacagcagcctggacctgttgaagagccttctcctcttctggaccctactaaaaactggcagccttccaggtcactcaataaatgggccagagtaacacaccaaaatgaggaatgtgttgcctccaaaatccaaataggcccactagctgaaggcaaattgcttctggtgggccttatggacaggaatggaaaaaaaggcatttgccaaatcaatggctgcataccagatctggaatgcagagaagagcaatcacagagcccttcaaagatgcaggtgcttccctcacaaatctatttcacaaagcacagttcaaggttgcatcttctggaccctcccagctgggatgatgaagaaaggaacaaggtgttcagctaataacgtggtttgggaagggagtttgaaaagagaagataaagaaatactcatctaggagagtaggagtgtggatggactagaaaaaagaaaaagaaattcttggtccccaacatggaaatccaagatgcaaggaaatcataggctctgaatcacctggggaagaaaccgctgcagaccaaattgcatcttagatccattaaatcagaaacttggattgctggattcaggtacaagtatttttaaagctccctaagtgattataatgtatagccaaagttgagaactactgctttggagccactggtctaatggaacaaattgcattgatttacttcccttaatattactatgtataactaactaaataagatgtattattttatgtttcttcttaatattggcataaaccaataaattagtgtatgtatgtttcattgttagaagaatatatgaatattatttttgtaccag

SEQ ID NO: 477334 - DNA, 677 bp, Homo sapiens
gtttgagtgtttcattcattttcttgacttttcctgaggattgtggcctccaggcgcagttgtataatggcccctgcttttgctagaatgcctctccctaacaaaggagtggggctttcaggcataattagaaaggcatgtgaaaagagtaaagttccccagtcacaacttagtggctgggagaagtatctagtgactgcctgtcctaggacccctcggatagtgacagatctggaggacagttctccgggacaggagagcttcttcccagttttctttagttcttctagcacgcaagttagcaaatgtctgaggcaccaatctccatgttctgattctgtgtcccatcacctgggaggaaccatctatctcctgtcccgaagggagttcttcctaggtctggaaggctatgggttgtcagtggtctcagtgttttgggctacgcccttgtttacactgacaacaacgtagtattggagtgttatagcctcatagagaagaccttcaattatcaactataggcttaactctcttcatttctccttcatgctctctcaatatcttcactagctcttttggtttgggtcatctatgcagacaaatgccaaatccttacctgtagccttaacttttctaaaaactctagttttgaatttgccagttcctcctgtatgtgg

SEQ ID NO: 477335 - DNA, 583 bp, Homo sapiens
tgaggttcagaaatgccagacaacaaaagtaactttgtagatgtggtcaaaatgaaaagaaagagaaatagtctcagagaagatgatgtaatgttcaaagattacaaagaaaaggcaactgacacaacattgctcttaagcaagtcattttatctttccatgacacggtttcctgcctcctcaacaaatgaaaagagagaaaatccaccgaaagctctggaaagaagtggcagtggagtcaaccctgatgaagacagagcaactgccaaggggactaaggaaagggttgcaggcagtttccctatttcagggaaacgacgagagtgcaggagcaagaagcacctggtgagctccaagcagcaggctggtgtagacagtggcagcagcctacgtctgagagaagggtcaagatctaagacctggggcaaaggtaactggaaaagaagctgatagactgagagagggcaaagggtggggtgagttgtttcaggatttaaaaaaaatctcacataagttctattttcccagactgcattatttttgttgactcctcctgaagccttttcagctttacttcactcat

SEQ ID NO: 477336 - DNA, 598 bp, Homo sapiens
ttctaagagccacttctcccctccacttctagtctcatggtagtgagtgctatcagccatgagtcagcttgtggtgacccttcgggaactgacctcccctctgacccagggcaggtctagaaatgccatccaacagccacgtcctggaatccagatgttctaccctcctgtggctgagctggtgcctaaggtgcaagtcacaggcctggaacaggggcctcacaactgtgactggtacccaatcctgctgtggctgagctggtatactatatgccagacaaagtcctccgcactctttcctcccctttcctcaacagaaggacgggatctcttttggagccataagctgtgcagcctgattcccatagacacctcagctgatggctcggcaggtcatgtgccctcccagtccactgtctctggatccaattcaacactaggaatcactcaagaattgcagttcttatatcctagactgtttctcaagtttacttagagacacagagcactgcaggccacagtggtgaggcttgcaggaactcaagtttcaacctctgggataagtgattcccctctggctagggctggttcaaatgct

SEQ ID NO: 477337 - DNA, 656 bp, Homo sapiens
acaggtgatatgatggcttagcttaggctcagaggcctgacacatatttacaaagcaacattttaaatcaaatgttgcccgctttgaatggggcttctgtgtgctgtgcttctcactgttcagccctatgaccttcttagaggactgtcctcatgctaatggagctgcttgctggcgtgcacagacagcaaaccacctgctccaaatcacatgcagacaaaagagagaagagaactgtggctgcagcacccaagactgtatgctcatgaaaatattggcaagcctttctggaataattagaataattttaggtgggacatggtataggaacaggataatcttcaagaaagctcttgcctggaagtgtcagaaaatggatgaaggcttggagaaaagaatgaatggagaggaggacaaaaagcattggatcagaagagagaagctgaccatactccaagggtggggacatgactgcatggaagaagcaaaactatttagcaatacaactgtagtgaccaaacattttcattttcttccaggggcagggaatgaaatacctctactaagtacataagggcagtgttgtaagatctcatcccatgatttatgtttgtgccaggtagcaattacctgtaggcatgagggaaagacaaaat

SEQ ID NO: 477338 - DNA, 594 bp, Homo sapiens
accccgtaacaagggagtggggcagagcagtgtactcaaacttgtttgtccacttactagaaggcgcactttttcctactgttatcattgtgaacggtgattgaacacctagcaaaaatggcaaagaaatgtaagagtccttgccctcaggcaatttatttcaggagacaaagtagatgaaaataaacagctgataattctcatgccatatacagatgacttcctggagtcaagagctgagtcctttcatcaaaaatgctcctgtatggagctcccactatgggcaaggcactgtgctaggtgttagaggagtgcaaagaatgagggggatggaaaaagcaaggatagctatgagaccaacactaatggtagaaagaagaccaatgtcaattgagtatgtgtcagacacaaggagaggcacttggcatactttcctcattaatcctcactgcattttattatttatgtctatttctcaggcaaggaaactgaagctcaggaagcttaagcaggttttccacagtcagacaacgatgattggtggaggccagataattacggagcatatgacatgtatagtgtgctaggcacatg

SEQ ID NO: 477339 - DNA, 592 bp, Homo sapiens
gccaggcacacttcgaggcacagaaaatgtagcaacgatgaagacagatggggtcctgcctcatggcaacaaatgataaaatagagtgtctggttgtgaaaagaactgtgaagtctaaccaagtagggaaagcccacagcactgtgcttcaagtgagcactggatacacggaagtgccggacatgcagaatccacggaggagaagccttggaagaggaggcccccggggatgccaagaagagagcaccctcagtgggggcaggcccctgtgtaggagcagccagcgcggaaagctggctgtgggcaattctccattccgtggaagaccacagtgccccctcaaggtgtacctggctgctgccccagagtcgctgccaggtcccgatggctcctccacaccttcaggaaaagcaagagataaaccattgcatgctgagctctgcagggaactggaggcggacaccatccattctgcaaacctgcaatggtgacacttctggaatctccttgcctcttccagggctgcagcctctaaggcaggactcttttcttcctctccccccacctccccccccactcccctcctccccct

SEQ ID NO: 477340 - DNA, 1447 bp, Homo sapiens
gaagtggaagcaggggctcaggcaccccctgtcccagaatgccctccacattagcacacacgtcctgttgtcccaacatgatgtcccagcagcacagacgttttgtaactgtcaagaacgtggcagagcatggaatccagaggcctgcgtgctgtgtgtgtcctcttctgctccttgccgttccctggctgacatgggacctgcgcaactccctggcctcgctgtctgccttccacactcatccatcaacacccagtctggatcagccccactcccacagtgtctctaagaggaataatgaaaaaccttgcaaactgatgccacctaaagccatggtttttaacctcattggggcctctgcaccccctggcaatcctctgggttgtccccacttctcttggcaactgttttcaatgttcataatctgcctcaagtcctcacctaccaaccctgcagacaatcttgctcccacagccctgacgcccaccaaagcttccagctgtgccctgctctgacgtcgttgtaccctctgcagatttaatctatgccacccgccttgccctccttcattccagaacagtccagctttaacttgaatattttctccattattttgatgtaaagagtaatgtgggaatcatcttttctcctaatgtatcttccgctgtcccagccctatatattgcaccacctgtcttttcccctctgatatgagatgccattttacgacacactaaattcccacataaatttgggtctatttctgagctcttcattctgttctgttgatctgaccaaatattcctacgtacttctctattttaattatgttttcatatatgatgaaactgatctcatctcatgggttttttttttttaaagaaaacttcctggatatttgtgcatatttatttttctgtataaacttaagaataagcttgtctggttgcaagaaaagagttatctaggtatttaagtgtaaagcataatttagaagaattaacaactttataatacttcggatcaacattttccaattcaagaatggagtttcttatttccatttcacaagttcttctattatgttcctcaataatgttttaaaattcttcacatgaaccttgcacgttcattgttattacaattggttttcaccttccattgtatttttaaacttcctattgttttatgtgggagtgctattaatttgccatattaatttcatatcagaaattgtatagaattcttactatttatattttttcccattgactatcttgggatttcaagttatgaaatcactcatttcatattactgatacaaaattacttcctgttttctaatttggtgcttcatttcctttttcctatttaactgctttatttaatacttcatgtaagtgctccttactctggtgggagtttcatcatatttttctatagtttt

SEQ ID NO: 477341 - DNA, 1038 bp, Homo sapiens
tgaagtgtgcatattaaaaatgtaaaagtaattgttaaaggaaaagaaatgcaatcctttcaaatcagcagaagaaatgcagaaagcttgatcaatccaacggaagaaggtacttgcttctcctttgcctaccctcatgattgtaagtttcctgaggcatcctcagcaatgtggaactgtgtggagacatcctactccctggacttcaagtcaagcttggttaagtccgtcaagatgcaaactgaaaccaactcaaaatatggtccagctgcagctcctgcttccttcacacctactcctttgcagcagtcctttgcagtaaatggcaccatcattgaattatcctggactccgctgtctctcacccccgtgccttgtaagttaccgcagtcctcctcagaaacatctgtgcagccctgtgacagtggaagctccctggtcaaggaagtggccgtgctagaaaggagcatctccaagctccgcactgggctgagtggcaaacggctgatttataagaagtggggaagcgatcctctgaggccagcaggagttgtctcttaccatccctcggagcattccaactgtttcggggctctctccactggtattctcagggacacctcaaactaaatcaaaatagaactgcttgtcttctttctcagatccatgcttttgccagtattttccactgtggccacccactttctcaaattgaaagtccgagggtctccttgtctcatccctctccctcactgtcacatctaacccaacactgagtgctccaaattcttcctccttgaatctgcccctccctccattccctccaccatgatttttgtccctggattatttgatcagcctttgaactattcaaattgtctcatttctcccctgctcccatccactctgcacactgcagccaatatgatctttaaaaaatgtatgaatctgtttcatgcctgtttaaaaccctccagttgctacctattgtcttaggatgagatcagaagttctcaacagtgcaaggctccccgggat

SEQ ID NO: 477342 - DNA, 566 bp, Homo sapiens
aagggctcaggcacaggctaatgggcagtaggtattctcattattatttttaatcagactatgcaattttatagctcccgtcacccaaggctattgcagggcaggtcaacctgtgctgagccccagggtcacctgacggagcccaccccagggaggcaggaaatgagctgcagcactcatagcggccccaggttccagtctctggctctctttcacagagagcatctgggctacatgagcttaggaaactgcgctcctgcagggcaccccagtggctggacgtttttggattttggaatatctgcatacacaaaaggagctatcttggggatgggacccaagtctaaatatgaaattcattttttttcatatacaccttatgcacatagcctgaagaatccacctctggtcctgaagctccttctggtactgggagacatcccaggatatgtttctaactgtgttgactcaacttgtcttttcaatatctagattcaagtcttctcttatttcaggaagttttttttcaattatattttaaatatctttttcagtctcattgtttc

SEQ ID NO: 477343 - DNA, 708 bp, Homo sapiens
cagctgaaggggcacagtcaactcagggtggatttcaggatggtccttgcatttttttcaggtgcctttttctggctctcctccatattaattctcccgaaggataactatttcagatagaataatgatctctttcagccacattccacacaaataccacagataccaaaaagtggaaaatcatctctttcctctttactccaagtctttgtttcatgcatttgagagtcaaatgctagaggccaaatgctgccctcgggctgcccagcagaagccttgctggcatgcatacccagtgctctggcctcttcctctaccccatacatcctggtcctatggcctagaactttcagggaaagaggatgaatctaaactgaaatctaaaagcaccaccaagaatatgatgactgtagaaagtggtgttgaccccatgtctgccccatggagcagcccccaaataagtgcttgtgttatgctgacgcaagccaaggaactaccagaagctagtagaaaggcctggagcagatccttccctggtgccttcagaggaagcatggccctgccaacatctggatctcaggcttttagcccccagaactgtgaggcaatataaatttatgtagtctaagtcactcagtttgtagtactttgttaggcagctgtatagcaaaagaacacaattccctttgatgaaaagaaaaggatgaa

SEQ ID NO: 477344 - DNA, 615 bp, Homo sapiens
aaggcatacactgctgggtttgcactgaagccatgcttctctggcactactcccagtcagctacattttgggctcctggggcccagaactctcaatccaaacagccctaccttcaggtccatccaattgtgccaccagttgagcaccccaggaccaaagggaggccaaagaatagccattttcaggggtgtggacacagcctggttctgcaggctgaagaaccacacacaggcatgcgaggccctttggcgagatgcagtggggtggagcctctcccttcccctggcatggggaaggctgcgctggaggaagcgggagtggcaggctttttctccctttctatgcccaatgccccaactcctccccagcatgccaagcctctggggttggtgcatggggcgggagtaggggaaagggcgccaggaaagttcttcatagactgatagtgtaaagaataaccctaatgatggcctgctgtttttttctagcaatgcacattggtattcatctttaagctctacctgtattaaatgtattctcattttagttgtataacagaaagagaaaattttaaagataattttcacttatgtgtaaaaatgattcctgaaatga

SEQ ID NO: 477345 - DNA, 744 bp, Homo sapiens
cagccagcaaagaactaaatcctgccaacaaccactgatgtcaccttttggcctcaaagggagctacgctgtgtttgtgagggatggtagtggtgatggtggtggtgatggtgacaatggtagcgatgatggtgattgtggtggtagaaggaatggtggtgatggtggtcatggttgttgtggtgatggtggtggtgatgatggtggtagtggtggtgatggtggtggtggtggtgatggtggtagtgatggtgatgattgtggtgaaggtggtggtggtggtggtgatggtggtagtgatggtgatgattgtggtgaaggtggtggtggtggtgatggtgataatggtagtgatggtggtgggggtagtggtggtggtgatggtggtggtgataatggtagtgatggtggtggtggcagtggtggtggtgatggtggtagtgattgtggtggttgtggtgaaggtggttgtggtgatggcgatggtaatggtggtagtggtggtgatggttgtggtagtggtagtgatggtagtagtgattgtggtggtgatggtggcaatggtggtggttgtggtgacagttgtggtgaaagtggtgctggtggtcactatgatggtcatggtgatggtggtggtggtttttgtgattgtagtagttgtgaaggtgatggtggttgtattagcccgttctcaagctgctgtaaggacatacctgagactggctaatttataacggaaagagg

SEQ ID NO: 477346 - DNA, 1490 bp, Homo sapiens
tgaagtcaaaggagattatttcggaggtctctggatgagcagggctgcgtccaggctgcagctgagaaggactgaaccagagtcacgagctgcttcgtgttctatggccagaacagagtttggtggacctgttacccaagacatgggcaggtatagcttctccaaggtcttttattggaggttgctggtggcagagcacggaaaattaaggctacatctgagttcacatggggacagaactgtttttgtgtctgcagccaaggccatcatcagcaagtctgccatttggacacaggcctaccttctcaaatcgaccttcctcattcttggactcacctgggttttgcaccctcctacctggatcccaaagctcccacaaggcactttgatttggtggctgactgtcaaattattatttactggaagttcttgcagagcaattaggcagaagaaagacatagagtgcatccaacttgggaagaaggaagtcatattgcccctctggagacatcattttttatctatcgaaaaacctagatcccacaaaatatgcttagaactgatgaatacattcagtaaagtcatagcgtacaaaatcaacacataaaagttagcatttcttttgaccaataacaggatttacctgaaaaaggtatcaataaagcaatcccatttacaacagtcacacaaaataattgctaggaatacatttaattaaagaggtgaaatatctctacaatgaaaatcataaagttctgattaaaaaaatgaagagaacacaaaaaattgaaatatattcctggttcatagattggaaaaataattattgtaaaacgactatactaccaaaagcaatctacagattcaatgtaatccctatcaaaacaccaatgatgttcttcacaaaaataaaaaaaagtctgaaatttcatgttatttcaaatgacctgtattgaaattcagaaatcttctcttcttcttgctcctgtttattgtttacaatcttgatgacgtatttctgtttcaatcattaaatccttcagttctggggtttctatttggttctttttttagagtatctatctctattaaatttctctttgattataaattgttttcatgatttatctgtattttttatttgtgtgctcttgcatctcactgattttccttaatgtcttcattttgaattatttttcaggcatttcacagattttcttttatttggagtctgttactgaagaattattttattcctttggaggtgtcatgtttccttgctttctcatgtttcttatgttttcatttacatccatacatttcttaagcatatgagagttctagttgctgaatatccttgccactgctttgttattttcttttttaactttttttttttttgtcattttagcctttctggtgggtgtttcatggtatttcattgtggatttagagcaccttttcatttgttatatttcaatattatattc

SEQ ID NO: 477347 - DNA, 720 bp, Homo sapiens
tttttaaattatggctattcttgtaggagtaagtttgtatcacactgtggtttcaatttgcatttccttgataattagtgatgttgagcatttttttcatgtgtttgttggccatttgtatatgtcctttagagaattgtttattcatgtccttggcccacttactgatgtgattatttcctttttgcttgctgatttgtttgagttccttgtagattctggatattcatcttttgtcagatgcatagtttgcgaagattttttcttactctgtgagttgtctgtttactctgctgattatttcttttgctgtgcagaaagcttaattaactccaatctatttatctttgtttttgttgcatttgcttttgggtgcctggtcataaactctttgcctaaaacatgtctacagggatttttccaatgttagcttctataatgtttattgtttcaggtcttagatttaagtttttgacccatcttgagttgatttttgtatgaggcaagaaacaaagatccagcttcattcttctgcatgtggcttgccaattaattcagcaccatttgttgaataggctgtccttttcccactttatgcttttatttgctttgttgaatatcagttggctataaatatttggctttatttctgggttctctattctgttccattggtctacatgcctgtttttaataccagtaccatgctgttttggtttc

SEQ ID NO: 477348 - DNA, 1118 bp, Homo sapiens
ttgaagactattataagtgaagcaatttagaaaaccaagcagcatggacagagcagcgtgtggagactcccatcgtgaatttttgctccaagaactattgcagaaacataccacaaaaaccaagagaatccatagaccgtttgaaggaaagaggtggattgcccctgcaggctctgtgggacagctggagaactgcgagtcagcttgctttctcatctgggaggcttatagcctggggcaagttctcagcgcagctcacaggctgcctagaaatacgctcagtgttttgcggggcacagtgggagtgagacaggccttttggcctgtgggctgcatgggagggcccagcacaccacctgatcctccctatactaccacagctgatgcactcttgaaagcaccacctcttggctggagaccagccaacacaaaactagtacatttgacaaaaatacaaccaaggaccctcagaaagtcccacttcactcccctgctacttccactggggcaggtgctggtatccatggctgagagacctgaagatgaatcacatcacaagactgtttgtaaacattccccagtacaagtccagagctcagtatctcttctgggtggctaatccagaagagaaataataatcactgcagtttggctttcagaaagccccatccctagggaaaaggggagagcactacatcaagggagtaccctattggacaaaataatctggacagcagcctttgattcccagatcttccctctgacgtagtcttcctaagtgaaaaggaaccagaaaaacaattcttggtaatatggcaacacaaggttctttatcacccccaaaatattacactaggtcacaagcaatggatccaaaccaagacaaaatctctgaattgccagaaaaagaattcaaaaggccaacaattaagccaatctaggcttttgaattaacccaatgcaacaaagacaaagaaaataattttttaaaaaaagaaaaaggaacaaagcctccaagaagtttgagattatgtttaatgacaaaacataataataattggtgtacccatggaagaagataaatctaaaatttggaaaacttatttgagggaataatc

SEQ ID NO: 477349 - DNA, 713 bp, Homo sapiens
cgggtgtcgggctgggggacggtcaggtctttcccttcccacgaggccatatttcagactatcacatggggagaaaccttggacaatacctggctttcctaggcagaggtccctgcggccttccgcaagcctttgttaccttcccgacgactaatttacatgtaatgaaattctactatttgccccttgtcctctgtgtctgtctatatttagcatcagatgaagtcagacttcagacaatgccaaaatcatacaatgaaagtcgagagtgtcaagtacttaatagattctgcatacacactggaacagtttcactgggagaattatacatctcaacaccactgacatcaggtttggccatagaactgctttggcaaatgtgctgtgagcagagaagggaagtgcaggacaaccagccggcccaaaatataagaagaaatcacctgcaggaaggagctgaatatgatcacttaattgagaagacacagtcaagcatggataagaatttagctataaaagttaacacattagtggaagtttattgtgaactggtaaaagaaaataaaagacctagaagccacagatatagcagcctttcacagtttactaggccttcctatacagattccaccaggagctaagaagaaaatgtagcaagatttaagaaaccatgacataagcttggtagagggagacagtggccatgaggatat

SEQ ID NO: 477350 - DNA, 1660 bp, Homo sapiens
ttaagattcttccttgcttcttctggccatgagggcagaaaagaaagcggaattcatctccactatagacaattgcaaaactgaactgaagaaggcaggctgtcccaacaagtgttcagctcagcagagtggagacactggagtgagtctggctgagtccagggttttcataggcctcagaaagcaggaagtgtgctccaactggaccatgggcagccatgggcaggcccagaaaaagcaccacaagttcccactgcagtctgcaggactggcagcctacaggactggcaactggcagccccgcccccaggcttcaggccctccctggctcgaaggtggggttttactggggaccaacccccttccatccaggaccctgtctgccattcatggcacccaggctgccattcatggtgcccaggccgttcatgccaagtggcatatgcaggccagcgctgagctgccctcagcaccccctcaggctccctcccatgctcatcggtgcccaaagtccggagggggccaaggcggcagggggcccccgagagtgcctggatcggaggacgctgcttgggcagctgcagctatgcgtgggagggcagggctcctgcctgctcctggcccccaagagcacggggaggcctgggtctgcagccatgacttggtggctgcagctgtgcccagagagcacaaagctgccaccctgctgattcagaagggggcagggcttccacctgttcctggctcccgctggctttgattggtcctggattgatttttttaaaagtatggacatgaagatattatgattccaaatgacaggaaaaaaacttgaagatagtattccgcattgcaatttcttaacatttctgcagcatttccataaaatggtatctttcatatggaagcacatatttaaaattagaatttatttaatacaatgaacaagaacaatatcacttcaattcaattcacaaatggcctttattgcaacagccatggatcaagtacatattttcactctttaagcagaaggttgaatatgtgcattatgataatctgactacgtcactattggaagaggattatcatagttgttcaaacactatttttcctgttctttcaaatgaataaaactacatttttttcttgtagtacagtataactatcaggtataaatgaaaaagtcaatgcaatttaatttttaattatatttttgctgttttaatgtttaggcaaccacggatatgccaattcaaattttttagttaggtatagatataattggaaaataacttagagtttttttatatcattttatctgtaatcagataacagaattgaaaggaaatagctctcacaaataacaagtacattttcatatgtatttgcatagatatacacagtatgaaagcaagtaaataaacagagtgtagaggtttcagaggtatacatggtaaaaaaaaaaaatttgctccataatgtactaccctttctgccattaaacaacaattagtgatgttatttaagcggaatttaaattatctaaaaaaaatatttacttttctaggttttggcacatagaaacaaaaaattttctcttgaccccaaagttacttgtttcatttttataaagggtcattctagaaataaaattcac

SEQ ID NO: 477351 - DNA, 2011 bp, Homo sapiens
aggagaagatccagcatggtcatgcttacacaagtaaacatttgtgaattctccaagatttatcagttgagttcctcatttggctgttcctggccaggggaagaccactttctcactccatctcctttacagctccccatcccactgacagcaacttcccaccactcaataaaatactccacattcaccaccctttcaattcgttcacacgacctgattcttcctggatgccggacaaggacaggtgcaagaagtggtcacactgaccctccgctgagctgtgtaacacttaagccttccatggatggcaaagctaagagatcatactgcaatacaagccctctggggcttcaggggtcacaggcaacccctagacaccactgcgggcccacaaggagttctgttcatgctggttgcccagaagcgctcatcctggaccctgcacccactcccctgcatactctccatgccatgagggtctgagcactgcactacaggctgagtaaatgagccaacccttttgcgagtcccatgaaagggtaaaggaaatgatcctatttcagtattagactcttttctcttgctgattggaattctggaagtaaggagtttgggggaataataaacacaaacaagagcacaaacaataggagtaaatcttatgtatcatatctagcatgctcaactacattatctagaccattttctggaagaatgaaaaccctccctttttccacagacttgtattctattgggaaactatagacaataaacttaaaaacaaacatataaatattatactatgtaaagatgaacactataagcaaaatacagaaaaataagagatgagacagagataggttaggggtagagatatactgtattagttaaaggagtgaatgataagaagtgggaatataacttaatttttttttgctaatactaattttctccaaattactttttaagtagtccacacttccccacatattttaaatgccaaattcccatatgctcatgaatctgaggtatattcattttcaaacttggaatgaggagtaggaaggcattgaagatgaagagtagcactaaattttctggacaatgtcattattttagaccttgcagcattaacaaaactctttgcaaagtaaggtcttaatgtgtacttatgaggcttataagcactgaaaaaaaacagatgctttatattccttgaataagaggcaatttgaccattacagaaaaataattatctgcaatttactttgtaattacaaaacaagacattcccaatatcttctcttagtattttttgtattaaattttattagcatgtggaagttattttgattattttgcataaaatcattgctagtaattactctcttcagctctttcttccacagaaaaaggaatgacattctgttacacacaatactattggctcacttgattcagtagtaaacactatcgttatataaaaatagagttgaatattattataatgtatttctgaaaagaaacaagtttaaaacttaagttttaagggaaaatgacatttttggaaacaatatggtcttaaaaaaaaaggtatctcccttggttgacaatgtaaattttgtaactaatcatatgccttctttgctttggccacaaaaaactactgaaccaaatgtgtagcccacttctaaaaactgtattttactcacctctgtatattggcttaactcacactattatttcccatggtaatatattcctgtgttataatcttttgataaatttaatatattaaattataagaaaactgcctcaaattttctgtagaatgaatctgagtaaagtcatatttatgagatataaaagcagctcaaaaacacaagcagcacaataatgtaaataactgtagaaacagcagcaaagagcattagtgttttatctaatgaactactcagtcaggtatcattttttggtgcttacattgaaatcaaaatgattttatgtcact

SEQ ID NO: 477352 - DNA, 2657 bp, Homo sapiens
tcatcagttaaggcaggaacaggccattttcacttcttttgtggtggaatgtcatcagttaaggcaggaaccggccatctggatgtgtacgtgcaggtcacaggggatatgatggcttagcttgggctcagaggcctggcagggctgcttcaagcgggatgaggggcggcgtgggaacctagagtgggagagatttagctgaagggaggtcttgtgagttacccgaagctcggcatccgtgatggtctagggggcttccgaggcgatcgggaagcatcagtcttcagctgctaagccgagaagatctgggaaggagtcagtcagagagccttgggccagagtttcaagggctctgggagtggctgccaggtgagttgaacagtctgattttcagtggggtcccacacagatgggacacggcttaggaggaatcctgggccgcgggcattccttggcccagtggaccaaggcaggcgtccctgcgtggtctgacacctttgaaacgtgggtgaataatcagagaggcgtccctgcagtgattaaacaccaagggaaggctgccttcccagtccgtgaccggcgctggagttttggggccacggataaaacaaatgaagacccaaagaaacaggaaaaattgtatcttatgctcagttttgatgaaatgtggacagtcatgtccacatatgatgaacaaaaggagaaatattctaaggggtatagaaaatggaataatggcctaaagaaagtaatgctttttacagaaaacattttaaaagtatacaaaataataactggctgcacattgatggaaatgaaatacatgggaaaaaatgatatgggagagagaaaggggaaatgttggattgaccctcctgaccttgagggaatgaggaaatgggatctgggacagtagaaaacacggttttacatagaaatcagggtatttcctctatgttatctgtgtagttcacactgcaaatctttcacactcaaatgtatctaaatcattcttgtaattaaaacttcagtgtatatcattctccaagtaaatggttttcttgaatttaatatctgttctaaaatatactgtttccaatttgtagtcttaaattagcatcttccatgttttatgatcctgtctcttaattcttatattttatatgtttcctttacatttctacagagctctctttcagactcaatcttttcaacctgtcctcattgagcagtcatttcctttgcattgatctatgctttacgtaactttagtttaccctccctatatactttgcagctccaagctatctactttgactgatgagatccgaacagaattccaggtggagctgcatcttggtattttaaaaagttaaaaataaaatataaaataaaaatatattttttattttttcatttatgtaaaaagttatgtactttttacatgttttattatgtaaaaacatatgtaataactgttttttattacgtaaaaagttaaaatataaaataaaaaaattttatattataaaatataaaaataatataaaagcattttgtttattttcataaaactttttaagggtgttcaacattttgtggacctactttttcttttagcatacagtagcacattgaattagatgtgttcaacctaactcaatgtgttattatattggcttatattatgttcatcttcaccctctttatttggccaaaaaatatttatagatcactgctcaataaacacgccaccatgatgtagggcagtgtttttaaaacctgactatcatctggcaatgtatgaagagagtgttcttgaaacttccctctcttttctcaaatccagacagttggcagcctctccatttccattttacaggtcagctactaccccccgtcattgactgccccatgtttacacttcacattgtttaagatttatcctctaaaacactaattatactattcaaaatgtttacaattttcaaggactcatcaataataaaatcagacaacgacagcagcaatgtacttgacattaagaacttcaacttctgattcctatagattccattttgagagtctcccatcttacagaactttttctagactctatatactttgtgtctctgcttttactgcctgttcaccttctttttcctgtgtaaagaatgacacccctctttccattggagattaggtttcaaaatacgaattctggagggacataaagattcagttgatagcaatgcccaagccccatttttttctcttcgcaatactaccatttccatgaagctatttattccttttctacattattaactacaaccacttctatttccccttagcactttgtatatatcacaattgtagcgttagacatactgtataattcatttatttattttactaactgtgagtttgttgaggttaagaatttaagctctatttgtatgttctttgtctaccacagtgccaaggagatagcagcatgctcaataaacattgattgaataaattcataccatgtatttcttggatctaaaactatctctggaaaaaggaaattaattaattactccttactttttaaattaaactttgtgctaaaaatcttctatttattttaattgtagaaagcagagctatgt

SEQ ID NO: 477353 - DNA, 624 bp, Homo sapiens
tgctgacatctgttctgcttctgaggaggcctcagtaagcttacaattatcatggaagacaaagggaaaacaggaacttcacttggaaaaagcaggagcaagaacttttaccaaattatttactccatcacaaccatcatcattatcatcaccaccatcatcatattcttaatatgcaaacctttaaatctggaattattatctccactttccataagaggagacagagctccagagaattacatatgctggtggaatggacagaatccaaatgtaagcctgactccagtgttggctggtctgagaaataaaaagaaagcgtacaaagagagaaattttacagctgggcctccgggggtgtcatcacatattggtaggaccgtgatggtgacttcaagccgcaaaaccagcaagtttttattagggattttaaaagaagagggggtgtacgaacagggaggccctgaatattgcaaatctgatgtacttcatactacagaccccttggaatctaagtggatgagtataactaaaatctcagcttccaaaagctaagactgaataagaggctagtgatgtgccctagtaggtcatcctctgccatttcatctcttaatgcacatg

SEQ ID NO: 477354 - DNA, 3103 bp, Homo sapiens
gaataggtcttttccttcaaggtgacttattttgtcacatatctggcacctcaaagatctttggtctctctctctctctctctctctctctctctctcacctcacctcaaagatctttggtctctctctctctctctctctctctctctctgtgcgtgtgtgtgtctttcttaagttcaaaatcaagatgccaacagggctggtgcctggcctgctcagccaactgagagggcttggattcaacaacactttgctagcgaagtcaaagaacagcaatccctacgagccgggaagcaaaaaagttgaacaccatgcttctctttacttagagcctggacagtttccaaatgatggcacagaaagaagaaaccaggaagaacctaatggaatctttcaggccaaaccccttgttcatttaaataatgacagtaagctggtgaattcaaataacgctaccaatacaataaagggtacaagtcacattggattagtatccagtgtgattatacgtgcaaagaacctatttccaaataattcaaaacattcacagataacagggatgatgacaagtgaattgacagttagaaataactttctgataacaatcataactggcttttaccatttagtacagaaggcttgactatggttaaaaggtttaatttttatgtttcaatgatcttgcatatttcatactactattactatttgtattttatcctttcttcatatgataaacgaagtcatattttgtatattttaactgattacacacacacatattcatttttgtatattaatgctgtaactagttatataaatgtcttttttttagagttctataaggtttctgattttggagttgattattttaggtttccaagtataaatatcacttctgtaaatattgctgatttcattttcttctttccattttattaaaattaatttatacctcttttgtaatttcattgtctagaattttttttaagtatatcatagtggtgattgtccacatttgattcatcctcagctcctataggaaaatttctagttttttcacattcaacacaatgcaagcttttaggttcatattaagatagtgtccatttaatcttgttttaataaaaatgtttcacaaacataagaattaagtataatagtatatttttaatatctaaaaggtgattataccttttattcttcttctgaaagaagacccccatttatgatatcataacattattttactgtagtacaaaattttgtcttaattttattctaagattttaagttgataaagtgggactgattctttccttaaatggcagcctttgtaaattttgttatcacttatttgtttccttattaagttaagaaaataaacatttttatatgctgtggaaaaatctaaatagtattgaaattatctgatatttgaaaatttggtaagattttccactgaatccatttgaacatggtcatttttttaaaagctggagcttgttcattgaaaacttatttgattttctggttagttgatctgttcaaatttttctgtctcctctggaattactttggataaattgcatactcttaaaatattattttcattcatatttttagtttatacaaagcatagaatgttagactcataacctttacttttttatcagtcctttcttccctttaacattcattcattttgtgtattttcctgtaagtgtaattttaaattttattttataatattctttttcaaagaagcagtttttggacaacttgtgaattgaactgcttaaattaattgacctcaatgattttatcttcattaactttttctgcttcaactttatagatttgttccctaaatattttaaatataatccttattaacttaatgtattaatttgtattcttttatctatagttacatacctatatgtatttacacatacgtacatatacatatataaaatatgtctcatatgtatatcactgctttaattagattgcgtatgttttgttatatgtttgcattatcactttgtagatattctgaaattaatttttagatttaatttttgcctcaaaaggctttgagagagataatttctcttcccttacatttccagatgagaggaactgttgcattttctggttttaaaatcaagttatacttttaattctttgacattttcactggcatttaatagttgattttggtcaatattccatgggttcctgaaaagaaattgtacgtgttttacatgttatctgttttattaactatgtgtttgcaatttaaaatcttattccttattctttcatgaaatgggagagctaaattatccaataaaatatatttctatctttcctaattttctgtgatttttaattatgaaattaatattgttacctgttatatctttaatatgaattatatccaatactggcacttatttcatacttaatcatgtttcccaaacttgtcacttttctagaagatcatacctcattcctttatttttcatatttctatgttattttgttttacctgtatctctctgagtttgttttgatttataatgcaacctaaaaataagcattttttgctcaatgggtgagtttatctaatgtatgtaaattaaggtaactgatgtacttgatattagctttgttccactatgttaagattttaaataacactcattatatccatatttctgtcaatattggttttcttgtcattttttactcaatacaattccctaaaactctaattcttctaataatttctatttttttgcatatgatcaatgatgaaattaatgtggctcttcttcctctctctgccatgactttaattgtaacttattacacttataaaattttttaattttcttattacttattaaatttatttgtgtttactttggtgctattcaatatcttaattttgtgacttaatttgccttccaaatattatataatttaaaatccattaagtaaatatgcataattcccttacctttagtacttcctcttttctgctgctctatccatggacatatattgtcagtgctcatattataaacgaaac

SEQ ID NO: 477355 - DNA, 677 bp, Homo sapiens
aaattgtatatgtctcagttcacacaaaacatagacctacctctgcattcagcttttgatatcattatatttatgaaatatttcttgtttcttcaggaaattatatgtggaggatctctgtggcccaggatgagggtcccacagaagatttttaggtacttatggctcttaaatctactctgtgatttgatttgggcttgtaaatgttcagaggcccagtttatatttctaacttctctggggttctaccaatcctctactcttctcacagccaaagcaattatctttactcttgcctggttgaggaagaacttattctccctgctgtcagaagcccaagccaagatagaggtcccacagaggaatatcaaaatgtcctggttcagagctccatgcaagctcccagacaacaatgccaaagatcagccatgtgagaaaatcatcttggatattgtaggcaaattgaacatccacatgacttcagtcacagctggtacaacatgaagcagcagaaccacctagctgggcctagtcagctcacagaaccatgaaaaataataggtttttttgttcttgttgtttttggtaggtaaggtttgttacatatcaataaactttgaacaatgtctgtcccatggaagtgggcactcaccagacatgagatctgtgcacagttt

SEQ ID NO: 477356 - DNA, 524 bp, Homo sapiens
gtcctacaaattctgaaattccttcattctctctacaaagtctctagagcacgcagtcttaagattttggtaaaatgttgttgatctattactactactgcctctggagaaaatgtctagaacaagatgctaaaataaaaatgatacccagtgaaagacctgtcactatatgttacaaaaggccccgagtgaagccgcagaccttcacagtgagtgttacagctcttaaaggtggcgtgtacggagttgtttgttcctcccggtgggttcatggtctcactgacttcaggactgaagctacagaccttcgcatgtggaaggggacccaagcagtttgccactgctggctcgggtggccagcttttattcccttatttggccccacccacatcctgctgattggtctattttacagagacctgatttgtccattttacagagagctgattggtccattttacaatcctttagctagacacagagtgctgattgaatgaaagaaaatgtttgaaaaactgtacctt

SEQ ID NO: 477357 - DNA, 2579 bp, Homo sapiens
cagggaaccacatcaatggttgtagtatgaggttcaagcattctcgagtgggctacttcagccctggcagatggcaggctgctggcaacactgctaagaaccacaatgaagtacatcatgatgaagaaggtgatgtagctggagaggctgctgctgctgaccatgatgaagatgatgatgatgatgaagatgatgattatgataatgtgaggattcatctgattctaaaaatccagatgactctgaaaatgacttattcaggaaaagaagaatctgttgcaggactccaagctgctgagcaccccgaggaaacagaggattctcaaaacaaaaaaggaacaagaatacttggacacaattcaaagaacaccatcagatacctgaggtctagcttctggtcccaaatctgtcattcagaagtgtgtaacttgacaatttgttgaatctcactggattttatttctgtcaagagtaaaattaaccagataagaattatgctgagacatagcagtacctcaaaaagtggtggaggtaataagctgcaaagttggaacttgaatcccggacctcaagctccaaatccagaattcctcactttccccccgctacctgatacagaactggagaaaaataaatttgatttaattaagtgtagcagatcccaggaactattttatgtttaatgattactttcaagcttaatttgcctctatttaagtgtaactaacacataatctttaggataaacatctcggaattctttctgaattatccccaaattttaagtttaggtgtgcatttgacaatctgcattgctgccaacagtagttggaagattactacctgaaagctgaggaagtttgcttcagctactacatgcccttccttgtggtaaatgtgcaagtcacggcacaataattgaggaaataaatgttggtgccttaaaataaatgttgatattcaaatttgtcctattttaccctggtaaatgtgtaagtcatggcacaatacttgaggaacttgagcagataagtttggagtaaataacctgtgttataaaatgcacaacactcaaaataaaatgaaacactacaactatgtactttaacttatgattcatagattttgtaggccaattctttgctattggaaaacacaaaacttttccaactttgaagactggaaacaaaacacaaactgcaagaaaacattaagttcatctatatttgttctgtaggaggactccttcctgtagtttgcagacagtcatgaatccccttaggtcaacagctgtcaacttcaattctcattttatccactccttccagtccaaagactttagaccaatatttttaggaaaataaaagatattttcatttaagtagcaaaatcaccaaaactacctaccagagaaaaaccaaatactctcagaatcgttgctgaggcaggttcagaaggattgttctgagaactactttgcaagtggaaaaaatgaagcctaagagacttacattaaatagggggttaaataattatatagtacagatgatataggaaaggcagaataagtgcttgatactttctcatttgtttacaagcattcacaagtttgctccttagccttctccaaattatgaacaaattatttttgttgccattttaaagtcttatatgtaaacatatttgatatgtttgcaatctattgcagatattatcccagatagatgcccatttttagctaatggaaagcctctacatgttggcactaaagttcttgtaacatgacatgctgcagtttagtttcagcagtttaaggacttcatttaaatgaaatcacaaagtatgcaatcttttgtgtctgaatgtttccactcaccacaatgtctgtgaaatccctcctatttgttgagtatatcagtagttattattgtagagatgtaccctactgtatgaatgtaaagcaattaatacattcaatcacttgttaatggtcactttgatggttccagtttgagactacactgtgttataaataatcctgcttctaggaacatatatgttcatttctcttgagcaaataactaggaattgctaggtcacatgataacagtatttttaacttgacaagtgttactaaacttttttctaaagtgtttttataccaccaacagcaatatataaggtatttcagttcctctggctcctcacctgcacatgcactgtcaatttttttagttatatctattccagagaatatgaaacgttaactcgttgtgattttaatttacatttctttgataactaatgatattgagcattatttaatgtaatttttagacattcctgtaacttttttgtaaaatgcatattctaatcttgcaccattttatttgggtgtttatctctttattgaattgcaaattatttatataggtggtctcctacttatgatgatttgacttagattttttcacttaatttatttatcagaatatcaaatacattttaaattatgatatttttgacttactggtttgtcaggatgtaatcccatcataagtcaaggagtatatgtaccc

SEQ ID NO: 477358 - DNA, 878 bp, Homo sapiens
tgacactgagtgcattttcctgtggatgggtaatggggagctgggctcagaagcaggcacattcaggggacaaccactctgccccagctgtctggaacatgaatgtgataaaaaaggaacacttttacactgctggtggaaatgtaaattagtacatccactgtgcaaaacagtagggagatccctcaaagaactaaaagtagagctaccattccccaaagtagaactactggcaatcccattactgggtatctacccaaaggaaaagaagtcattatatgaagaagacaaatgtacatgcatgtttatggcagcacaatttacaatagcaaaaatatggacccagtctgaatgcccatcaatcaaagagtggataaagaaaatggggtatatatacaccatagaatactactcagccgtaaaacagaatggtaatagtggcttttgcagtaacttggatggagttgggggtcattattttaagtgaagtaactcaggaattgaaaaccaaatattgtatgttttcacttataagtgggaactaagctatgaggatgcaaaagcataaaaataatataatggactttggggatttgtggggaagggaaggaggggaatgagagataaaagactatatatggggtctgtatattgggtacagtgtatactgcttgtgtgatgggtgcaccaaaatctcagaaatcaccactaaagaacttatccatgtaacctaaaaccacctgttccccaaaagctattgaaataaaaaaatttttaaaagattattttttaatgttataataagacaggattgaaaatcaaatctattcctatttttcatcttttaaaatagatgaatacattgagaaatgttttct

SEQ ID NO: 477359 - DNA, 565 bp, Homo sapiens
ctgaaggggcaaacaaaagataactggcaacatcagtaggctcgtaccgaggaatgtctgcaaagagtcctgtgacgtgatctgtcttcagcagtgaatacaacacctgctccggtggatgtagcaggggagtgaaatggactctgtgaggaaaatgtcccaaggatacagagcaaatgcagaaacatttattcaagaaaatctactaaaactcagcataaacaatgagactgtagcacttgaagccatgatccactgtcaccatatccccagccccaagccaaaacagcttagcagaagttccactctggatggatatggcccagaagatgagctccctctcctcctcagctcccgaacaagtgttaccatatctcatctgaagcagcagcctaccagcatttcttatccccttcgactcaaatgtgaagtgactaaattctggaaggctgagaatactaagaccctgaattccttcaccccgcttgctgaaaggcagagattccatgctgtgagaagcaaaccaagaagaccagaggctactgctccacccagcacctagaat

SEQ ID NO: 477360 - DNA, 693 bp, Homo sapiens
gctattacccattgaagaaaagaaagaaaaatttaagaaagcaatgaccatcggagatgtttcattggtccaggagctcctagattctggcattagtgtagattccaactttcagtatggatggactccccttatgtatgctgctagtgttgccaatgcagagctggttcgggtccttttggacagaggtgctaatgcaagctttgagaaggataagcaaagtattttgataactgcatgttctgctcatggctcagaggaacagatcttgaagtgtgtagaactactactttcaagaaatgctgatccaaatgttgcttgtaggaataaatcatcctgggacactaagtcctgggaccccatggagagctctagtgggaaggaggaagaggactgggatgagtccatagaggttcccatactgtctgcatgtacattggccaccaccaaggatctgtataagaataaggagttagcaatatgaaggtctggggacaggcaagagcacttgcacagttcctgcaaaggggagatcttggcattttcaaagacaataaactttactgacccaatattatagtattgtaattattactttacgtaatttcacgttactaaagaagttgagaacagaaatatgagcaaatttatatttagagtttgttatatttacactcatatttgccatttctg

SEQ ID NO: 477361 - DNA, 1779 bp, Homo sapiens
aactgggaactgtatctgttcattcaattgctgaaataatgtacaaatataagatttgactgcaagatgattatcatagaaggagttggccacctcaccacagatctccaagaaggagaagcttctctcacagctggagcaggttcctttctagaaacagaagaagagagagaccactgtcttgggagagaaatcacaagctgtcctgatccttctctaggtctcatagcagatctacgtcaaatgaaaggaaatacaagaccagtttgcaagagaagaggtgtacaggaaactacttcatttgacaggactagaatacagtatgcagctaagttgcacaagcaggctttaaaagctgctgtgaaacacaagccatcaggtaaaaagaaacgctgcagtattaagttagaggtttttaaaaaatccaacggaagtccaaaatcaagatgctggcacatatggttcctggctctctaagctagtctcccttttaaaaggtttagtctggttgtaagtacttaattgctgacaaggtactgagataatatatgctatctgccctccaaaaatatataactggaatataaatttgattcttatattgcttcagacctagccttaacatctaaagatttttcatattctcctcacatctttgaattcaatttttcaaaaatttaattaaatcaggcttaaaaagaaacagtaggatctccaatttggttgatattttatttttctgcttctacaataaaaaatgtttttacctaccatgaattataatattaactaggttgtgatttggaaatcctttttaatctttattaaatctttcatgaataacatacatatgaagagattttagttggagatagtcattcaatttgatttaaattagaagcagattccactatttgtgattaagtgtttttgcaattactaatagaatgcatcaggtaatatagcctctggtaaccactattctactttctacttctaagggatctatttatttagattacacatatgagtaagatcatatggtctttgtctttctgtgcctgttctatttcacttaacataatgctccccagcttcattgatgttgaggcaaacaacaggatttcattttttcttatggctgcatattattttaatttaggtgttgaaaatatctatcatagcttgtggcttgtctttttattccctttctttggtgtcctttgatgaactaagttcttaattatgagtcagtcaaatttgtcaatcttcttcctatagatttttacttttttcatcttacttaagaaatatttccctacctgaaggttataaaattatttttaaatggtcttctaaaagtttttaccatattcttatgtgcatttaggtttttaatccaccctgatttttatgtatagtacgagcaaagacctacagtgtaatgttcaacaagtggggtgatacagtcctgataattgtattcaaggtcttgaagacttgggaaaagtagattagaaatgcagagactgcctttgatcctgaagtaccaatcaaggaaaggtgctagctttacttcaagcataagaaagcctgatttttgttgaaagtaatgttcagaatatgattttttataagatgatgtttttctttagaatctctgatgataattgtgctacaataaactgtttttaagttgggacaatatatatctcttttgtaaaaatttaatataatatgtaagcaacagaaaatagttttattaaacagtggcaaata

SEQ ID NO: 477362 - DNA, 567 bp, Homo sapiens
gccctggatgtgagaaatggagtcaaaggagccaacttggcaaatttaatctcacatacaagtttcaatgaagtttcatgtctggactgatataaatgcattggaagtacagcatatgttgtggacccaggccccacagatgcatcatcgaacttacattattcagtggtcaagaaaatgtttcttcaacatcaattacctacgaatatgtaaaacaatggccagcaatggccagttaaatccttctcatgatgctatccctctggttctggcacttctgcttccctcttccttgtttaagggcccttgcagttacattgggcccacagctggagttcctctgccttcacatgctgacaccgtggccaactccttcatggttgattcctccaaatgtaaagaatacaggagatcctggaacacactaggaaatggggagtactcacaaatttataactccaagtctatagtcccctaaacttttcagacatatataggattttttgatacaatcgaacctgatctcatcatcttcttcccctacatcaagtgtagtggagagactct

SEQ ID NO: 477363 - DNA, 1358 bp, Homo sapiens
tctttaatcataagaactatttgtggccgttccctgcagcagaatataaagagccacccgaaaatttcattatgatactttctgtactagaaaaagtggattcactaatctgtgttccactatctgacttattgatttttcgctatcttaaagacccatatgaacatgcccagaggcaagaattcgattttctattcatctactgggtgtttgcaggaggagagatatttactttctttggtcctgagttagaatcagggctaataataatgatgaagaagaagaagaaagaagaagaaggagaaggagaaggggaaggagaagaaaggggaggaggaagaggaggaggaggaggagaggatgaagtgacggaggaacctggtagttattggtcaagccctaattgttctgggccaattgctgcagagttttggtttggcttcctgggctggctactgccaaattctgttgtcatatatgtaaattctgggaaccaaatagagtaaattaagagtttagattaattttaacatactagtacaagatttggggaaaatgtagtgatttctttagcaatggtcaaaatacaatgatgaggaaaattgcaggattagtagatattataaagggttttgctaaattatgttcaaataattgttatgtgaaggaacacaaattgattaaaacattgcagtatattttaagacaaatgaatataattctctatatatttgtggctatgtcgggcttaaggccatttttttgcagatatttcagaattattgtttacttgcaatgaattcaagaatttatttttttcataggaaagttaagaggttcaacttgcagaagcagggtgctggtgtttttcaaaataaataaattatttttttatttaaacatttcaatagcaaaatatttcttaaatatatcatagctgcgacaactagaataagctacagatgtttttaataagttgaataaatttgattttcaaaacagaatcacaataccaccttgcttaaagccaaaatatataaattgaaagtgaatttatcatgtaaagtgaaatgtaagtgccttttttgaaacttggagtacataattgatacatatattgaagtgtctgtgactttttaaaatgtctcatttggtaataggaaaactgatacataactcttgcctgataaatcccagacaccaaaaggagaaaagataaataagaattgtgaacgtcaaagaaatgcaattatgtgcaccccgacatgcaaacaaaacatcagctacttctatttcatctagaaaactttaaacatttatatcttctcatttttgatgtttatgaatttatcatcatt

SEQ ID NO: 477364 - DNA, 786 bp, Homo sapiens
tttgtcacaaatcctaggcttctgctgttccttgctgcctatgtggcaaatgcagccacccaagctgtggctgcagacctgggcatccctaagctctcgggggccagaagcaggcaacggccccaccctcctgggcacagctgcagctgcccaagctgcagctgcagacctaggcatctctgcactctcagggacccaggaagggtcccccctgtctccagtacccttcagcataaagagcctgggcactacgaacagtggcaagaggcagacaggctcctgggcagaaaggggcaggtccccagtgaagccccaccttcaagctggggaaggcctgaagcctgggaaccaagctgccagtcccatggaccagagtgggtacttacagtgctttttctgggcctgcccatggccacccatggacccatcggcatgcactttctcccctctaaggcccataaaaaaccctggactcagccacaccagaagagatgacgggacaaccagctgcagaagggagctaccctctctgctgagagctcaagagatgatgggacaacctgcctgcagagaggagctaccctctctgctgaaagctgaacactcatcgggacaccatggctatgtagaggagctaccgactgtgggtttcctctgagctgttctattgttcaataaagctcctcttcgtcttgctcaccctccacttgtctgtgtacctcattcttcctggacacaggacaagaactcagtacccaccaaatggggttgctaaaagagctgtaa

SEQ ID NO: 477365 - DNA, 762 bp, Homo sapiens
gaagactttcaagaagagagacaataacctcccaccattaccatggaaaatgtatacctccaagttctgttcctgttggatttggatgtatggcttgctcttgccaatggaatattagaagacttgactcagcaaattagaaatgtgcctaaacttttgggatctggcatcgctgttattgtgactatgatggatatttccaaaacaattgctgtatctgactttttggtgtctgcagtttcagttgctacaaatcctgttgaagaagaaggagaaggagaaggagaaagagaaggaggaggaggaggggaaggagaaggagaagaagaagaagaagaagaagaagaagaagaagaagaagaagaagaagaagaagaagaagaagaagaagaggaggaagaagaagaagaagaaggaagaagaaaagaagaaagaaggaagaaggaagaaggaaggaagaagagaaggaggaggaggaggtaacacatattgtattaattcatttcaatttctatgaaatatccagagtaggtaaatccacagagtcagaaagtacattggttttgcctaagactgggaggaaaaggtgaatgaagagttactgtgtaatgagtatgaggttttctttgtagtgaataaaaggtttggaaaccagataaaggtggtggttgaataaaattgaggatgcattaatactaaatgacactgacttgtacgctttaaaatggttaattttatgttatgtgaatttcacttcagtgt

SEQ ID NO: 477366 - DNA, 1250 bp, Homo sapiens
tcaggaaactctcccatttcactaggaaaaagttgaaaagggaaagctcaatgtcaaaaccattatctgaatataaattttcaataactgctcaggggttaggaaatcagaggactagcaagccatccaggaaagcaccaccttatgaggcgtccattaaaacacaaaaagagaaagaacagagaccatttacacaaataaaacaggagaagtgggacttggagatggagaaaggaaaccaaaagcaaaaagggagatatgagtctgccctcctaaccctacacagatgtctcacaaactcatgttcctgctcatggaggacaggcaaactgagcagggtaaatctatcaccccaacaatgcaaagcccttgacctggtgaagctaatctgccagagccagcggctctcattgttgtcaggggaacgatggaaagccaaggtcccaagtgatgaagctcatgagggtgaccctgctttggaaccaggcaggacagagaagggcagtaaatggatcttcggggtgttctcatggaaaacagagagtgatctgcatactcatcaagccatccctgaagaagtaagctgagattagtgcaaaaatgtatacacaaaatgctaatgctaatgctaacattatttagaaacataagatcgtgggaatactatatataatcagaagtaaggtattggagaactaaaatttagaagtgacccatcaattttcagttgcaaatcacgaaataatttaaatagcatgtttcaatggaatatgtattggggtgcacatatttatgctatataagttaaaatgagaaggctacaaaacatatacatatatgtgtgggtatgaatataattactgcatatttatattaacgcttatataaaaactaaattcatttgaaagacctaaaattaagagtttagagaagattgaaaggaggatgaactaaccaataagagagtaacattattccctaaagaactttaaatgttatttgttccctttcaagtttaattagaatcatggtgcggagtgcgagtaaaagtctttgtattgaaatgaatgtgatattattatttcatgagcactgaatacattttttctatataagaacaaatgtaaaggttattaatataaacagaatatggatttcttctaagtcaagatcagttggtagaaaaacaattgaccaataatcctagttgcagtgtggctttgagaccaggaatacagaatatttaaaaa

SEQ ID NO: 477367 - DNA, 870 bp, Homo sapiens
gctggcggctccgagtgtggggcctgccgagcccacgaccacccggaactcacgctggcccaccagcgctacacacagccccagttcctgcccgcacctctccctccgcacctcctcgcaagcagagggagccggctccagccttggccaacccagagaggggctcccacagtgcagcagcaggctgaagggctcctcaagcgtggccagagcggacgcccaggctgagaaggtgccgagagcgagcgagggccgccagcacgttgtcacctctgaagatctcggccaggcctgctctgtgacttccgccacgctcccacgggtggcggcgaggagcctgagccggcgatggtgctacaggaggcgctggagccggccatgtgcctggatcgctacccgcatgtgcagcttgaggcctcggagctgctgctggaagatggcggctcagccctggccactgagctcaacaccgccaagcttgccctggcctatgcaggcatggagatgaatgacttggtggtgagctgcggcctgggcctcgcgccagggtccgtgcccacctggctgctggaccccatgcggctcgaggaggagcacaccgcccccggtgtcaccttggcactcctgcccatgctgaatcaggcctgggcctcgagggctgcgagccctcgaccccatgctgcagcagtgcctggtgtgggctgcctgccacaggggcaccactgccccaccctgaaccagaagcctgagcaacgacagacgccacgctgaggaccgtgctgccaccgtccttttggggactcatgacattggcctccagcctgcattgagataaacagccggagccccggagagcacctggggaggctc

SEQ ID NO: 477368 - DNA, 670 bp, Homo sapiens
ggaagagaacaaggatgagggacagtgaaaaggggttaggatcaatagactggaggttccagcatagccaaaggattgtgggggttgggcacaagagggagggaaacggggaggcagaagacagttgtctgagggaaaatgcttgctgtccaggaaatgtcaaggttgcagttcccagtaatgactggggcatggtcatagatatgagtgtgcctgagttgggtgggaaattccaatgggaaaaaaaaatctcagaaagaagacagctcaagaaaccccacagtgacattagggccatgggctctgagagtggccgcaccatgtcttctctcatccctggacctttctgtggaaatatgaaagcaaccacagtgctcagccatgctggaactgacttcttcctcctcatggtccacttgaaattccaggaaaaggaacagatgtgcaaggaattgcagcctggagaaacatagtgtatttggagacttgcatgtaaatggataaaatgtcaatcaaccttcatgttgtgtctacgctcaatcatccctgatgaccctacgctgactacagatgcagaattcagcaaaaaccaatgaaagcattcggtgagaatcaatggctatatggagcttacaataaaccgtattgtgtattttattattacgtatac

SEQ ID NO: 477369 - DNA, 958 bp, Homo sapiens
agcatgactgtgatggtgggtacatcactgtcaaaacctacacaactgcacccacgtgtacagtatggcgcagacaagatggcgctggctgagtggaaagtccatctgcaaagcacattcacaacctctacctctcccaccaaagttattcccctggtgggcccatggtgtgaacactgggctggctgaggacggcggctggctgacatcaaggcagtcctgcagtagaagtccaaccttccacaaaccaggcccagattgtttcctccatcagttggtcatagggagcaccccacagggccatggacagaagcttgggagaagaatggatgcaagggcactgaatgacatgggccagtctctcttcctcggtgccgcctacggaggtgacaaccatctacttgacatgatggctgacctcagacccctcatgaagcccaagattgtcaaaaagaggaccaagaagttcatctggcaccagtcagatcgatgtgtcaaaattaagtgtaactggtggaaacccagcagtattggcaacagggtttggagaacattcaagggccagatattgatgcccaacactggttatgggaacaaaaaaacaaagcacatgccgcccagtggcttctggaagttcctggtccacaatgtcaaggagctggaagtgccactgacgtgcagcaaatctccctgtgcggagatcgctcacagtgtttcctccaagaaccacaaagccatatggaaagggcagcccagctgccctcagagtcaccaaccccaatgccaggctgcgcagcaaagaaaatgaatacacagctcatgtgcatattttatttatgcttaaataaaaccattaaaactgccaaaaatttagccaagtatggtgacacatgatatatgctgcctggagcaaggaagggaagaaataaaggatgaaaggaacaccaagaaccccaga

SEQ ID NO: 477370 - DNA, 829 bp, Homo sapiens
aatgacttatacaagttttccatggggcctggtggaagactaggacggtcaacagcagcctggagagcctggagtctgcgtcaatatgcaaccctagccctgcacgctgggcgtttgcctgaggtttccagtgcaccggaggcgcgtactcgtctgcctaagagggtgaggagggtgaaggggattgatgaagcaggaggtggggggctggggctggaaagtctgaacaatgggaggaggataaaaatgccaggtgtcgcagcacatgaagtcacaaaagatgtatacagaaccagatgtgagataaaggtcagggagtttcaggaccaaatttgtgaatgtcgggtttgttctaatgccgatgttacaaacatacatgatagcttaagtgagctctgcagggctggacaatctgtgaatgccacatttaacaagactggagagaggctgggtgcacataactcaaggaggtgctgagggttggtcagaccctaagaaatgggtgaatgtcatggactgttgtcctagaagattaatgaaatgatacatgtaagaacttaagacagtgcctgcaacacagctatctctggaagttgttgttattattattacataatgttttcacagttgataatggtttggctctctgtccccacccaaatctcacctctaattgtaatccccacatgttgagggagggatctgtaattcccatgtgctgagggagggatctgtaattcccatgtgctgagggagggatctgtaattcccgtgtgctgagggagggatctgtaattcccgtgtgctgagggagggatctgtaattccc

SEQ ID NO: 477371 - DNA, 1462 bp, Homo sapiens
caaacgggaacatgaaccctttgaggttgctaagtgagtaggatggaacagggagtggagggatggccgcctgttgacagttgggcattagcaagtgggaggaagaagatgtctggcttctccattccttctttttttctctttctggttttgctaatttatttgaaaattacatttgttcacgtcaaattaccacttgatactcattgttggatttctttaggtcatcctgctgttctctcagtttcccaggggtttgtgtgtctgccttgtgctattcattttcccacggccttgttggttgcttccacagaggcaaatattctgtgtcacacagctcactgtggacagtttgccagcttttgggcatggcgaaagaacgatctttggaagagcagggaagcccagaagttcacagaaaagaaagctctcaaattcttcttgcaacagtggtaagtaagaaagaccttagcttcttctgaaaaggccgtatgcgtgtatgtatgtgtatatatttatacaggtatgcgtgtatgtatgtgtatatatttatacaggtatgcgtgtatgtatgtgtatatatttatacaggtatgcgtgtatgtatgtgtatatatttatacaggtatgcgtgtatgtatgtgtatatatttatacaggtatgcgtgtatgtatgtgtatatatttatacaggtatgcgtgtatgtatgtgtatatatttatacaggtatgcgtgtatgtatgtgtatatatttatacaggtatgcgtgtatgtatgtgtatatatttatacaggtatgcgtgtatgtatgtgtatatatttatacaggtatgcgtgtatgtatgtgtatatatttatagaggtatgcgtgtatgtatgtgtatatatttatagaggtatgcgtgtatgtatgtgtatatatttatagaggtatgcgtgtatgtatgtgtatatatttatagaggtatgcgtgtatgtatgtgtatatatttatacaggtatgcgtgtatgtatgtgtatatatttatacaggtatgcgtgtatgtatgtgtgtatatttatacaggtatgcgtgtatgtatgtgtgtatatttatacaggtatgcgtgtatgtatgtgtgtatatttatacaggtatgcgtgtatgtatgtgtgtatatttatacaggtatgcgtgtatctatgtgtgtatatttatacaggtatgcgtgtatctatgtgtgtatatttatacaggtatgcgtgtatatgtgtgtgtatatttatacaggtatgcgtgtatatgtgtgtgtatatttatacaggtatgcgtgtatatatgtgtgtatatttatacaggtatgcgtgtatatatgtgtatatatttatacaggtatgcgtgtatatatgtgtatatacacatacttacatgtgttcatatgcatctattaaaattttactcatttatgaagatgaccctgg

SEQ ID NO: 477372 - DNA, 597 bp, Homo sapiens
gaagaccttgtgtgtgtttacccctcacagtatcaagagggaacagctctcgagtaaatgctatccaaaaccataatgagataccacagcacaactatcaggatgctcacatttaaaagactgaccacatcaggtattggagcctttgagatacctaagaagaacaatcaaggcgattgcttggtacagtggtctagagcaagcttgtccaatccacagcccacaggccacatggggcccacgacggctttgaatgtggcccaacacaaatttgatggcaaagcaagagagcttgaaaccattggggaacaagtgggtggagattccaagaagacatttggagatacaatgatgaagaaaggtttagagtatgatcataagcgtggagggaagattcgggtttcagttaaaacgaggaactatgaagggccctctccaaagcagatgagcatgtgggaaaacaggaaatcagaaggcccctcagatagagtaaagaggggttggtggtgtggtgctgctctgcaaacggaagagagcagagagccagctggctctgcattttgaactgtgagcaatggtaagcacagtagcagaaaa

SEQ ID NO: 477373 - DNA, 465 bp, Homo sapiens
cctgacccagtgactcatgattctgtgtatatccactcctttactaagatattctcccacacttatcttcagtggttccatattgtttatagtgttcaatccaaatttggacctggcacttaaggtttaccagatcttgtccaaacttgcatttccaaatttatttcctgccacttcccagaaggaactctcaatgccatccggtcctgttggttgtactcactggcccacagatgagctctctgctgtcagtctgaggaagactgtgggaagaagcaagggagaggctcccacgggaaaaagattgactcaggattctgaatttcttctttgtgttatcttgaatctcattgagtgtcctcaaaacagttattttgaattctgtgtctgaaaggtcacatatatgtctctccacgattggtcactggtgccttatttagttcatttggtgaggtcatgttttcc

SEQ ID NO: 477374 - DNA, 1292 bp, Homo sapiens
gaaataatgaataaagaatattcaggtaaagttcatggacatcagcaatggtaacaggatgcactccaaagaccaagcagggcaatctcaactcagagatggatcttcagcagccatgtggttacaccactgcagaagtaatcaggacagaggccattacccagggaccaagcaggatgtggtatatcacctggagacttgcatgttccacctccatgtcagagaacatgtcagcttcattctacacccaggaatcccctggtgcaagtcccagagtccagaggctgaagaacctggagactgatgtccaactgaaggagaagagggaacaagtgtctggcacaggaagaaagagagagccagaagactcatccactgactcaaatgtcaatctcctctggcaacaccctcacagacacaccccgaaacaatacttcactagccatgtaggcatcccccgatccagccaagttaacatctaatattaatcatcacacatcccttgactaaatctatactaactcttatctaatactggattaaagagtatttgctgattgctctgtttacttaaggacttcttaaaatattaaatatgctaatataaaataactgatgttcaagagggattaaatgttgcatttcctaaaattatttgatcactgggtttttcttcccatgaaatttcttaatagcagtgttgtgctgaacaattattgtgaagttagttgctctctagaaatgagcatcttctgtgttaaaataagtcaactgtctatttcaaccaatagtctgaagagaattgctatatttaatgtaaaaagtaatagaatctatataaaagcaatgactatagctttaaagtaactatttgttaaaaggatggataagtgaacaaagagtatgtttgttatgaaaccacaaaagcttttgcacagttttcaaataaagcacaataatccaataaaccaatcacattttctaaaatcaagttcaaaacaataccgggaagtatagttttttccataaatttagagaagagatcaaaagtaaacaagtaccattcaaagataaacttaatataacaataatagatgacactattaccaaggaacttgtacaatcaactgcaatgttaatatcaagtatcagcctcaaagagaaaccaggaagttattggcaaaatattttattaaatacaggtcagtgttgtacaatggtatgtggtgtggaagaccaattactgacatctgcatgttttagcatcattcttaatctcctttaaaattctc

SEQ ID NO: 477375 - DNA, 1739 bp, Homo sapiens
gagggccatgaacatccttgagttggagcagagccacttccgcacctgctccgagcgtcccacgttgccccgacacccacaggagcggagccacttccgcacctgctccgagcgtcccacgttgccccgacacccacaggagcagagccacttccgcacctgctccgagcgtcccacgttgccccgacacccacaggagcagagccacttccgcacctgctccgagcgtcccacgttgccccgacacccacaggagcagagccacttccgcacctgctccgagcgtcccacgttgccccgacacccacaggagcggagccacttccgcacctgctccgagcgtcccacgttgccccgacacccacaggagcggagccacttccgcacctgctcctctccagctccccacaggctgccttcaccacacccctggagctgggtagctcctgtgttctttcagttgctgagtgccacatacaccttctcagatgtcccctcactgctcagcagcctgtggaagcccccgctgactggttcaattcatagtcctgccgaccatcgaaagctttcggatgaccacagtgtcatctcctgccccctgcccagcgtggggctgtcccctggacggtcctcactgacctccatgcctgtggtctcctgccgcctgcccacctgccttctgcccaccgtggggctgtcccttggatggtcctcactgacctccgtgtatgtgatttcctgcccagagcagggctgtcccctggatgttcctcactgaccttcgtaacactgtagcgctgtcccctggacggtcctcactgacctctgtgtatgcaatttcctgcctagcacggggctgttccccggatggtcctcactgacctccatgtgtgtgatttcctgcccagcgcagggctgtcccctggatggtcctcactgatcttcatgtgtgcagtctcctgcacactgcagcgctatcccctgggcagtcctcactgacctccgtgcatgcggtctcctgtccactgcctgttgcagaggctgttccctggatggtcctcactgacctctgtgtgtgcaatttcctgcctagcatggggctgtcccctggatattcctcactcaccttcatgtgtgtgatttcccgcccagcgcagggctgtcccctggatgttcctcactgaccttcatgtgtgtgatttcctgcccagagcagggctgtcccctggatgttcctcactgaccttcgtgtgtgcaatttcctgcctagcacggggctgtcccctggatattcctcactcaccttcatgtgtgtgatttcccgcccagcgcagggctgtcccctggatgttcctcactgaccttcatgtgtgtgatttcctgcccagcacagggctgtcccctggatggtcctcactgacctctgtttgtgcaatttcctgcctagtgcggggctgtcccctggatggtcctcactgacctccatgtgtgtgatttcctgcccagcgcagggctatcccctggatggtcctcactgaccttcttgtgtgcagtctcctgcacactgcagcgctatcccctggacagtcctcactgacctctctgtgtgcaatttcctgcctagtgcagggctgtcccctggacggtcctcactgacatccatgtgtgcagtccttgccccacatccaagccctgggtcctgagagatcctcatggatgcctgttctgacccatagctt

SEQ ID NO: 477376 - DNA, 662 bp, Homo sapiens
ctagctttggcctgggtgatggggggagcttcgcagagatgtgtcttcaggagggactgtggtggacaagctgagtggcagctccattgcaagatggatggaggctcttgggccatccctgatggagcccggggcatgggtggccacaacctgcacccacagccatccctgatggagcccggggggtgggtggtcacaacctgcactggccagtggaggcccagggagggtagcccctgcatcttcaggcaaggcatccccagcaaaggcagtggtggctggggagagagcagctgtgacggcggcacggagggcctgacgtgcgactttgggatgtacccggagtgggagctgtgttttcatggtgttcattctgcatccacatcttcagaggaaatccccgaggcattgtgagcatgtccatcagggcaccctggaaagcttggtaaatgctgtgtggtggcgaaaggatgtccgttatagagatgccacgcattccaaagcaaaatggagatgattttaaaatgtgaaaatattcagaagtaaatatgcacgcagctgctcctcccatcagcgttagccccaggaccaacagcgacgggtgcttagtgcccaccaggtgctgtggctctgggacaggtctgaggtctgtgaggggaggc

SEQ ID NO: 477377 - DNA, 738 bp, Homo sapiens
tccaacaacaggactgagggtgcctggggcaagcgccaactcatgtcatcaccctcactgagccccaggcttaataagaaaatgcagcagtcccagcaacaaattctaggagtacaaaaactgaacagtcagtggagactagcgcaagattttagactcatcaatgaggcagtaattcctctatatccagttgtacccaacccctataccctgctctctcaaataccagaggaagcagaatcgttcactgttctggacctcaaggatgccttcttctgtattcccctgcactctgactcccagtttctctttgcctttgaggatcccacagaccacaactcccaacttacatggatggtcttgccccaggggtttagggatagccctcatctgtttggtcaggcacaggcccaagatctagttcacttctcaagtccaggcactctggttgttcagtatatggatgatttacttttggctaccagttcggaagcctcatgccagcaggctactctagatctcttaaactttctagctaatcaagggtgcaaggtgtctaaattgaaggcccaactctgcctataataagtcacatatctaggcctaatcttagccagaggaaccagggccctcagcacggaatgaatacagcctatactgtcttatcattgccctaagacattaaaacagttttgggggttccttggaatcactggcctttgccaactatagatcccc

SEQ ID NO: 477378 - DNA, 2056 bp, Homo sapiens
catcgtcttttttatggctgaataggcccaagggctcttcggtcagcttgtggtgaatgctgcctggcttgggactcctcttttgggtcagtgggctcccctatggccgagggaaggtccagaaatgtgagccaagtcctagaacctttggtgctctaccccctgttgctgagctggtacctgaagcctacaactcacagagtctcacccaaggcccagaacatagtacctgggtatcactgctggttattcagggctcaagggctcttcagttagcagaaaggggacctcatgactcagatcagtaccctatcctgctgtggctgagctggtatccaaggtgcaagacaatgtcctccccactcttccatctcttctcctcaagcaaaaagaagtggtctcttttggatccacgagctacgcagcttggagttaggggagtggtgatgccagcactctcttagatgccccagctgatgcctcagcactaaagttgtaaaggggaataaaaagtaggttcggggatggtgaataaatcacttggaaaataagcaagatttgcacagataagatgtaggaaattattttttaaaagtaaactaaacccaaatatcgagagctttgacaaccaggaaagccctaaaatatctaagcagagaagttatatggttgtagggatatttgaagaaattaattccaaagtcagcttgcagaaataaatgaaaagggacattagagagaagaattgttatgagaatggttttaccattatgtctatctaaatggcccagtttatgggttaaaaagtagtggtgtaaaaggaaggcagaaagaaatgtcggagccattttgtcatgaatttattaaatccctaccaaaataattctcaactgtgtgtcagagaatctatgaaccagaaactcttggagaaatgacacagaaaaggtaattctgataaacacctaagtttgagaacccatgaactttatattgtggcaggaataattaattttaatgactaaatgaacacagaagtaaggatgcatataaaatcaagatgattccaaatttttaagcctgggagactttatcccaggaaaatgagaataactttgtcactattattattatcaaaaataatctatcaattctgctaattcctgttgtgttaaatttaaaattcactgaaacatagtgcctagatgttagaaagtttataacagatgcaattaaaacatttattggcatatataaactcaaggaaaagagacatggcaatttaagagtcatggcagagtaattaaaatggattactatgtatctacctatagttacagaaaaagataattttaaaagtagaaaagatacaatatgtgaagaggtaataattatacatttgtcaagattaatgaaagacaagagttcctttactcactgcgaacacctatgaggcaatgaatgaatactctggccattaatttcctgtttctgaagtctatgaatttttaccttgtcaaagcatataacattggcatactgttagccttgttcttatcatctgaagataaaatgaaatcaagtataaaaacatgctttgtaaaacactacacaatatcaattcatttgtctttattttaatatttctttctaattcccctgccattcaaggcacagttgggtttttagactattttttattaatgccaatcattaggtcctttgttcactgatgcgcatttctatttatatagacttcaactattaaaaatggtgatgcattttttgaatcaatttcaatttgtaatctctcctcttgtctacttacctagagaataaatacactaaggtagtgaatttcatcttattaccactcctgccaaaaaagaaactacatctaacaagtacccaatgtttgatggctttattgattttcttcggaacagtttccattagattttcccataaaaaatgtggcaggatttatgtcattgttccaactgcaggtggcactgactgacttaatttgtcagttctgttcttggttattctttcttaa

SEQ ID NO: 477379 - DNA, 1666 bp, Homo sapiens
caataaaggaaagaaaaaaaagccaaagatgaggcatgctgggagttgtagttttcagttatcatatgtaatttttgtaacattacttagtcttgcaaagttccattcacctgtcaaaaatatcgtttgccttaggcaagtgattgaatgcagttctgcaagattgatctatatagagcagttggtgacaaccagttacaattttgaatttctaggaaatagcactatgaacacaggtcttattcctcctcccaaaacaacacttccaggcattcccataggatttttggtaattgtaaagctaccaacagaatgctttgctaactgcttctcttccccagtggactgtgagctcctggaggacaaggcaatgaaagacatgctagatattcaaagcttgttgaataaatgactgaaaggatgcagaattttcaaaattccctcttcaagtacttcttctacaggaatgggtagagtgggaagtgaggagacagggtgggtatgtgggtgggaatagggcaagtgacttaagctggtgtgggtgggctccagtatccacttctacttcaatcagagcaactcaacaatgctacatatataagcccactatgaaaattggatattgaatcagctgggaaaatgaattccttactgagcatttcaacttaaacttgggttccaagtggattaaacagatgatgttgtaacactgttatcagcctgacaggaaatgcatagagacaccagtcctcgtttcttaaagtggaggagcctcagctagcaaattgccacttattagcttgtctcacctataaaagagccatggaagagaagtgcaagagaactgaagtgatttcctgatgacagcagggggtgctctcactagactgaaggacagatacattctcagagcagtaggaaaggaataacacattgccttactacgactctatatgagactttagaagtgcctaatacctgcctggagcaaaagaattaatatgctctattccacggctctgccgtcttcaactttgataaatacttaaaaatgtatttttgaaaagtcattaacttctggaatataggattcagccaccacacttagaatgtgtgaaactgtggtgcaatttgtaacaggatgtacaccacatttttaatcagggaattgtgttttttaaagctaagagacctgtagtgaattaaggcatttggctcagccaaacattccaatcacgaaacgatcgaagaggaaatctatagaatcttattataaacttacaaaaaggataactgtgggtctcggccataaactgaagtaatacagatgaactggacacatatgttgcacaataggtgattcagagcaatatagcctatgctgttttatgatatggaaagcaatcaaatcttatttgcaaaaaattcagatcaattgaattttaatgagaagcaggtgctggagtgtagcatccacaaagaattctgggaatgtttaaaattagtcccatatttgccaggagacagttgggtacataaacttttttatttcttgattcatgggtctattcggactgtagattgctctgccattctgagttcagcaatttgaataaattatgctgaaaatcacttggtggttcattttgtgtgaaattatattttc

SEQ ID NO: 477380 - DNA, 893 bp, Homo sapiens
tctcagaatgcattatactctgctgttatgggttaaagagggttattatccccactacccccaccacacttggctgtgtgccttgcatttcccagaagtgatgggtgccacttcccagtggaagcttttggagctgtctgacacctctctcctgctcctctcacagcaagcacccagacaggaactgctccttcagcctgcggttcccaaaattaacaggacacaaagcagagccccagctgtcggtgatgcatgtacagcagtagcgagaaatgcacttctgtcctggcttgctgctgaggacgtggggccacttactaccccagcggaactcagccgacactccaagcaagccgccagtaggtccttggccagcatccagggtgaccaattagtctcggtttacccaggactgtgtgggtttaaaacaggaagtcccacatttgaagaagcccctccatcccagagaactggagcagctgtcaccctaacaggtgaaaatgtaccctaatcattgaaaaagaaaagagctagggatttgtatgctatcaagaaaaagtaatgactgtaagtgaaaataaatgttctaaagggacattaaacaaatactagacgtgatacatcctcaaatacacggagccctcttccaacattctccatttatttttttccttccactgatcaaacttgtttttcacaaaataccacttttgagttaaataaaacaccattgcaattccattttctctcctgcttcctaattgctctattcacttgtttattcacccaacagaatgtgtttctgtattgcacacatacatcacggcagagactgtggtcaggaaaggctgtattgagaaaaaaaaggccacctttctacaagccagtgaaaa

SEQ ID NO: 477381 - DNA, 709 bp, Homo sapiens
tttggtttgagcccccaatccaaagatgctttgctggtagctaggaggtattcagcaagcacctgctatgcagaatgcacagtgtggagcacttggagggaccataaagatgaacggaacacgaattctgcccccaggagtcttgatggagctgacgggcaccctaggccttgtctcgcccctaggaggcccctcttcctgctcctctgcaaggctggcatcgacagcaggtccagccccatccctggcctcagtgactcaaggggagttttcagaaacttctcagatcaaggaaagctcagaaaatccagtgtctcctgaggagaagccagaccctggccaggtgtctctggagtctgtcacagaacagattcaggaaaaacaggtcgctggggcctccagcaaacagccgataccacatctgtgtgcatcgtcctgtgatgcccagggaatgggcttcgagggtgctgcacagctgtggcaccagagaacactccgcggggaacggcgtcagacggggcggggcgaggtgaggcccgcaagccagtccctgctgcacacggtagcgaaggcggaaagctgcggcaacaccttcccaccatctctgtgaggtctgtgggtggagagggtgggatgcgactgccagccccgtggaaagccacttgccagccatcctcttgtcccagtgagagctgcaggttaaggcacc

SEQ ID NO: 477382 - DNA, 979 bp, Homo sapiens
cagtgtaaggttcacaaccattctagcccaacctgctgagaaaagtctctgttgtgtcttgtcaggtttttgatatctctgcttggctatggcccagatgccccacgagcagccaaggcctccctggggcactcagctgagtaccagtggctaccagtgctccctgtacccggggacttaccagtgccccctgtacctggggatttaccagtgctgcctctacccggggacctaccagcaccccctgcacccggggatctaccagcgccccctgtaccctggggtctaccagtgccccctgtacccggggacctaccagtggtccctgcacccggggacctaccagcgccccctgcacccagggatctaccagcgccccctgcaccccaggacctacaagacctaccagtgccccctgcacccggagatctaccagtgctccctgcacccagaggcctaccagtgccctctgaacccagggatctaccagtgctccctgcacccagagacctaccagtgccctctgaacccagggatctaccagtgctccctgcactcagggacctaacagtgctccctgtacccagggacctaccagtgccccctgcacttggggacctaccagtgctccctgcgcctggggatccgggagccacaccacggcatccacggcaccgcgtccctttctcataaaatctcacgatttttctttcgaagtatccagcctgtctccttaattaaaccataagctcctttaaagatggcatgcgtctacactttgtcatgtcccagccctgaggaagccacctctcacacagccgacctgaatgttgacaatgatgatgatgatggctttggctgaataatttgcaaatttgttcaataggtctccttattcacactgagacaggccaaggtcctgaccccagagtgaagccagcttgagcccccagggctgaaggtactgagcccttaactg

SEQ ID NO: 477383 - DNA, 1820 bp, Homo sapiens
gctgcgagctggtttcggatccatcccgcctcccggcgtctcactgtgtgccctaccctttgaaacacgcccccgcgcccgccctgccgtagaccaggcagcgaggaagcccacagtctccgggggcgctgcgcgcgaagtagcacgtgcttctcgaaacaccgcagcccccgggtcccgccccgcccggcgcgcgcactcgaacccgcccagagagcggtgcgtggcgctgggtgcgagcagggtctagccacccccaccctcaccccaccccaccccaccctgcttttttcaggttcatcaaggtttgcgcagtggatccgcgaatgaagccagcctggaagatccccagtctcgagacagagcctgacaggggcagatgcactggaaggaccctgtctgggtttagcaaccaagcagccatcctggccccacaggtgtgggacttctgggtcttctcctggctggcttcttgctagaggatttcaagagacccagcaagactgtattgtcccactgaatgctcaagatattggttagaagtagaaaaggggagggggtagtatttagcctctgtccccactaaaaattattcccaattgtcatttgtgtcatctgtttagcttacagttttaatccttgtcaaaatgatcatttgccagggtgcataaaacaccctatttgatgagaactggttttaaaggaaaatggggccatcagaaggaagccggttggtgtgaagagacgtctgggaagagcccctggcgagggccctcattccactgggtgacccagaaggagaaaaccgcgatggcgcttctcatttgaaatgttttctttatggacagtgtttagcaattgttataatgtgtacttttgttgattgatctgtatacatatgtaaaataatttgttctctgagttaattttgttggaacaaagactttagtgcttcctacattaaaacattttactgtattgcctgcattttaagagcctttttttaatttttaatttttttggtccttgtgatatgacgagcaaattaatgaacctgagagggggttgtgggaaccccaattgagagcccagcctgtcggtcagaagctccggatgcctggacttgcaactgctgtgcgaagtgggatgggggtggggtgccttggggattgagccctcaacctgtgggatctgccactatctccagtgggcccagcgtctgccgggcagccttgactgtggccctagagtcacggaatactcgagcagacctctgacggacatggtggggtgagccatgtgggtcgctggggagaggattccaaaacagaaggcagcctggctgctatggagagaaaagactgtgcaagcaacagggaaagaacaggggagcacagtaagaaggccatcgtgtcatcaggcaggaggtgacagtgctcaggccagggtgggagaggagcagtggcaagaaggcattgttatttctggatatgttttgaagacagaatccccagaatttgctgatagattggatgtggggtctgagaggaggaaagggcagcatgggagcacctggaatgatcccacttactgggacggcaggggcagggaggggctggggaaacagtttgcttttggatacagtaaacttcagacatacatcaaacacccaagtgaagagtccagagagacaggggtcagggtgacaagagacgcttgtttggaagtcgtcaaccaagggatggaatttaaagctgtgaggtgggaagagatggtctaggatgagaatgtagacagcaaagaggttgggactgtacctc

SEQ ID NO: 477384 - DNA, 941 bp, Homo sapiens
ttctcacagtgcagcagcgggctgaagggctcctcaagcgcggccagagtgggcgccaaggcggaggaggcgccgagagcaagcgagggctgctagcatgctgcacgctggcagctccaggtgccggcacaggtgctagctccacgcaaagctatggctggaccagatgcactgcacgcagcttctgctgtgggcacccacaactggatgagggaaacgcagtggcacctgaaaatttggagatgccaggaaccacagagcccaaaagagggtgtcacagccctggctcagggagcccctaagtctgggctccccgaaggtctgcagctcttctgtcctcatcacccacaacatggtgagcatgggggtgtgtttcagccctgtttgtgttacagctctttcagttccgccattcagtgggtccagaattcccgtcctgcgtccagaaagaatgaggtacatagacaactggaggaagggaggaaatgtatgctgattggtccatgggcagccatggacgggcctgcaaaaagcaccataagttctcactccaggctgtggactccacctgaaactgacagtccagcccccggttttcaggccatccatggcttgaagtaaccattttccttattttttaaatgccaattacttcctgcatttttaaagaatttcattattcaaactcgtatccctagacactatggtttaattttatcctcgcctatttttaaataattgatatgtctttttaagtctcctaatctatagatttttgtagagattgaaaattacacagacactcctctgtccccctaaaatgcttgaaataatgtatttttaaataaggtttttccatttaaaatagtcatactaatcatggaatatttttaaaaggaggaaagaaatccccatggacccaccaatcaaaggcaaactgc

SEQ ID NO: 477385 - DNA, 641 bp, Homo sapiens
cgcccactcagcggatgccgtccccaccaaaggggtgaagccatgaaccaatcggagccaatcagagaactccatctccccaaccacagcaatggatcacagcccggccgtcggtccctccgtgagattgggtatatgggtgttgggaaatgaaagcattttctttctctggaattaccatctagcctggagccccagcgtgggaaatgcccccagcgtggagtgcccccagcatgggaaatgcccccagcgtgggaaatgcccccagcgtggagtgcccccagcgtgggaaatgcccccagcgtgggaaatgcccccagcgtggagtgcccccagcgtgggaaatgcccccagcgtgggaaatgcccccagcgtggagtgcccccagcgtgggaaatgcccccagcgtgggaaatgcccccagcgtggagtgcccccagcgtgggaaatgcccccagcgtgggaaatgcccccagcgtggagtgcccccagcgtgggaaatgcccccagcgtgggaaatgcccccagcgtggagtgctcccaccgtggagtgctcccagcatggagtgctcccagcgtggagtgctcatggcggttccttgtgccttttgatacaatcgcataagaaggctgtgtggtgg

SEQ ID NO: 477386 - DNA, 528 bp, Homo sapiens
ccacctcatgtctgttaggatggctaatatcaaaaagatgaaagaggccagcttcctcaaaaagctaaaaacagaatgcccatgtgatccagcaatcccacttctggatatctctcctaaggatttgaaatcaggtgtcagacatcccgaaccccagggtgggccctggcgctggtttggaggcgtcccccccggtaaccctcgtgagacacgggacctcaccacagaccttaacactattaacagcaaagtcagggatccgtccctcggaaccatgaagaattccggggacacagacaccgaccggaacgggggctctcggctccgcaaagacattctgcagcacaaacatcgccctggctgttgcgcggacgtgtcttgtgctcggcaggacctgaacgacccgttccctgaccgagttatctgcgtgtgaacgggaacttgtttggaaacagggtctttccagatgatcaagtttgttttgggttttcaccttgtggtcttatattttcctaggtttgagtaata

SEQ ID NO: 477387 - DNA, 497 bp, Homo sapiens
agcatacaaatcatggttatgcttttaatagtttcaattttcctgtctgagctctggactagagaccctgcaattactccctgcaaaacacctaaattacattgccagaatgaacctgcaagcaaccaaaagaaattctgggagtccatggacaaaatgacagccagagtccaagaggcaggagaggggctgaagccagcagatactcggggagcgaaggtggctctgacacggcgactctgtcctaagagggacggggcaccaagcctggggaccacactgggaaggggaaaaggcgaactaggaaacatcctgagccttagtcggcagggaaactgtcttaaccttagtaccaggcaagtttatttcttaaatcccgagagaatgtgcagcactgaccagccctgccacgggcttggctcctaaatcttctgctctttgcatgaccccaaaatgacaaggtgagaattgtaattaattttatttatttatttttt

SEQ ID NO: 477388 - DNA, 556 bp, Homo sapiens
catttgtgcttggcatatagaccatgagacagcaaaaagtacaaggcaagagagaagaaagtggcaagaactccagtgtgcctataacaaagactgtggagggagtgaatctggagaactcatcgggacccacgttggttgctgctgaacatgccaggaagccactttccagcccttctggctgggaagctggctgtggcaccagtggcactgtctgggaagctgtccatggggaggctgctgagcaccactgtgtgtcctttatactggacaagcaccacaggagcaagaagagagaaaagaaaactggaaccaagaagagaagccccttccttcttcagtctccacttatcttcactgacaaagcttcactttgggctggctggcagaggagaaatatttataagatccagctccaggatcatcagcaggcaatgaaggggaaccagggaagaaaagaagaaagaaagaatcggtgccaattcatcactactgctggaaaaacaacttgaataatattacctactcctgtattgattatattactaataaatgt

SEQ ID NO: 477389 - DNA, 609 bp, Homo sapiens
atgttagacatggatcctaccctcctgaataggtttgccatattaaatataggacacttaatcaaatgtgaattgcagataagcaatcttttaaaaatatccacatgttcccttaagtcctgtttttggtataagattttaatcctcaactatgttcggtatccaccagtccagaatccatttattttgccctctccaaagaatacacttcacctcagcccaggtgggaagggacaagttgcttccacactccagcccaggtgcagaagggacaagttgctcagcagcacagaggagatgggggagacctgggaagctactggcttctcaaacagccttcatctggacctcctgatttggggccccacttcaccaccatttccagaggtgcttggtgctatcatgttgatcaatgtaaatcttagaaagccacttccaagccctgggaaaggtgtctgtacccaaatccaagaggcaggaacagatgtggtggaacattggaagcaagatgatgagtaacatgaattgctagtcaagcatctgaaaaaaagagccctcagttatattttagagtttatttttaagaagggtttgctctaaaagtactgt

SEQ ID NO: 477390 - DNA, 636 bp, Homo sapiens
gatgaatgaatacgcaacatgtgacatgtacaggtgctcctcgaggctgactgtacctacaatggaatatgattcagccttcagaaggagggaatttgaacccatgctacaccatggatgaccttgaagacattatactaagtgaaataagccactcacaaaaggacaaatactgcatgactccatattctggctgtggaaacaacacaaatgagaatcaacagtacttagggaacaactgggtactggatgggacagtgcggagcggggatagtggggcttttgatagatggccgacctggggcagggcaattccggagcagagggctctgactccctgtgaaggaaggaccctggctggaggatccccacctatgctccaaggtggtagccctgggcctatgaggggaccatcacgatgtgggaatgggatgcagggagtggagctgaaagcccaccagagacaaacccgactaactacccttcagttttgcccaagacgctgttcacttcaactcatccattcatggaagtaactttcctgccaagctctcttcctctggtgatggtggagattctatacactttcttcatggtctctcagccagcggcagcttctgggcccaccttgcttca

SEQ ID NO: 477391 - DNA, 1902 bp, Homo sapiens
gcagacgcctaaagggcggatgacgactgagccctttcctgtgctcccagaaggcactgggacaggcgcatggtctcatttaattcatgcaaacatcccataatgatccccatcttacaaaggtggaaagtgaccctcagaggagtcaacaaccccactgggggcaggggtgagggctgcataaaggttagctccattgtctcccagatctcaaggaggtcaggactggagatgaagccggacccccaggagggtggaatcccacagcgaccaagcccagagctcacgggtgtgcccagcagcacgggaacatgtctctgggaacggccgtaaccctgggtctggaaggctttgagggaggtgtccattcagcccgggctctgagaaaaagggtgtcattggcgccacctggcacccagccactgaacttcatagcgcctatgcccccaatgaggaacatggacagggctttcccaggaagctttctaggaccccgctgcctgctgttcttgggagaacacactggttctgtgcatggcactctgtgcctaaaacagcatgaggacaaggccaggaggccacagcaaggctgtaatcagaacccacaaggattgcatggagatgctgcagtgccgccaccacccaacggccggagcccccagcaaagctggaacatgaatgtgattgctggaactgaagcagccatgttggactctgaggtgaaagcctcatgcgcaggagagcagggcacagacaggaagaggggccatgtggccatgtcctccagctgccatgtgcctagcacatcccagatgtgcctggttggccccctccctccagctggctcctacatgtggctgctcgcaactctttcccctggcaattacatccccaccccacccaaacaccttggcccccacagtcctacttatccccatctccatgccttcctgacacctcgaaggaccttgctcccaagcagacttttactgagtgctggtatcagcgattagttgggtatttccagatgcattttcccatggagtcttcaccacaaccctgagagatgggcattacaatcctattttgcacaagggaaaaatgacccagtttaccagtacggggaacagtctattcagtcattcattcaacagatatttaataaatacctacaacttgccaggctgtatgagaaactcgacacagtgacggagctgggttttgaactccaaacccagtgctttgcctgtcatatctggccccagtctcaggtattcctttctctcacacacaactctacaactgagtcactgtccagcacaaaccctgttgagcacacttagttcaatcagcccatggccacttccccatcagattgccagatgtttgaggacaggaactgtttttgtcttcgcatctccaaattcgtctgacagcaagtccctcaataaaggagcattgagggaaattgagctggcttgctggatatacagatccttccttgggaagccaggcaccgaaaccatgccctggttctttagcggcacttaaagcggaacattgcatttgaaacccctcctttctatgaggcacttagagtactttctagatcatgggtaattaatccatgacacaccctgggaggagtgggaacaggagcaagaaatgctgctctcattttgctgatagagaaattcagcacagagcctgtcctggtgtcgtacaggaagccagcagaagaccaaggaggtggattctcctcctccctctgtgtcccatccatcctgtcctccggatcctgctgtgcctccagggcggaaagagccgctctgaccgacagggactgctgtgcacagccctgatgcctggatgcagagctctgacccagatttcccaaggccc

SEQ ID NO: 477392 - DNA, 718 bp, Homo sapiens
gtaattgacatggaaactatacctcttaatctccaacaggcaaaacaactcctgctgccatgtgcaagatctgtggctccagctgtaattacttcctccatgcctttttattgttgttgtcccaagaaacagttcgtggaaatgaatgtgccaccctaacttccacagagtcacctccattgctgagtgtcttaggtgctcaaatcttgacccctgggagcagaggccagcaccatggtaaaccagacaagaggacacggacccatgtgctagactcaactgtgggagttttgcgttccagctaccaatggggaatggacccaggtctctctgatggtgtgggtgatcatgtggccccctcattctccccttcccactgctcactctggggttcagtagaagtagtatatggaggttaccctatcacaagctcagccacgcttctctccaacctcacacgcagcccaccccaccaggatccaagctggctgggtcgcataacactagccaccattcactgatgtgatccaaatgcctagaacaatccctggcacatagcaggtgcttaataagtagtcgctgtatacgtgtacctattgaactcttcctatgcgcccgacactatgctgaaagctttacaattattattccatttatttttcacaagaatcttgtgaggtaaatatcaactcattttcagatgaggaaatcaaagctc

SEQ ID NO: 477393 - DNA, 528 bp, Homo sapiens
ctgactccttgctgtacttcccctgatggcgattgcctctctgccagccagcttggatgccctcccttctaaagtcaagggtccagtgattcctcatctgtatcattctgagtgtaccagcaagaagggccagcaagaagtgccaccaagatggcaaggctttatggcaagggggattggggcgctgcagaatgatatcattgaggctcaggtgaagggttgcaaggagctgcttcagggtagcaactataaaatccgaaagttgagcaaggtgggaagatctagaggacaaaagaaaaagactgaaagacactgcagtataattcaaggcgctaaacagatgagactggcacgtgtcagaagcagcagtgaccttgtgcgcgtcttaccatccctgctccatttagacatttatacaatggttgcaagaggaaggctgatcaggcaaagtctaattggggagctgaagaacctctttattctcctcgtcctccttctaccactcttctccttttttctcctttgact

SEQ ID NO: 477394 - DNA, 1323 bp, Homo sapiens
agcctgcaataagatggttcaggaaacacaaccagaaccggtctcattcggtacccagcagctacgtgcatacaagtccagagacatgtaatggggtggagggaccacgctaggaatctggaggtcacacatccagaagttcacaaggggcccaaatgtgacagggggagctatcagaaggcgggaggtgacttcttgccagggagcaagccagggcaagaagagaggcgccgtgaagcctgcgttccctcccgcacgcggcttgcctcggtggccacacggggagctcagcaaggcccagggttcgggaggcgggtcctgcacagcgacgcagccttgtcccggtggccgcaggcctggggagcagggcgcagcacacccgccgcccgcttgcaggcgagacgagagcggggcgccgggatgctggcgtccaatttaaccaccagggcgcacgggacggaggccgggggtcccgcttttccgtcagagttcgcgggcgcgtctgcgcctccggccgccgcggctcccggggcctccgcctgcagccggcggcggaacgagggcaggcggctgagacaggcgagctatttgcattccccggcagtcatttttatatgcggaggtaatgaagttgtcagcggcgccccgagtgtggcagagcctgatattcaaatcgccctgcccgctccgcctgctcccgcccgctggtcccgggagccccaggctgcgcgcgcccgcaccgcatcgccgctttgccccgcgaccgcgcgcgcctcctcgtcctcccccgcgcctttgtttccgtctccttctcctttccctcctcttttgtgtcgggccagactcagccccagaaaccagccaccctgccgcgtccgactgccagggatccctcacgccgcgagaaacccaacacacagctattctgtcaggctgccgagaaaaggctgttcggcagttgcagccctggtgaggcaatgaggaggaaaggtggacgcacctgcctggagtggttgaaggaaggcagtgaacatccacgctcctggggttggttttcctgaacctctgtagctgtgctgctcactggggcagccactgaccacaagaggctgccgagggcttgcagtgtggccaggccagaccaggatgttctccaagtgggaaatacacaccccattgtaaagaagactgtatggaaaaaagaatgtgaactggctcattcatcatttaaaaacattgattgcatattgaaatgataatattttgggtatatggggtgaaataaagtatcatgaattaaatctttttttaaaaatgtggcca

SEQ ID NO: 477395 - DNA, 721 bp, Homo sapiens
aagagaacagaagcctttgcatgaatgttgaatattggctccaactttcttctggcttgtagcgtttctgctgagagatctgctgttagtctgatgggcttccctttgtgggtaacccgacctttctctctggctgcccttaacattttttccttcatttcaactttggtgaatctgacaattatgtgtcttgaggttgctcttctcgaggagtatctttgtggcgttctctgtatttcctgaatttgaatgttggcctgccttgctagctcagagaagtttgttattactgatcgtctagagccttcttctctcaactcgtcaaagtcattctccatccagctttgttccattgctggtgaggagctgctttcctttggaggagaagaggaccctcagctgcaggtctgttggagtttgctggacgtccactccagaccctgtttgcctgggtatcaccagcggaggctgcagaacagcaaatgttgctgcctggtccttcctctggaagcttcttctcagaggagcacccagctgtatgaggtgtcagtcggcccctactgggaagtatctcccacttccttacgatgggttcaaacgtcctcttttagctcggagaagtttgttattaccgaccttctgaagcctacttctgtcaacttctcaaagtcattctccgtctagctttgttccgttgctggcaaggagctgtgaacctttc

SEQ ID NO: 477396 - DNA, 490 bp, Homo sapiens
tcctatttcttgagctggctggcgttccacctttttctcctccgttcagaggttctaactaaatgccacttctctctcagatagccctttcttttaagtcagcccagatctcccctgtgcctaccaccaccccaccccacacagtagagtctcatgccctggattctcttctggatctggtcatctcatggcaggctgcacacatggcttattgggagacacaggaaagttgtgaactgcctcgtgcaaattcttcaaggcccatcccacacaccctggccttcctagcccacaaggatctctccctgcctctgcctatctacacactttattggagtattccttggtattgctatttatctttgctcagcgcgggctacgttgccagtcttcgttataatttccctgagggcaaaccctgtccagtatcctgtgtgcccatattgtgcctatccagtgctgggcagtcaatatttatgtgttgagcaaa

SEQ ID NO: 477397 - DNA, 1115 bp, Homo sapiens
tggccagccatgctcgtgatgtggagcaagagtccacgacttccagaggagccaccaaggaggaatgatgcccatggcctgctgagccaagttgctcagtctgctctagtaaaaggatcaccaagctgtggattaaaaggtgaacttttgcctacacctttcaacccacagcttgtggcaaaagggccctcaactcaagagcagttccgtgagaagggctcacttattcctagacgagccaaaccgcaccctgctgtgtatggcttctcggaatttctggagccaggaccaggaacccagatgtttgacaagtatccaggtgaagtatccagcatactgaagtcggaggcccggagaggctggcccacctgtgtcaaactcaaatcaactacagctgcccgtgagctagatgaggccccattgactgttggctcagaacagcagcttcacagaaagaggcagcagatgccatttagctctggcttgtctagcctgggttgccagtgcctgctcccagttgctcagtcctgaagcctggtgcactctaatctttgttccttccagtgattattctgtaacttgatccctcaaagacgcctcagatgacactaatgagcagcttaaaaaactggaaattcttgaatcaaagcacaagattctacccaaggtgccttcccctgttaggaatgagacaatcattttgtaaaaatattaatttaaaaaatttgtttagagatgtcctttgaaatgaagcttccatacttttcatactttggaatttttcaaaaatattcgtcttgaaggaagtcttgttaaaatctaaaggaccgagaaacatattttagttctaaggtgtttttatagagactctgatagcaaatgaatggaaagaaatactgctttatgcactacggaaatgcaatgattatcctgctgccaacatggcatcaatatcaggtggcatataaaagctttcccaaaccatgattgccttattaatcaattcataaaactgatcaggaaagtgttagggtatctattaatgtagtagttaggaaataaatctaaaccctacctttctctgataagtaggttttaaaaaaggaatgaggatg

SEQ ID NO: 477398 - DNA, 824 bp, Homo sapiens
agtattaagatgggggaatttggaataggcttcattgagaacataaacttagcagaaggcacatttaagcaaagtcctgaagaaggtgagggagcgggccaagtagatacctggggcagaggacactgcctcggtgttggctatgagttgagttgtgccatccctcaaaaaagatatgttgaagtcctaacctccagcacctgtgaatgcaaccttatttggaaacaaggactttgcagatgtagtcaagaggaggtcacgagcgtgggccctcatccaatggctggcgtccttctgagaagagggaaatctggacacagatacccagggagaaggccgtgtggagatgcaaagacacacagagggaagaggccatgggaagatggatacagagactggagtgatgctgcctcagccaaggaacgcctgggcttccagaagctgggagaagcagggcagggtcctcccacagaggcttcagagggcacgtggcctgccaacaccttgacttccaacttctggcttccagaactactaatccggtgttcaggacacagaaggagtccatgtggcctggaggagagtggcaggggtgaagtgaggagtggagcaggaagcctttgggaggaagttgagggcccacgagggatccagctggccaaggggacttggcacttggatcattcaagcagcatgaaacaaaccaacaacacattacagacactgaataagtaaaccaccattgtttacaccgcccaagtgaagcactaagcaaccctaggccctctgattgggcattaggatgctatttttaaaataatttc

SEQ ID NO: 477399 - DNA, 1099 bp, Homo sapiens
aagactttgagcagcagcaggtcaggaaaaaagccatctccataacatgaaagtacaaagcaaaacagcaagtgctggtgtagaagctgcagcaagttcccccgaagatctatctacaaccattgatgaaggtggctacaccaaacagcagattttccatataggggcttttcccccttttgctcggcacttcttgcagccgccttgtggagaaggaagtgtttgctcctccttctgctgtgatttaagtttcctaaggcctccccagctctacggaactcttattgctcttgctggtggtgagagttcaatgcacagcattctgaatgtcacttccatgaggcaggtcacctctcctagcattccctcctcgcagcaagtgcaccccacactctgccccagcagctgtgctggagaaaccacctctccagaggcagcctcacctcctccataccttcagcaaacaaaggccctcctgattaccagggactgccctcctgaaaatgaggctaaaggcctggcctttccacaacttcctggaggttgtgcttctggaccagaccacttctcagtacatctgcatgatttctagaatcagattttgaatccatggcttaagaaaagaaaattcctttgactaaacttttggaggaaattgaaatatatactgcttttaaaatgcactttacacatgtgaacccattttatggacataccaagataacactggaatgatagctacattgcaagtcaacatttcagagaaatatgagaacggggtggtgcatggcacttacttcttgaatcctaggcttgcaatagttctgtctggattgtgattccaaccaagaaatgtcttcgttggttgcaaggtcaaggtgaggaagaatcataaatctacacagggaaataatatatgctggaaggaaggaagaagaaaggaaaggaggcaaggaaggaaggagggagagagagagggagagagaaagaccttagaaaaacatctgagcaaagttttaccactttattttcttaatctaatagtgagcaaaccccacaagcacagatataaagcagaactagtgtgagagccagtacc

SEQ ID NO: 477400 - DNA, 581 bp, Homo sapiens
caggtcttctcctttgaagaaacatctctctctaatctaaatgggttttctgcgatgtcacagagctacataataggagaatccaaattcaaggccaggtctcctgactcccagtctaagcccttcccaaacctgggccacaccacctgtttcagtggaggtgtctattgtgtaggcccagaggcaaacacagctatcctggatgtggatgagggcacagcaagccagccagtctcactcactgtggaagagtcatcggagagcttcatatacagcgaacacaacctcagagatactttggagctttctgggtgggggagaaagacgtggcaaaagcagctgaaggattcagggttaacactttgccttttgaagagacttcagttcttggagggcttccagtctgaatttggggaattcatcaacaggaaaacaaatagctggcaggctctgtatttactctgcccttctcaaggttgcaacataaatctcccaacttggaaagcattaaggccgaggagacattttgtgagttcagggactctcctccagtctgcatgaaccacgtctaccctcatttc

SEQ ID NO: 477401 - DNA, 825 bp, Homo sapiens
gctcatacacgctcatacacatgccgacattctataggaagcatgggtcgagggctcaccacctgcagccagaggactgcgtcaggactgtagatacaaggaggtccatgcaccgaaggagcttggggcacgggcagagcttctcagaggggtgtgggtatcaaccctatggtgttttggaaatttggactgacctgtctgtgtgcctattgtggggagagcccaaggtgaagggtaaagacaaagtgggggaaccgccaggggaggctttctacagtgcctggggcctgagctcaggcatggaggacacaggtgttgtccgcatccccgaaagttccaggaaggagacagtgtttgctgagtggtgggctttagatattcagcagtgtggttggcttttatgggctgagaatgtgtgtgagtgtgagcgcatgcgtgctcgtgcatgctggtgttgggcctggggcactgtgttgtttgaaaggcgcagggaacagacactttgtactcagatgcatcaatttccaacggcagcagaatgctgtttctggttgaaagagaaagaagaaagcgaaatcttcatttcagcttaggaatggggtccacatgtttagctcaaagtgagtggaaatctctgaaaagcaggtttgggctaatgaatgtcagcaggccttcaatgtaaatgggatttgattagcaggaaggagtgtggttgggatgtttccattaccaaagaatgatatagaggggcaaggcttgtcttaaggggatgaagaaggtccctccaactgcccaagtagatccttttccagtaggctttcagac

SEQ ID NO: 477402 - DNA, 2989 bp, Homo sapiens
cccagaggaaactggggtttgctcactgcaaacagccaaaagatcttcaagagagaacgtcttttacatgcatcgttggattgcagtctcaagcctgggattccaacggaattaacgtccattgaaaacttactgtgctcaaggcacagaacggggtagttttatacacattctcccatttggatttttcaaagacaacatctaatcatccccagagaaatttcagctgagaagacaggatgatgaagtgccctgggggccagagtccagacaagtattttggcacctccaaggactcgcagaacacagagaggaaaagagagaccctgttatctttccgcaggggtggccgttcaaactctcagagatggaagttaagatttcctttggtataagtggcagtttgactggctgcaaggagagcctcagtttgtttaatttggagtaaaattttatgagttaatctctagtgagggaaagcagcagtaaacacagaacatactgagatgacaacaggtccatttttcatgcgcttatcctcacttgactttctcagtccaccaggattgacacatagtgaggttggtcttggttggggcatttggaaagtcttgatcatctctacttttaaatatcactatgtctcctgggcactgacttcaatgtggtggagaaagggagggcaaagcttacaccatgagaatgttttccctggagggccagtagggacggcatttagagttggtcatcagttattcctaccaagagaatacaacgggggtgctgagaagtggggaagtgaagcagtgattcagagaccaccagggcccttaagaagattaatttgtatgagatcacagaagcctcagagatctccacttccaatgactggcaaagtatggtacaaattaaacagctctggtggtgtacagggaactgccaacattttcttttctggtgcttttatcttcaaagggcaaaattggccctaaccatatgttttttatacatcttgatgacattgaatttttaagttaatttagggagaatttataccctaacaatgttgagtcttctaatgcatgaaaatgacttattccttaatttatttaagtctttcaaaatttccctcagcaatgctttgtagtttctggtatatagattttgcacatttttgttaggcttgttcctaggtattttatgatttttgatactattatatttggtgttttaaaaatttcattttgtaattattttcagtaattatgcaattactttttgtatccaacaatcttaagttaccttaataaattgaatagtctatagtttcatttggattctctatgtgcacttaattatctcctctatgaataatgttttacttttttctttcaaatcttttacttttatttatttttcttggcttattttctgggtaagagctctgctataatattgaatagaagagattcaggagtattttcttgtattgttctcagtctcaggggagagtgttagatgagttttatcggcatcttttatcgaattaaaggtttctttgctattcttaatttgctaaaagtttttttaagtcatgaacagttgttgaattttatcaaatgtgttgtctgtgtctattaagatgaatgaacagattttctcctttattatgttatgtggtgaattactttaatttatttagtatgttaagccaactttgcattcctggaataaatcccatttggtcataatgtattaatttttggctgtattattggattcaatgcattaatatcttgcttaggatttttgcatctataatcttcctttcttatatcagattctgatatcaatgttatgctcctcagaaaaaaaactaggaagggtttcttctttctctattctttgggaagatttgcacaaaaattcacaaatgaaaccatatgggtacacggctttctttgtggatgtctttaaattatgattccaatttcttgaacagctttaagagtattcacatattctatctctttctgagtcaattgtaaatagttttcttccagaattcattcatttcatttaaaatttcaaatttattgttgtaaagttctttataacatcctcttaatatgttttcagtgtctgtaagatgtgtagtgaggtcctgtttttcatctttggacttagttacctgtgttttctctttttctaaatttaccttgctgggaatttgtaaaccttgctaattttttcaaactaccaaacatttgtgtttgttgatttttctccattgcgtatttattttatatttcattagtgtctgggcttaactttatcatagctattttaacatttttacttgtgcttaatttgctactttttccataagctttttgagacagcaatgtattaatcttcagcctttaaaaactttaacaatatatgtatttacctaatttaaaaaatatttttaatacctgcatttagttctaggaatattcctgtaggcactgctttagcagcattccacaagccttgatatgttgcattttcacttggttcagaatattttctaatttctatttctattccttcaatgacctgtgggatatttaaatgtgtgttgcttaatgtctaaatgtttggttatttcttatctatctttcttatattgatttctcattcaatgctactatgatcaaagaaggtattttaatttaaattgtttgaaatttgttgagacttattttatggacaagtttatggtttattttggtaactgttttataatcactgggaaagcatgtgggttctccagatgttgggtgggctgttctaaatatgccagttaggtcaagttgactaatcatgttgttccaaccatctttattttttgctgatcttttatctgcatgttctatcagtactgagagaggtgtattaaggttggtgctactctgtccagctgcagaggcttgcctgactttac

SEQ ID NO: 477403 - DNA, 849 bp, Homo sapiens
gacatcaagcccatttggccagaaatacctctagaggtggaactggcccagaagactggacccccagagtgctatggaatgtctatgggaacaaaggaggacctaatggacagcagagaaacacgatgcccagctctggtctgctgccaaggtgatgctgatgctgctggcctggggaccacagaacagatagccccaagagttccctacactcagaggggaacagatgttgctgagagaggaccaggcccaatgaggcattcaactggtagtatctgcggcgatgaaaacatcaaggaggttatcgtagtatgcctctgtgtgggggctctgcacaaggggactaactgggactatgatgaagtcgtaggtcacttagaaaatgttggtgaaacaaatcgaaatattgtggccaaatcgcagctgtgtaagagagcaggagacatatgtgaccgattttcatggttagctgagaggcacaccatcgcctggggtgagaggcttcagtcatgcatgggtgaaaatgatctccctccatctctggccgacgggcagcttgctgttgattatgtattaatttcaagtggtcatgcccctgttcaggagcacagagttccagtgaagaacctaaagcacaaacactgacagctgtaagtcaatcattttggttattctgacactttctgtataccatgtccttcaaagttatttttgttttatcaagagatttctttgtgtggctaacagaaaatggtgcataattgtaacaataatgaagttttatagatctttgcacatgggcatatgtgacattttagaaattcataacattctgaggaacatattggc

SEQ ID NO: 477404 - DNA, 781 bp, Homo sapiens
agcagctgctcacgctgggaggcgagggctgctggctttggtgttttgtttcttgggcaggtgcaggatccagaaaggagaggttgagagaaagctcaagtgtgggtgggactccctggagaaaagccgcctgaggaatgcagggacctgggtcccgcatcatcaatcgcctattgagaaggggtcccagatctaagatgctctctgggagggcttggctttcagaaaagacaagttctagaaagagatttgattgttgtttgagggaaggagtacggtacctcaaggtgagtgagctcagagtgattccaagtgactgggttggaaagcacaaagctggggtggatgaagaggagggtgatgttatcagaacggccagactttctgaagaaacaaacctggcagcaaggtgggaggtctcaaactggttggagatctgcaaaacaattctgctggtaactagctcactgacggaggttgaaaacaagatgtgtgtcacatatatcaagctctttcagacatgtgttgggggaagtgagagacttaagagagtcaagcccaagcaatattattaatattctccatcatcaaatgttggacccaggccagagagcgttttctgtaataaatttttttccttggattttatcctgtgagatacataaagtttaaggctgtcagtggagaagcattctgtaaaccaggaacaactgacattttggtctttagaagctaagtagggtatggctccaatatgagaggggtggaaattatttttatt

SEQ ID NO: 477405 - DNA, 848 bp, Homo sapiens
tatcatagtaaatcagaaaacaatgttaatagcaccaaaaattgctttatatggcagcaactgtatttattcaccatatgtattactaataaaatacagagaaggtgaagtcacacaacatgctgtctgcaagctgaggacccaggaaggcagtctgagtccaaaaacctcaaaagtagggaagctgacagtgcagccttcagtctgtggccgaaggcccgagagcccctggaaagtcactggtgtgtgtccggaattggttcctgctggtgggttcttcgtctcactgacttcaagaatgaagctgcggaccttcgcggtgttacagttcttaaaggcgtgtcccgagtttgttccttcagatgttcagatgtgtccagaatttcttccttcaggtgggttcatggtcttactgacttcaggaatgaagctgcagaccttcgcagtgagtgttacagctcataaaggcaatgtggactcagagggagcagcagtaagctttatggcaaacagtgaaagagcaaagctgccaaagcttcaaagtggatcgttgagcactgttgccactgctggctcccctggcctacttttcttcccttatttggccccacccacatcctgctgattggtccattttacagagtgctgattggtccattttacagagtgctgattggtctgttttacagagtgcagattggtccgttttacagagtgcggattggtccgttttacagagtgcggattggtccattttacagagtgctgattggtccatttttacagagtgctgattggtgcgtttacaaccctttagctagacagaaaagttctccaggtccctaccc

SEQ ID NO: 477406 - DNA, 681 bp, Homo sapiens
ctacagaccgtgcacgtggataggctctgccctgccctgcgcagagcaggaagagtgcagggaggattcgtgagatgccagttctgataactttcagatgtggagggagggtcctcggaggggcacctgttagaagggacagcaggacaggctggtggggcagtcatgtcagcagggcacacaggaaatcacgtggccccagaattcagtgcccggcacttggcccacactgccccaagacaaagcatcctaccctacactgttctattgtgtgaagtgcagtttcttagctgggaggaggaggaggagagaggagccgcccctgggcacaaatatcaattaagatcactaactggggagtcccagttctgcgtccccatagctccctcttttacattgatgggtctgcctgaagtagcagaaggtgagaccaagcattgcccgctggcattaccttatcccccaaccccccaaacccttttcccctacacttctctcccaacccctcctccttgccctggcatagtgatggaaccatcacctgccgaaacccagaaggaggcctcttgtttagcactggcaaggagcagatgaccttccctaggatgaagaagggcagccctggctccgaaatgtgactggcactttgccctgcagagaatgcacctgtgaggctggttt

SEQ ID NO: 477407 - DNA, 807 bp, Homo sapiens
gctcactccttataccagagccatctgggagaagacttacccatttcttttccgatcctctaattggaactgctgactgactcttatgtacctgaagcttcctgaaattaaagccttcattcttgggcaaatccagcataatggaaccattgagcaacaggggcagcaagttcccaaagtcctggtcaggtcaaagataccatccaggagccagggcctggaattggaaaccttagaagtctacctggtgctctattctactgtggctgatctggcactcaagccacaaaacagtcctttccacttttctctcttcttttcacaaacagaggagtctcttcccatagcaaccaccatcccaggcctgcacaagatggaagtcattgatgatattgacaagcaggggtctggtgaggtggtggagtcccggttctggcagcagcctcttggtgcctatattgcccatctccctgctgagagtgtaacatatttacggcctttgcagactgctggctgctggcgccttctcttgcccgtggcctgcctgccaactgcttatcagtctcccccaaaggtgacatcctcctcatttgtttagaagcactgtaggtgattctatatgagggatcaggaggggtctttggatcatactttgagaaacgatttcccaacctgggagctcctggggagagtggcctcctttatcccgttacctccagtcacctgcagagtgctctagcacacagtaggtgctcaatcagtatgaggggtggttgaccaaaataaaagtgaatatttagatgctga

SEQ ID NO: 477408 - DNA, 622 bp, Homo sapiens
tcctgcattagctattactatgttattattcctgtggaagtaatgcctctttattctggattagcttcatggagacataaggcatctctctcatcgccagtgctctgtcccacacgcagttttctccgtggagtctcagctcgatttcctctccacaaggaatcccttggactctctcttggtcacatattttctgtgccatcacctagagaccctctcaatgcgggaagctgtggcactcataagactcacctcttttttacctaccttgcagggaaggctgtcctttatttttcagcacccgctgccttaaaaaccactgtttcatctattttgcctttattgagggagggcattgctccaggcagcagtttgttttttgaggaaaccagtctttgcttcatagtgttttccatactcctgactgtgctgaccccaccagcatatttctctatcctctatatttcctgcaaaatgttaatgggtctagaaacttgatcaggtccaggatccatgcgctttttaatgcgctttatgaactctttatatttgagataattatggttaaaactcctaaggaagccacagaaaaggattattgttagataatttgctgaaatga

SEQ ID NO: 477409 - DNA, 821 bp, Homo sapiens
tctgtatgggcctcttccctgttctcctgaaggtagaccatgactgcctttatgagcacctctacgcctgaggagtggatgaggcgcagctgtttgcataggctgaaaacagagcttggatgtgtgaactggggtgtcctgcaggtcccccacagttcagggaggatctggggatgggatgagaaggggcctccacgtgtggtcctgggaggtggaagctgtacttcaggggtccccaacccccagagctgtggacctgtaatggtccgtggcctgttaggaaccgggctgcacagcaggagagccatagatatctcagctgttacagccccagtctcagggtcaagggccagtagctcatcatctgaatcaggctcaggtgctgcagctgacactcttcagcttcagatcctcatttacatcttcttgaggactgctcctcatctcaagatctgtgaactaaagtgacaagttgtttgccttccacaaacccagcatattttgatttctacggacttggtaatgctagtgagtcacagagggtaagccttagagagccatatttgcaaagtgcctaagatctctcagactctaccctaggggactctaggtagtgtcacaagtgagttttaacagcagagtctggtggcgccttctcaactgcttttatgcaggaagctgtctgcaactatgttcctaactacccaagccccctaacattgtaatttctaagattggctttagtcattttataagataatggcattcaaactggtctccagtaggatatgagacaatgttaataattacaatctgcattt

SEQ ID NO: 477410 - DNA, 1219 bp, Homo sapiens
gcagttcaccgtcaggactgcaggaagcctgggaggacgccatggagacctgcaggtctctgaggcagggtgatggtgtgtcagaagcagcaggccagcagagcaccaagaagggggtgccctctccccacgccctcacgcagccctcaacactgtgtgggcaagtgggaattcagccagacatcagtgtcaatctcagagatacaaggaaagaggatgaagaaaatctgaactgtaactcagttctaaaaccagatgcccgggaagttgctggatctgactcggtctacctgaaaatagcgaatttgagctttccgcaatggtctgagaaagctcaagatgaaaaatcagagctccccaaagcagaggacctcaggaaagccacctatgtactgtgcccttgggagttctgtgatgacaatgatgatcatgtccacataggtagtggccatccacctccactcctcaggcccttcctcaggactgtccagccatggtgatttgcctgttcagtagccactgtcctccacaaccagatttttgtcagaaaatatctatattctcacattgtctgttgagggacagaggtggcagtttggaagattgattggcaagttctaagagatggtcaatgaagcaattatagcggaagatgttgtctgcatgtgaaagtgctttctgtaaagcagtacatgcagatcagccattggctgctgcttctatgttcctcctattattattaaccacacttttagagtaggagaaagatagcagagctgaagagccagaggactggcatccgttcttgaaactctgctaactggtttgtgagttgggcacgtcatttaaactgtcttcttatctagaaaatgcaaagctcgtgtagctttgcatttagaagatctctgtggtccttccttgcttttatctagttgcttgaggaaaccccatgagtataatcaactagatgtccagaaaacttctaattactggcagctctattaggagcccagaggacaaagagttttcttatttttaatatagtagagactttaaatccagggtatggagggcccacaggagcacaaagagctgtttaaaagtccaactgcttgagttggaacttatttgagaatgcaggtttaaatgtacaaacactcatacacatacacacatacacaaacagaagaatctcatagtaagatataataagcttctg

SEQ ID NO: 477411 - DNA, 499 bp, Homo sapiens
ttgtcttccttggcgtttagaaatatgacttggggcaggagggtagggagtggcggcgggggaaggatgagtctggcaacccacagagcagccatgtggaagagacctctggaattccaaagctccaacagagatccagtgcagcatggggagcctccagaagggttgctttatccaaatctgcatcccgcttctggagtctttacagacaaaactcatttttgtctaagtcaaagctctgagcccctgtctgaatgggagactagagtgagcattagaatgaccccctgctaccatgcaagagctcagtcactttattcttcaaaagaccctgtggaaatgcaaacagcttgggagaggttgtaccataaacacgacagacagacagacatctcttctcaagaggaactcctgtcccatttgagaggctgcccaccaccacagtcccctgggtgctggcccctgctctttccctccgactgccacctgacgtaatgag

SEQ ID NO: 477412 - DNA, 854 bp, Homo sapiens
agaagaaatttttaagcagcaaagcattcaagatgtgacttgggtgctgttaaaggcattcagttttatgagggaagcagagcttaaaagtttggaaattttgcagcctgacaatgcgatagaaaggaaaatcccattttctgaggagaaattcaagacagctgcagaaatttacataagtaacaaggagctgaatgttaatcaccaagacaatggggtaaatgtcaccagggcatgtcagagacctctgtggaagccactcccatcacaggcccagaggtttaggaggaagaaacggcttcatgggccaggccctgggtccctctcttgtgtgcagcctagggacttggtgccctgcatcccagccgctctagctttgattaaaaggggccaaggtacagctcgggctattgcttcagagagtggaagccccaagccttgccagctttcatgtggtgttgagcctgcggctgcacagaagtcaagaattgagcaccatgcacctggaaaagccacaggcactcaatgccagcccatgaaagcatccaggatggaagctgtaccctgcaaagccacaggaatggagctgcccaagatcatgggaacccacctcttgcatgagcgtgacctggatgtgagacatggagtcaaaggagatcattttggagttttaagatttgactaccctgctggatttcagacttgcatggggcctgtagcacctgcattttggccaatttatcccattggaacagctgtatttacccaatgcctatacccccattgtatctaggaagtaactaacttgcttttgattttacaggctcataggcagaagggatttgccttgtctc

SEQ ID NO: 477413 - DNA, 831 bp, Homo sapiens
tccacactgcttttatgagctgtaacactcactcttcactcctgagccagcgagaccacgaacccaccagaaggaagaaactccgaacacatctgaacatcagaaggaacgaactccagacgcgccaccttaggagctgtaaccctcaccgtgaggtttggaatctggatgcagcttatgtagatgcctcttcctcaagggagttcactcacaaggctgcaatcaatgtgttgagcagagctgaagtctcatctgaaggcttgactggaggagagcacatgattgcttccatattcactcatgtggttgttggtggaagtcagatcctcggggattgttgggctgagacttccctcagttttttgccatgtgagcatctccatagggtagacagcaacatttcagctagcctccctcagaataagtgggtgagagagttttctgccaaaccaacaagggatatggactgtctggcagagtcactaggacaaaggattaaaggaagaaaaaaggatccagatgtttccattggggtaattgaattttcagacacatctaatttagatgagctgtatccatggacaagtatgtcatcaggcactacgggataaattgccaaataaattgtataatgagttgaaaggtaggtagagggagaaatcacattaggatggcaaaggaggtttccttcattccttttagcagtgttttagagttctcagagtgtaaattttgtacttcttttgttgaatttattcctaaatattttattctttgtgatgttactataaattaggttactttcttaattttatttttagatttttcatt

SEQ ID NO: 477414 - DNA, 1427 bp, Homo sapiens
cagggccattctaagggtcctgcaagaatgtgtaagagttttaaatgctaccaaactggaaggagtatttgcaaaaccatgcctggcttggctggatggtcacgagatggagtgagttgcttggcaaagcatccaaagatcctggctactctcctttctaggggatgtgatggagcagttagaatttggaacctgactcagctgaaatgtatccgtataatacaagcacatgaaggttttgtacagggaatacgtgctcacttttgtgggacttcttttttcactgttggtgatgacaaaactgtgaagcagtggaaaatggatgggccaggctacggagaggaggaagggccattacatacaatattaggaaagacagtgtatactgggattgatcatcactggaaagaagctgtttttgccacatgtggacagcaagtagacatttgggatgaacaaataactaatcctataagttcaatgacctggagatttgacagtataagtagtggtaaatttaatgcaattgagacatttatcttgggaagttgtgcttccgacaggactacagtactgtatgatatgaggcaagctactcctctgaaaaagcgatgttgtcctgaggaattgactaacaagaagtttttggaaatggaacaggaatgcatggctgaagaagagagtgaccctcctcaagaagaaccacaagcaggaccttcaggaggaattccagaagaaggcactgttatcataggagatgacagctccatgcatgttactgcccctgaagaccttccactgggacaagttgaggaggtggaagacagtgacattgatgatcaggaagctgtgtatgcctaggctaaagtgcatgtttttgtgttagtttttaacagaaaagtttaagaaatagaaaataaaaatttaaaagtggaaaatttgaaaaaagctgatagaataaggatataaagaaagaaaatacaatgtgttcctgttttaagctaagtgtatttcaaagtttaaaaaagtttataaagttaaaaagttacagtaagctaatttattattgaagaaggaaaatatttttaaaataaatttcccattgcctaagtgtccagggtttataatctctacagtactctacagtaatgtcctaggtcttcacatttgttcaacactcactcaccgactcacccagagcaacttccagtcctgcaagctttacctatggtaactgccctatataggtgtaagctgttccttagcctttaactttcaaattagaaatgtttatttagagtagcaatggaaaatagaagataagttagcaaagccagcagaagttggagaactcataaacaataaaatatcagaaaagtgttacccaaaatgcaacattgaaaaaaggtaacattaaaaaaaatctc

SEQ ID NO: 477415 - DNA, 656 bp, Homo sapiens
agcagctgccctgtgtgaagctatgccccttgatacaattccctctcctgtggaaaattttgagaagcaccacagcagccaagagaacacattggcacttgtttggaaaggggtctgttgttctaaatgctgtacctcctctggtctccaggattcttcatttgaaaatgacaactattctgtgataaagaaagtcaagtttacccatattcactggatgtctacaactgaaccaagctctacagtgccccagtgtttatatgccaagctctacagtgccccagtgtttatatcccaggagacgaaggaaaatatgcaacagagactaagtggactttacgagaagcagaaggtgagcatagtgtctggaaatccaagtgaaaaaaaatcttttgaggaggagagagtcattgttgtgacaaatgctgctgataggtcaaggaaaataaggggcaactgattaagcaacatagagaagatgagcaaccttgaaaagaaatcttgattaggtggtagaagtagaagcctgattagattggattcaagaaagaattggtcactttatctcatttgcaagaacatgggtagatctggaggatgttatattaagtgaaataagtcaggcacagaaagacaaatactgcatgatctcactt

SEQ ID NO: 477416 - DNA, 751 bp, Homo sapiens
ctctgctgctctctgctggaatgtcgctgccaacaccactagggagagagcctgtgatcgggtaaaatgagaaagatgtcatcagaaattaaattttttaagctaacgaatgctagaaatgtcacaaaattgggttgcctttcttggtggctaggaggaatggacttgaaagagagggatggcggttggagaattagcaatgccagagaaagcttttggagcactggtcctcaaccggcaggagcatcagctggaaactggttcaaaatgcagattctaggtcctcaccccagaccaattgaatcagaaactcagggatggggtccagccatctgtttcaacaagcccccagatgatttggaagcatactcaagtttgacaacccctgatggtagaggagagtggaaccctgttgtgcatctcgacaaaaatcaaggtgatgggacagagaaggtacagacagatgaggcagtgctgggagtggaggaacatcacatgtaaaggccagggctatagatttagggacctgggtttgagtcctggttagagtgttgccttggcctttctgagctgtagtccctttttatgtaaaacgaggattttagtgcctgcctcatagagctgttgtaactattaaatgacacaaaacttatgctgttgtttatatttacttattcctggagcaaactaaatgttttatacattgtccatagaaataatgttttaatgtccctcttaaaatgcagaaacc

SEQ ID NO: 477417 - DNA, 588 bp, Homo sapiens
ctctctctcctgctgccttgcgaagaaggtgcctctttccccttccgccgtaattgcaatgatgagaccatttaagaggttatttggccaaaagaacttcgccctcatcagtgggattgatgcctttataaaagagaggggtctggaggacagtggccctcttctcacagctccactaggtggtgccccagtagggactctgtgtgggggctctgaccccacttttcccttccacaatgccctagcagaggttctccatgagagccccacccctgcagcaaacttctgcctgggcattgaggcattgccatacatcttctgcaatctactggaggttcccaaaccccaattcttgacttctgtgtactcacaggctcaacaccacgtggaagctgccaaggttttgggcttgcaccctcttaagccatggcctgagctctatgttggcccctttcagccatggctagactggctaggatgcaggacactgagtccctaggctgcacatatgtcactctattattttgcacttgggaaagcctgacaggtgaacttaccccacagtacctgagttgtctaactgatggc

SEQ ID NO: 477418 - DNA, 498 bp, Homo sapiens
acctaagttgaagattcagaattcactcaccattttcatccttcttgggcatgaaacatgtgctcagcacttggttgctgcagtgggaactgagagtcattcttgctggtcgtgctggtggcagaagttatggcaagctcccacagagcagtggcagacttgccagtgcccgtgtctgggctccagataaaggtcttgaatccaaaatatacaaagacatcttaaaactcaacagtaagaaaacaaacaacccaattataaagtgggcaaaagacctgaacgaacacctcaccaaagaagatatacagacagcaaatggcatatcaacatattcaggaccctcagctgcaggtctgttggagtttgctggaggtccactccagaccctgtttgcctgggtatcacaagcagaggctgcagaacagcaaatgttgctgcctgatccttcccctggaaacttcatctcagaggggtacctggccatatgaggtgtcagtc

SEQ ID NO: 477419 - DNA, 1691 bp, Homo sapiens
tgacaaaatcttaagacaagaatcactatttgatcatcatcaccccacggaagcatcaattttaatggccacacatggatgagagtacctttgagagagtctgggaatccagtggacaagttccagcttaccattgaagaagaaaatttgagaatagatgcattgaagaggccccacccagcacagctgagtggctgggagaggctggaagcagagaagagagatggggatttacagcaaccagggcatggaattcaaccaaaggccttggatgctactaactgctttggagacttgatcagaaaacctgcccatgagctgcttgggagaccttgcctgcagaccccttcagctggctcatgggcacccccaacactgtgtacctcactcctgcccctgactgtggctggctctgtgcatgtgcctgtgaacacaaagtacaggcctctgcagatggcttatgagcttgcacagacaaccagcctgattctgaaaaataggaagaagctatacaaacttgagcatttcagggcacggacctaggaacaagaaatggtagccttttttaatctaccatggcttgtgtgattgagagaagacatacaatcttaagtattcctcctcaagagggaacaagagatgtggagtaggcaaatccatagataagttctgagagagcctcagaaatccctagtcaggctggctggtgatggtatttctcttctgaagctagtcagtacagatttgaggaggtgattactttttccggtgtctttaaggaacaagaaaaaccaagtaaacacgatactatcagaggaatataatacttttccagtaactgactctaaagaaatggagatctacaaattgcccacaaataatttaaaataattgttttaaggaaactcagctgtgttcagcatcttttcaacacagatagacaactcaacataatcaggtaaacaaaatgagaagttaacaaagagaaattgtaaaaaagaaccaaacagaaattctggaattgaagaataggatgaatgaataaaaaaatgcaacaaaaagcatcaagagcagactagatcaagccaaaataaataaatacataaataaataaataaaagaaaaaaacatgaactcagtaacaggtcatttgaaattatccaaataataaaaaggtatgaatagcctaacttgctccttcaagagggaatgcatggatatacccatggactattgttaggagcttaaatgaatgaactggatctataaatattaacatggaaaatctcaaaaatagaatcttgcaggaagaaaatcaagtcaccctagtgggtgtgaaggggaatcccattttgattctaactcttaaactgtgctcagtgctaattttgttttcatgtgtttgttgcatcattggttgttctttttaaaaaacggacatcatttctttgttctttatttgaatactctaaacttatttgaaaatcttcatcagactatttttgataaattattttcatctggagcaaatatttgcttagtctgtcttagtattacagtttctcaaacactttggaatttcagtgtataggctgattttcagtcagatatattttattaagaccctcccctttatgggccaatattcaacattcttaaaataattttcaacccagaatttcatatccagc

SEQ ID NO: 477420 - DNA, 635 bp, Homo sapiens
tgagatcatcaaggacaacgatggtatgacctttggagcagatgaggtcaaggaactgaggagtcactatattgggaagattaattatattgacataatcaagaatcataacaggaaaaagatggggaatgagacaatgagtcaggagataaaattttcaaggaatgatggaattgttgaggcaacagtggacagtgggaaaggagaggtggccaacaactgggatgttcagtctccagaaagtaacctagccataagactggcaccagtgagagagggccagcagtgcaagtcccattgtccccaaggactctgtgacctcaactctttccatgctagaattgataccacagttgttcaagaaggatctggatggggacccttttccagtaacagatctgtaagatctttctatgggtctatttggactaaatcctaaattcttggtgggctacaagaccccagactaatgctttcaaatctttatttttaaaactgggaattgcacccgttatcctcgtattcattacttaccttatagtacactgttcacttaaatgtggtactaaaactatacatgacaatactaatgtctttgtcatacaggtctggaaatcccagcctgcattagtaca

SEQ ID NO: 477421 - DNA, 602 bp, Homo sapiens
tgaggggcatttgtcctcactgcctcaggcagctgcaatgttaaatgattgttgctgaattgtttgacaaatatgttgtggaaaaggatgctcacattaatcataagtcacttaacgatgaagatacctctgaaaaatatgtcgtcaggctattttatcatcatgcaaacatcatagagtgttcttacacaaacctagatggtacagactactgcacacctatgctagatgatatagcctactgctcccatgctgtgaagctgtacagcagggaaactcatcctgatcaggcgacctttgagcagagagcagaaggaggtgagggcagcagccatagatgtgtgggggaagaggattccaggaaagactacatagatgcattacagaaacgagttaaattccacaacacgttaactagacatgaaaaggactctgaacacttgtacatattctggaagcatcctttgcttcctgcagtaatttatatctgttactactaagctttaagtattccaagagttcattataagttcttgctttcatgtgctcttgcaaatgaaccccttaaacagatcacttcacgtccatgatgtgtgtaattc

SEQ ID NO: 477422 - DNA, 736 bp, Homo sapiens
ccaacatcaaagaccaatggtagataaatccatgaagatggggagaaaccagcataaaaatgctggaaattcgaaaaacaagaacacttctcctccaaaggatcacaactccttgacagcaagggaagaaaactggaaggagaatgagtttgatgaattgacagaagtaggcttcagcaggtggataataacaaattcctctgagctaaaggagcatgcaaggaacctaagaaccttgaaaaagaacataaatgacctgatggagctgaaaaacacagcacaagaacttcatgaagcatacacaagtgtcaatagccaaatcaagcaagcagaagaaaggataccagagattgaagatcaacttaatgaaataaagcatgaagacaatattagagaaaaaagaatggaaagaaacaagcaaagcctccaagaaatatggaactatgtgaaaagaccaaatctatgtttgattggtgtaccagaaagtgacgatgagaatggaaccaagaaatacagagaacaccacaaagatactccttgagaagagcaactccaagacacataatcgtcagattcaccaaggttgaaatgaaggaaaaaatgttaaggacagccagagagaaaggttgggttacccacaaaaggaagcccatcaaactaacagcgaatccgtctgcagaaaccctacaagtcagaagagaatgggggccaatattcaacattcttaaagaaagaa

SEQ ID NO: 477423 - DNA, 764 bp, Homo sapiens
atatgtctgatttattttttaaatatgtcgaagagaaaataaaatggagttatcccacagatggcctgagagaacttcagatagtttagaaaacagccagtcatcttgcagcagagtttttaagttactttttctgctagtgttaaagacagcatggaagcataggatgccttgtctgatggttataactatcttttcccaccaggctgctgtttcatgcattctatacagcatggttcatactggagccctgctgcgagacaggagacagacacagtcctcattgagaagaggttgtggactagactgtagacggaaatggaagcatttggatcatagaattggagaggtgaataaggttctcagttattcagaattagcaccagagtcttactctgtaaaacatatgcagaacccagaaaaaaagccaactggcaatggtaaagcctatggagaggccccaccctacaagggcaggtgattgctcacaccacttggtctggagagctgccttagactctccagtgaatctattcaaacagctgcctctgttaccttgacttgtctcagattttgttgacccgacacaggtcctggcactaggaatgtaaaactgtttattattttggcttcctccagcaagggagaagcccatagaagcctcctactgactatatgtttcacttctatatttttttatttttatttatttttatttttttattgtactttaagttctagggtatatgtgcacaatgtgcagg

SEQ ID NO: 477424 - DNA, 1333 bp, Homo sapiens
gtttacgttagagttcactcttagtgttgtacattctagaaaagataatgatggcagtggctggtgccatcacgctggctgcagcagggaggaaaggctgggactgcagacccaggcctcccactccatggggcagtcaggagccccaccctcctggacggtgctacagccgcccaaactgcagctgtagatccgagcctccctgcgctcttgaagtggggctgggaacaggcaggatctgccctcttgggtgcagctgcagccgcctgaccagcagctgcagacctgggcctcccacaacatggagcaggcaggagctggggaatcccgcccctgctgagttggcctgcgggagctccctgggtgcagctgccactgccctctcacccacgggacccaggcatctctgcagcctgtaccctctggtgccccggaaggcccccctatccctgcaggcttggggtgtctgctcccgctgcctgacctctctcctctcctgacctctctcctctcctggagctggctcagatcttggagtgggaagtatatgttcatgaccacggaaatagctttttaaaactaagatgtgaaaatatcttagaaacaaactctaaataagtagaaaaaagttgtatataattttctacttatgaggtgaataatttcattttttcttcaaaggtgtcaggaaaatggacgttttggtagagtgataaaagggccagaccttctaattgcttaatcttaatgtttctgaatctgaatcctcatctatagtgtgaggagaataatttccctcctaattagtgaggatacattgagatgacgcatgtgaacatggtttgacaattataatgtcatatggatggaagatacaacttttattaatcactgttgatatgtggacagatttgatactcattatactgtttttaagtgtctataactttaaatattttatgccaatcttaatattaataattttctccattttcaacattgtatgatcagcaaagtaaattttcagtcaattctatttggtttttatttgaaaaagtaaaataatgatcatgcaacatagaaaattatagttcagttgccaattccattaacttagtttgtctcagaaaaggaaaaattaccatagacacagaattaactattagaattaatatttaatctaaaaatgtctagtgtttctacagaaaatttgagtaccttctcaacttccttaaaccagtgcctttttcaaatttcttttcaaagttacacctctcaattttcataaaaaatagtttgaagattattctgaataattataaccaatgaaaca

SEQ ID NO: 477425 - DNA, 785 bp, Homo sapiens
cacaccgtccatgggctcctgtgccgccctagcctcccctacaagcgccgccccccgctccacggtgcgcagtcccatcgaccacccaatggctgaggagtgtgggcacacggcacaggactggcaggcagctccacctgcagccccagtgcgagatccactgggtgaagccagctggtctcctgagtctagtgggaacttggagaacctttatctcagggattgtaaacacaccaatcagcgccctgtcaaaacagaccacttggctctaccgatcagcaggatgtgggtggggccagataagagaataaaagcaggctgcccgagccagcattgggaacccgctggggtccccttccacactgtggaagctttcttcactcctgaagccaacaagaccacaaacccaccaggaggaacgaacaactccagacgcgctgccttaagagctataacactcatcgggaaggtctgcagcttcattcttgagccagcaagaccacgaatccaccagaaggaagaaactccgaacacatccgaacatcagaaggaacaaactccagacacgccgcctttaagaactgtaacactcaccgcgaggactagaaattaacctttcagtgtacctggactcttagaaatcgtattgtgatgcactgtccattcctccctcactttgtttgtaactacgggtgtctggggatagcagcactagtggtgttgagggagtacatgtgaaggtttgttatatgtagtttcttacagagtctgtctaaactcttatt

SEQ ID NO: 477426 - DNA, 1145 bp, Homo sapiens
ctcctggctccgtgggtcctgctggtcctaggggccctgctggtccttctggccctgctggaaaagatggtcgcactggacatcctggtacagttggacctgctggcattcgaggccctcagggtcaccaaggccctgctctcaactgaaaatctgctgccatggatgtctctcactgtaacaaaatataaagcctctcctatctcactttcacctttgcagggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaa

SEQ ID NO: 477427 - DNA, 859 bp, Homo sapiens
ttctttatacaccttattcagtatgcaactgtgggtaaattacttaacctttttgtgcctcagttttctcattttgttgaagattttggagaaagatactagattataccaatatattgttcttcttcaaacttctatcaagaaaacttggcatcaattgacagctcccgtctgcatcaattactattatgatggttgctatatgataattttatatttctctttcttttggcttttattaacagaattctaccaagaaagagcttttctttatcctctccctcattactcctcatggtccctttattccccaccctatgaccctgtctccgctgctactgccttaagtccatcgctggccccattgccccacaatcccttcacctccatgcctgcctttggtcatgatgctgactccaaagaaagaggtgttaggaaaccaattagacacagaatattagagctacaaaggactatggcagtaacctcatcaggtggtccttcaattggtgcacatctgaatttcacaggatgcgtaagaatagcaatttcttactaaatctgaatttggcagatgaggaccaggaatctgcattttgattaggagaccttgctaactttttaaggttaatattacatttttaccatgttcagtcttttgcctttaaaactaattgaatcttgagatgacttataacacaaggcaaatattacaatcacaattatgttctgcaacaggaaataagctctaaatgaatcttaacattttacttgacacattactatgtttaagtgtattaaagatgttattgaaaggtgcaggggaggaaaatgaacttgatttggcaggtaggtgttc

SEQ ID NO: 477428 - DNA, 619 bp, Homo sapiens
tgcaatttccctcggtcttgaacatctgaaagcagacagatttacaaatccatcatcaaggtgacatgggtgtggctcatttactcagccaccacacaaaccccacgcaggagtgggagcatgcaggcaagcgggtgccggggcctggctgcctctttgatattcagatgcttcttttcttctctccttctctgctgtgctgctctgctcctttgccagaggagtttggggtttttatgggtacacaggatgggggcatggcaggccagggtgctattaaaacaaatgaagccaccaaggatacaaaatcaatgcacaaaaaatcagtagcatttctatataccaataacattcaaactgagaaccaaattaagaacacaattccatttgcaatagccacaaaaagaataaaatacctaggaatacatctaaccaaggaggtgaaagaactctacaatgagaactacaaaacattgctgaaagaaataatagataatacaaacaaatggaaaaacatttcatgctcatgatcagaagaatgaatattgctaaaatgtccatactgcccaaagcaatcactggattcaatgcaattcttatcaaattaccaatgtcattc

SEQ ID NO: 477429 - DNA, 586 bp, Homo sapiens
ccgcgagggtccgcagcttcattcttgaagtcatctatcattgatgggcatttggttcaatgtctttgctattgtgaatagtgctgcaataatcatacgtgtgctaaccttctctccctggaaccttctggaaagggttcagacccagggagagcagagttctgtctttgaccccctgaatggagttggagttcctgcagggaggccctgcagtggcagtgttggctgccgcccctcccccaaggagctcagacagcttagacagcaggagttgggatccacatctgcagactacacaaagacaacacagattaataacacaatcatcactgaaatcacagagcctccaagtgtttttatctgttttaatgcgttactagctgctaatctgtctgcatctccttcaagcactccagtccctggcattaaggtcaggtgtgcctgggatgcttttaatatttgttctttaaatttggaatatccaaagacaagtttgtagagtgttcttctagatgtttttttattctttcccaaattttgatcttattaagagtcattaatagtttccacaaatccttatgtttag

SEQ ID NO: 477430 - DNA, 1221 bp, Homo sapiens
atatcaccagcatgtggacgaaggagcagcgcctgaaggcccctttgatgcccctgctaggcagcggtcccttggtgtgggcagtgcaaatgaaaggtgggactggcccagcttcagggatgtaccaccttctgctgtcccttgatacagatgccctttgggtaggggagggggcagctgcttctgcccacgctggagctcccttctggagagatgcacatagcagccgatgttgcagtttagaggatgagcagcgctcaaaacctcccactactgctgctgtctgtccggtcctagacaagttgtctgcatttgttagatgtggacgaatagtagtaccaacttctaatgttgcagtggggattggaccacagccccagaccagccctacaggagtttgctccaagcgccactggcctggcccagcacacaggttgcctcgtccgccgcctccccacagcacctttcctgaattctgtcggcattgagacccatctcctctttctctgtctctctttgcctgaccctcgtccattctcctagtgggcaggatgctgtcagctattgctatttggagggtgagatgacccctgagtagaaataactcctataagttcagaggttcagcctttaacaaactcacattcctgtttgactgacagatctcccagaaaggaaaataaaagcaccttgaggacagagctggaagtagtctacctgggtattctccacagctgcaagctcaatgtcctgagcttgctggtactcagaaaatgtttaggaacttctttttacattgagggtagtgcttatgggcaaaatgaatgcccatgggcctagccctgagatggctggacagcaagaaaggagaaaggacagcatgggcaattttccacacatgttttaagtttacagggggaaagagaccaagagaataagatcaagtcaaatcaaacccatgtataataataccattaccaattgttttcttattttatgttttattctgattccttctaacaaaagttcacacacacatacacacacacacacacacacacacacgttcagcagagctcaggttgaaaataagtgccagtccttataccaaaaagtagtatgctgtgctttgaaattcctgaaagctcatttgctgcctcaccctccctctccccatgtcctatagaccctgtgttccggatccatcctttgaattcactc

SEQ ID NO: 477431 - DNA, 953 bp, Homo sapiens
ttccgtttcctgctccaaaatgaactgcttcctactttctctggtggcctcatattccaatgatacagaaaagtacacagttgtgagaaactactcccaaggtcaaaggaagagctccatcagcaagtcctgtgtgctccacctccaaaacacatcccaaatccgaccaccctttgctgcctccgctgataacactctctccaaacaccagctcagttacccttctccagtgaactggtaccccccttcaccttttcccacagcctacttgccacacagcagccatagcgatgcctctggctggccgtcctctgtctctgagacaggccctggctgctgccccatcaaggaccctgcatttgctggaccattgccctttcactctcccaggtcttcacatagctcatccctttccaatcaggatggggctccaacatcactcctaaaacacacagctctcccccttcccacagacgcccccatctacttactctgcgtgattttctctttggacttctgaaattctattcatccctatgttttattattattctcatcacctttactagagtgtgagcaccatgaagcaagaagtataggaaaaggcctataacatggaaggcactcaaaagtcctctgactgaagaatgctgacagatttttaccatcttcagaagctacttcagtttgtattggcttttcagttggactagccaatacagactgctcacaagttcctgtggaatgtcacagtgttattttacataaaggaaaggacacaatataagttcccctccttcaaatgctgtatttgtaaaacttttacatatttggaatttttaaaatatttacttttattccctattacacatattattaaagataaaatagaaaacccaagtatgcatgaaggagaaggtataaatcaccttcctgccactcagaaatgaaaa

SEQ ID NO: 477432 - DNA, 497 bp, Homo sapiens
gccagcagaacgatcctcatgtttaagtcagataacaatgtcattgacagcaacgttctgctctgaagggcagggatggaagacaaatgaaaccagatttaccctgagtagttttattgacatccttcttgtgtccattggggagatcatcaccacagttttctgcaaggcagatgctgaatggaatttgagtggtattggctacaccaagaagaaagacaggaatctatcaggagctcgtgtcattcctattttgggagcccacagaaggtgtcttaaggtggatcccctgagaaagagacagcgatttgggtgcagaaaatttactgaggtgtgctctcagaaacaacacagtgagggtggaggaggcaggacaggaccagaggagctagatggcaatgttcttgctacagaggcctcagcccatccccctgagagggaagcctttcaactgtcccttattaaggcaagggggtgagacttcctatctacacctc

SEQ ID NO: 477433 - DNA, 660 bp, Homo sapiens
gccaatttatctgctgacatttcaatcaaacataagatgaaatcctccttttttcatttggtcttctcctggttacttgaggaaacgttaacaaatatcttcagaatccagaaagaatgtcgactgacttctagatacagcatgttagacatacagctaaaagacaaagtagacaacagtccttctcatctaggatcttacagtctagctcaccacaggagacccttatggaaattactaaaccaccctcctctgtcctcttccaaccctaatctaggaaaattgtatgacaccatcactattccctctcatgggaagactgatcacttatgggggcaaagagaagacggaaaccaacatttgctgaaccttctggtgtctgacagggacacgctaggtgcttttgtatttacaatctcatttaaccctgcaaaacccctaaaaaattaatgttgctatccctattccacaaatgagaatactgaagctctgcatgccacggagctataggaaaactaaaacagatactaagatacatgaagtaatttgttttaaatcaggccatgtccatcatgacaccaaataatcttcctatatcaaaatatatatttgaacttttaaagcaactttttcaagagctgtcatatgtggtcatacagg

SEQ ID NO: 477434 - DNA, 598 bp, Homo sapiens
cacttccgttcagccgtagtaccatgacgtgcacaggcctgaagagaaatacctctgtgaagtggagcgctagtgaattcctgctacctgcttcttatggctcacgctatgaatattcacctgcttcatttgttttttccatatcaatactcccccaaccagaaatgcagcagaatatcctttttgctataaaggaaaatactgtgtttttatttgtttttgcagaagaaaactggtgttgcctatttggactagatgtaggggcctggaagaaggaagtggcagattcacagtttggattggagtttctagtaatgataattaatgccattttacatgatagcttcaatgcagaaatggtggtggaagagggagccacaccaagaaaggagcctggccccaaaccagaggatggagcagagtccccaccccaccctcactgaaccaaaatggacatgaacaaaatataaacttctactgggttgagccactgatgtttggggttgtttgttatagcagttaggcttttataacttttacagagcactccatggaccagagaaatataaagaactcaaattggaatatgattagctca

SEQ ID NO: 477435 - DNA, 612 bp, Homo sapiens
gcagcctacaattactgctgcttctataatgtgtaggtaaggtgagaggagggactggaaagcatactatagtcctatgattcaatttcagtcttttagcgggcttgtgcctccggactatgaacttcacaagtgcttccccctccccgcttacccctactcccccatccaccaccccagtagttttttctccaatattcactgtgagaacctggtcaagctcctggaggaaaaactcaacaacagtatggggcccccagtgactgaacccacacccctggagtttttatctctcagacttgtccatgctgagcctcctgtgattgatcaattacaattcagtttcccaaccctggtcatggttcctgtggatgttcttgttctggtgaattgttattctctttatcttcctgtctgtctttccaattctaaaggcagcaatttgtcctgtgatatcataattattaaactcattctttgcagcaatactgctgttttcagtgtattggcttttctgggaagcaggcaagaagaacctatcaggctttgacactaacctatacatccaacaaatgacaaatatccagaattgacaaagaacttaaacaaatc

SEQ ID NO: 477436 - DNA, 2868 bp, Homo sapiens
aaggacaatctttcaaactcctcctagaaagaagcgtgctgacatttcttacacatcagctgcaattgtttttaagtattcactcactatatttacaagtttgcagctgcagtaaaacctgcatgctttgggatttttcagattgcttcccatacttaatcattgcgcaagatgtaaaagcggcacctggttttagaatttacagcgcaatgagaaatgctttgaaagtacagaaaaacagaagtcacgcccagcggggaaatcaagaaaggatcctgagcatgaagcataggaccaacaatcagagaatgaaaccacacgacataggcaagcccaagtcccacggagagcacatcacatctccaaacaggtgccatggaggacactgtgagacacagcagcctgcagtgatgctgagagctctggcttcaaaggaacaaaccgagtcctcatcacagctctgtccgtggctaacagctctttctgagtctcagccgataccatctttcaaagttgtgggtggaacatatggacataccatcaaccatgatacagaagataagggaaacaacaggcagacagatgcccggaggtggagcagacccatgacaacactctgaggaccatcaatattgctttgaggaatgaatatggaaataagaataaccaatgaaaatctaaaaggatgaatctgagaagtcgaggttcttttcagtttgaatttattacgaataaaactgctatgaaaattcaaatacatgtctttttgtggacatttaatttctctgcttctatatttagggcaatgatacatgtcaaattaatttctgtacatagtgtgagacatgggttgcagtgcatttcttaaaaatttcgttaaaccagctctaattgctgaaaatattctttttccacatttattactttggcactactgttgaaagtcagttgatcatatatatgtgaatctatttgtggaatccactctgtatgtgtattctaacaccaatagtaaggcttgaaatcaagtagcttagatccttctacttcgttattctttttcaaaattattgtgcacttacaaacagatgttagaatcagtttgtgaatttctaccttccccacaaaataaagcattctgggactttcaaaatcgggattatgttgaattgatggatcaatttggggaaattttgcatcttatcaatattgagttttccaaaacatgaacatggtatacctctccatgtacataggtctgtttaaatttctcctagcaacgttttataattttcagtatagtggtcttacacatgtaatgtacattgacttttgggagtatttgattctactatgaaagatgaaaatgtttgtagttggtaacattggcaaaaactttaaacattagcaaaaacttttaaagtgttttaagtatagatagcataataagcaaaatctttgttagaacagacaattcacaagaggtattatacaagataagtagttacaaagtaaagcatgtgcgtacccaatgtaagaagaaaaggatggaaggtgcaaaacatgcctaacattcatgaggcaccaggatactaaatattcatgatacaccaaatgtcatggaggtgtattcaggatacacctcagataaatattcaggaattattaaatatgtatgagacatatgcagtgctaaatatacaaacagcacaaactattcaggatacattaaatattcatgaacactcaatattcaaaaggtcttgatttaccacccattaatgacatccattttggccccaagaaaaacaaaacccatggctgttcagcaaactaatagcaagttaaaactgtggccaggttttcttgtgcctgcatctctccaacagagcaagcatgtgttactagcccaggacaccttctgtcttttcccctcttgctcaaacttcagctcttgtccctctaatcatatcagaggggaaggctgattaagcaacaggagagacaggacaagtgaacatagcatggcccaggatccagacaatatggttcttctacttacttgcctcctcaccaaagtatattaaaataccccagatctttctccttgattttttggtttatgttattaattaactaaacaaagcatgtgatttgggttttaacctaatgttttaatttggcctgtgaacacttgttttgtgatgtctaggacagcatcagagtcatttcccaaaagacagtatatcttttgctaacttattcctaagtgtttcctgggttttgatgctattataaaagtagtttgttatttcattttccaattacttggtgccagtacatagaaatacagctagtttttatacattgatttgtgtcctgtgacattgtaaaattcacttattaattctagaaattattttgaatttttgttagatctttttaaggattttctatgtatataattatgttatctgtaaagatggtattactttttactttctaatctatgtcttttttatttcctgccttatttcactgtctagtcattagttttaaatagaaatgagtagagtgcacatcctcaccttgcttcctgtcttaaggggaaagtgttcaatatatcaccactaagatgttagccatatcaaattgagaaatatattttctgctgtgacgtggcagagaacatttctcatgaatgggtgttaaattgtatcaagtgccttttctgcatctattaaaatgagcttgtagcatttcttttttattctattaatatgatgagttgattggtatttttcagtgttgaatcacctttccattccacacttcatgatgtattatcattttatatattgctagagt

SEQ ID NO: 477437 - DNA, 2549 bp, Homo sapiens
acgtccctcacggctctgggccctcatggctctgacgaccgtcacagctctggcctcttatgattctggcccctcaaagcttcagctccgacccctcacagctttgatccctcacagctcctactcacagcaagtgaccccttacagctcccatccctcagcagtgacctctcacagctcccaccccttacagcagtgacccctcacagctccgactcctcacagctcccacctctcacagctctcacccgtcaaagctccggcccctcacagctcccacccctcacagcacccacccctcaaagctccagtccctctcagcagtgacccctcacagctcccaactcacagcttcagctccgacccctcacagctttgatccctcacagctcctactgctcacagcaagtgacccctcacggcttccacccctcacagcagtgacccctcacagctcccacccctcacaaaagctttggcccctcacagcacccacccttcacagctcccacccatcacagcacccagccttcacaaaagctctggccgtcacagctcccacccctcacagcacccacccctcgcagctctgtgaggcctccagcgtctccactcccctgacaagggcattgcaagaagggagggccacgggcccatctctcccgtggatgctgctacaaatattccatgcaagatattcacgagattccagtcatgtaaagtgtatgataaaatctcaaatcaaactgcctcaaaggaagaaatctaaatcggataccggatacctacaagaacccacaggcaaggcagggcaccagggagacaacgtgtgcaagagctggaagggaagaaacgcagctgccacccctgtgaacacagaagatgcaagagaatccacagctgccacccctgtgaacacagaagatgcaagagaatccacagctgccacccctgtgaacacagaaagtccaagagaatccatagctgccacccctgtgaacacagaagatgcaagagaatccacagctgccacccctgtgaacacagaagatgcaagagaatccacagctgccacccctgtgaacacagaagatgcaagagaatccacagctgccacccctgtgaacacagaaagtccaagagaatccatagctgccacccctgtgaacacagaagatgcaagagaatccacagctgccacccctgtgaacacagaagatgcaagagaatccacagctgccacccctgtgaacacagaaagtccaagagaatccatagctgccacccctcccctgaaaacacagaaagtccaagagaatacacagctgccacccctccccgaaaacacggaaagtccaagagaatccacagctgccacctcccccggtaaacacggaaagtccaagagaatccacagctgccacccctcccccgaaaacacggaaagtccaagagaatccacagctgccacccctgtgaacacagaaagtccaagagaatccacagctgccacccttgtaaacacagaaaatccaagagaatccacagctgccaccccatcaacaggcaagtgtgtcacaaatgcagtggtcaccactcaggagaaaaaggaatgtgccaccaacacacacatcatgagctgcaacatcctgacagtgtgtgagagagcccagatcgccccgctgccccagttccacacaccacctggccccacttctgtgagtcctggggtctgtgagcagatccactggggcttcctggacagggcagaggggaggaaggggcagtctcaggacacaaggagacctggtggtgacggacacattcattatttcaactctaaacgtctgccttctgaatacttactaaacatgtggccaaatacacattatttcataatcttcaacaagattagttcctgaattcttccctgagacagactttgataccgaattaatgtccaaattttctagattagttttgaataggcttgaattatacatactcaagaaattgttcttatgtttcatgtttacatgtttgagtcttaaaaactgacttagtggaaaagtagttagtgtctcaccataaaacagcttgatagatacttttaaaaacaattcacatttagtcattttctataactttccataaaatggccaacaaaatgataaaaattttataagcaataaaagtcttaaaatagggcaataaagtgctaaattcccttaaataaaactgtcaaaaccatgaggcaagtcattaagttaaaattagatgcaggacaatttttttaatttaaagaataggaaagttaagaaagtaattaaaacagtacaaatgaagaaaagccattgaattattcaataaatataaagccacagtaaataaaaaatttaaatagtaaatttaaatagagtaaatgtatccacaaaaaaatgttaaaatgaggttatatttgtgtgaggctctgaaactgtgaagtgttttgtaaatattcttcattgacttggactcgtgactttttgagttgaaaacttaactaaaac

SEQ ID NO: 477438 - DNA, 2308 bp, Homo sapiens
tgcctgtgagttcagcgaatccagcagggctgtctcggttgccctcagaccgagaacctgtgacactggtggggtgaggaatgagccgtggccactgccgaaaactctgtcggctcctagataagtcccaccgaaggggcattggtgacctccttggtgccacagaatctcctgctccagccctgctgtagacctgtggctctaggttacttgctttattatgacccgttgccctcagctgccttcaacctctcggtagggacccttgcctggcctcacaggtccgagcctgctcccacgaccaggtcagccagaggtgtttacatgagagggagagtgaggaacaccagtttccgaggtcccggctgaccttgacgggcgctcccttcacatctctcccctcacggtgctcccctcacaatgtttgctcacatccctttcctcacagcgcccccctcacatccctctcctcacggtgctcccctcacaacagtcccctcacagtgctcccgtcacagcactctggcacagtgctcccctcacatctctcccctcacggcgctccactcacatctctcccctcacagcgaccccctcacatccttctgctcacggcactcccctcacatccttcccctcacggcgctcccctcacggcgctcccctcacgacgctcccctcacagcgctcccctcacatccctcccctcatagtgcccctctcacatccctcctctcaggggctcccctcacatctctcccctcacagcgccccttcacatccttctgctcatggcactcctctcacatccttcccctcgtggcgctcccctcacagcgcccctctcacatccctcccctcagggcgctcccctcacatctctcccctcacagtgccccctcacttccttctgctcacggcactcccctcacatccttccactcatggcgctcccctcacatccctcccctcactgggcccccctcacatccttcccgtcaggcgctccccccacatgtctccgctcacggcgctcccctcacagcacttgttcacatccctcccttcacaggccccccctcacatccctcccctcacagagctcccctcacagcgcccccttcacatccctcccctcacagagctcccctcacatccctcccctcacagtgctcccctcacagcgctctggcatagcgctcccttcacagagctcccctcacagcgcccccctcacatccctcccctcacagtgctcccctcacagcgctctggcgcagcgctccctcacatccctccccgcgttccctcacagcgctcccctcacagagctcccccctcacagcgctcccctcactgccctcctatcacagtgctctggcagatgggatttttcatgctgacaaataaattgtgaactcctgggggcgccctcctcgcttgcatgcggatgtctggctcccatgcatctcctccagacctggctgcctgctgctgtgacctccacggctttgttcttcatgagtgtgttccatcacagttccttggccacgtccacacacacaacggtggattcattgaagggcctgtgcattattcactcctgtcccctgagcacaggaacagacagacacataataaaatgtgcacagtgactcggtgccccacatccagagcctccactggagtggacctccagcaaactccaacagacctgcagctgagggtcctgactgttagaagggaaactaacaaacagaaaggaatagcatcaacatcaacaaaaagacatccacaccaaaaccccatctgtagtcaccatcatcgaagaccaaaggtagataaaaccataaagatggcgagaaaccagagcagaaaagctgaaaattctaaaaatcagagcacctcttctcctccaaaggaatgcagcttctcgccagcaatggaacaaagctggatggagaatgactttgacaagttgacagaagtacacttcagaagatcggtaataacaaacttctccaagctaaaggaggatgttcgaacccatcgcaaagaagctacaaaccttgaaaaaagattagacgaatggctaactagaataaacagcatagagaagaccttaaatgacctgatggagctgaaaactatggcacgagaactacgtgacacatgcacaagcttcagtagccaattcgatcaagtggaagaaggggtatcagtgattgaaaatcaaatgaatgaaatgaagtgagaagtttagagaaaaaaagagtagaaagaaacgaacaaagcctccaagaaatac

SEQ ID NO: 477439 - DNA, 897 bp, Homo sapiens
gagactgggcacaccctggcttctgccgctgccctggacacctgtggtgttgtgaggcacttggtgttgatgtgttagttttctgttctcaaaatgtcacatattatcttggtcctgagctctgagcacaaacatgaacaagggagaggcgtctactccagggactctcggtgtagccggacacacagttgtgaggacgatggccgcgtggccagagctgtaataaaccacggagggcttatctccatctggacacccggcctcagccagggagcagaaaacctgaaaagggctgggaatgaccaggccattgttgaccgatacctgagcttcctcacattgtttcacccagagcttttctgggcaaaccctggagcggcgagggcggcgtccaacttcctgaccctgggtctggctttactcctctggggtttggaatttgccaccgagaaagcaggaaggaggtcaggccgaggtccctggcacggactggaacacagggagggaggcgggcttgcatcccgccgctctctgtgagaccccctgttccgtctgttggatccagggctgcttccctgggctgaacccccttcttgagccctgtggagtgcgtgctccacctcccacccctccctgctggccggagtttgctgaggcccttggcaggcacccttcatgccccaccaccctctgtccacctgccagaccttcccttcccaccccagcccctcagtctctggaacttagggccctgcccccagacggactgttgagggactcaaagaatcccttcaaggaattctattgaaattgacttagagataaatgagcacttatactaattaaatatttcccaactctcagaataggaactactccaaatgcctttttgagctc

SEQ ID NO: 477440 - DNA, 865 bp, Homo sapiens
tcactcgatagttaagaggaggggcattagaactctttgagcagaggattaatgcaattagaattaagctttacgagtactgacccagaagtgggatgcaagatgaattggagagggaagagagtaggaataagagatctcttagaagccaaacttcatacactagatgacttgactctttccaaaatatttgatgattttctggcttctttgccgtcgtgcataagaaacagtgtgtggatgctgctcccttgcgtggacactcagaaccttcaagagttgttggttttgaatcttgagagtgccttggaaatccctaatgagacagctggaaccacgatcactggcaaacttatccctaaaggctccagggcttctcccagctacatcttcacggctgagtacacacagggttcagaggcttcttggaagcctcttgctggctggacaggccttcacttagggcttgagtgttcagctagtggcatctgtattgcagctggtcactttttgctgagccctcaggaatttggcaataccttcagtgcagtagttctcaatgattttgtctcttacaactgggaagtggaattggcatctagtagcacagaccctggagatggccatataagtttgagctctggctccatttcttactagctctttgatcatgggaggcttacctgacattcctgtgccttgattttcccgtatgtaaaaggtatactttgagcactgtcatatttcttacccagccttcctgttctcattgaccacttttctttaaaattaaaattaaaaaaaacattttaaataaacgcaatgcttacttcccctagtatagaaaccactgcttctactcgat

SEQ ID NO: 477441 - DNA, 509 bp, Homo sapiens
caggacataaatgattcctgttttttcttcaggactcacttcaaattattttctcagtaaagcctgccctaatatccccaaaggctattactcttcttctttcattacatatttgtatttctcctgtgtaattaccaggttatacaccaatgtggaaaaggaggaagtggtacaacccattccctacatggtctcaacatctggtatgcacctggcatcaggaggtgaaggaaaaatcaatcctgcatcgtctgtaaaagaatgtattacattggatggcttcgggctggtggtagtttttagatcaggccttactccatgcgtgaaggtgaacaatacagaagaaaaagcaggagtaaaaccttcctggacatatctcaggtttcaaccactccatgctctaatggatggaattaaatgtggacatgactggaccccatagaaaatcttttattgaccctgagtcactgtgggttcatccgatgacactgtaggagtcacccctcctc

SEQ ID NO: 477442 - DNA, 2837 bp, Homo sapiens
aagaaactaaggctgaatggcagttcctacgagctcaggatgtcaaggaactacaagttcttccacaagtggaggaaggtagattcttactacagcatccatgtagctaatattaggaagccggaggagtggaagcagcaggccagagtgaaggggtcaggggtgacagtggacagagcaggaaaggggcaggctatgggctatgcaattgttaggggagaactgagaagctccttgtctttcatgtggactacatcaatggagactctgttggaggtggggcctggtaagaagtgtttgggtcatgggggaggatctctcatgaatggcttggtgctgtcctcccaggggcttccctatcctgttcccatggcagacatcactagtcaatcatggcagtctttcctcttgaacttacgtataactatcataggctttttcatcatagtttgctagacttgtctctaattaatgttcatagacaataaaatgaattgatttacagtccctgttgtgtacccatgctcattagaatttaaactccagtagatcatggatttatctgtcttgctttttttatgcttacaacaatgcccggagcacactaggcactcaataaacgtttgttgaatgaatgaacaaataatgcatttagacagaaattttccaaaacgaattcaaatattcttcatagtacaataaaattctaataagcattcatgatatagctatttctgaacattttaactttgtagtcactagttctaaggttattgagggaaatctttgattttgatgctatttagatattgaggggtttttttgctttggtgctgacacagatcagggaaatcaggaattgcagcaactttatttgtattgcttgaaaattgtagctcaatacaaaattcagtaagagactagctccactgatgtattcatataataaacggtattagcattttcttgattttatgttacattaactttatagtatgtttcatgttcaacaatgcaaaggtaatttattaaaatatgttttggaggtatgatgagtcaacattaatattgatgacaacgaggttattatcatgttgacaacttttcttaattcagtaaataattcctggcatagtcaacactggccacaaagcctgtagttaatacaaagcaggtaaattgattgacagagtctggagatccaggattctatgagtatatagatcagtagtttgctgataactactggtgaggtggggctgggggcactaatgtgaacttgaccagttaagtcaatctctacaaattctacttgataaaatattacttctgaactggctttcagacagatttactaatctgttcagcggcttttcatggcagaagacaaaaaatgcaatggttactatgaaaacatttgaaatacctgaatttgcttaatacacagctttatttactagaagcttgcagctaaaataaaattcccaataataggaggattctatataaatgttaaaagttacattttattatacagggagaccttgaagaagagggctaagaaaatgttatttatgctatctgttattatctgaaagtatgtcaatagtatgtgcttcaaaagaactgacgggaaatgtttatcaggcgacaatgaagccaaatagattgtttatgacaacatgcggaatatatttcttggcaaggttttgaagtatagacatgagggtcattctcatggctgctttggatgacattcatcattgctgaatatctagattttaaagtacaacatatttttgtatagagagaattgctaggtagtgtatattgtgtttatattagccttgatggcacattcatgtagaaatgtagaaatctatgttattattttaatatgtggtcatttgcctgcaatttactgttgcttgtgccctatttttcgtgtttataagggcttatttaatgctacaaccagataggcttatttggatatcttaactccgtttattcgtctacagatttgtgacttaaaagattagcattcattgactagtacttttcagacatcaaacctgctgttaattagtcaggtcatatcatatggaagtataaaaaaattatatatttgagatatggtctatttgaatatttttagtccattactaagtttttgttgtaatttaattttgaaaaaagcatatacaaaatttcaaagaaggcaaacaaggtttatatttatctttctgtttctctagctcaccaataactcttcagtaagaaatggcctctctcatggccggagagcttgttcgggcttatgtctgtaattaggtcaaattatttgagtgacaattaaaacagcaaaaccaacttccatggcatccagtcaggagtatcattatttaacatatgtgtttacattttaattttcagaattagaaatcacatggatacaaatgtaagattgaattcgattttctttaaagcaataaactaggtttattgtagtcttttggcatttagagaaatacaaggcattgagctgtcagattttacaatgacaatacagaattgcgaattctgattttgaggtgcagacattgcaatcattaacttaacatttataaaatgagttggcaaagggaatagaaacaaaaacttgtaggtggcatggaagatggctcctggtactcttacagcttaagatgagagagagagagagagagagagagagagagagagaccgaccgacccaccctctttttccaagtcagagaagatattggttagttctgcctaggtgacttgcccgtccttgagccagtttttgtact

SEQ ID NO: 477443 - DNA, 1203 bp, Homo sapiens
cagacttcaaacaaataaggcaggaatagcctggtcagtatgttgccacagctgctgctgctgtcatcacctctgttactgctgctactgattcttatagttcgaggtcttacatttaggactctaatcgatctgaagttaatttttgtatatagtgacagagggtgtgaacttagaagatgctgggtagggtcttttggctttgcttctatagccctgtgcacttctgatggcaacttttatactgggccgttcagtttgacctataagctagcagatggcacttatagggaggagctggcttcagtcaatgtggctggctatgtacttttcctggtttaccaggagaagctctctgttacctcaggcaatgggcttatttgtggagttcacagtgatcttagctccttgctcagttctggaggagcaggggccaagattagcagttttggaagtttccgttatcatatcatcaagcataaagactctttcctcagcagccccaaaatccagtatgtgtatcatccactcagtaaagctgctgtattctatttctttggtcatattttggcaattccctcaaggagacaagtggggtgaatgtgaagcttagtgtgtatgctgaccttctcccaatgatgtttctcagtacctgcaaacacttgttttatatattttatccaactctgatagaaattattacagcaagagatttagtcttatatcagcgataccattgtgtttactaatggaattccttcttttgtattttttctttgtaacacctttattgaggcatgattgacaaacactaaacatacatatttaagctgtacaatttgatgaattttaatatttgaatattccaggaagcaatcaccaaaatcaatataataaataaaacaattatttataagttttcttgtgtccctttgtagtttctccttcttcaagacaatcactgatctgctgtcaatatatattaatttacattctatagaattttacatctatagaatcacacaataagtactctttttattaacctggcttctttcattcagcataattattttaagattcatctatgttatatgtatgtgtaaatattttattcctttttattactgactacaattctattgtatataaataccatatatattaaatttttaaaaatttttaaattgaaatttatagttc

SEQ ID NO: 477444 - DNA, 605 bp, Homo sapiens
gcagtgtttgactcctaggcttcagtccgaatggggaaacagggaaacttgttgttggttgatgtgcctcctggtcctcattcctcaacaccagactcattccagacccctgctggtccagaccctgccagtggccctctaacaccacaatgcttcatcgtgagttcaccagcgggcacagacattatcccccggccatcagaggcaagtgcctgggcagagcaggcagaaacaaattgctttacagccactaccttgaatctgacacacatcccttttccaaagtgtgcacctcactggcaacttctaagtgaaattcatgggaaagtatttagcaaatcacatgctgacacatttatcttgttagctgtcaaaatgacccgaaaaatctatcaaaaaccatatgttcaggccttgccacaaatgcaagcaaaaaagccatggggtaggtgaggtcatggtcacattctcaggggttctgtccacccttccgacagccagggcagagccttgaagtgagttcaatgtggaggaaatggtaagagcatggactctggggtggaaatacttcagagcactaacagacttcagagcagagaaatgtc

SEQ ID NO: 477445 - DNA, 2549 bp, Homo sapiens
taccctgcaaagccacaggggtggagctgcccaagatcatgggaaactatgtcttgcatcagtgtgacctgaacgtgagacctggagtcaaaggagatcattttggagctttaaaatttgactgccccactggatttcagacttgcatggggcctatccactactgggcatcagaggagcccctccccaatcactggtgccatacccgtgtttcctttgttaggtgttccaggcctggggactttctcaggcagaggtcacagctggcagacaggctattcccttccagagaaaggaggcatgccctgttccctggccagcccacaaaccaggtcatctcacctctctgtgttctgagaatggaggctcctcccctgcatgggcaccacccaaatgggcaagtcttgcctgctaggagcagtggcagggtgaggtggggggcagtcacacaatctgctgcctaggtgtttcccaggggaacacagagctgtgcccacctgcagcgttcaagcagggatcatgtattattcatatctgtaccaattaactagcccctctctttgaacatgtacaatgttcttaaaagggtgtcatataaaattaaaagaaaaagtcttgctctgtgctctgaagaacagttctggaaaataaatgtcagcaatatgtgagaaatgatttttctaactgaattataagatacacttgctgaaagttctctgaagatttatttataatataataagatagatgcttagtgaagagataggacctatttgtccatggattgcagattttgaaatcaaacaaattggtttatttaggttatttctttagcatattttattagcctgtgtaaaaaataatataggatattttattgaaaagggagagttgaggcatactaaattagaaggatttgttaaatatattctgataatatatttattaaaattattatcacaaaattagatattctatcattaaaattatataacaaattgtactgttatacttagaggttttttttcagggagtagttactttctttggttaaaatcttaaagaaaactaactaaataaataataaagcttgtatgaggaaagaaactataagttcagctgacagtggaagaattattttatttttacatttttcattcattttttttcttttcctgacagcttgtggtcagagttgtattattgtttgtaaattttttttttaattttagaagcaagactcattgaaataaatttcctatgaagtatagtttccatggcaactgtaactgtcttttattttcacatgtaccatttagaattagttgacaataattatagaccacttaagctaaaacattttctgtacagcagagacatgtataaagacagggtttcagaaaaatagttctggtttagagaaacttaaattacttgttaagaaagacttgattttcttacttaagtagatgactgaaattctatctaaatatccagtgtgaagtttgagatgactattgagatatgtcaagggacattttccctactataattttaaaattccatttgttaccaaaacttttcatttctcttgtgctgcgtatgtttacatgcacattcctgacttctcaaatcttctttagttcaattactacttctttggaaacaatttgggtattgggcaacagaataatgtagaaagtatgtgcattaaaattaacttttttatttaccaaacctcttagaccatagttttctaaagaaggtaaagcaaggtttcatataattgaaagaactgccaattaacttgagaaggaaatccatacgttaattaattaagttgcatcatgctattgaaagtgaatatatttatttatctcaatggccttccagaagttaatttgtaaacatgaaattatttttcagtcattggattattactagtgtccattgaaacaatatttctctgggtgagatgttaccagtttagaaaagaaaaaaaatgagatttagatggttgtaaaatctccccctgaaatacttttactcatgccatttctttgttcaataataaaggtaaatagcatgacaatgacaatcttgtgcaggaaaactatgctgtgctttagtacacaacaaaaagtgtgttctagcatgtaaaattattctctgaggttaatataggcaggctaaaattttctttataacttttttacgatgctggggtatagtggaagcaattatgtgctttgatggagtactgtggacagtggaagaaggagcaaatgaccacaagctgctgtccagagactaactgcaacaatgagggctctagtttatttcgcaagctcttttactaagcttcctctcagaagaggccatgggattcatggtggggctacttctgaacctgcattagctctatggattacctgtggtggcaataaaaaggtacttttcatatctcctgctgaatgaagtataattgactgacagcctgagctgtagaccttttggagtattaatgtagaggcataccttattttatc

SEQ ID NO: 477446 - DNA, 1491 bp, Homo sapiens
tccaggtctcctcccctgccagtgccagcaggggcaattgtggactggatgggcaggcaggttcttaggcctctgggaagcaggcatggcattggtgatggcagtagaagtagtgggtacatcttgggaccttcctgtggcatacatgggcacagtagtggcagcagtggacttggaaggccagttcccaggcctccaggtggcacatgaagggaaagaaacttgtgtatggcacagtggaaacaatgaagttgaagggtacggcttaatggatgatgaaaatgagatgttcgggggacaagagagggagtttattacaataattcagttaatgaataataatcttaaccaagaagtggctgtggaaaaggagaaagaaatgtcaattatcaaaatattctggggaagcttacaactcaattgcataagcactttcctttggtattcaactgatttgcttaatatatacttctcattttgtcacatggcatattacaaacacattgtattcaagggttgagatttaataaaattaataattctcattacttcatcaaagatgttatttagtgaaaatggctgttttttttttttttttttttttaacttcatgaactgtcagtttaactaaagactgatatttttttcaagtggagagaccattatttgtaaagctttaagacacatagctaaatgccaaccagtcaccataaattttcggctttatttaaactttggtatacattgacaattgctttgatcataatttaatttgagagtcaagatgatgatcagaacatgtttgaggtaaatatggttaaatattttatttaaaaagaacaatgttttcagtaagaagcctgggggtgaaacggactatattttcttgcttttgtaaactttcatggataattatagacttcgggttaatgtcaccagaaaagaatctgtcataagttagcacttcctcatttcctctccaatgtgtctatgaaatcttaaatcaaaagtgtaaaagttctgtaacattactcagacaactaagtgttgagaagagtgttatttaagtaacaaacatcatttactgaacatattatgtgctattcgtgttatatgcacagtataatattgcttgcctcaacaattatgcaaggcaggtatttttatttaagttttacatataagaaaattgagacccatagagtttcactgagttgtccaatttaatactagtagtaccagaaaaagctgagactcacattcagtcccatttgaagttacttttcttttctctcaaaaccccatactgcctttttaggtttgccctgtaatctaaaaccactaatatttaccattaagtctattaaactgtattagctatattcacagttatttaagatgtccattccttagcacttaatcaatcacaaaaggtgtttttgatactgaatgagaaagtaaaaaggatcattacttagttaagctgttatt

SEQ ID NO: 477447 - DNA, 613 bp, Homo sapiens
ctctttgctagctttaccctcttcagtgtggatacattgaactatagtatatctcctaatgctgtatctcccccctccccccaccccacaacaggccccggtgtgtgatgttccccttcctgtgtccaagcgttctcattgttcaattcccacctatgactcagtggagtttgttattacccagcttctgaagcctacttctgccaatttgtcaaactcactctctgtccagttttgttcccttgttggcgaggagttgtggtcctttggagacccctctactgcaggtctgctggagattgctggaggtccactccagatcctgtttgcctgggtatcaccagcggagcctgcagaacagcaaagatggtggcctgttccttcctctggaagattcttcccagagaggcacccgccagatgccagctggagctctcctcagagcttgagcactgtgctgggagatctgctgctctctttagagctggcaggcaggaatgtttaagtctgctgaagctgtggccacagctgccccttccccaaggtgctctgtcccaattactggggaacctgccccgatattcacataggttcttttctattttccttaagc

SEQ ID NO: 477448 - DNA, 1294 bp, Homo sapiens
agctcggagggtcctatgcccatggagcctcgctcactgctagcaaagcagtctgagatcgaactgcaaggcagcagcaaggctgcgcaaggggcatctgccattgctgaggcttgagtaggtaaacaaagcggctcagaagctcgaactgggtggagcccactgcagctcaaggaggcctgcctaccactgtagactccacttctaggggcagggcatagctgaacaaaaggcagcagaaacttctgcagacttaaatatccctgtctgacagctttgaagagagtagtggttctcccagcatggagtttgagatctgagaacggacagactgcctcctcaagtggatccctgaccccaggggagcctaactggcaggcacctcccagtagggaccaactgacacctcatacggctgggtgtccctctaagacaaagcttccagaggaaggatcaggcagcaacatttgccattctgcaatatttgctgttcggcagcctccgctggtgataaccaggcaaaaagggtctggagtggacctccaaaaagggtctggagtggacctccagcaaactccaacagacctgcagctgagggtcctgactgttagaaggaaaactaacaaacagaaaggacatccacatcaaaaccccatctgtacatcaccatcatcaaagaccaaaagtagataacaccacaaagatggggagaaaccagagcagaaaagctgaaaattctaaacatcagagcgcctcttctcctccaaaggaatgcagctcctcgccagcgatggaacaaagctggatggagaatgactctgaggagttgagagaagaaggcttcaaacgaataaacagcttagagaagaccttaaatgacctgatggagctgaaaaccttggcaagagaaccacgtgatgcatgcacaagcttcagtagccaattcgatcacgtggaagaaagggtatcagtgattgaagatcaaatgaatgaaatgaagagagaagagaagtttagagaaaaaatagtaaaaagaaatgaacaaagcctccaagaaatatgggactatgtgaaaagaccaaatctacttctgattggtgtacctgaaagtgatggggagaatggaaccaagttggaaaacactctgcaggatgttatccaggagaacaagagcaactccaagacacataattgtcagattcaccaaagttgaaatgagggaaaaaatgttaagggcagagagacagaaaggtcgggttacccacaaagggaagcccatcagactaacagctga

SEQ ID NO: 477449 - DNA, 535 bp, Homo sapiens
caccataggacactactgaaggggttattactatgaattccagctctgttaaagatatgagacaacaattctggcaagtaaccatccttgacagtcattttgccatgccctttgcccaatccagaaccttggatggcatctacttctttgcttgtcagaaccttcttctcaagaaggctatgagggagctctgtgatcagccagcttccttgctatggtcagaattaggtcatatgcttatccctggacctattattggcaagggtcaggatgagcagggaggctggggccagttccggaaggtcagtcagtggaacagcaatgtcatcatcacctgggagctgatcagaaattcagattctcagactccagccaagaactgtggaatcaaaatgtctgggtgtggcctccctcccaaatctgcatggctattaagtggagattatgatgctaatttgagaacctgtttggattgacctcctgggatgaaaggtttgctgagattagctacaatgatgaattcaattatctttat

SEQ ID NO: 477450 - DNA, 654 bp, Homo sapiens
ctgttatgctaacccactctcacgcatgcttcaacaccactgcagagcctgctttcaggctacttggtagccctacgttctgagctatctgatgggttcaagaaaagttataattgtgcggttcattcagctttttgttgttgttagggtctacacagaccaaaaaccttggagtcatacttggcaccttctctcggatcccacatctaatccatcagcaaatcttgttgactctgccctcaaaacatatccagaactaactgcttctcacagtctccactgtttttacccttatctaagccacagttacttgggcttggattcacatgtaaatgagaaagttactgggaactggagtaaaggtcaccagtgtcacaccttatcaaagagcttggctgtattatgtccatgtctttgggaactatggaagtttgaacttaagagtgatgacttagggtgtctggtggaagaaatttctaagcagcaaagtattccagaatcagtgtttctgcttctaacagcctacaatcagatgtgggaacaaaggaatgacttaaatttggaacttatatttaaaagggaagcaaagcatacaactttggaaatttgcagcctagccctgtggtagagaaagaaaccaagtaggttgtgaag

SEQ ID NO: 477451 - DNA, 715 bp, Homo sapiens
gcacactgtgcttcagctgatgggggcggcaggactgattgtcattctggataatttcaaggagagattatgaagaagaatgagaaggagagtaggaagcaggaggaggaggaagaagaagagaagaggaaagagaaagagagaaagaaagaagaaagagagaaagaagaaagagaaagagaaaaaagagagaaaggaagaaaagaaagaaaaaggaagcaaaggaggaggaggaggaataagagaaagaagaggaggaggaagaagaggagaaggagaaataaggggaaaaaggagttatcctggtcaaatggcaaggaacagcaattcttccacatgccaggaaagagacaagttggaatatttctgagcaaacaagtacttaccgaaatttgtgattttacaaaggaccttcacttttcaaaatgtatcatcatcatctacctgccaatgacccccccccaaggtggatttaaagtagaatttgacctccatcagctggatgttatcttctataatctttatgtcttcaggtcttagatctaagtctctcatccatcttgagttgacttttgtacaagtgtgtccttgatttccagaagttgtgattgctttttatttatgctatctatttcactgaagaattttccttttatatcctgtgttatgttttttatttatttaagctggacttcacctttcctggtctttaatt

SEQ ID NO: 477452 - DNA, 603 bp, Homo sapiens
tggagaacctttatgtctagctcagggattgtttatacaccaatcggcactttatatctagctcaaggtttggattgtaaatgcaccaatcagcgccctgtcaaaacagaccactcggctctaccaatcagcaggatgtgggtggggccagataggagaataaaagcaggctacccgagccagcagtggcaaccccgagaccacgaacccaccagaaggaagaaacgccgaacacatccaaacatcagaaggaacaactccagacgcgccaccttaagagctgtaacactcaccgcgaaggtctgcagcttcactcctgaagccagcgagaccacgaccacgagcccgccgggaggaaggaacaactctagacatgccgccttaagagctgtaacactcaccgcgagggtccgtggcttcattcttgaagtcatagagatcagatcttccactggtggaaatatacctccaggagttcatcttgcctttagcagaagatgactgtggtccatttttcaccttgatccacagtcatagaaaatcttccttcatctcacttctcagtccactacttcagttgggccatcatgaacacttgagaga

SEQ ID NO: 477453 - DNA, 548 bp, Homo sapiens
cgacactgactagtctccataactggcagggccagagctcctgggggcccaaactgggggcagcacaacctccaggactcctgcagcggccccgaggtgaggggctgagggcagagcgaagggcatggaaagggcaaaggtgcctgttactttgaagaactggccaacgtccaagttttgtatctgcattcagttactcgcggaggtttggggccacagctttgtcctcctgacagacaagcttccagggacaccagagccctggccccaatccatccagatgcttgggcagctacgtcagcattacaatatccacgttaaggatgagaagatggaggctttggctggttatgtaaacagagctagtgaattggatccaggcctgaacccagttccagaagccttgctgttgagcgcaagtctattttatacactcagtgacttacttaaggtcaccccactgaagttcagaagggagaagtccagggctgatatgggcatctcctctttggccctcattttcatgggccaagatggctactagaatt

SEQ ID NO: 477454 - DNA, 724 bp, Homo sapiens
cagggatgcccaggtccatagccatgggtgggcagccacagctctgcccagggaatgtgaggctcttgccctgccaactcagaagtggggcagggcttctgcctgttcctgccttcagcaggtgttctccagtcttcccagtcttcatttgtgagaacttctcccctgtagattgttcctttgctttcttaggcccaaatggtggagggggaggggaagtgaaaatattcttcaaagatgaaggcaaaataaaaatattttcagaaaagcagcaacccaaaatattaattgccaagagggaagaaatattcagagaaaagttgaggaaatacagctggtcctgggggcatttgttgattcttggtgaaggtgagtgtggggatccaggtttggcttgggtagagaatcccggatggaggacaaataaatcagcagagattttggtggtcacatgggacagaagcaacaatattggcaagctgaggagcatcttgccctggattccagagaaatttactgcatgatgaatacatgataatttctgctgccaaggaggtcatagtcgcgtatggaagacaggtctaaatgattatataagaagagtgttgatttttgtttcagtaaatgctaagttactgacactatctcatttctgaaaagatttagttttagggctttattagggaaggtttattttggttctgtaaagacacagctcttaatt

SEQ ID NO: 477455 - DNA, 1226 bp, Homo sapiens
cccacagcgcttctctccacagaagaggcagaggcgcagcagtctgagatccatctgccaggcagcagcccagcagggagaggggtgtccgccattgctgaggcttgagtaggtaaacaaagcagcctggaagctcaaactgggtggagcccactgcagtgctgcaaggcttgctgcctctatagactccacctctgggggcagggcatagctgaacaaaaggtagcagaatcttctgcagacttaaatgtccctgtctgacagctctgaagagagcagtggttcttctagcacggtgtttgagctctgagaacaaacagactgcctccttaagtgggtccctgacccaggtgtagcctaactgggagacacctgccagtaggggccgactgacacctcatacacgcgggtgcccctctaggacaaagtttccaaaggaaggatcaggcagcaatattttcagttctgcaatatttgctgttctgaagcctccactggtaatacccaggcaaacagggtctggactggacctccagcaaactccaacagacctgcagctgaaagacctgactgttagaaggaaaactaacaaacagaaagggatagcattaacatcgacaaaaagaacatccacaccaaaaccccatctgtaggtcaccaacatcaaagaccaaaggtagataaaaccacaaagatggggagaaaccagagcagaaaacctgaaaattccaaaaaccagagtgtctcctcttctccaaaggatcacagctcctcaccagcaatgaaacaaagctggacggagaatgactttgacaagttgacagaaataggcttcagaaggttggtaataacaaacttctccgagctaaaggaggatgttcaaacccatcacaaggaagctaaaaaccttgaaaaaagattagatgagtggccaactagaacaaacagtgtagaaaagaccttcaatgacctaatggagctgaaaaccatggcacaagaacttcatgatgcatgcacaagcttcaatacccgattcaatcaagtggaggaaaggaaactctacaagccagaagagagtgcgggccaatattcaacattcttaaagaaaagaattttcaacccagaatttcatatccagccaaactaagcttcataagtgaaggagaaataaaatactttacagacaagtaaatacggagagattttgtcaccaccaggcctgcctt

SEQ ID NO: 477456 - DNA, 847 bp, Homo sapiens
gttcttttccataccatgtggttccgcttctctttttcttagttcctatgaaaaccggttgttgaaaacagcatggctcctcctcctcctcctcctcctcctcctcctcctcctccttctctctctctctctctctttctctctccttctccctgcttacaccatggctgatcgacccagagctgggcaccagatccaagctagaccaatccagtgtcccatctctccagctacagctgactgttccaggggtcagcacctatctgaagtcgtgccagatgaagagaaacaccatgacaatagccatgcagctgacctagagaccaacttgtccattttagagcaaaacagagggctctcagaaagatttcttcaagaagatgaaaatcacaaaatacttcatatgcttaaatatactgagaagagatttatgttgctgaaggaaagtttgggattgaataatcagaacgtaaagactaaacaaagaaaaacaaatgaagaaagaaggtacttacaatgccagggaaaaacgaatgctaggcagctaaggatgagttgtcctcactgtccctgtctctgctatgaatagctttttcatggacataataatgtaactacttatgattgatctcatttgaattttactacatatacatagggaggtttggaaaatgtaaaatgtgtgtttgcatgtaaaagaggtcacatttgcatgtgaaagaaagcaaaatcctcatttttcaaagggggaaagtcagtatataaggactaaactgaaaaaaagtaaaattaagaagctcacttgtacaatgataggaataataataataattgagtctgccttcac

SEQ ID NO: 477457 - DNA, 765 bp, Homo sapiens
gccctataccctccaacatttggcagtatttttgattgtcacaatgtggagggacaggaaggcctcaaaagtcaatattgctgagcttgagaaatcctgctctaaggaaagtggaataatgaaatcgaagcattgccagccccccttcaccttctgccatgagtggaaggagcctgtggccctcaccagatgcagatgcccaatcctgaacttttccagacgtcagaactatgtgccaaataaacctcttttctttgtaaattaccccttctcaggagggaagaaaggttcaacatggtattatacaccaatgcagagcctgtgggacacgatagccttgagaagaggagatttgcatcctcaggcaccagctcggaattgccttaggagcgtgggagcgggagagggcggagcagaggccatgaagctggtctcagagcctgtcccctggagtgtggatctctgctgaccggcccgctgccgcgctaataaatatcaaacccttcaacgggaaaataaattatccccaactgctaggcaaaacagtcttgataaattgtcgttttagccaacagtgtttaaagtaaaatcagtaaagtctgtgctagctagacttgctgcatcagcctcatctgagaaattgttagacatgcaggttctcttttgttggtggttaatttttcttaacttttattttaagttcaggggtacaagtacaggtttgttacgtaggtcaacttgtgtcatgggggtttgttgtacaga

SEQ ID NO: 477458 - DNA, 1411 bp, Homo sapiens
caatttcaaggggcctaatattatgggtaattggggcaccaaaagaggatggagggaaagacatttgaagaacaatggccctaaattttccaaatttgatgaaaactataatcccacagatccaagaagctcaacaaacccaaatccaagcaaagaaaaagaaaaaagaaaaaacctacacccagctgcagcttctcatgcagcaccagcttttaactctggcaaagtaaatattgtcgccatcaatgactccttcattgatctcaactacatagtctacatgttccagtataattccacccatggcaagttccatggcactgtcaaggctgtgaacagaaagtgtgtcaccaatggcaatactatcaccatcttccaggagcaagatcccaccaaaatcaaatgggttgatgctggcattgattatgctgtggaatcctccagtatcttcagtgtcttggagatggctggggctcacttagagtgggtagccaaaaggatcatcatctcttacctctctgctaatgcccccatgtttttgaagactgtggatgtcccctctgggaaactgtggtgtgagggcagggctctccagaacatcattcctgcatctactggtgctgccgagggtgtgggcaaggccatgcctgagctgaatgggaagctcactggcatggtcttccatatcctcactgccaatgtatcagtcgtggacttgatctgccatatggagaaacttaccagatatgatgatatcaataaggtgaatataggaaattctagacaagatcttgtaaaatcgaagttcagaataacagccatccttaagagagcagccggtttagaattcggaaactggagggagaatttcatgaggaaggtatccaggaacaacataaaattgatacatcatctggctttgaacatgaaattctttcacactctggcaaaaatctattgccaagagaaccgtcataaaagaggcctaggcagtgatgacagtttggagcttcctgtgatttcaaccccaagtatcaggtatgtggtaaaggctgtacagtgataaatgttttattgatgttaaaatgtgttactaaaagcagtaacacattttaattgtttcttctgcaaatatctattgagtgcctgctgtgtgttaggcagagttctaagcactgataatacaagagtgaatgtgttagatctttcagtggggaagacagaaaatgaatatgtaaaataatatgtatttaaatttatagattatatgtgtaaatttaaataatcaatcagtcaatcaatctttttgctaagtaacatattgcaccaaaacttagcaccttaaacaaacagatgcttgttatctaagacagtttctgagggtcaggaattcaggagtgcctgggctggt

SEQ ID NO: 477459 - DNA, 584 bp, Homo sapiens
gaaaagtactagaatggtgcttggtacacaagccaagcagcagatgctcattctctgcagcaccgcagcagctctgggaccatccccggtccggcattgttcccagagcttctgtttgaaagtggcccaccacagggacgacatgcagccatcggggtccttccactggaaatgcattgtctttttaagtctggccagagccagggcaggttatggagaaagcactagtctactgaccgatggagaaatggaggaaagaggaaatgaatccacgaaagttaagtacctttctaagaggtggcccccattctctctgacggagcaccagctttctctgaggggcttcagccaaggttgctggcagctctttgctgacttcttgtcaactgtgtcactagagagaaaaaggaccatcttccccaactccatttagaaaaatctgggcaaaggcttctgattggctcagcacctgtctttctccaaacctagaccaaccacaggggctggagggaaggaaataactcaagactcaccgcccttcctttctgatgagaaattttctgatgggctgagatggcctcaac

SEQ ID NO: 477460 - DNA, 477 bp, Homo sapiens
ttctcagaggatgaaactgaggcacagcgatgaaataagttgcccaaagttaaacagtttgttagtggtggatacatttgtgattgcactcaagctgagcctgggattttgtgactcaaatgtagtccagagaaagcggcaggaagacacaaaggtttgcagaatgcgtcaaaacattgggaaaagaatccacgtggagtatggggaccctgttcaagagctggcatctcgactgatttcaggccacagaaacacagggatgtcaaggccggagtctgcctactcacaggacacaaaagacaacgaaggccaacaccagttattctgtccacagagcacgcaaccagccaaccacccctggagccacctgaagagtggcttggaggtgtggccatctctaatcaagcaagcacctgagatctgagtctccttccaaggaggaggaggaggagcaaaggtgtggcggtcaccagggaa

SEQ ID NO: 477461 - DNA, 592 bp, Homo sapiens
tatctagcacctcttgttctcagatgagagccctagttcccacttcgacaacatgcaagagatttattggaagaaaattcctgtgaaggataaaaggcaaagagcaggaatgggcaaggacagtcttagactccaaggcgggtctgacatctgtgaaagaagagtgtctgacaatgtaatagaaaagaaaaacccattttctggggagaacttcaagccaactgcagaaatttgcgtaagtaacaaggagtcaaatgttaatcaccaagacaatggggaaaatatctccagggcctatcagaggtcttcacagtatcccctcccatcacaggttgggaagcctaggaggaaaaaatggtttaatgggccaggcccagggccttgctgctttgtgtcatctcaggacttggttccctgcatcccagtcatggctaaaaggcgccaacgtacaactcaggccattgcttctgagggtgcaagccccaaggtttggcagcttccatgtggtgttgggcctgcatgtgcacagaagtcaagaactgaggtttgagaaactctgcctagatttcagagaatgtatggaaatgcctgg

SEQ ID NO: 477462 - DNA, 454 bp, Homo sapiens
cctgagctgcagaagaaagttccctatggcagagaacagagaaaacatgcatgcaaaagttttaacaaaacaaggaattgaagctggcagtgaggcaggcagcttccagaagaaacgctgctctgctgacaccttgagattagtccagtggaacccatttgagacttccgacctctggaactgtaagataatacatttgtgttgttttactccgccaagtgtggtaatttgttatagcagtcataggagactaatacacaccccactgccactctcctggcagtggtggctgaattctggattggaaaggaaatggggctacaaagaggccacagagtacagggactcgggagagaaaccacctggattcagaactcagctcagtcacctgtttgcagttacccttagtgaagggatgcaacctctctgagtgttaatttcctcatctgtaaat

SEQ ID NO: 477463 - DNA, 640 bp, Homo sapiens
gtccagttcattgatgagaaaatggacactcgaggagataaaggctccagtcctgggggacaaatggaggacgagagcatctgggcaggctcctggctgctgctgcattccagatggggaccaaccgggtgtgggttctatgtggtgaaagttcacacacactcactgacgtgtgaatatccacggagctttatagccatagctacacccttaccgtcactccctctctgcatcaatctcaggcatttccctaaaaatgcactcccaagtccagggttaagccatgttttccagctcctagaagcagtgctggcagcagcagtggttgggtccatagtggtggtcaaggcaggacccacagcaggaagactctggtgctacagcagcagcagcaacgtggttctaatggcagcagcctctgtgatgaactgaactccctgggtgcatcattttgcctttttctccatggcctgaggagcagtagcaactctccgcagttactaatctgtggtttcccttactgttctccttatgccatctagatttttcagtcaactccccaaatagaattctctctgattgaaatatgccatctagatttttcagtcaattacccaaatagaattctctctgattgaaa

SEQ ID NO: 477464 - DNA, 683 bp, Homo sapiens
ccaacattttcctgcctaatgtgaaagaaaatgaagcatggggtcaggaggctttgaggccaaggctgcaggatggaaggcagttccctgtgggcttccacactcaggactcctgcttttcacttccctcctgggtttctctatgctgtagacaccagcactgcttcccaaacagacacaagtagcccagaagtgctgggagcaataatggccccaggaacaacccataagcaatgtgggcaaggagctgatggagaaatagtcctccagtcagtccccaggtggataactctgagatgcattctatgccctcctcagaggttactggcaagactgaatgtgagaggaaacctggagccagtgcgaagaacagcatggcagcatcaggcaccagccaccactgtccacacactgcccggcgtgcggggtccagaatgcaatcagaacaattacctgaatagtcaacttcttcccccacaactggcttgctttcccggtaaagacggtgtcttgtcacatccagaaaggccaaagtgtgcccacttcctggcaccactatggacagaatcctgggagctgtgctaggagagcatgtcaccaagaaacggcaggtcataggaagtgggggcaatatctctttttaaatcaaagagagaggactgattttaagacagaatccttat

SEQ ID NO: 477465 - DNA, 537 bp, Homo sapiens
cgggtttgaatcttggccccagcactgattgctgatgactttgggagtcaaaatatccttaggagagaacatctttctgagtcaaacatcttttatcttgcataaagattctttggagggtgtaaagtgttatcagaaggagtggtttagggcctacagaggtgtccgtgtgacacaaagtagatgtggggcatgtgacatgaatgtgagctgcccattttctctgaatggtggcccagcacctggagggacagagtacaaaggactctggcatgttgaattcctcaagcaacctgctggtaaggtgggccctattgtttctaagggcactgacaacagcatctgtgttctctgtgaaggatgtaaccagagaggtcaaggactcctaagaatcacctggtttattcctgttcctctaacacgctggctcccacgtgctggccttggaccctgggagggctgaagggttactgcagtaggtctaggaagccacgagcacatccagcaccacaatttttcaaatgtttccagatgctt

SEQ ID NO: 477466 - DNA, 604 bp, Homo sapiens
agcagtgctttgcttgcagtatagcagaagcttaggtagagatgaggaatgccagaagcccaggtagagatgaggaaggccagatgtttgcattggtttgggtgtgggattttgccaggcaggtgcaacaggaggacagatggagtaagggatttgaagatattggcaaaggagcggctgaactaatgagctgtaggatctggaccaggaagagaagaacgatcatcaatggcaaatggcagttgcagagaagcaacactgagagctcacttcatgctcagaagagaaggcagcttctcctcacggtttccagaagatgtcaacacctgtacactttacggaaggacacaggcctgcatctgactggtgctgtggaattcctgcaccccagactggtgtcagggagtaaatctccaggcttgactggagcagtctggagtatgaactatgcaaactctaacgatgatggcttcaaatcctatagaagcttacaaccccctaagccttaagaaggatttttattttttattttttaactagaaaggaatgaagaaagggtcataaaatgttaaagtatattgctgactatattgctgacccatat

SEQ ID NO: 477467 - DNA, 1111 bp, Homo sapiens
agtccattttgtgcttctgcaacagaatactacagactgggtaacttacaatgaactttattgaatcatgcttctggaggctggaaaatccaagaccaaagggccagcatctggtgaaagccttcttgctatgtcataccatggcaaaaggtggaagggcgagagagagaggaagaaattataacatcttctggatggcacgctacccagtctgcagccctgctggccatgaaaagaaggcatatctaggattgtcaacagtgtgtaggattccagactcatattcaggcttcagagcatcctccataaatcctggacagaaggtttttggggaacaggtggtgtttggttacatgaataagctctttggtggtaatttgcagccagtgaacagggctaagaacttgccccggaccatgaacctccacattgaggaagcaagcagactcacagtttttcggcatctcagggagcctgcagtggtgatccagttccttcaaagggtctgtggattatctcagctttcctggtatgttcctgcagtagttcttgaagcaaaagtctatgatgtgagtcttcacatgctgctctgtccgttcaagtggcagctgcaagctagtcctacctcctatccgccatcttaatccattgtgattaaatctattacaagcctcttatgggtaataacacagaaattggctatctgaatggtgaaaaatctaatccaatcacaacagaaaaaaataataattaacaacatggctgcatctaagtacatttgaaattacctaatataaactttctaaacttgaaatatcatttcctggaatttttttactttccttattttgtttttagtgggaaggggtatggattgtaaatgaacttacagcaagcaaatgaatagggaaaagtttttaccttcagtttcagcatcatactttatctttcaccattcccagggtataaatatgaagaaaatatacccataacataaattataataaacaatataattccatatatgcaaattagttaataaatggttcttactgaagcaatttctaagcaatactctataacctataactatagctttaaattgttaatc

SEQ ID NO: 477468 - DNA, 548 bp, Homo sapiens
tcctcaaagagaaagaaagtggggcctgtacccagcaaggtatgctccgtaaaagggcagctcaccacttggaaatttaccaaaatgcaattgacagaataggaaataattttgccctagagcctcagaaagatttagacactgccttccaggacctggagacagaggccaagttctttattacacgggaaatgctttcagcaatgatttggatagagttggtgcccagggatataatctggtgggtagagcccacagcagggagtccaaatggacacctgacactagagaggcaggatgtcagtctcagacctaaggatagtgggaatcctttgaagtattttaagcagcctgacagggttggtctccaaggaggagcctgtcattttccaactgcagctgtcactgcttccaggtttatgtttttcctcttctgtgagcccagacttttccacaacatatactggtcagtttcataaactttctttaaaaggggtggccgtgagtgtaattttccattctgctttccagcgcactcagctgccttt

SEQ ID NO: 477469 - DNA, 509 bp, Homo sapiens
tgcagccctgctgctgggttaccaaagaatgactgactttgtatgtgcccacattaaaaatggtgtcctgcttctagtcctggatctgggaaaatgcctgcagcttttcctggtgtctttccctcatggtgtctccaagactttccccatattaactctggctcaggagaagcaaagtgctcttccttggcctgggttgctcagatccccagtggaaagaggctttgtccggcaaactggatattctttaatcccttccagcccatcttgtgctgagattctgactcctttctcagggacttcagtctatggagtggaaagccttttggttgttggtgtggataaaggtggatggacagacagtgtcatcggttggttggtttgttgtaataaagaaatagaagaaggcaatttcaggtttttctctatcactcagtttctgctgccaatataattcttcttctttttcagtttgagttttactttttatttcagtagtttttggggag

SEQ ID NO: 477470 - DNA, 522 bp, Homo sapiens
cctcacttcctagacgggatggtggccgggaagaagcgctcctcacttcccagactgggcggccaggcagaggggctcctcacatcccagacgatgggcggccaggcagagatgctcctcacttcccagacggggtggtggccgggcagaggctgcaatttcggcactttgggaagccaaggcaggcggctgggaggtggaggttgtagcgagccgagatcacgccactgcactccagcctgggcaacattgagcactgaggagaccctggagagggagagggagagggagcgggagcgggagcgggagcgggagcgggagagggagagcatcaagtttgtgttagcaattgagcggggtgcagttaaagcagacatgaattgcagtgacagaagcagtttaattagctgtcaattttctaaacaaaacgttctggtgtaggtcaggattttgaaactttcatcttggtttctgcaggaactggcaaggttgaaaagggaagcggctggagggtgtttcatc

SEQ ID NO: 477471 - DNA, 996 bp, Homo sapiens
gcggctgttcagtttttaaaaaacgcaacaggcccgtagcactgcaggatgggcaagtgtcgtggacctcatactgctaggagtctctgtagtcaccaacaagatcagaagtggcatgataaacagtacaagaaagcccatttgggcacagccctgaaggccaacccttttggaggtgcttctcatgcaaaaggaattgtgctgggaaaagtaggagttgaagccaaaaagccaaattctgccattaggaagtgtgtcagggtccagtggatcaaggatggcaagaaaatcacagcctttgtattcagtgatggttgcttgaaccttattgtggaaaaccataaagctctggttgctggatttggtcaaaaagctccaacaaatgggcagctggccggatatgaagatgtttcctctcctggccttctacttgagggagacagggaggagctctaatagtttacataggactcaaacactgtctgtcacctagggaaacagtgcacgtgagatgacattgcaattttacatgtctcctcatgcattcagtagagctttattttaggtttatagacctgaagatcatcccacaaggtagaacaactcatttaacctatttgacttggccccaagtgtaatttgtacatagattaactattctgaagaattccaatagaactccctggggggaaaacacccattttaattggcatacaccagagtcactggaatcagttactaaattacaatttccttacaatttggaagggtttggggattgttattgttttcctggtaaattactggatcacactggtgtcttggaataagtcaacacattttaaatttaagtttccataaactgtagctcaacttcccaagttcctaggggattttcactggcccagactcaggaagaattttcttctatgggatccaagacttcagagaccaaacatttcctgaagactttcctctgctttctgacctccacct

SEQ ID NO: 477472 - DNA, 1897 bp, Homo sapiens
cggaggttcccctgactccgtgttgctcctggatgggtgaaggattttcttaaattttcaatgaaatgccagattcttggatacgatgtatgtgggctttcctatagtcatttcagtagatgctatagatattatggtatttgggaaactatatttcaatgtaaagaaggcaaggtgtcatgctttgacattgatttggtggaacttcctagagacttgttgaatggttttgaccaaaatgctgatagtgatatggacagtgaagtccagattgaggtgatctcagatgaagatgaggaacgtactggcaactggagcaaagacaacagagtaccaacaggatacctgaagcaaaatttgacagaaatgaagggagaaatagacaattcaacagtagtagttggagactttactatcccacctttaataatggatagaacaactaagcagatcctagaagaacggcaagttccagttgttgtccagacacctattgtccagatgcaactgtatcaccagagaagaaggggagtaaagatttagagttgattctaagggcagagaataattattgtaggttttaagccaaagtgtaactatttatgtattgcttaatttaaagattacccttggagatagtctacagattgggatactgtattttactcagtttacatttagtttcaggatgcttgcattctatgaaatgtatttcaagactccctaaaaagacaaaatagacactctttaagcagtttacaagatacagatctttatctcttacaaaggaaaggaaacaaggaagctgtaaataataagttctgaatagaaatgacataaactgcctaatcaatgtcttccagaactggcaagtgacacctctttgttttttgcaaataaaaaccttcttcccatcacaatataaaccattatctctgcaggcaaggtatatttagaaatgtacaaaatgtacatttcctgccagcctctagatcagtaggtggagatctaaagtcatgcaaatattacagtaaatgcaggcaaccaatttctaattattccatatcagcagatttgtgaggaatataatttattaaaaaagaacagtttatgatcagcagaccttggttatgactgtttaggaattcagtgcattttgatctaatcacaaaatcaaaatattcatgaaacacaatgatatctccccaaagcagccgggcagccattaattttgaaattcgggtaatttattaacacttatctgaagctgtaaaagcttacctctgtgtttgtaatacggagaaaagtgaaagcagttttaaaactgattcctaatgatttataatggtttgctgtaatttgagccagaaattcaattaaaatgtatgtctagttttgtttcaagatctttagttaaaaattctattaaaattctatttccttcttgcattaaatgtatctgttatctgcatatacaagaaatataagaaaattctatcatttattccccagtccccataaatgctttaaaaagcattcatttttatttcataattctgctaagcaagagtctatgagcagaaatagtaaatgaagctaataattttttgaagatttgctatgtatagatacttcacatgtgttttaaacatttcaatctcctcaatagtaggtatattagacacagatgttatttatattttactgaagtggtagcagaggcaggacaaagtttcatagggctggtggttgaaataattgcaagaaccaccagcatggcttacctttggggggatgggagtaaagacaaaatgaaatgtgaaaggttcaaggaggatttgaaaggaaaatgagttttataggaaaaaaaagcacattctattaaggtgagattttt

SEQ ID NO: 477473 - DNA, 1337 bp, Homo sapiens
gttacagatgcttgcacttggaaacagaagcatgagttgccttaccaagtacacactggcttgctgcgggtgtagttcatcacggttttcacaggcctcgcagaccggaccttttcctaaagcacctgattcagccgatggcagctcccgattcacgaggccagagcagcgtgccaaccttctgcaggttccccagaaagaagagaagaatggctccagcaggtataaaggcaagtgtgcgctctcacctgagttcagggcagcaaactggggagacggcagtgatactgggagctttctccgcacccaaaggaatggacactgccttccacgaagcatctgtttttcgcacggtgatggaggtgcaccccgtgatgcagaagaggccacacctgctgagatggttaatttcaacctgtccacaggactgggctaagagaggcccaggttgctggcacacctgaatttctagtgggccgactccatccaattcattgaggactcagatgggacaaaaaggtaccgaaagagtaaacttgttcctcctcctggagttggggcatccaccttcccctggctcctcctcctggagttgcaacatccaccttcccctggttcctcctcctggagttggggcatccaccttcccttggctcctcctcctggagttggggcatccaccttcccctggctcctcctcctggagttggggcatccaccttccccggctcctcctcctggagttggggcatccaccttcccctggctcctcctcctggagttggggcatccaccttcccctggttcgtcatcctggagttggggcatctaccttcccctggctcctcctcctggagttggggcatccaccttcccctggttcctcctcctggagttggggcatctgccttcccctggctcctcctcctggagttggggcatccaccttcccctggttcctcctcttggaattgggacatccgccttcccctggttcctcctcctggagttgggacatccatcttcccctggttcctcctgctggagttgggacatccatcttcccctggttcctcctcctggagttggggtatccatcttcccctggctcctcctcctggagttggggtatccaccttcccctgatcgtggacactggcccctagtgctcaggtctgcagtttggggaattataccagcgacattccagggtccccaccgtacagactgtgggacttctcagccacggtgatcgcataagccaattcccataataaacctccttctatgtctcagtatttgtcctaatggctctatttctctggaaaaccctgact

SEQ ID NO: 477474 - DNA, 997 bp, Homo sapiens
gcctggaccctctgtcagtcaagatgtccttggcttttctccttgctgccctgttccttgtacagccacacctatctccaaaccagctgcatcgacacctttgttattatgaggatttgattaatgaagagctgttccaggatgaggagctgtttcagaatgaggaaccattccagaacggggagctattccagaatggggagcccttccagaatggggagccattccagaatgagaagctgttacagaatgaggagctgttccagaatgagaagccgttcaagcatggggaacttttccagaatgagaagctgttccagaatgaggagctgttccagagtgggaagctgttccagaatggggagctgttccagagtgggaagccattccagaatggggaatcgtttcagaatgagaagccattccaggatgaggagctgttccagaatggggagctgttccagactgatgagctgcaccttgtacctgcctcacacctgatcacatagccttgatgccagaaacctagagtgctctatttaggaacgttaggctggcagcaggaacccctgaagaaactcaggacactaggtgcttgagcgcgcagctaacccgcaggagaaacatctcccttctgctgacctgaggcttgactcctctcccacaggaggggaaaagaggcctccacccacagtccactgttatcctaggagaaatcctctgccctcctgcccaggaagtgacagagagagagagaagctgaagctgctttaaccttcaagatgaacctatttcttccatgaggttttctcttgcctgtacacgtatctttatgtccacgagacacatccacactctgctcgcacagcgttgccagggccagtgccttctctcccatcctgtgtttgcatttgccatttggtgggcctgtcctgctgaccagcaagtctctgtactgaatttggtgactttgatcttatgattcatgtttcccagc

SEQ ID NO: 477475 - DNA, 1476 bp, Homo sapiens
gagcctcacgcatcaaatgacagccggcagctctgtcacatcccagacccaatacaatgcccagcttgtgtcagcagcttgcagaagtgtatggatgggactccaaatgggatgaagacccacaggttttttaattattgaattctgcatctgacggcgttgattcataatgaaaaacagccagcacgccttcaacctacagcaagccctctgctgcattctggaggcgctttgcctggtagatcctcccaacaccccacaaggtcgcattactcccccagacctacagcaagccctctgctgccttctggaggcgctttgcctggtagatcctcccaacaccccacgaggtcacattactcccccagacctacagaaagccctctgctgccttctggaggcgctttgcctggtagatcctcccaacaccccacgaggtcacattactcccccagacctacagaaagccctctgctgccttctggaggcgctttacctggtagatcctcccaacaccccacgaggtcgcattactcccccagacctacagcaagccctctgctgccttctggaggcgctttgcctggtagatcctcccaacaccccacgaggtcacattgctcccccagacctaaagcaagccctctgctgccttctggaggcgctttgcctggtagatcctcccaacaccccacgaggtcacattactcccccagacctacagaaagccctctgctgccttctggaggcgctttgcctggtagatcctcccaacaccccacgaggtcacattactcccccagacctacagcaagccctctgctgccttctggaggcgctttacctggtagatcctaccaacaccccacgaggtcacattactcccccagacctacagcaagccctctgctgccttctggaggcgctttgcctggtagatcctcccaacaccccacgaggtcacattgctcccccagacctacagcaagccctcggctgccttctggaggcgctttacctggtaaatcctcactcttgctacccaaggcagagcatgcagcagcagcagcagcatcacctaggagcaggtccggagctacccacaatctgcaaaatcaaaggggagacggcggcggacgtgcagagcctccgagagccggatggaggacaatgtcatcagcgggccactgggaccacctcagccccaggcaaggcccaagcctgcctgctccagccgcccgtggtcctccgcagccaggacctgctttctgggctggcttcaccccccaccacttccacagcccagcggtgccctccaggctccaccgtcacatcgcatgtgtgttccctgcgctgctgagggacagctcactgggtcttcctgtttcaaattcttggggactctgtacttgaggctgggggtgccagcagctgaggaggggagggccttccgaaagcccgtctgcctggaggctg

SEQ ID NO: 477476 - DNA, 569 bp, Homo sapiens
tgttttggggttcgtcccatctgcacagggtggcccatggtgatgctatgtggatgtgcgttgagatccggaatcagcagccccggacacctgagacagggggtgcgggccgtgtcccctccacaggtggagacagtcagcccctggctgagatcgccgtcctctcattccaccctggtctgctggttgggaccacgggcagcgagtccacggcaggactcccgagcagtggctgtcgccggtcaccccggacggctcagggcaacacggaccgtggcgccccaggaaaggcgcccacagccacagccagcctggatggggcccctggagctgcccggaaaagccgaaaggatccaggaaaacactgcaggagaacactgacagaggtgtcagacaaaagggctcaacttggtatcactggaaacccggccagtagctcatcagctcgtcttccaggcaggttgctgcgatcctggcaggcctgacggtgtctttcagatgtccctttattgtctaaacttctgacgacttgtgctcagtgtctggcaatcttgagaactcttctctgc

SEQ ID NO: 477477 - DNA, 1154 bp, Homo sapiens
gctgatcatcctgagagggctcagtcagagactcacgctgtacggtaacttttcagatcctttattcttctcagcagcaggttatctttgtcaaatcagaatttactcagaagcacacgggaaagccatgaatccacatttgctctggttgagtcggggcttggacgaccgagaccacgctcctcaccatggttacccatccaggaaagactcaaagagggctcttcagaaactctaggactcactggagcagactgaacattccagatgtaatcaaaccgattaattttgcagatgaggacagtaaagctgagaaagcccggcccacccacctgaactcctcagtatgctggctcatggccgtggccagaatccacatgctcctggctgccctctacctcggggccgttttcaagtacaccaagattctgattctgatgtctgaatccacctgggtcagctctatcagtagcttgctgaggaccccgtcactcagaagtacgaccctgcagcctccactgcaggaaagccaccgtgagaggccggtgtcagaggcctcagggcttttccaggacttttcagcaacagaaacctgggagttttatcctaataaaatcagagctgggaacgatgcatgccacacagctgttctaggaaactaccagaacctatctttagccccactggcatggacacagcctcttcacaagccgggtgtgtctttgaagagactggtgcctggaagggacttttgtacagtagaataattttttaattaaaaatttataaaacttctactgtatcttttatgtctccaatatattaaagaaattgcttactgtatcaaccaaatgattcagattcaacaccagttaatatgaaatctaggaaacaggttgtaaaatgtcaattaagaaaagaaaatgaattaaagaaaatgcacaaaacaacaaacacccaaagatgttcagctcaaatataaacaggttagtttcatcatataattgctggagtaacttgttttttaataaaaataggaactatgtataatatatcatgtagcaaattgttattataattgagtcatttttaagtagccaaataattaatatagtcctactgttttaattgttccctgtatagaagatattttt

SEQ ID NO: 477478 - DNA, 1352 bp, Homo sapiens
gagcctcacgcatcaaatgacagccggcagctctgtcacatcccagacccaatacaatgcccagcttgtgtcagcagcttgcagaagtgtgtggatgggactccaaatgggatgaagacccacaggttttttaattattgaattctgcatctgacggcgttgattcataatgaaaaacagccagcacgccttcaacctacagcaagccctctgctgcattctggaggcgctttgcctggtagatcctcccaacaccccacgaggtcgcattactcccccagacctacagcaagccctctgctgccttctggaggcgctttgcctggtagatcctcccaacaccccacgaggtcacattactcccccagacctacagaaagccctctgctgccttctggaggcgctttacctggtagatcctcccaacaccccacgaggtcgcattactcccccagacctacagcaagccctctgctgccttctggaggcgctttgcctggtagatcctcccaacaccccacgaggtcacactgctcccccagacctacagcaagccctctgctgccttctggaggcgctttgcctggtagatcctcccaacaccccacgaggtcacattactcccccagacctacagaaagccctctgctgccttctggaggcgctttgcctggtagatcctcccaacaccccacgaggtcacattactcccccagacctacagaaagccctctgctgccttctggaggcgctttacctggtagatcctcactcttgctacccaaggcagagcatgcagcagcagcagcagcatcacctaggagcaggtcccgagctacccacaatctgcaaaatcaaaggggagacggcggcggacgtgcagagcctccgagagccggtggtttccacccccgaggtgccaccgtttccggcccaggaacgctgagaccttcgcgctcccctcgcgtcacagccaagtgtaactgtaagaagcagctgggtgatagagcaagactccgtctcaaataaataaataaataaataaaaataaagaaatagtatctcccgtcttttggtgtctaaatgaaggctgcttttagaaaggggttgtagtgtttgttctgcttggtccgcttagggttttttaaccctgccttctgcatttccagtgggacaggaatgttataatgggcttggtccgcttagggttttttaacccggtcttctgcatttccagtgggacaggaaagttataatgctgaaaaccaccggagttcagtttgttttacagaggaaaatagaatggggaggtttccccgaagtgtccttcttttcaagatgattgcttgcct

SEQ ID NO: 477479 - DNA, 712 bp, Homo sapiens
tacgtaagccagggcctccgctcccattagaccacagcgcagagagatcaatcaagatggtggccttgcctgtgcaggttctgccaggtcaagtgaagcgtcaagctggagaagatctaaatgctgacagaatgctggaacctgcagccatgtggccaggagacagattcgcctccagacttcacatgaatctttttgggcagtttaaccagtgtcacccagaaaccaatacccaaggcagtatcaaaaatagcaacacgctcagcaaacagcatctacagctgctcaggaaagaacagccttcattcaaatgcactgcagaaaggacagctggtcacattggtctttcagccttcctgctgcacatatttagtaacagagtcggtggcagtttctttgaaatgggaagctcaggtcttcgggattcagatcctggtcctgcccctccacctgctgttctctgtggcctccaccaagcccccctaaagccccttgatgttccttcccggcctccttctctagtagcttgtccattggcgatttgacatttaaaaatatcttcagcagtgtaagaagccctttgctagccttggtctctctgtcttcttcctttgtaaatctatttttggagatatagcctgaaaatgtggttgtcaaggtaaacatctctcggtagcaaagaaaatcttgaaggattttggaactgattagt

SEQ ID NO: 477480 - DNA, 864 bp, Homo sapiens
agcgccagtgttggcagtatttaaagtttctaaagcctccctggaggcttgggctggagggtcagcaagtgtatctagaccaccagcagtgtgcattgggctctgggtagtgccaagcatgtgcatgaatcatgggtgtttttttctacatcacagggggacgctgctctgctggactcactccattcccagtgtcctttgccttgttaccaatgggaggagaactggctttagcgaaggctggaactctccaactcactcactcagccatcgttccttatctgacaccccagaagtctgataccagaaatatgatcaagaaaggggtcgtgggaaaaacagtggaggtaacccagagatgctggcatgagctgtggcccatgggagaccccatgcccaatctaaagacattcacatttcaggaaaataaagaagtcaagttccaagagataacatacctattggctgccaattccagacctctggaccagatggtggaaccttcctgtggttgttctgcatacacggtccagggttttcagttgcgctaagcggcaggaatatggaaaagtattcctactccatctttccagatgccaacgttccccactccccaagtcatgttcttgtacctagtctagatttttcacattcttgtactggctctccttgaaactttaggaatatttaccatgtgtcttctgacaaaattatatcagaacagtattaaatggatttaataagtatccaggcatacctgaacttccaattgtgttttctaattaaacaagatgagatgcaggaatagtctgttctgtacacgatgctaggttttgtgataagtattacaagcatggatcatcc

SEQ ID NO: 477481 - DNA, 992 bp, Homo sapiens
atcccacggtgatgtttaatccacacagtgaaaacaaaggcttaaaacaagactcgtctgaaagtggctatgtgcaatacctgcaagatgactgatggagagatcaggtacaccccagacatcacaggaaccaaacaatgccccggaggaatgttgtggaaggtctacccaggaaaatctggcaaagctcccaaagcagctgggcagcaagtatacactgatggtcgacagcatgctggggctgagcacagtcccgggcctgtaatgtttgacaagattgaagtcgggggacagcagctctacagggagctgagagagaaagacagcgggagaatgagaataccgccaaaaccaatacaagcccacttcctaacttgggtgaacagcaccaggggagaactcaattactataaaacaatcatcctggttcttcagaatgtgctagactactggtttagacccagagaggagagcctacatggacttcctgctatatttgcaggttaagaactttagccagataacatttgctttttccctgaggaaatgagcttcaaaagcaataagaaatcttatgccttattaaaaggaatatttgacaatagctgggaggatattatgtttgtcttaatcatatttgtcaggcatcatgattaggcacttctaacatattttagaaacaagtacatataaaggattatgtaaacactttcaataataagataactcattattgggttataataaatacttttcatatatctcaacctgggaaacaaaatattaaatacaaaattttaacaacaatggcttatacctttgaataacatgtattatctcttaatagtaagactgtatatgagattttacaatcttagaattatttgaaaattgaacttcaacttgtcattaacattgaaaagtgccgcatttgcaaagtcattatggaagcacataagcataagcacatattaagaggaggggaaaatggt

SEQ ID NO: 477482 - DNA, 682 bp, Homo sapiens
ctaaaggtttgtgaaggcaccaatgagcactctgtgtctagctgaagcatggcaacccgttggggtccccttacatgctgtggaaggtttattcttttgctctttgcaatcaatcttgctgctgttcactctttgtgtctgcgctgcctttatgagctgtaacaccatgaaggtctgcagcttcactcctgaagtcatcagtgagaccaagaacctaccaattctggacacactatggtctccaatttcagtgaaagcaggacttagtgaacacctgcaaactcccgggtacacagtgtgtggcctgcaaaagccactgacacagacaaaagctaaagggccaagcagtggcaaatctcagaaagtgccagcagaagtccacttcccaagggctctgaccctgggcatttggctggcaaagctcaacgcggtgtttcatcaggggcaactagctcacatggaccccatgaaaatgcattctgactcccagaaattaagcacctattaggaatattacactgattaccctatagagaaaggaagactcagggtgggcttataaagtgtccatttttgtaagctttctggctaagaattaatgattactggctcctttaattttaacaataaaattggcgattgttggagagaggtcaaatttaagcatcacacaatcatttca

SEQ ID NO: 477483 - DNA, 632 bp, Homo sapiens
aaaccaagacgcccggtgcacggatgagtggacttctgcagcagtgccctcagaagtggcagctcgggctacagagaatatctggtgcaggcatccttggcagtcatctcgggcagcaaaagttcctgatggtgctttatgagattcgcatatacacaggcacaatgacaggtgcagaaacagagtctaatgtatttatcaacctcatcggtaccagaggtgattcaggaaaacgaagacttcatcagtccaaaaacaatgaaatcaagtttcagcgtggacagcatttactgaatgctttccaaggaataggcttcatggtaaagccagaactgcacacagatactcatttgatccccacagccagcctacagaaagaacccaaccaattgggttactgtgtgttcccagtgcacgtcctgtgggtccacttgcagtttgagcttcgagctggtgacagagtcctgcaggcagagagcagcagagcgcagggcagatatctcacatccatcggtcactttttctcatgaagcctcaaatacttgtcaacttggtgccacaggtgccttcttctaatccgttaatttggcacataagctaaaactcatttgccagccccggagaggtcagga

SEQ ID NO: 477484 - DNA, 569 bp, Homo sapiens
cttcagtgtccctttccctgatatgatcttaaaaccaggtgtatagcactcgtgtgactccccgccgccccctcagctgcaatgaagatctggaactattccatcctgagaaagccctccccgggcaagttggttgatagtattgatagtgttctatattcctacttattttttgtaaatatctatcaattattgagagaagatgttaaaatcgccaaatatgattgcattaatctcaaagatattggtgaaatctataaaatacgtattggacatgacaacactggaaagaatcccaggtggtatctggaagaagttagacttgaaaatatagccacatatgagctattttgtttacctgttgattcctggatagctgagaatgaaaatgatggcgatctatggaaggaaatacccatcatgggaccaaagaaagcacctttgccagaatggcacagaacacatgggtacgtgcccccagatactagttgattaattcagacacagcaagaaagatttgggactagctaatgaaactttatccattagcatttcccatttaaaggggg

SEQ ID NO: 477485 - DNA, 639 bp, Homo sapiens
accaatgtgtatcagttcagtgtcaatccccagaataaggtgagccatcatgacttcgaaggtgaccatgcaacatatgaaaagcaagaagatcctagattttgcagcaaacgtatggctgtctcggattcaggcagatggggatgttgtcttgagataccaggttgacgtctacactgggcagctgaagcatgcagagacggagtctgaggttttcctctgtctctttggggagaggggagactctggcctcagacagctgtacaaatctaacatgcaagtaaaatttcaaagaggacagataactttaggacgtttattctcgacaacaatctacgagaaagtaatgtgtgaaggagttcttttgattttaatcagtatagcactgactttaggtcctgaatctctctggaaatgtcagtgtatttttgatataacaaaccaattctatttaggagtgaagagtccaggctactcttttacaacaaacccaagaatgtgctctattttcatctacagaggaaggtgcaggggaaggatgtattgaaggagggagggaaggagggagggagggagggagggaaggagggaggaaggaaggaaggaaagaaaatttgtcccacatgtctcaaagcatat

SEQ ID NO: 477486 - DNA, 515 bp, Homo sapiens
caggtagccttcagacaagacagaattttggatgtatggtccactctttcgtttctgtcctgagggaggttctggactgtgggtggtttccttcctgttgcactgcactatgccagtggactgcagaaagctggaagtttacaaaaggaaatactcttcagttctataacaagctgactggagggtttgtccgtttgcatccagatggcacagttagtggtgaagccaccactgagctgcgggtgctttatcagcctaaccgctgtgcacttcttgagtcggcactggttcctggtcacacagttgtttttgatcgtcatggcaaaatagctgatgcatcatcagcaggctatgcaaatctttcaaaagaatttgtgatttttgtcaagtgtgctggttatctttttcttcccagtgagtaaacttcctctgtaagtttttagcagaatctttttgtcctacacttaatattcatgctttttcttcctatttgtgctatgggtgactcagctcta

SEQ ID NO: 477487 - DNA, 638 bp, Homo sapiens
tggtaggttcatgggaaaacatgacttgtacatcacaggaattcattatattgagagtgaaagtggtagtaactggaaagtttttataatcaccagtgacttgccagatgcagggaccagctcacagatttatattattctgtatggacaacatagaagttcagcccccatatatctttatggaacagatggggctcgatttcaggttggccatgaagacatatttactatacagctgcataatatgaattctggaaaacagttttatgtacctgttcaacgatggttggcacgagatcaagaggatggggaaatctgtcgagaatttcctcttttaagtaaaggacaacctgtccttccaggtaggaaagattcaactccagtgacaatatatgaagtgaatgtggcaacgggtgagctatggaatgctggaacagtagcaaacgtctacatttctatccatggggaaaagggagatacaggatccagacaactatttagatcgaagagctccttcaattttttaagaggacaagtggtttagaggccagtccctcaggtagaagctgtaaaatatgggacattcgatgtatggacaaactccttccagggagaagatgaagattggctttattgcc

SEQ ID NO: 477488 - DNA, 1231 bp, Homo sapiens
agcagcgacgtggcgttcaccccgctgcagaactcggaccactcgggctcggtgcagggattggctccaggcttgccgtcggggtcgggagccgaggacgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcctgggcagggagcagcggcgctactcactgtgggactgcctctggatcctggccgccgtggccgtgtacttcgcggacgtgggcacagacgtctggctcgccgtggactactacctgcgcggccagcgctggtggttcgggctcacgctcttcttcgtggtgctcggctctctgtcggtgcaagtgttcagcttccgctggtttgtgcacgatttcagcaccgaggacagcgccacggccgctgctgcctccagctgcccgcagcctggagccgattgcaagacggtggtcggcggtgggtctgcagccggggaaggcgaggctcgtccttccacgccgcaaaggcaagcatctaacgccagcaagagcaacatcgccgcggccaacagcggcagcaacagcagcggggctacccgggccagtggcaagcacaggtctgcgtcctgctccttctgcatctggctcctgcagtcactcatccacatcttgcagctcgggcaaatctggagaactcaatactgatatgggaggggtgaaagcaacatggaaaatggctgatggtactgaggatgatgaggtagaagagaagcccgaaaacttgagagctccatatatcttccctggagcatcacaaatccatatgccacccctgagtgctggctttggcatcaagatctctgagttagctgacagggctgctgagctggccttgactttgcttcagccaagaatgggcattcatgtgtctctggatgaaaacacagggatgcacagtgacttaatcaagtctgactttgaggcaagccttcaaagtcagtatacaattacttatcctgaaagcacccacctcttggacaagaagggaaaagagctgagcttgctggtgacggttaatctattaactgcgggaaaaccaaaccacaagcaacgaccagatgcggcatcaacttttagttgaccggcacaaccaaga

SEQ ID NO: 477489 - DNA, 539 bp, Homo sapiens
agtgcagccatggagacggttcaggaaaggtgggggtattctcacacgcagaaacttacggccatggcagaagaagaagcaaatacatccttcttcacaagcttaattcagcttaagcgccacagggcccagcgggactgtgcccttggcaccatcctacccaaccttgataaaatgggtggctgtccctccacttctctgtgctccgggagggatttccacaggccttatctaggccctggcatcagcagctcagacctgactcaccccacatttgccagtggatactggaggcccacaataactgacattcaaggcctgcagatatccaagggacttccttttgcatgtactgcacactcttcagctcaaagtaccactaagccacagagcaacactgacggaccttctagaggccggcgcccaaaagtgaaaggtcactgcttaccagctgcatgcagagatgcatggggaccactctgcttgctgcccaccaatgcacatagatcccggcctattttctgggagagtgtctaaag

SEQ ID NO: 477490 - DNA, 585 bp, Homo sapiens
aaacaaagatagcaggggagggtggccaggagctgaatggagaatgagttccctaggagcgctgtttcacttgcaggctgaggagcagactgagtttctgcagtcagtttggctccactgttctttggctacgctgcctgtcttggttgaggctgagctgggctcggtgccggtgaagtggtgtctctgcctgcatgggtctctgcctggtgccaagagcttctactccacgtgcctacacttctctgctgctcctctgagtctctgtaagagggaggtgtcttctgtaagagggaggtgtcttctgtttgcatccccttcactctgcaaattaccaggaatgcttgttcccttggtacgagcctggcctggagtagcccagctaatttttgcattttttcatagagacggggtttcacccaggttggagtgcagtgatgtgatcacagttcgctgcaacctctaactccagggctccgtggttcccatcatggctgccttcttctccagctcccctggtccatgagacagacctgcttgtgcccagaccgaaaatgcagacagtatccacgggtacagatgcat

SEQ ID NO: 477491 - DNA, 566 bp, Homo sapiens
agctccctttgagatcaggggaagcctttgttgtgactggatcatggttcagcttcttcacgtgcctgagctggcttccttcattttcccacgtgttgaccctaagagcttctccatggacaacaacctccatctcggaatcttcttcccagaaactacctcagatagttctgtccctctaactggtaacagaagtatactaccgaagtggcaggatgaattagggctcagagaggagaagaaagggagagaaaagagagagtccaaggacgttgcgaataaaattccaaatgccctgctcccagagctctggaaggaaagctgttcttgccctctggctaatgcaggatttaagctgatctgggtcagtgctgagtctgcttctgggagcatggagaagctgctgctgggagtgccaagaggactggagtcttagcttccctcactgctaggcatttggtaagagctagaaacagaaaggaagtcccttcggctctcttcttacctaggagttggtgggaaatgatgacaatccagctggtgagggggtctggggaatgtggttc

SEQ ID NO: 477492 - DNA, 862 bp, Homo sapiens
tcagaggaacattggggcagcagccagatttcaaggagagtttcagggtggaggaatatgaaaatgatgttctacaaaaaggaaattcaaacgattttcttattcaagttcaaaataggtcgtaaagcagtggagacaacttgcaacatcaacaacgcatttggtccaggaactgctaacgaacatacagtgcagtggtggttcaagaagttttgcaaaggagatgagagtcgtgaagatgaggagcatagtggaaggccatcagaagttgacaacaaccaattgagagtaatcattgaagctgatcctcttacaagtacacaagaagttgccgaagaactcaacgtcaaccattctgcagtcatgcggcacttgaagcaaatcgaaaaggtgaaaaagctcgataagtgggtgccacaagagctgagtgaaaataaaaaaagtcatctttctgaagtgtcatcttctcgtgttgcaggcaacaacaatgaaccatttctcaattggtttgtgatgggtgacgaaaagtggattttgtacaacaatcagcaacgactaagtcagtggctggacccagaagaagctccaaagcacttctcaaagccagacttgcaccaaaaaaggtcatggtcactgtttggtgaagcattagaaccagaacgacttccttctgaatggaggaaggttataaagaccctgctgatgaaacaggatgcagtaaagaatctggcccaaacccaccaaaaccaaaatggcaaggaaaacgacctctggtcgtcctctctgctcattatacacttactataacgcattagcatgttaaaagacacttccaccagctccatgacagttgtaaactgct

SEQ ID NO: 477493 - DNA, 4091 bp, Homo sapiens
ggggacaaacattcagaagaccgtagcagtgttctggaatcctatgtgagggacaaacattcaaacaacagcgggagtgttctggaatcctatgttaggaacgtatattcaaaccgtcgttgcagtgttctggaattctaagtgagggacaaacactcagaacccagctgcagtcttctggaaccctgtttgagagaccaacattcagacaatcgtagaagtgttctggaatcctatgtgagggacagtcattcaaacactcgtagcagtgttctggaatcctatgtgaagtacaaatactcagaacccagcaacagtgttctggaaccctatgtgagatacaaacattccgaccacagctgtattcttctggaatcctatgtgagtgacaaatattcagagccccgtagcagtgttctggaatcctatgtgagggacaaacattcagaccccatcagtagtgtactggaataacatgagagggacaatcattcagaccctcagagcagtgttctggaattctgtgtgatggacatacattaggaacctcgtagcagtgttctggaatcctgtctgagggaaaaacattcagaccacagcaggagtgttatggaatcccctgtgaggaggaaacattcagaccctcgtagcaatgttctggaatcctacgtgatggacaaacatttagaccataccagcagtgttctggaatcctatgtgaggtacaaacactcagaacccagcagcagtgttctggaaccctatgtgagggacaaacattcagaccactgcaggattgttctggaatcctatgttagggacaaacactcagaacacagcaggagtgttttggaattctatgtgagagacaaattttgagaccctcgtagcagtgttccagaatcatatgtgagggagaaacattcagacaatcgtatcagtgttccagaatcatatgtgagggacattcagaccctcggagcattgttctggaatgctatgttagggacaaacatttagacaatcgtagcaatgttctggaataatatgtgagggacaaacattcagacagtctcagcagtgttctggaatcctatgcgagggacaaacattcagacctcagcagcagtgttctggaatcctatgtgagggacaaacattaaaacaacagcgaaagtgttctggaatcctatgttatgaacaaacattcagaccctcgtcgcagtgttctggaattctatgtgagggagaaatactcagaacccagcagcagggttctggaatcatgtgaaggacatacatatagactccagcagcattgttctggaatcctatgtgagggacaaacattcacaccccagcaacagcgttctggaatcctatatgagggacaatcattcagatgcttgtagcagtgttctggaattctgtgtgagggacaaactttcagaccctcgtagcagtgttctggaatcctgtgtgagggacaaactttcagatgctcgtagcagtgttctggaattctgtgtgaggaacaaaccttcagaccctcttagcagtgttctggaatcatatgtgtcggacaaacatttagacctcagcagcactgttctagaatcctatgtgaggggcaatcattcagacactcgcagcggtgttcaggaatccgatgtgagggacaaacactcagaacccagcagcagtgttctggaaccctatttgagggacaaacagtcagatcacagctgtattgttctgaaatcctatgtgaggaacaaacattcagacattcgtaacggtgttcttgaatcctacgtgagggacaaacattcagacgccagcagcattgttttggaatcctatgtaagggacaagcattcaaacaacagcgggagtgttttggaatcctatgtaagggacaagcattcaaacaacagcgggagtgttttggaatcctatgtgagaaacaaacatttacaacacagcagcagtgtcctggagtcctatgtgaggggcaaatattcagaacctcgtagcagttttctggaatcctaggagagggacaaacactcacaacccaacaggagtgttctgggaccctgtgtgagggaaaagcattcagacaacaacaagagtgttctggaatcatatgtgagggagaaacactcataccacatcaggagtgttctagaatcccctgtgagggacaaacattcagaccctgcagtgttctggaatcctatgtgggggacaaacagtcagaccacaacaggagtgtactagaatcccctgtgagggacaaacattcagacctttgaagcagtgttctggaatactagtgagggacaaagattcagactagagcagaattcttctggaatcctatgtgaggaacggatatttagaccacatcaggagtgttctggaatgctatttgagggacaaacattcagtccctcttagcagtgttctggaatcctttgtgagggctaaccactcagaacccagcagcatgttctgtaatcctatgagagggacaaacattcataccacaggaggaatgttctggaatcctatgtgagagacagacattcagaccctggtagcagtgttctggaatcctatgtgaaggccaaacactcagaaaccagcagcagtgttgtggaatcctatgcgagcgacaaacattcagatgccagaagcattgttctggaatcctatatgaggggcaaacattcagacctaagcaggagtattctttaatcctatgtgatggataaacattcggacccctgcagcagtgttctggatacctatgtgtgggagaaacagtcagaagccagcagaacggttctggaatcctctgtgatggacaaacatttagagcctagaagcatttttaagcaatcctatgtgagggagaaaacatccagaccccagcagaagtgttctggaatcctttttgaaggaacaacatttagtccccagccgcagtgttctggaatcctatgtgaaggacaaacattcagaccctcctagcagtgttgtggaatcctatgtgagggaaaaacatacagatcacagcaggagggttattgagtcttatgtgagggacagccagaacccagcaggggtgttctggaatcctatgtgagggacaaatatacagaccacagcagaagttttctggaatcctttgtgcagaacaaacattcagaccacagcaaaatttttccagaatcctatgtgagggacaaagcgtcagaacctcttagcagtgttcttgaatcctatgtgagggacaaactttcagactcctgtggcagtgttttagaattcgatgtgaaggacaaacaatcaaaacccagaggcagtgttcttggatcttatgtgaaggacaaacattcagaccctcttagcagtgttctgaaatcctatgtgagggaaaagtattcagactctcgtagcagtgttctggaatccgacgtgagggagaaacattcagaccacagaaggaatgttctggaatcctatgtgagtaacgttcagaccacagcacgattgttctggaatcccatgtgtgtacaaacatgcagacgccagcagcagtgtaccgaaagcctattttagggacaacattcaaacaacagcgggattgttctggaatctatgtgagggacaaacattcagaaaacagcaggagtgttttggaatccaacttggaggacaaatattcagaccctcgtagcagtgttctggaatcctatgtgaggagcaaacattcacataatcgtagcagtgttctggaatcctatgtgagggacaaacattcagaacttcataacagtgttcttaaatccaatgtgagggacaaacattcagactgtcgtagcggtgttctggaatcctatgtgagagacaaaccctcagaacacagcaagagtgttttggaatcctatgtgagagacaaatattcagatcctcatagcagtgttctggaatcctatgttagggacaaacattcagactatcgtagcagtgttctggaatcctatgtgagggacaaatattaagactatcatagcagtgtt

SEQ ID NO: 477494 - DNA, 754 bp, Homo sapiens
ttagaatataatcaagaaataactggagtgttgccattcagggatgtggccatagaattctccccagaagagtgggagtgcctggactctgctcagcagcatttgcacagggatgcgatgttagagaactatggaaacctggtgtctctgggtcttgttatttccaagccagacttgattacccttctggagcaaagagccctggaatgtgaagagacagaagacagtagtcaaatacccagatatgtttttcttgcaggaccgatgctgctttcaagtgcatacatggtggttcttttgctcagccatcagaagaaatcctggtaccttcacagcacctgcctctccccaagaccttccccagagcagagtgccactcagaccatcctgctgctagtgagtttctttgtggtcgtgtactcggtcgatttcatcatctcattctcctcagcctcactatgggcatatgaccctgttgtcctgggtgtccagaggcttgtgtgcaccatccggcagggtgtccgctgtgctccggatccaacgagactcccattgccactcccgatcgtgctgaaggctgccattgttcctgcagggctaagtgcctgggtccagggaggggctacgggcaccatccttgaagagggtcctggaactccactgagccctcctgcctacgggggccttagagggtgccctgtcctgtccgtggcccctgggtcctatctcacccgctagctttttttttttttaa

SEQ ID NO: 477495 - DNA, 529 bp, Homo sapiens
atacacctaatgtaaatgacaaggattttcccttgactaccgtcccgtggtcccggcacaatggggagagatgcggcgatgccggtgcagagctgcccagcgagagctccaggccatggcacagtcaccgcgcagggaggagacaggacgcccggggtcctggctgtcagctcagccgccatcttatggctgaaggggactgagggccgagctgtaccaaggacaactctggccaaggattttggagccgacagcggggaggccggagtcccgccacagccacttcagactggcttcccagggggtcctggcatcttagctgtggatctcccaatacctacaggtcacagggacacagaagctgggcctctaggagcagaagacacagaacagagaagaaaagacctggagctacgactgcagccagagacaaaggccgcgccaaatctcgaaagccgtcctgtccactccagctgcgtgcctgattggatggatcccagcccagagtccctgattggataacgtttaa

SEQ ID NO: 477496 - DNA, 700 bp, Homo sapiens
gtttattcatccatccatcaatccatccatctaaccacaggaactggcaggtattcccgatctgccatgtattctagaaaggccatgtataagaggaagtactcagccgctaaatcaaagattgaaaagaaaaaggagaaggttcttgcaactgttacaaaaccagttggtggtgacaagaatggtggtacccaggtggttaaacttcacaaaatgcctagatactatcctaccgaagatgtacctcgaaagctgttgagccacagcaaaaaacccttcagtcagcatgtgagaaaactgcaagccagcattacccctgggaccattctgatcatcctcactggatgccacaggggcaagagggtggttttcctgaagcagctggctagaacacaccagaaatttgtcattgccacctcaaccaaaatcgatatcagcaatgtaaaaatcccaaaacatcttactgatgcttacttcaagaagcagcagctgcggaagcccagacaccaggaaggcaacatcttcgacacagaaaaagagaaatatgagattacagagcagcgcaagattgatcagaaagctgtggactcacaaattttaccaaaagtcaaagctatttctcagctccagggctacctgcgatctgtgtttgccctgacgaatggaatttatcctcacaaattggtgttctaaatgtctt

SEQ ID NO: 477497 - DNA, 685 bp, Homo sapiens
gcagaccgcaccatgaccctctgtcccttccctcctggcccacaggcagcttttcaacaatgtgtctgtgcatcaacacatgtgggtgatggaggaactggtgtgcagggacaagaaccaccccgccgtggtgatgtggtctgtggccaacaagcctgcatcctacctggaacctgccggctactacttcagggtccacctctgatgttcactgaagagtaccagaagagtctgccagagcagtaccatctgggtctggatcaaaaacgcagaaaatacgtggttggagagcttatcgggaattctgccgatttcacgactatgcagtgtaagtggcagtttggctcatgggataacgtacctgtcctcattttttcaggttgccttgccaattctggccattttgattataagaatattggaaacaaaggagggaagctggcttactccatcgcattaggatttctggacagtgggtaagatgaatcttgcagggctgttaccatttgtacaactgttccttgaaccccatggaccaatgaatttcttcctttgcctacactagttcacaatgagtttctctcatttgcaatcgagttcccctaagtaggtcctgagtctgcagggtggacatctgtctctccttgagtgttgcgggaagtcagggaccctgaatggagggacc

SEQ ID NO: 477498 - DNA, 681 bp, Homo sapiens
cgacacgctagagcatgaggggccgacagcagcagtctggtccagggacagggtggccttggcagagtggaggacctggatctgaggagacctgtgagctgaggtcaagggactcagggcaagggcccagcgaaccactgtcctccgaccctaggtatcccaagggttactttgtccagaacacagactttgacttcttcaactatgcgggactgcagcggtctgtgcttctgtacacgacacctaccacctacatcgatgacatcaccatcaccaccggcgtggagcatgacagtgctgggattgcatctgtttttaaccctaatgagggaatagttcatgagtgcaggatatctttggatgagattaacatgcggatgagaatttctattgagaggatgtttggttatcgaattcgaggagttgaagttcttctggttttaagttggctgttggaagtatataagaatcgaaacttaattcttcataatctatatactcgtagcttcaataccattgatgttaagaggaaggtcttggtaatgaaatatgtagtatagagtttggtgaatatatagtgtgtaatgttcctagaaaaaatgtagtagttagggcatttattacgataatattcatatattctgttataaagaagagggcaaatggacctgcagtatattc

SEQ ID NO: 477499 - DNA, 831 bp, Homo sapiens
gtcatctgttatggttcccacaaccacggccgttttgttttcctggccaggaagcttcattttcgggatcatccgggaaagggacagaggtggctggttgaagaacgcaattctatattcggaatacagaagaacgcaattctatattcggaatacagaagaacgcaattctatattcggaatacagaagaacgcaattctatattcggaatacagaagaacgcaattctatattcggaatacagaagaacgcaattctatattcggaatacagaagaacgcaattctatattcggaatacagaagaacgcaattctatattcggaatacagaagaacgcaattctatattcggaatacagaagaacgcaattctatattcggaatacagaagaacgcaattctatattcggaatacagaagaacgcaattctatattcggaatacagaagaacgcaattctatattcggaatacagaagaacgcaattctatattcggaatacagaagaacgcaattctatattcggaatatagaatatattcctatattctatattcggaatacagaattatattcctatattctgtattccgaatacagatttatattcctatattctgtattccgaatacagaattatattcctatagtctgtattccgaatacagaattatattcctatagtctgtattccgaatacagaattatattcctatagtctgtattccgaatacagaattatattcctatagtctgtattcggaatacagaactatattcctatattctgtattcggaatacagaactatattcctatattctgtatac

SEQ ID NO: 477500 - DNA, 1056 bp, Homo sapiens
attgctagcacagcagactgagatggaactgcaaggcggcagcgagggtgggggaggggcgcctgccattgctgaggcttgagctggtaaacaaagcagctgggaagctcgaactgggtggagcccaccgcagctcaaggaggcctgcctgccttagtagactccacctctgggggcagggcatacccgaacaaaagacgcagaaacctctgcagacttaaatgtccctatgtgacagctttgaagagaagtcaggagcccagctggcttcacccagtggatcccgcactggggccacaggtggagctgcctgccagtcccgcgccatgcacccacactcctcagcccttgggtggtcgatgggactgggcaccgtggagcagggggcggtgcttgtccgggaggctcaggccacaccggagcccacggaagcggggaggctcaggcatggctggctgcagttcccaagccctgccccatggggaggcagctaagggccggcaagaaattgagcgcagcgccggtgggctggcactgctgggggacccagtacaccctccacagctgctggcctgggtgctaagctcctcattgccctggccagcagggccagtgggccgttccaagtgtggtgcccgccaagcccacgcccacccggaactccagctggcccacaagcaggctcaacttagaacagaagtacttaaacgggacactacaactacacttaaagcttccagtaagtttttcaatggtcccatctttgacataagctacaccaagtgtcaccaggcacctgaggagagcactagaagaaagtcagaaatccaagcaaatacaaacaaagaaggggacaaagaggaggaatgttctccaaggaagactggagaaagaggctcctcccaggagctcagggaaccagcttcttgggaaagcaggaccaaagtgcaggcccgtgttggtgcctgccagcctggcaggactttggcacaggaacacaggtccagagccttgcctagggtcactggtcctcctttctatagagctccataaggt

SEQ ID NO: 477501 - DNA, 1039 bp, Homo sapiens
gaaaatcaagtactttcgatctttttctcccttctttttttcctcctttcttcgtgagcaagatgcccaactctgtggatgttgtcagttacttttcctattcaaccctgaggcttgctcaatggacgtgtggcaagggcagaagtccctcagctgcaggtctgttggagtttgctggaggtccactccagaccctgtttgcctgggtatcaccagcggaggctgcagaacagcaaatattgcagaacagcaaatattgctgcctgatccttcctctggaagcttcgtttcagagggatacctgcctgtatgaggtgtcagtcagcccctactgggaggggtctcccaactgctgtgctagcagtgagcaaggctctgccagcataggaccctccgactcagacatgggatataatctcctggtgtgccatttgcttaaaccattggaaaagcagtatttaggtgggaatgtcccatttttccagaactgctctggttcttgggaagtggcctatttctatgaaataggcactgcatctaagaatggtgaagctgagtttagagaaactaacttatcaacatccctaactcataatgaagtaagcagagacgagtgtccaaggagttcaactgcaatgcccatactcttaaccaattcccagtacctgtaccacaggattacagtccctcaacaagtcatggcattgaaggaagataatccagagagggctacccttgcagctttgggggccaaaaatgcaattccaggtgattttaaccatctgcaagttcttgagactgccactaagaggagcacaaggtgcaagctttcagtaggtctaccattctggggtctggaggacagtggccctcttctcacagctccactaagaagtgccccaatagggactctgtgtgggggctctgaccccacctttcccttctgcattgccctagcagaggttctccatgagggccccgcctctgcagcaaacttctgcctgcgaatctaggcatttccatacatcttctgaaatct

SEQ ID NO: 477502 - DNA, 486 bp, Homo sapiens
ttattccctgaaaatcactggaatgaagcactgtgtagtattgactgtatactctgggatggtagaattcaatggtatcccagagtctgtgaggccagttgcagcagcagcaagaaacacagaatggcagagtacagccatcatttggaccctgcagcaaggttctggggcatgtgattgctcttggcagccaaaggaacattttccggcatatagggccctgcttcaacacaggcaccttggagacataactgctctgacagctaaggtaatatttcttaggagagatggtaccacttcagctgtaggcacagggaacaaggggataagtggttggagtggttctacttcaatttggttccacaaggaaggatataacatctgcttgcagcttggctttgggatgttagcccaccagaccggtgtggcccactggcaacttagtctcattaatgaagggcagcaatgactgcttgcccccagtgt

SEQ ID NO: 477503 - DNA, 1174 bp, Homo sapiens
cctggaaaacagtcctttgttatggagaatgaatgaccaagacatttccacaatattactgttctcctgcccctgcccaagccacagagtgatatttcttggatttttaccacgagaatgtggttggattcttggaagcaaaacccaggaaattgttggggcactcttatatctacatgccctcttaggaaattctcaatctcagtccagcaattcagcttcaaacaatttattaaaattagcatttaagtgtacttactactctacggttccagtagtgtttgttctcagtaaacggttctcagctgtgacattcaacatttgcctgtggaaactcctttctctgccacatctaacaagagtcattgattttgcatttgttcagtattttcttgtcataaggacacaggtaacaacttccaggatttttacatgtcagtgctgaaagtggaaacctccatttagaaaaattgttgataataatatgttaaggaaaaaatgatatgaaagaagaaacctttataagttacttctgtctaattctcatcttagatctgtttaagtacctgaatctatgtgtttaatagtgtggttaagttgtagttttatgctgatttaataaaccataaaagcaaaggaatattggattcaaataaatgtgtaattgaaattctgcaattaataatttatgttccccttgtgtggttagccaaaatactggatcctggattagtctggctgccagttatatctcaaagaatgtttgaaaaaaaaatatggctaacactttttaaaagccccttttattttctcatttgtaatattctacttgtttattctgaatgttcacattcatagtcagatgtgagcagtgtttccattttggcctattctagtttttgagtatttttgtttggagatctttacttttctatttcataaagatttttatttattgtttcaagatttaattacaaatatttcctttttttacaagtgttgtcttcatatttgaagatgaaaaactgaaagtacctctgattggtttcttcctgcaaccaatcagggctgttcatgggccaagtctttatttgcatagaagtataactttgtaactttactttagcctctgattggtcactttctgcaaccaatcagactgatcacaagacag

SEQ ID NO: 477504 - DNA, 886 bp, Homo sapiens
tgtacatatacaccgtggaatactatgcagccctaaaaaagaatgagcaagatcttacattgccttgcaatttctctctgctttactgtcccttgtatgagtggattgtttttacatttggcactctttcatttcctgccaaaccataattccattacagtcttcgttggtttctccctttacctgagcatcttcactatcttagtaagggtgctcttctatttgatatataacaagccagacacacttcttcagaaatggaagctgccaccagatataaatttcttatttctccctgaaattaatttaaccaaagcttttttgtatccactcttcctttttaggcaatacaacatttttatttatatttttgcctggtatattcttgtgatcagcatagatgtaaagattttcttcattcttctacatcctatctacatgtgaagttcctaacatctaattttaaagcattttacctaggatgatattgagaaagttagttataaaatgacagttttaggacatgttacccccaaataaggcaccttgaaagtcattgtctgaccttctcccatctttctcttatatttacattacttcaagttcacagattcttctacttgatttgctgttaacgttctgtattaacttttttttccattcattatgtttttaggctctaaaattttctacttgatttttaataatgtgaaattatttaatgataaagatagtcatagaatcaaataattaaataattcaaaatattaatcatttaattatattataattttataatgtaaaaaaaataattttaactgctaaatttctcatttcaaatcacttatcctttttctgatttcaataaattgtttctctgtatttt

SEQ ID NO: 477505 - DNA, 2964 bp, Homo sapiens
cggggcagattccccaatataatgccgttctttgccttcattgatctttgttgtgcctctttcaggagctgtcataagttgtggcagggcactggcagggacaggggtgccagcctctttgtgggtgtcactgcagtcatggtggcagcatggtgtggggacacaggagggcccacaagcaactttatgtgtacattcgcaccggcggtgttgtctgcatgggagagaggtcctggtgggcatggggctagcaccttctgtgctcacattcacaggggcagcagtggccatgcaaggagttacggtggttgcccacaggaggcagcacagctggacatccgaacctgcattgcaagcaggtgcagacagactggggcccttggagaggccagaagacaaacgtgctctcaggttggaccagccccatctcatgggtgagattgccctacactgttcagattttttattattgctttaaatagaaaaaaagtactgtacatgtattcatctatatttaccacttcttgtgctctttattaatgtgtattaatccaaattacgaatgggtatattccttgtacatttaaattcatatggtattgctatgatacattttaaagttaactattctatgtatttttccaagttctttgattttcttttgccatttcagtctattattaacctcattccatgaattttattactaatatactacctttcagttctataattttctatctattctttttgcataattttcattactttgcagaaattctctaccttttcactcatgaataatttatttttgtttattttaccatattttatataattattgaaatatgcatatagtatacacttaagtcagtcttctctcatctggttcatcttaggatcaaggtctatttcctattttaaattttcttaattacaaatcatagttttatgcttcttcataagtctattaatttttgatggaacgtttgacattttggataatacattgtagaggcactgtgttttcttattttcttgtaaatcattttaattctgagtatagcaggcagtttacatactggattatcagtttgaacttgtgtaattttgtttctttacctgttttccaagctcctttacctttattggattcaagtccttctgaattttgtcagagtttagttttaggtcttgttaaagcaagtgtggcctatatgatttctgcattctcagctcagtgggataattatgttctgcttggattccatttctctgtgtcacaatctacaaattgtctccagtcatggaattttgattgtggggatcacctcattatcattagtgtctattctttcagggatcacagtctcacactgcctattgtccatttttggaaaactaattttatcacacattttgtgcaatattatgtttgtttatgttggatacactagtttttttcttcctagctaaagcagaatttagttcatcttttataactaatatttattactcaataaatcaattattactattttcagcaattatgacttatttatgtcaacattatcattgacataaacacctttgtaaaattaggcagaaattattatattaataatcactattattatcacttttatgccacagcatatcaggaatcacagtaaaacagaaaatatttttcagaatcctggtaaagtctgtgtttattctaaggactgatatctactcctttgacctacttcttaaaatgatcccaaaccttagaacagagagagtaagttaggttaaatggcaattaattggtggtgtcttctagagtgctgtgttgagggggtcactgaggaaacatccagtattatgagaagagttcataaatcattagtaatgtgggcccaagggattatgtcatacactgcatatttttataattattgcattggtcatttacataaattatggaatcaaaattctcaatcatgcaaaaaatattttagatctatttttagcaggatactgtataccactttattactggatatctcaaaccaattgtagggtacataattctgcccagaattataaacatcaacaataaaagactgaaagaatgatcactcttaggaataaaaaggcatatcaagcaacattaaatataaagttataccagggctttttggttctgactaaagacttgtcactgtgcaacaaagcctatgtacattgtcagaatctttttttttcatcttttgagtgaatcctggtaaagtgaatttatgttgccacttatcaactggttgatatatagactattgggaatatgttcaactcccaggagcttgatgaaatgactcaaggagtagaaaattctaaatagtttcacaagttgcctatcatacttgtttgaccattggagccagtttaccaataagtctagcaatgtacaataagaatatcctgtgtttgtacagctctatgtcatttaaaatgcattgttacatactaacatattttacttcatattgaccctgaaaatatctttgttctccttgtttaatcataatagtactttatatataatgaatattaatttaacttcatatttattgaaattttttccctctattccttatttaaattcattaaatgctatttttttgccatatggaagctaaatttcatatagtcaaatctattaattacttcagttaagtttctccccttcctattacacttagcaaatactctttccaaacttctgttagcattttccaatatttattaagctctttaaaaatattccagttataaaatatttacattcttaacgttagcaccagaaaataacaaataccattttcttctacctaagagaaataatagcatatgtaaggttaaaactctgtatttctcttaaaccacactggcttaattttgatataattatatcatagttac

SEQ ID NO: 477506 - DNA, 870 bp, Homo sapiens
ccttgtgaagaagccatttgcttctccttcatctttcgtcgtgattgtatgttcctggggcccccccagccaagcagaactaaaattgaagaggaaataattcttccaaatgcattctacaaggccatcattaccctgatgccaaaaccagacaaggacaaaacaaaaatggaaaactatgggccaatgtccttaatgaacacagatgcaaatatttgcaacaacatgcgaggcagtaccaaacgaaaatgtgggttggagccccccacacacagattctccactggggaactgcctagtggagctatgagaagagagccaccatccttcagaatgcagaatggtagctcttccaacaccttgtaccatgtgcgtgggaaagccacagttactcaatgccagcctgtgaaagcagccagaagggtggctgtaccctggaaagccacaggggtgaagctgcccaagaccatgggaacccattacttgcatcagcatgagctggatgcgagacatagagtcaaaggagatcattttggagctttaagatttgactgccctactggatttcagatttgcacggggcctgtagccccttcattttggccatttttctcatttggaatgagtgtatttatgcagtatctgtaccccccttgtatctaggaagtaactaacttgcttttgatttaacaggctcataggcagaaggacttgccttgtctcagatgagaatttggactgtgaacttttgagttaatgctgaaatgagttaagacattgggggactgttgggaaggcatgactggttttgaaatgtgaggacgtgggatttgggaggggccaaaagtggaatgatatggtttggctctt

SEQ ID NO: 477507 - DNA, 502 bp, Homo sapiens
cctcctcctctgtctgctggtgggatgagcatatctttcaggataataatctataggagtctgctcatctataaaatcagaacaattagagtttctaccccacggggttgttgtgagtgtgtagaatgcttcgattactgtccagcatatgaaaagcaatcgtcacagtcatcattatgtcctgggtggatgacaatgactttctggtccagccttcacaacattgccagaatggtcttcctggaagtctgctcctgtcctctctcacattcctgctccctaacacaggatctgcctctccccctaggaggaagtcaccaggtgataaactactttcactcagaaggcaggaatgagcaggaagcctccaggtcacaacaggaaactgagctgctttttcaagatgttcttcaatttttttggggggggtggttattaacctaggtgaggagagttgagttcatttcattcctcagttcaaggcacatgcttgtgattagtc

SEQ ID NO: 477508 - DNA, 654 bp, Homo sapiens
aggccttaacgggcttgggaggggaagagagaaccatccccacatgatttcgccacctcctggccttgcatatttctttagccaagattgcacggcccatggctataatcattcttttgaaaatgtgttaacttcaactcctctgtctcctcttcctccaagcacttggctggccaacctgtgctcctgggaggctgtctcctctgcccagcccacctgtggggtggagggctgcagaggaaagtgccctgtgaggttgctgcctgccacctcagtgaccctgggctgcagtccaccctcttctcccttcccatttgaaatccccctcccaagaggtcatcgctgtgaagtctggtgggcattcatcccttttcctcgcagcacgctcagactgcacgggcagtctgcagttaactgtccatcaccagtacccactctgcgggctcccagttttttcctgaagggcttggagaaagtcactccccctaaccagttaactctactggctttacatttttaaacaaagtttctcttccttagccaattgcaaaccagaagatgtttaaatctacctatgacatgagaaggctaagcattctgtatgctgagatcagagagaaatttctcacgtacatgtaatgccttcaaaaggat

SEQ ID NO: 477509 - DNA, 874 bp, Homo sapiens
aggcctgaaaaactggagggactgcttatatcccagcacaggctatggtcattccttatgatgtactctttggagagacgtacaatttgttggctaatgggtcaacacaaaaaatggcccagccttaccaccttcaaactcttatggttcatcttcctatgcccctggctcttgcccttgatgttcctgccaactggattatcatcatcagccccctaacccacggtactatttttggcttctgggtctcagtatctgctgctagcttcgctggtgctagctctacttgtttgtcaggtctaatctcagacttagctgatgagaggctggagaggagaggcctggggtgctgccatcaacagaaatctctctcggtcccaaccatgaagatgtgggaggttccggaagagttaatgatgcttgagctgctggctaactatgctgaaattctcttgacttctcctcatggcaacaagatagctgccaccattgtaaacattacaccttcaatctgacaacaccagcaaaaggcagagtcttttccttagacacaaaccaagctcattgaattgcatcagacaaaaaccatatattttaacctgaataataggaacagttatggctataatcttgtcctataattattattattttttctgatggctaagcatccatatcccaaggagggtttgtcaatgcaaactccttttcatatacaaaatcactctgaagaggtcttttgtttctaaatgttcaccaattaagtgggtggatatttaaaagctgtctaatttgtactgggaaggttggcatgggaagctcattttatgagccagcattaccttaatattgaaaccagacaaaataattacac

SEQ ID NO: 477510 - DNA, 894 bp, Homo sapiens
ctgaccccctgaccttcctcctggatggggcggctggccgggcagggagctgacccccccatctccctcccggacggggcggctggcctggcgggggctgactcccacctccctcccagacggggtggctgccgggcagaggggctcctcacttctcagacggggcaactgccgggcggagggtctcctcccttctcagacagggcggctgggcagagacgctcctcacctcccagacggggtcgcggccgggcagaggcgctcctcacatcccagacagggcagtggggcaaaggctctccccacatctcagaagatgcgcggccgggcagagacgctcctcacttcctagatgtgatggcagccgggaagaggcgctcctcacttcctagatgggatggcggccgggcagagacgctcctcactttccagactgggcagccaggcagagaggctcctcatatcccagacgatgggcggccaggcagagacgctcctcacttcccagacgggtctcttccttcctcaaatcatattcaagaatgctggcaaaatgaccattttaacatgcaaatctgatcatgtcattactctgagtaaaatatttcagtagatcccaaccgtctatggaagtccaaattccttagtgtgtcatataaacacttcatgattttcctttatccacttttctaaatcacgtctactctttgtgcattcatatgcaccttgtcctgattgcactgaatctataatcaacttgggaataactggcaccctaacaatattgagtcttccaatccatgaacacagatacttctttctttaaagattgtgattctatcatcaatattttaattttcagcatataaagtttgcacatattttgttagactt

SEQ ID NO: 477511 - DNA, 578 bp, Homo sapiens
gtctttatgtccatatacatccgatgtttagctctcacatatgatggccagtgttttaaagtctccaaagtatgtctcagatgctcatctaaacactggatggcaaagaggtcaccacccgtgtcaggcttattggcaaacaaatggtgcttgcacagtgtccagttcaaggtgccagctccgaaaaggcacactgagcgcacatgggccctactgcaggcagaagcagcacagtagggcaccttcttgcacctccagggccagactttcactccagcactttctctccatgcagagtaaagcacggctgcttttggggacttggtgcagccaagcagatgaatcctctgttgactttggttcggggctggtgactcagagcatcagggatgatgcagaatccgctctggccagggccacagcagcaatagcagctgcatctggttcccagtggcagcagacacagctgttctgaggcaatatgcagggtccagctcccaaagacttggcagtgcaagccatgggaactttgtgtatttctgttctatccttgaattgaattctgcacttcaaaatgt

SEQ ID NO: 477512 - DNA, 459 bp, Homo sapiens
cgggcaaggagaaccactacaaagtgcgtatgtatgaattcagtgtcaatttaaacagaagcacaactttgcctatggtagttattcatctccaagggatctctgaggtccaaagtaagctggaagaagtagatatcaaagaagcttttaacattgataatgagcctccagttgttcattcattgaccaatggtgaaatagctgaaattgttctggatcaagatgatcacaataatagtgacgatgaagatgatgtcattaacaccaaagaaaaggtgcctatagaagacatggcctcattaaagttaatgtcatcctttttgctgactgtctttggagaggctcctcgtctatttcaaagtaacatcacacaaaatttaccacaaaaacaagggacaggagttgagaaaattgttaggtttatgctttggggttaaatataggtcttgcatttcaaca

SEQ ID NO: 477513 - DNA, 767 bp, Homo sapiens
ccccccaaataaaaataaaacaaattttcaattacaatgagcaatgcacaaagatattgagatctccaggcctgtgatgggaggggctgccacgaagacgtctgacatgccccggagacattttccccattggagttcaaaactttcccacattttcctgtcttcttctgagccctccaaacttttccaacctctgcctattacccagttccaaagttgcttccacattttcaggtatcttttcagcagcaccccagtctactggtaccaacttaccttattagtccattttcatgctgctgataaagatatacccgagactgggcaatttacaaaagaaagaggcttattggacttagagttccagatggctggggatgcctcacaatcatggtggaaggcaaggaggagcaagtcacatcttaagtggatggcagcaggcaaagagaaaacttgtgcaggcaaagtcccatttttaaagccatcagatcttatatctattgagaaagattttttgtgaagtgtagtactcacttgtatgttttctaaattattatttaaaattatttctgtaactagcaagctgtatttggagtgaatgcatgtttgactagtatccatccatgcttgtcagatagaaggaactgcacagcattcattgtaagatgcaacaggaataaacgcagtttgtaaagttatagggatgaattatagtcgcattttccctaactgctcatctcaaaattagtcacacaggttattccctt

SEQ ID NO: 477514 - DNA, 648 bp, Homo sapiens
caggtggatgagtttgagcctgaaagatgactgagggcccctgctttttgacagctgtctgctggaggccaccttcagatcctagaggcctcctagttccctggaccctctcacaacatggcagcttacttcctcaagccagcgaggacaatctctttcttcagtttgctaagatggagctttcaataatgcctcctcaagccctgctggcttcagaggctgggcctgagcatgaggaggagaaagtccaggggaaagagttattggacttattttggataaagcacctgaaggagtcccagaagcttagctttaatcccaagggatgctcaaataacaatatcaggctcctgtgtcagaactttgtggacacaggtgcaagcaaacctgaggaaaatcacaaattgcccactctgactcatcagagctgcttgccaggctgaaagccattcctactcagtgatatgagctacttttgtggactctaaattttgtaaaaattgcttatcacttttctaaaaataccttgtacactcatggttaagtcataactttagttaaaacttattgacttcacctttgaggttgcctttggcaaagctcaaaagacacaagtatttgccatttggccaggctaaagtcaggtat

SEQ ID NO: 477515 - DNA, 1688 bp, Homo sapiens
gctctctccttccctctgctctgccagaatttcacgggaaagaactaagggttatgttgaaagctctcaagtttccctgccaggtctagagaataatcatgtggtttttgtcattggttccgtttatgtgatgcattatgtttattgaaccagccttgcatcccagggatgaagccgacttgatcgtggaggataagctttttgacgtgctgctggattcgtcaggatcctctgctgcaggtctcctggagtttgctggaggtccactccagaccctgtttgcctgggtatcaccagcagatgctgcagaacagcaaagtttgttgcctgttccttcctctggaagcttcatcccagaggggcacctgcagatgccagccatagctctcctgtatgaggtgtctgtcagctcctactgggaggtgtctcccagtcaggatacacagggagatgccctgcccagagttgaggagtctagagaggaagtctggctgcagaggccttgcttagctgcggtgggctcccctcagttcgtacttcatggcagctttatgtacactgtgaggggaaaaccacctactcaagctttagcagtggtggatgcaccttcccctatcaagctcaagcgtcccaggacttagtcaatgaataatataaaaatacagtcagcagatcataaatatttattgctacatcaaaagtctgctagtcgatctttcaataattccttcagcataaaatgcttgagtcaagatattggaaaaaatattaattaaaatttagacttagctctgaaaggacaggaaatagaaactctaccaaatattttctactgtcaaatgtctttaattttttgtcttagtttcattttccctgtgggtttgactgcaggttcttaaatttattaacctactacacatgcaattatcattttaaatctgacaatgcatctacttgcttagtggggaaagattagagctaagtggtggaattttattttttttttccccaaaggcaaagggaatactaacataaacttcagtgtttatttcacttaagtatttttctttgttcagtcaaaattttcttatagactctttactaattttttttaaatcaggaaagatgcatgaacactaattttaacaatttactgactatagttgattaacagtcaattgagtgaatataggtaaaagataattgcagttatgagttaccttacatattatatgtatatgaaatatacaatatcatctttattttcagtatcttacaagctaaagatatatttaaaatgttaacctggttatctatgagaatagtaatatcactggtgtgcatgaaaattcatggtagaggagaagaatgatatgtgcctggtaaattctagtggaagggggaggagacttgtaaacattgaggggaggggctagagatacaaattttggagtcatcaatatagagacctaggtcctaagcattcacttccagacttcttatttctctctgcattccatatttaaaacgattttccaatctcaatcttatttattaaattagttctatttttactaatttaactactagttgtagtttctaatcagcatgagtgagtcaactagtgtaacttacattagtttgatgtatttttgtcataaaaaataattttaatgttttagtaccca

SEQ ID NO: 477516 - DNA, 530 bp, Homo sapiens
actgggtccttgcacagcacagggaagatgccacggtacagggagaatgaaaccgcggactgggactccgcacttgcttcgtatctaggacacgtctcagtcacacacactcgacatctgaaaatgtccaaccaccaaggaagtacttatagtttacttttcccaccttggctcgtgcacaaggttgcctggttgctgtggtgcctgcttttctccctgtattgcctccgttgcctcctgaataacagtctccggtttgtctatggcctctgtcaggagctgggacacccagacagagtgggccacctactcccctctcggcaggagtcccactctatgcaggcacagaggtcccagaaaggcccccaggtttgtgagaaacacacatttacccatccaaacccgaagaatagactcagagacgtgaagaacagtggaagtgagacttttaatggcagtcttccaagatcgagtgtctgcatgagcgatgcagaagacgggtgatttctgcatttccaactgagggaagc

SEQ ID NO: 477517 - DNA, 516 bp, Homo sapiens
aacagaccgattgaacatggcacagggattgattagtactcccagtcctaccatcactgtgcagactctaaaaagaaaagaaaaaagtccatacacttgcatgacccgtttggtggtcagacatttaaaaacactaaagctgcaggcgtggccttcaggaccggccaccctagttggccccacattgacccagataaaaattagtctttattttgcgctcaagtcacagatcagaagcacccagaatttaggtcacttggaaaatctgatcaaagttatggtatattatggactgaatgtctatgtacctccaaattcatatgatgaatcttcaacccttagcatgactgtatttggagatgtggcctctaaggaaataattaagggaagagggacccccaggaagtgtggaggagctgctccctgaacctgtgtgaatatgtctaaatgacacaatgggtggattgtggtggccaggagatatgagggatggggggagagaaagacattgaaaaa

SEQ ID NO: 477518 - DNA, 884 bp, Homo sapiens
tttccgaggactcccagccatgtggaactatgaatactctccacttctcatatagctttaaattatggacaaatgcttgcaattgtgaactccctacattgtggctgcctgttcccaggcttcatcaaccagggttgtccaatgggattactgtaagccttcacggcagtctgccagccactgatgagaaactcatatccctggatcatatcctcattcttcttgcatatgggacaggagcttgggacccactgaatgtgggtacagagaaggctgtaacgtcgtggccctctgccctccgctggcagagggcagctgcctcatgccacagcagcagtagtggggctgagctagccccagagccctgtgctggagcaggacaaggggctgacagagctgttaacatgcccccattcattgggctgcagagggcaggacaaagaatgctaattaacatgctgttacatcccctctggagcttgagtttgcgagcacccctgcctgggcatcaccacatccctgtcatctggatgccagagtctgccacaggagtgacatgtgacatacctgttccagccacaagcaccgcacagggcctacttctgtgctggcacttggaacagtgggccaggcaccacattcattcgcttgcatgcccgctccagccaggggctgagtacgcagtcacggtggctgcaggatctgtgctggattgccaccaggtgcagcctggtggaccgagtggacagggcatctcctctggcaaacccaggcccaagtaaggcctggtcaaggacatttccagccaggggtcaccagctggcaagtgactgagaaaaaccctgtgttagtgttttttctcatttattattttctcagttcta

SEQ ID NO: 477519 - DNA, 582 bp, Homo sapiens
aaaggggtcaagggaactatcccaagtctcactgatgaaccacgatgaggagtttgaaatgcattcagattggcagtgtgggactgaaatctgtgggaaaatcacaagctaattcattgattgccccttggaaattactgctgttaattgttagaagaaagtgctctgaggggagaaacggtgctataggacagcaagtgagtgggacaggaaacccacgtgcacagatcagattcaaaaaggctatcagagaaggggacaaaagaattgtcacctggatgatgaagatgaatgagctaagtgaggatttggaggactgggcttccccctttgcttggcgctcattctctctcctgctgccctgtgaagaggtgtcttctaccatgactgctcacggactgagtacatggtatggtcagaatttgaagctatggcagtctgtcatcaagtccatgctctttacaataattctaaactatatcctacatgaatgacccactatattatttaatgtttttaatttgttgacccccatatatgttatttaattttccccaaatttttgaagtagtattattaact

SEQ ID NO: 477520 - DNA, 607 bp, Homo sapiens
aaaaagttcctcatcatctgagaccacatcagcgtggaccttattgttcacatcactatgagcatttttgtcaaagccattcaacaagtctgtaggaagttccaaactttcccatattttcctgtcttcttctgggccctccaaactgttccaacttcttcctgttacccagttacaaagttgcttccacattttcagaatgtgtctggaaatgtcatctgggagctatggcctggaatgtggaccccacaattctgccgaatgctccatcctactgtggctaaacagggagatggtacagagtggaaggagaagcaggcgaaggatggaactgtggacaacagccatatgtgtgtggctggtagaaaatgtggaagagaaaacatcaagctgacaaacggaggaagcagcaaagagttacgagagtcgtaatagtttactgcttacagagattagaatattaatctcttggagagaataggtcatcacagatggatcacagtgatgtgtagaaaatagtcatattattctcagtatatttgactcgttactgcccatatgatataaaagcccatgttattgttgtttctgtgaatattcatcctca

SEQ ID NO: 477521 - DNA, 485 bp, Homo sapiens
ttaagtctggcttctttctctcatcctaatgaatttactattaattgatgttgttctgtgtttcgatagtcagtttcttttattgtcaagatggttttctcatatatggaatccttggtcaataattttttacactggcactgaatacatcaactcccttctggtctctgaagtttctgatgagaaatctactgttaatcttattgtggataacttgtttgtggcaggaagcaagaaagaggtggagttgaaggaatgtcattccttcagcaagactaataagaaaagagagaagaatcaaatagatgcaataaaaaatgataaaggggatatcaccactgatcccacagaaatagaaactaccatcagagaatactataaacacatctatgcaaataaaatagaaaatctagaagaaatggataaattgctcgacacataccaccctcccaagactaaaccaggaagaagttgaatctctgaat

SEQ ID NO: 477522 - DNA, 556 bp, Homo sapiens
gcgggaacacaaacattcaaactatcgcaaggtgctgagttcctttagctctgggtgggtccagagatgctgtctgggggccagggcctggagccaaatactttaagaatatatgtggtgttctattctgttgtggttgtgctggctacaatcacaagacaaagtcccccgtgctctttcctccctcttccactagccaaggattctctccccatggccaccaccagtgcaggcctgaagagagtactactacctatgctcattgaaggctcaagggtttttcagtcagcttgtggtggatgctgtcagacctgggactcccctttcagggaagtgggctcccctctgatccagggaaaatacagaaatgatgtccaagaagcaaggcctggaatcagggtccaagggctctttagtcagcaggtgttgactcttgccaaaactgaatccttcccttcaatccagcaggttctcttctggcccagcatatgtcaagaaatgtcatctgggagctttgacctgggataagtgcctcaggacttgcctagttccctgt

SEQ ID NO: 477523 - DNA, 784 bp, Homo sapiens
cccagaagagaaagatctgcgcgtcctgcccgcgcactccacagagtctgtaatgtcaaatggacagcagggaagaatagaagagaaggatggcgggtctgggaacgaggagaccctctgtgacctgcaagcccaggagtgccccgatcaggccagatcatgtgcgctttccggttctgaagacggtcagctggctcattatgagagtcaagaagggcttcgaggattggtactcaggctattttgggacagcctatttacaaatcgaatgtttgtagcctttgttttctgggcttcatttgcatacagcagctttgtcatctcctttattcatctcccagaaatcgtcaatttgtataacttattggagcaaacgaaggttttccctctgacttcaattatagcaatagttcacattgttggaaaagtgatcctgggcgtcatagctgacttaccttgcatcatgactgaagacttggttggcattgaacatttggccaatgcctacggcatcatcatctgtgctaatggcatctctgcgttgttgggaccaccttttgcaggaaacgcagggcagaaaagagtgacatatcagatgcacacaacgcagctggttggcagactggacaggtaagctgttgtgaactctgggaaggactcaccaaagactgagatgttgaggataagggcaagcatttttgttttttcttttgttttgtctttcatatgccatcaacggacttgagcatttaaaaaatataatttatatttatttaaacatttt

SEQ ID NO: 477524 - DNA, 1193 bp, Homo sapiens
cacagcagtctgagatcgaactgcaaggcagcagcgaggctgggggaggggtatccgctattgctgacgcttgagtaggtaaacaaagcggccaggaagctcgaactgggtggatcccaccacagtgcaaggaggcctgcctgcctgcctctagactgcacctctggcggcagagcatagctgaacaaaaggcagtagaaacttctgcagaattaaacatctctgtctgacagctttgaagagagtagtggttctcccagcagagtttgaaatctgagaacggacagactgcctcctcaagtgggtttctgacccccgagtagcctaactgggagacaccccccagtaggggctgactgacacctcatagagctgggtgcctctctgaaacaaagcttccagaggaaggatcaggcagcaacatttgctgttctgcaatattctgttctgcagcctccgctggtgatacccaggcaaacagggtctagagtgacctccagcaaactccaacagacctgcagctgagggtcctgactgttagaaggaaaactaacaaacagaaaggacatccacaccaaaaccctatctgtacatcaccatcatcaaagaccaaaggtagataaaaccacaaagatggggagaaaccagagcagaaaagctgaaaattctaaaaatcagagcacctcttctcctccaaaggaatgcagctccttgccagcaacggaacaaaggtggatggagaatgactttgataagttgacagaagtaggcttcagacaattggtaataacaaacttctctgagctaaaggaggatgttcgaacccattgcaaagaagctaaaaaccttgaaaaaagattagacaaatggctaactagaataaacagtgtagagaagaccttaaatgacctgatggaactgaaagccatggcacgggaactacgtgatgcatgcacaagcttcagtagccgattcaatcaactggaagaaagggtatcagtgattgaagatcaaatgaaagaaatgaagatgttatcctggaaaacttcccaaacctagcaaggcaggtcaacattcaaattctggaaatacagagaatgccacaaagatactcctcgagaagagcaactccaagacacataattgtcagattcaccaaagttgaaatgaaggaaaaaatgttaagggcagcc

SEQ ID NO: 477525 - DNA, 905 bp, Homo sapiens
cccctataccctgctctgtcaaataccagaagaagcagaatggttcatggttctggaccacaaggatgccttattctatattcccctgccctctgactcccagtttctctttgcctttgaggatcccaccgaccacacatcccaacttacatggatggtcttgccccaagggtttagggatagccctcacctgtttggtcaggcactggcccaagatctaggccatttttcaagtccaggcactctggtccttccatacagcgagatagccaggcccctctatactctaatcaatgagacccagaaagcaaatattcatctagtagaatgggaaccagaggcaaaaacagccttcaaaaccttaaagcaggccctagtacaaggtccagctttaagccttctcacaggacaaaaattctctttatacatcacagagagaacagggatagctctcggagtccttactcagactcgtggaacaaccccacaaccagtggcatacctaagtaaggaaattgatgtagtagcaaaaggctggcctcactgtttatgggtagttgtggcagtggccatcttagtgtcagaagctatcaaaataatacaaggaaaagatctcactgtctggactactcatgatgtaaatggcatactaggtgccaaaggaagtttgtggctatcagacaactgcctacttagatacaggcactactccttgacagactggtgcttcaaatacgtacgtgtgttgccctcaaccctgccacttttctcccagaggatggggaatcaatcgagcatgactgccaaaaaattatagtctaggcttatgctgcccaagatgatcgcttagaagtccccttagctaatccttaccttaacctatataccgacggaagttcatttgt

SEQ ID NO: 477526 - DNA, 633 bp, Homo sapiens
tgctctcgccggagcggcttgactctgcaggttcccggcagaatgattgaagccggcaccacttggagagaggcaggtctttttgggaacatcagcagttcaggaaaaatactgttttgtttgattccgttttccaccctaatgacaaaagtgcagcaagggctttctctccccctctttggcaataagaaagctgcccctccagatgatagggtccttccccgcttcctgcaggtgatatggtttggctatgtccccatccaaaatctcatcttgaattgtaatccccattatcctccaagggttccaccagttggagagcatttgtcaatcaaatttaaggttctgaataatgataacagtccattgcggggcttgagaattcagaagataagggcagaaccaaaagagtggttgtataagtcctttagcaaatccaactcatatccattgaaccctacaaagagcatagttatactgacagatattaaatatgagtaaaaatttttaaggtccatgtacagatggtcaggtttttattaacaggaaaaatataattaaggtaatttttaaacattaaaaatttacacttttttttaacttttatttgaagttcaggggtacaagtacagg

SEQ ID NO: 477527 - DNA, 786 bp, Homo sapiens
taactgcactcaagtcacctcttgaatgttttgcggcttagaaatttcttctgccagataccctaaatcgtctctttcaaattcaaagtcccacaaatctctagggcaaggaagttccaaactttcccacattttcctttcttcttctgagccctccaaactgttccaacctctgcctattacccagtaccaaagtcacttccacattttcaggtatctttacagcaatgtcccactctgctggtaccaatttactgtattagttcgtttttgtgctgctgataaagacatatccaagactgagaagaaaaagaggtttaattggatttacagttccacatggcttgggaggccacagaatcatgatgagaggcaaactgcacttttcacatggcggtggcaagagaaaatgaggaagatgcaaaagtggaaacccctgataataccatcagatctcatgaaacttattcactaccatgaggacagtatgggagaaaccgcccccatgattcaaattatctcccaccggtcccttcgacaatacatggaaattatgggagtacaagcaaaagtcttggtgtcccaagaaagaatgatgtatactataatctattaagttttctcttttattttgtttatttgtcctttcagtatttgttgaattactactatgttctagatactgttttaagctctgaggagataatggtaaacctgatggaatctttcaaattagagacaaacagataattagaatataagtgaataaaaatagagaatgtttgt

SEQ ID NO: 477528 - DNA, 740 bp, Homo sapiens
gtaacaattattctgaattttggatttaatattcctttgctttgttatgtttctcttaatttcctaccatctcttctgagaagaattctcagtacgtgagtgggtttggtacgtgtgcaaagacgatggccaggtttcagtcatctgtgcagagttcgggctacttcatccatttcctctccaatacctcatcagtgaaggaagaggacaagctggcctcaaaggtggagctgactctttctgcatcttatgacaggttctattcattaaaaagcctgctagagccatcattgtttatacctgtttctaagattgctgctttagcattttatgagttgatctccagtgttccagaaataatattccacagcatgtttcataactgccagaaactaaaaccatcccttttcagaggggaaatgcctgcctccttgctgggacttgatagctcaaggttatctggggagaggaaaggttatttcaagtacttggatacttcttctatacttgtatttcccaagaaaataaaacacttcttcaaaaccgcagtagcctaaaagcaggcagatgttcctgcatggtcctaactgaaaatgccttatctaagtgaattttctttttcagcttgaattacctggtttctctggctatcatgagcagattaactgaatcattgccaaatctactcttgattttgttttcttcaaggacatatttttcagcttaagcaaagaggtata

SEQ ID NO: 477529 - DNA, 521 bp, Homo sapiens
gatcctgcaacatcctggaggagctgtgagtgagtgagctttcagatgacgccagtgcccaagcttcaagatgctcccaatgatgccaagtggaatggagttgagctgcccctgctgagcccttctatctatgtttgcatggccattggcacattcaatataaaactgcatcacgcaaaaggagcagcagccagttctagcatcacagctgtttttgtcttagcacaatgtgaggcccgattgggagaagagaaagcaggaaaagcacaagaagctgccaaaagaattaaacgcgatgcagtccagagccctgctctctgtttctacctgcttcttctcaatgtcactgtcggccaagagtttgataaaaaacagatccccagaagtattccagtaactcctcaggaccaccagggcaaaaacaaaaacattcagggcttgacacttaccagggcaacttgccaagcttatcacatgtgaaaagagctgctcagagagaataatcttgctcgcgttcacaa

SEQ ID NO: 477530 - DNA, 943 bp, Homo sapiens
gtttggtttgtggttgttgttttgttttgttttttgagataagtatttgttgaaatcactctccatttcgatgtttgttttgattaaacaagggccgaaaatgtttggtggctctgacaattcgggggctaaatactgggcacctgtcggccagttaaaagcaactagtgcagccactggactaaagacacgggtgtcaggctttctgggaaaggactctctaacaacccctgactcttcagagttgggagcattggttttcgagaatgcatctgtaagggccaataaatccgactttcctcggtcctctttgtggtctaagaggaaaattaaggtttttgctgctgtgtcagtgaatgcaactattccaatcagcagggtccagggaccatttcgggttcttgggcaagaggagtttctgctgctgcatcagaaggaaacaagcaaagaaatctccaagggaccacaaaaacccctgggctattggttatgtccccttcaagctgtagggggaggggaatttggcccaacctgggtacatgtccccttctccctctctgatttaaagcagatcaaggcatacctggggaagttttcagatgatcctgataggtatgtagatgtcctacagggtctaggtcataccttcgacctcacttggagagaagtcatgctattgttagatcaaaccctggcctttcatgaaaagaatgcggctttagttgcagcccgagagtttggagatacctggtatcttagtcaagtaaatgatagaatgacagccgaagaaagggacaaattccctagcggtcagcaagccatccccagtatggatccccactgggatctagactcagatcatggagactggagtcgtaaacatctgctcacctgtgttctagaaggactagggagaattaggaaaaagcccatgagttagtca

SEQ ID NO: 477531 - DNA, 541 bp, Homo sapiens
acatcacacaccggggcctgtcgtgaggattctcagtgacaaatgatagaggatgaccctggtcaacatacttttaaaagagggggtgaggttatgggagaatccctgtgggatattgataaagacattgctaaggatgctagagaaggcagccagccagaaagccccctgcttaacagagaatccacaaaagggatgagttcatttacagagggctggattgattataagggtgatgctggactttctgggagagcatggcagaaacccaagccaatctgcaaaggctccagtgatgcgagagattgtcttacctcttctccttcccagattgatgacgaagtcttagggcagtttgccatgtgtcggtggctggtggagggggtgttaggagggagggcttcagatctgcaggagagtcccagagttgttttctggctccctattggactctacagcctggttactcttgtccacaaggtcactgctacccctgcctgctgcagcctgtggctggagagcatataaaaagctcacttgt

SEQ ID NO: 477532 - DNA, 615 bp, Homo sapiens
ctgaggggcatcgcagatgagacccgtgaggctaagcaaatattttgtgcttcgtatccttccctacaccaccagccacacctcctcccatggaggtgaagacagggaagctcagagcggagctataacttgcacgagccccacaggcaaatggtgcagagccgggactaatgccgggttcctggagtcaagcccacactgcatcatgggaagtgcccctggcagaggcgctgatggttatgggatagcccaggaacagcgcccccactggtctgtggcactttctcagcagcagagcgacccccacctggagaagcagcccactcagaggcccttggcaccatgggtctctcccacccactgctcgccagcctccatttcccacctgtgctcttgtctttgggttcaagagggaaaaacatcaaatttggattcaattctcttgaataagatgtttaaaagaaaacaaaacaaccaaccttcaggctgctccaagagagacatccgtacctgaatgctagatttatcataaggaatcaagtctgattccatgataactgccactgatttcagaaaatcatttcttatgctttggctttttatgtattagtaatt

SEQ ID NO: 477533 - DNA, 1515 bp, Homo sapiens
ggtagcaaggtttattgcgaagagcaaaaggacagcttccacagcatggaagagaaccccaggtgctggctggtggtggccagcttttattcccttgtggtcccctcccatgttccatttctgtcctatcggagtgcccctctttcaatcctccctgcgattggctacttttggaatcctgctgattggtgcgttttacagagtgctgattggtgcattttacagagcgctgattggtgcattttacaatcctcttgtaagacaggaaagttcctcaagtccccactggacccaggaagttcagctggcctcacctctcaagacttgttgaatgactttgaccaaaatgctgatagtgacatggacaataaagtccagactgagatggtctcagatggagatgagaaactttttgggaattggagtacaggtcactcttgctatgcaaagagactggcagcattttgcctctgtcctagagatctgtggaatcttgaacttgagagagatgatttggggtatctggcagaaggaatctctaagcagcaaagtgttcaagaggaagcagagcataaaagtttggaaaatttgcagcctgatgatgtgatagaaaagaaaaacccatcttctggggagaaattcaagccagctgcagaaatttgtataagtaatgaggagcagaacattaatcaccaagacaatggggaaaatgacttggtgtcctgtgtcccagctgcatcagctgtggcagaagggcccaagggacagctcaggccacggcttcagagggtacaagccccaaaccttggcagcttccacatggtgttggtcctgcaggtgcacagaagagaagaattgaggtgtgggaacctctccctagatttcagaggatgtatggaaacacctggatttccaggcagaagtttgctgcaggggtggagccctcacggagaacctatgctagggcagaagggaaatacggggtcagagcccccacacagagtccccactggggcatcacctagtggagctgtgagaagaaggccactgtcctccagaactcagaatggtagatgcactgacagcttgcaccatgtgcctagaaaagctgcagatactcagtgctacctcaccggcatctgctgtttttagatgttttggacttttttaaaccaaggtcatgaccgttatgagctggtatctcattgcggttttgatttacatttctctgatgattagtgatgatgagcattttctcatataaacatgcaaaaaatattgactgaaccaggaactatataaactgactaataatattggttatgataaaagcaagaaatgatgagggtatgaaagaagaaattggcaatgttatattgctttatagaattatttacaacatataaaggagataaatctgtgattttttaaaaaaagaaggatagtaagaaacctagaatcattctatatttggctgcttgtatgtcttcttttgagaagtgtctgttcatgtcc

SEQ ID NO: 477534 - DNA, 1557 bp, Homo sapiens
agttaagcttctgagctccttcctcgctattcctctaagtagggatagggtgggctcagatatgtaaaatgaagattcctaggtcatggaccacatcctctagatctgaaccttttcagggcttcagccttcagtctgtggccaacgtcccgagagcccctcggcaaatcacgggtgtaaatccaagagttcagaagctgaagaacttgaagtctgatattcgagggcaggaagcatcgagtacaggagaaagatggaggccagaagacttagcaaaaaatgagggagattttaaggaactgactcacatgaatgtgggcggagtctggcaagtccaaaatctgcaggataggtcagcaggctggagacccaagaaagagttgatgctgcagtccaagtctgaaagcagtctgctggcaagttctctccatctctctctctctctctccccacccccgcaaatatctaggtaccatggtgtaaaatagttgacacgtgctattgtgcttagagttgactgtgaggcaagcctctgcatctgtacaggaatagaactacgataccaaaaagtacttctgatctccttttattggttgtgaataagcactagtatcctcattttacagatgaagaaactaaatctcaaaggtgctaaaaatccttgatgttgcctacgaagactccaaatcatctattatcattgaatttagggctaaaataagtacatttaattgtaacccagttaataaaaagtaagtgctgagaaaaattattaaaagcttctgtgtaatgataattgtattcctgagcctaacaattgggttaggatacaacaatttttgtattggttagagctataccctgctttggtttgacagtcagagccaaagacacagcaatcttccctcaaatattggaaggactttgtcctcctgaatgactctttcaaataatttcttttatgaccaaacttagaaagtaaatatctattcagatgatgaaaaatactaatgtttgaagagctataaatataaaatcatgaatgccaacaaaacaaggcattgtacatattatgaaatataacttaagattttggatctcaatacttggaaacattgaactatgaactatgtactattattatcttagaaagctttactccattttagacggactataccacttcaaatgggctgttgatgcaaaatgagcaaaaaaaagtgcatcagtggaacttattttagtgaaatattaactggccacatttcaaaattatattctatactgtcctgtgaccaaagatgctaaagaacttcctatttaagagtaccatgaaagggtatggctggagggtgaaataagaaaagacacagaatgtattgtatttgtaggaattaagaataaaaatgtgcttcaaacggaatgttgaatatcatcatagcaactacttttttgatcaacaagaatcatgaaaaaccagaagctatgtcagctatgctttggataaagttactgctttttaaaaatcaagttaatgattcacaacagtaaagacat

SEQ ID NO: 477535 - DNA, 817 bp, Homo sapiens
cacagtctaagtttgttttctccagtgggtgtgtgtgttcgggagagaagggtctcctttcccacttctgcagctggggcactcacagtatttgggatgtctctggggtcgcacggaagtagtccacttccttcagagggtctgagggtcctcttgggactgctgatttgttcttgcagagcacccagcagtcagatgattgcaaggaaaaaaggaacatgctttgaccctgagggtggtacttttattcagttggcactcgctgaaccaaagcttctgcagcatgaatgcagcctgaagcaggaatctatccacaagaaagtgctttgtcatgctaattttaaattcaggattcatactaccaaaacggaacagagaagaataacttgctatgaaatagcattagttctatttgaagctggaaaattcattgaagttctagttccagaccaggctagtccatttacccaatttgcctttcatgctcacagaaaactcattttgtccatttcactattcaggatgatttttaaattgcatcgcacctgttcaaaagctgagaggaagcacggagaccacatactggagatggtaagtatcacacttcacagtgaaataataatgaagagcccctaaaaaatcacccatcagacagccacaataatcccagatacgaacgagtctaaagaccaggagtgcacaattacagtgcttgggttattttcatcaatagcagacaggctgcttctttgcacatggataaatagcttattcatttgtgttggagtatatatatatatttgttaccttgaaatgt

SEQ ID NO: 477536 - DNA, 945 bp, Homo sapiens
gactgatgggaaggatccaagatgacagatgtgactctggcggtcccgaaggatgccctaatagggtggcctgtgtctgtctccttgattaatcagtccgtgctcgccattctaatctattccagccagctgcatgaagcagattattaccaaggagtagcaaaagccatgacttccaaactattcagccagattcaccagagcaagagatcagatcccaggttcagtgccactctagtgatggcagaacaaccagatataggaacttggacaatccgtgaatctgagccatattccactctggactgcctccatgtactcatactgatggacttacatctggttcatcttcacatcacggatgtgccctttgaaatcccagttttatggctgaaggattttgtcccagtcccccatgcctgtgtgttcatgaaaatcaaatcccaaggccatcttgttcagcaaagaaccttcgaaccaaggtcgtctcagtcctctgtgtgcctatctatcaagagagtcagtctggataatttgcccgccacatcattggtaaggggagtcttgattgctatcttgagtggcctgtgcttaaccctggataaggatggagttgcatctcctcgggtgtgctgctataagaagcccttctgcagttgctgccctgaggacagggacctcattctgagcctgattgcctcttggagagacacattgcaaggtacctctgctgggtacattgcagagcccataaaagattttttgttttggatgaacgtctaaacagcagagtatattattctagaaatattgccatgattatttcctccttacaatacaggactatgaactataaaaaggagaatccacgagtgtatgtagaaattttgttgctaagtgatgtctttgttcctatactagactgcttacctctccccatataac

SEQ ID NO: 477537 - DNA, 2090 bp, Homo sapiens
tttcttgtttttgtcagtttcagaaggaatggtaccagctcctccttatacctctggtagaattcagctgtgaatccgtccggtcctggatgttttttggaccctcagctgcaggtctgttggagtttgctggaggttcactccagacgctgttttcctgggtatcagcagcagtggctccagaacagtggatattggtgaaccgcaaatgctgctgcctgattgttcctctggaagttttgtctcagaggaatacccggccatgtgaagtgtcagtctgcccctacttggggggtgcctcccagttaggctacttggggatcagggacccacttgaggaggcagtctgcccattctcagatctcaagctgtgtgctgggagaaacactactctcttcaaagctgtcagacagggacatttaagtctgcagaggttactgctgccttttgtttatctgtgccctgcccccagaggtggagcatacagaggcaggcaggcctccttgagctgtgagtgactgtaccattttacatttccaccagtagtatatgaatgattcaatttctctgcatactaaccagcatttggtgttatattatttttcattttagacattttgatagctgtgtcatgatatttcatcacagtcttactttacatttccctaatggctggtgatgttaaactcttcatgagttcacttccatccatgtattctctttgccaaaatgtctgcttttatcttttgtccattttctcattggatttttttaactttgaggtttgatctttttatatattctagatatgagtcctttgtcaaatatgtggctttcaaatatttttatctccttaactgatcagaagtttttaattttgatgaagtccagtttattgatttttaaggaattgtgctttgggtagaagtctaagattgccttccagaaatattgttcaaatttacattctgactagaaataattatttttctaatcctcattattcattgattaaaatataccaatttaatggacaaaataataacttttaagataaatggtttttaataatgtatttaatttttgtgtttattgtttatgaattccctggtcatctcctttgttcatttttctaaaggtaactttcttcttctaatgtatttctgatatattaaggtacaatttatcaatcataaatattacaaatatatttttgtacatttaccttttatctattatatttggatgtacagatggctttaactagtatgaagccaaatctatcagatttttactatatgccttctatgtttacatgtataattgatttagggtttattatgtggctagttgagaaagattctttttccgtaaatgattcattaattataacatcaaagtatattgaataatctatccctttcaggagctgaaatttcaggttaatcaaatgcaaatatttcttggctatcttttaccatttttcatacaaagaaattttagagttatttttctaagttacaaaaatataactgaaattttttcttagaattttattaaatggttgacttggggagagtttatatctttacactattatcttcctgttacaagaatgtgattattttccagttatttgtctttgtttatatccatagtaaagttttttaatgtttaatataccctttgagtttacttcatgtattttatatttcacaaagctattgataatgactcttttttctttatactttttaactggttactgttgatgagtaaaatatttcttttataactggctgaaatgtctattttcccattccagtcaattttctgtttttcctagttattgcagtttgatactcacataatctagaatagtgataattttgtcttcccaattgtcacctttgttaagttgcatgaagttaatatttcagaataatgttatatattacagtggttgctttgtcttattcttaacttttattagaaaatctcttgtggctcaatattaataaaatattggttgttaatttgaaacagactcttcaatatgttaaagaagaaaatgtatcctagtttactaa

SEQ ID NO: 477538 - DNA, 2631 bp, Homo sapiens
aatggtacatccactgacagcttgcactgtgcacctggaaaagctgcaggcactcaacaccagcccaagaaagcagctgtgatgggggctgtatcctgcaaagccacaggggcagagctgcctaaggctgtgggagcccacctcttgcatcagcatgacctggattttgtggctggcagcagtgtcagtgcagggatgtggtgctggtgggggcaggtctggcaggctccatgcccatcaacactaccacatcactggcggtgccgcttgggggagctatgatgtgggcccccaggaggtaactggcctacaccaaaccctctgggctctgcacctgctggaggtatgcccctaccacttctctaatcagctttcaagtgtctgtggtggttgggagtttcctcctgccagaattaccgaggcctatggtgagagcgagttgctccttgcctgttcaactcacctccactgcaggagtcctggggggccaggaatgagtcctggtgcgcagttgtcccattcagggttcccaacttccttcaccttcagcctgtgttctgtgtcttccctctatctgttgtcaattccttccttctgaatatctgctaggagtgcgccagtctttcagatgtcccggtcccttagtgtgagatgttcttcctggctacgtctagttggccatcttgcaagtattttcatagtaggcaattatcagacttttaattatttctttatatcttttaggcaattggttaggcttaggcaagttttcctaacaatcagctggatgtgctatacccataagattaattcaaccagtgatcatatatgcatattgtgaacacataaacatcacactctattaatttgtaaacgtttttgaaaagaaacacttattaattatataatgtattattaggcaattatttatccagtttttaaataaacagagtttctacaatctgtatttttcaacatattaatttaatgtaggaattaattgcctgtgtttcaaattataagttttatcttaataaatgcttacagaattaacaagtctacactgttagagtgatcctagacttgttagtgaatcactaggagaggatcaagatgcccagacactgaagagacagtgtagcaagaatgcatcacacaggaatgggagagaatcagaaatgagaaggggaagatgccatagaatccatgacactgagcacttagtatgtccctagtaagacttactatgtatgaaggaaggtaacactcagcaactagcatcgtgggaaagagcctaagacagaacagatggagtaaaattgtaaacacttcagcacgcaataccagagacaggagttaaacatattgcactaatattctaaatgctgtcacaatggaacgatttaactcagttcagtgtttgggacatcactatcaccatagctaattacaggggaatccacatgaagcaataattgcttagaacatattcaagggccaggactgctttcatctgtgaattttgactttaaatcactgcctgtaaataatcacagccaaatatttgttgatttctcaaaattttgccattggattattaaaattttgccattttaataatgtcacaatattataacatagtttactgactgtatatatgcctcaatatataattgaattagttatgctgtttgttttaaatgttaataataatctttcattagatcactttcactcctccacatgacttccagaaacaatttgctaggttataaaagtattttcctttggattttttactaatatttcatgaagatatataggttggctttgaaacattggtgtttgatcacctcattcaagaaaatgccgtttcttcagatatccaagtcacttttatctccacttgcaaacttttatagtcttgttttgtaggttatgcatccttctcacagtatatcctgaagaattttaaatgttagttgctatagtgaaggagatcttatatattctatgcagccagaaggggctcatcatgggggtattaatttttatatatttataatatgtgcactatttattggacttttctaataatatttggcattgattggagcctttagtgcctccttgttcaataccatgggtatgtctgtattgatatagaattgagtctcagcagactagaagactctgaaatatctgtcagaaactaaaatcttgtgggaatgcctgaagtgaatctcacctttagaagggcaacaaagtgagaaactggttaattttggactctataatggatactattagattttactcttgaaacatctgggtggcagaggtcaattaagcatggttgttgaggaactggaaagtttttgttgtagtcttttgctgtaccatctatttacagaaagtattatttttaaacttttgcaaatataattttatgtttttccctaatttatattgctgccaaatgggagagcacaggtctaaattattgtacctgccacacctacatgaggtggaaaataccatgaaagtatctttgtgcagaaagggaggattcatggtgctttcatctgtggacctccagtggaaggaggacaatccagacctaatttagag

SEQ ID NO: 477539 - DNA, 746 bp, Homo sapiens
tgccaacccagagcacaggccatcaaacagcagcagctaccttctcatagatgtcttgctataggagagcagtaatgccatttttgatcaggcattctgatacttattcccataggagcaggaaccctattgtgaactgtgcatgcgagggatctaggttgcctgagccttatgagaatctaatgcctgatgatatgaagtggaacagtttcatcccaaactactcccctaccctgtccatggaaaaatcatcttccatgaaactggtccttggtgccagaaagtttggcaactgctactttagccatgcacaagcccaggacatccggcccagccccagcgagcacactggcctcgagcacactggcctcatgacaatgcttgggaactcctctaaaacttgcctaggcccaagaaaagagagaggggcatcaaggtcagaacggggaaatcctggaggccggcagacccgcgtgctgccgggaagcactggccacgccaggccattctgctctcatgaggagctgctctccaccaagttctacaaaaagccacgtccgtccctacttccaggaacccagttttgcagatactcttcctccagactgtcattgactcttgataattttgagtccccagaaagcttcaagggcacctaaaaatattcacttctaattttaattccatcgcaaactgtcccggtgtactttcagggctatttaaggctcttaagggaatctatctga

SEQ ID NO: 477540 - DNA, 1217 bp, Homo sapiens
ttctctcctgacccaggtgtattttttgaagattgtcaggcccagccatggctgaaaggggccaacatacagctcaggctttggcttcagagggtggaggcctcaaggcttggcaacttccacatggtgttgagcctacaggtgcacagaagtcaagaattgaggtttggaaacctccacctagatttcagaacatgtatggaaatgcctggatacccaggcaaaagtttgccttagggtggagctgtgagaagagggtcaccatcctccagaatggcagatccaccagcagcttgcaccgtgcacctggaaaagctgcagacactcaacaccggcctgtgaaagcaaccaggagggagactgtaccctgcaaagtcacaggagtggagctgcccaagaccatgggaactcacctttttcatcagtgtgacctagatgtgagacctgaagtcaaaggagataattttggagcttttaaatttgactgccccactggattttgggcttataagagttgttcagcgcataagagttatctctggtatgagacacaattacaactgtaaatttcctttataaatggaaataattttccttacaaaagggaagatttattctctatttttaggcagtaagcatttggtattggctgcccgctggatgctccggggttttcagcattggaattcccctaggggaatcttggtcttgccttttcttgctttctgccctaaatatatcactttccataacaggattttcttattgtcagtttatttacacttttcattctacactttgcttgataaaaatacttttttgtcatgctttgttcattggcaaatataatccactttcataatgtcttgctttctatactttcaccttctctgcagttagtaagaatctaaaaaggaaaagttgcaagagcccagttgcttttactcacactagaattagaaaaacttctgagtcctgtagcaaaccatgggaacaatgatgagtatcccagatgacttgccaccggggtgtcttttaggttcttggagcgaattcaaatttgaaactcattttctattgcatcactgtttgggtctgttaccaattagaaaataaacagatccatcctaggcctgggtctttacattattttacattagttctgtagaaggaaattgggaagaggtcccttatgtgcaggcttttagagcttttta

SEQ ID NO: 477541 - DNA, 683 bp, Homo sapiens
cgccggaagctctggttgcttcccggcccctttgtttacctactcaagcctcggcaatggctggcgcccctcctccagcctcgctgctgccttgcagtttgaactcagactgctatgctaggaaagtgcgaggctccgtgggtgtaggaccctctgagccaggcgcaggatataatctcctgtgggttcttggtctcgctgacttcaagaatgaagccgcggaccctcacggagtgaagccgcagaccttcgcagtgagtgttaaagctcttaaaggtggcgcatctggagttgtttgttcctcccagtgggttcgtggtctcactgacttcaggagtgaagccgcagaccttcgcagtgagtgttcagctcataaaggatcagtggtaggaaccttttttgtctgggatgtttccttccaatataggaggtgcaagtcctccaacggttcgcaggtgtatcgaggctggatagtgacctattctttgttcccccaaaggggccttacaatggaccaagggattattcctttggcacacctcacaggctttgactacttgtcagatgatccagaggagatttggccctgtacatagggatttggccatttgatgagtgttttcaatacccatatgaaaagtttggtggaggattttaagtattttccactggctggctttggg

SEQ ID NO: 477542 - DNA, 640 bp, Homo sapiens
tctgatggtactcacagcttggtgatagtcccttcgtggttgccaaaatgtgtccggaattttttccttctggtgggttcttggtctcactgacttcaagaatgaagccgtggaccctcgtggcccctctgctgcaggtctgctggagtttgctggaggtccactccagaccctgtttgcctaggtatcactggcagagcctgcagaactgcaaagattgctgcctgttccttcctctggaagcttcgtcccagagggacacctgccagatgccagctagagctcttctgtatgaggcgtctgtcagcccctactgggaggtgtctcccagtcaggatacatgggggtgccactggggtatgaaaaaaaaactcctggggctagctcagtgtctgcgcaaatggccgtccagttttgtgctggaaacccagggcgctggtggtgcaggcaccagcgggaatctcctggtctgcagttgaccaatattacaaaaaatcatactgaaatattgtatttttaattttgtcaataaaaattgtgaaaatgttttctttcatcatatgaaaaactatataatatcctcaagttttccttttgtccacaaagcctgaaaccgttgccatctggatttacagaaaaa

SEQ ID NO: 477543 - DNA, 1084 bp, Homo sapiens
tgagatctggtggtttacaagtgcgtggcacttccccttttgctctctcttcctcctgctccagcaatgaaggacctgctggcttccactttgtcttctaccatgattgccagtttcctgagggtccccccaccagccatgcttcctgtacaggctgtggaactgtttaggtcttattatttacttcctattatggaagaagaggagattaagacacacagagagaaaccaggggcagtatgcaaagaaggaccacctcatgaagacatagcaagtgcgcagccatccgtcaacgcccaggctatggcagccgcttcctcatgtcagcgctgctccctccaccctcaccccttccacctcggggcagttcgaaatgaagctgttgtcatttctggaaggaaactggcccagcagatcaagcaggaagtgcggcaggaggtggaagagtgggtggcctcagacaaggatgtcgatgacttttatgtaattaatgtagggcaaatgtgtttggaccagtattccacgttaccagctgccccatggggtgtgtgggaaataattaagcaaactggcattcccaccctagggaagagtgtggttgtggctggaaggtcaaaaaatgttgaaatgccagttgcaatgttactgcacacagatggggcgcatgaaggtcccagaggtgatgctactgttacaatatctcatggatacactcccaaagagcagctgaagaagcataccattcttgcagatattgtaatatctgctgcagacattccaaatctcatcacagcacatatgatcaaggaaggagcagccatcattaatgtgggaataaatagagttcaagatcccgtaactgcaaacccaagttagttggagatgtggattttgaaggagtcagacaaaaagctggttatatcactccagttcctggaggtgttggccccaaaacagtggtgatgctaatgaagaataccattattactgcaaaaaaaaatgctgaggcatgaagaacgagaagtgttgaagtctaaagagcttgaagttgccactaattaactaattgtgtcttctatgtcac

SEQ ID NO: 477544 - DNA, 860 bp, Homo sapiens
gaaagttcccattgtaatgttcgttgtcctgcacagctgccagctcctgcaaggctgcagctggaccagaggtaccacaagtggcttctgctgtgggcaccagtgtctggacaaggggaaagtaatggcacccaaaagcttagagatgccaggaactgcaaagccccaaaaaggatattacagctgtcgcaaccctggcttggggagccctgatgtctgggctcccaaaagggctgaagctcttctctccttctcatcccccgccacgtggggagtggaggatgtgtttcagccatgtttgggttacagctctttctgtcctaccattcagcatgtcctgagttcttgtcctgtgtccatggagaatgagcctgtggggacaggggtgtcttcctgggcccctgagagcacagggatacctgggtctggagctgaggctgggcagctgcagctgcacccaggagtgcagggcttctgccacaccaactcaataggggaagaggctcctcaccagaagccaactgtgttggtaacttcatctcagttttccaactttcagaactacaacaaatatatttctgctgtttataagccacccagtctgataatttattattgcagcctgaactaagtcagtgatctaagaccttagacgcagtttagttatagaacttacctaagaagcaagcaattatttatgcatacacatgcaaattaatacctttttaaaagacatctgttatgtcctttaaaaagctgtatgcgtatgaaatttgaataaataagattggcataaaagaaggttgaagggtccaaagattcattagactaaagataaatttgttgccaacttttcactt

SEQ ID NO: 477545 - DNA, 647 bp, Homo sapiens
aaactgtatcatacaccatggaatactacgcagccatacaaaataatgaaatcacgtcctttgcagcaatatgaatgcagctggaggctgttattctcagagaattaatgcaggaacagaaaaccaaatactgcatgttctcacttataaaagatgggtgatttctgcatttccaactgaggtacttggttcatctcattgggactgtgggacagtgggtgcagcccacagagggcgagctgaaacagggcagggcatcccctcacctgggaagtgcaaggggtcaggggatttccctttcctagccatgggaatctgtcacagaccgtacctggaaaaacaggacacttctgcccaaatactgcacttttcccaaggatcacactcctcgccagcaatggaacaaagctgcaaagagaatgatgagttgactgaagtaggcttcagaaggttggtaataacaaacttctctgagctaaaggagcatgttctaacccatcacaaggaagctaaaaaccttgaaaaaatgttaagacgaatggctaactagaataaacagtataaagaagaccttaaatgacttgatggagctgaaaaccatagcatgagaacttcgtgacgcatgcacaagcttcaatagccaattc

SEQ ID NO: 477546 - DNA, 2714 bp, Homo sapiens
cggctgaggtggtggcggctggagaggcccctataggctccaggaggcggttggctgctggttaccgggaactgccgcagtgttttgctttgaggaaccactttgtcggtgtggtgatgggtcgcgcgcgcggcaaggcaatgcaaacaaaagcgaaagcagcgatagataattttattaaaaagccagaagaaaactacaattcggaatgcagacttgatttaccaccaatgaagaaaaacttagtcggagaatacaccattgagacacagttatctggaccaaagaaaggagcaaactcttttggaacggatcctataagtgatgttgttagattaagaggtgaagatcccctggatttggatactggatatcatgtagccaatgtaagattgggcataaaccttataggtgaatttgaaactaacatggtaagaaagaagaacattagatggtatttacatgagaaatataatttaaggaaagcattcagggatgatttttctgagtggaaaatgaaggatatgccatttcctttggattctattaatgtgactgagaagaaatctgttggagaaattatagcaagagtaaaagcaacagatcgagatgaagatagcagtatcatttattcctttaagactcagcagaaaatgttttgtttggaccccttcacaggaacaatcactcttcttcagcctttgaatcttgacaacccaagtaactccaaaatctactctttggaaactgaggcaacagataatgggaataataccagcagctatacgtttacagtttttgtggagaatgtagatgatcctatttcctgtgatccaagtttttcaacaggagcagcaattattacagtcattgtaagggtgagtcgcataaatgaactgaatccaattggaagtgcgtcagcatttaccttcagtgtatttgaaaatagtccagttgatacactagttggaaaagttacatttaccgatgcagactggccatttaataatatggaatataccattgttggaggcaatttgggaacacctcccaaattttacattgaaccagatacaggagtgataaagctattagattcactaaacagagaaattgaatcacagtacaagatagctgtaaaagtaacagacttggacaacgatgccatccctgaccccctcagacagagaagtggtactgctcaggtgaccatcagtgttctgaatgatgaaaagtattctaatacactgacaacaccaaatgctggtgagtatgtggagcagcaggaacccttattcattgctctgggaatgcaaaacaatgcagccactttggaagagtgcagtagtttcttacatactcttactgtatgatctggcaatcgtgctccttggtattttatccaaatgacttaaaaacgtatgtcaatacaacacctgtatacaaatatttgctgttgctttattcataactgccaacatgaggaagcagccaaaatggccttcagttaagggtatatgagcaaatttgttacaataggtaaactgtgtgtcatgggagtttggcatacctataattttgtcacccaggagggaatgggaatccttctgacaatgtcagcaatgtccaaaaaaattgaggattaatcaggattttcaccaacaataagcagctgttagaagcgctctcttgcgactagatctcttacagagagacaacaaggcaggatcagagattataaccttcgtgacttcaatcaactgaaatagatggggaattgctttacagtctgatacatgattcaattttgtaaatgttcatggggtcatatgatgtttgtcaaaatgaaactacagagcaatggtaaaaagatgagagtttcaagaaattatactgggcaactgatatgcatatagacatagtagaaacaatcccctataaatcaagtctaaatgcattatagacataaaatggcaataataaataaaataactatactttagaaagaatttaagagactaccttattaattttgtaatagggaaagatttcataaataagacaacacaaaactagaataagaaaaaaaattagaaaattgaatactttagaattaagaacttcttacggatgaaaggataggatgtctaacctttggattaaaataatttggggtggagaggagtaagaaagaataaagattaaataaaacagtatacattgacaactattggtattgtatgatggctatctggtggattattgtaatatttttatacttttgtgtatgtgttaggtatcataaaaagtagttgtaaaataattgaaaggaaaataatctgagatgcccatgaactttgtaaaactattagtatttaatatggtaaagtgctcctcaaattaccctcacagataaaatattctcacttatttagtgcttcactaaaactgtgttatctgctttagagcttttagtcatacattttatatagttaaactctataatttattatttaaatcatgaatattctcctggtcatcagcaaaatgcttctgagtcctgctccccactccatggcatatgacaatataactttctttcatattccacaaatatatattaaaattgtttgataagtcaggtaaatattgcctaagactaagttatattgtcagtgatattgtaaggtattatcgtagaatttcaaacagtt

SEQ ID NO: 477547 - DNA, 510 bp, Homo sapiens
cgaggaagaagcaaaagtggaaacccttgataaacccaacaggtttctttctataatgacccctcctactatcagccctggcctacagaaaacagctaccactgaggttctcaatggtgatgccactctcaccaatgaatttcttattgatttagtaagtgcagtttctgtgggtcctcctgtggaacacagcttggagcttcccaggtctatctcaggctgctgcactagcagcgagcaaggctctgtgggcatgggacctgcggagccaagcaagggaatttcctggtctgctggttgtgaagctgtgggagtagcacagtatttgcgcaggagtgtactgttcctccagcttccatttttactgctggtgcagggtccaggaccccagtgcctggatagttgtgcttctgggcacatataccctgagtgttatcctattacccagtccccagatccctactcttatctcccttaatccttttaatgggttgcttgaagatagaagtc

SEQ ID NO: 477548 - DNA, 603 bp, Homo sapiens
cagctgcttcagtgccttctccatgttcataggggacccatctatcgctgcccaggtttccaccagagcccatctgaccagtgcagctgccactgggtaccgcaacccatgtttcggccacatggctgaacaggaatcagcggggactgaaggctcactcactttgggatgctgccagctatgcagttgtcagggactactgtacgctggttccgagctgacatttattccaggtaactcaaaacttcactgtggtcctccagttaaagtaggggtttatggagatcagaaccatcctatggtcatttccccagtgccagagtgcataattggcatagacatgcttagcagctggcaggatccccacattggctccctgactggcccgccagaagcaatgtgcattcagctggcaagaccagcaacataccttcactgtcctacatcaggggtatatcaactctccagctttgtgtcataatcttttttgcagacatcttgatcacttttcccttccacaagatatcacactggtccattacattgatgacgttatgctgattggactcagtgtgcaagaagtagcaaatacactagactaat

SEQ ID NO: 477549 - DNA, 1767 bp, Homo sapiens
attagtgccaccatcaaggacatgaaagatgcaggggtggagattcctaccacatccccattcaacttttctatctggtctgtgcagaagacagaagacaaatggactctggagaatgacagtgaattattgtagttttaacccagtgatgactccaattgcagctgctatacgagatgtggtttcattgtttaagcaaattaacacaactcctggtacctggtatatagctgttgatgtggagaatggctttttctccaaccctgtccataaggcccaccagaagcagtttgctttcatctggcaaggtcagcaatacacctttactgtcctacctcagaattatatcaactatccatctctatgtcacaatttagttcactgggatcttgatcacctttcccatccacaagatatcattctggcccattatattatgctgattggacctagtgagcatgaagtagcaagcactctggacttactggtgaggcattttgtgtgtcagagggtggaaaataaatccaaccaaacttcagggccttctagctccatgaaatttctatgggtccagcagtgaatgaaggttcaccccaccagacgcatgtaacatttggtgctgaaacccaagacaggggactccttcagaagaccagccccctgtcctcaccctcagtccgggaggagatccacctacgacctcgggtcctcagaccagcccaaggaacatctcaccaatttcaaattgggaccccactggaagtcggaccatccaacttggattacagctgctcctagacctactggagcaaaaagctaaggctcctggctgattccttcccagatctcctcggcttagtggctaaagactgacgctgccaaatcatctcggaagccccctggaccatcacggatgccgagcttcggataactcctacagtggaggacaggaatgtcaggcctgtgagcccaaagtaagccatcataacccctgtgacctgcatgtatacgtccagatggcctggagcaactgaagaaccacaaaagaagtgaaacagccagttcctgccttaactgatgacattccaccattgtgatttgttcctgccccaccctaactaatcaatcgaccttgtgacattcctcccctggacaatgagtctcatgatctccccaccctgcaccttgtgtcccccatccctgcctgtaagagataaccacctttaactgtaattttccactacctacccaaatcctataaaactgccccacccctatttccctttgctgactcctttttcggactcagcccacctgcacccaagtgaataaacagcctcattgctcacacagagcctgtttggtggtctcttcacacagacgtgtgtaactaaaacttgcctaggtctttcactctgccttatgacccttggtcaaattctttcttctgaagaggcaagaattgaggttgctgccgaaccatatggatttgccactgctaacaatattgcaactaatgtttaaggaactaccatttgtcaagttttgaatattcacaattcttgaaaaggctattattgaattattgaatgcagaaatatatatgaaaatccagctaaattttattcagccaaacattaaaggaatatgaaaaaatgtaaagcaaccctactcttcacattcatattttaacaacatatttgtacaaaatattttaatgtataatgaatttattattttaaaagcaattcataaaagttttgaaaa

SEQ ID NO: 477550 - DNA, 588 bp, Homo sapiens
agcttcaagggcagcagatagaatggagttgacctcacaagtctcttggagccatttgaccagctcctgcttcattggtattcagacaaaaatcaactttattccagtggcctctgtactgctttcttctctgatgggtagacaaggaccttgcgggccacgggcactagctcctgcagggacctggggcgggacaggaagggatctctacctgccttgctctatacctaggaggaatatttttgccttcaaagcttggcctgcattttctggaattacccatcatgtgtgtctgttgaatcaacactggtgtcagagaatccgacagagaagagctttccaagagaaggtcaaaatgggtggtgatcaaccagtcaatgacatcatcatctgcccagatgcccatgccagaaacctggggattccctttggcccatccttcctctcacacactgcatctaaccagcctcaggttctgttgatgccaactccaaaataactcttggaatagatccacttcactgtgccccatagccaaagccccagtccaggttgtcactatcatacttagatgacccagtagtaccc

SEQ ID NO: 477551 - DNA, 725 bp, Homo sapiens
cctactgcctctatatagtccacctctgagggcagggcatagtaggacaaaaggcagcagacagcttctgcagacttaaacgtccctgtctgacagctctgaagagagcagtgttctctcagcgtggcattcgagctcagagaatggacagactgcctcctcaagtgggtccctgacccccatgtagcctgactgggaaacacctcccagtaggggccaacagacacctcaaacagatgggtacccctctgggacaaaacttcaagaggaaggatcaggcagcaatatttgctgttctgcagcctccgctggtgatatccaggcaaacagggcctggagtggacctccagcaaactccaacagacctgcagctgaggggtcaccaatatcaaagaccaaaggtagataaaaccacaaagatggggagaaaccagagcaggaaagctgaaaattccaaaaaacagagcacctcttctccaaaggatcacagctacttgccagcaagggaacaaaactggacagagaatgagtttgatgagttgacagaagtaggcttcagaaggtgggtaataacaaacttctccgagctaaaggagtgtgttctaacccatcgcaaagaagataaaaacctgaaaaaaggaaagatgaatggctaactggaataaacagtatagagaagatcttaaatgacctgatggagctgaaaaccatggctagagaacttc

SEQ ID NO: 477552 - DNA, 756 bp, Homo sapiens
tacagaatagaatacggaatgtggaatatgcaaagccattacaaagacaatgttcttcagcttgcaagacagtgaactgactaatattaagcatagctaaagaaataatgtgaaaatcaggagcatggtggtcagcttggggattagagtcataacaaatagaaaatataaggaacagttggcaggaccctccaaaccattgtccagaggagatgaaataatcccccttctattggtgggaccaatcccatcatttttacctcttaataccgtcacaatggcaactaaatttcaacgtgagttttggaggggacgttcaaataatagcagtgagattaaaggcaggggcccgatcatgggatggttgcacatttgcagagtgtgttctcatgcatttgattgtcacaacaacaacgacgacaacgatgaaaaagatctggctggagatggaaatttggaaagcatcagcttattagtagcagctgaagctgtgggagtagatgaagtcactcagggagagtatgtggcaattgaacaatgagaacacatggacacaggaaggggaacatcacaccccggggcctgttgtggggtggggggaggggggagggatggcattaggagatatacctaatgttaaatgacaagttaatgggtgcagcacaccaacatggcacatgtatacatatgtaactaacctgcacgttgtgcacatgtaccctaaaacttaaagtataataattaaaaaaaacatat

SEQ ID NO: 477553 - DNA, 600 bp, Homo sapiens
gcctctctctcctcctcctttctgccttcaatgttcagttgtcaccctctcgctttacccctcaaaccaagggtggggatgtcccctgcctggtgctggctctgggatgctgtattatcttttatggctttcatccaccctacccatatctttgtaaatagctcccttatggaactgccccaggtgtgtcccgtgtttcctggtaggacccttacttgtacagtcaaccagggacctgtttcttccaccttgtttcacagtattatcttcatgtgcatggggatagccggctctccatattcccacccaattgaagagaacccttgtgattacacggggcccacctggaaaatccagcatcctctccccatctcaaagccagttgatgaagaccttcattctgtcaactttccctttgccatgcagctgtgtgcctggttaaaatgtggagaagtcctattaccaaaaggaagaaggagtagaatggatgtcagacagcaatttccagcctgagcctcatgaggctcatgtgttcttgccagggtctgctttcagctttccttcccttcattgtgccatgccagtgcttctgcctaattg

SEQ ID NO: 477554 - DNA, 3102 bp, Homo sapiens
tgccctcgctgatttgacaggaggcggagctcaggtggtaattatgcagcccagttcctaacaggccacgtaattataataactctgatgcaatctgagaaattagaaggaaaggtcttatgggtacttagtgaggaggtggctatctgccacacaaaggaagaactttcactggataccaaccctgccatcaccttgaatttggttttccagtctccagaacttcagtctggagctacaattcacaatgcgaactttcgcaagctgctctgtttggagcttcaatctagtcctgcctcccatccacctgatgagttcaacagcagaacgtgtgggatcgaaagacaccggagaactgccaggcctgtgggccttaagccccatcacctccctgataccgaatacaaattacccaataaaacaaataaaagctttccaaagctgtatcatacatcatataaattgtttaaccctattcaaaaaacaagcattatgccagtcaggtagcaaaattaaataactgcatttgcaaaatttaaaagcaattgcttaaaacctagttgcaaattaatttctttccacatttctttcaaagctatttaataaagttaaaagttcacctcaaaaagcccaatatatgcccactttctttatataactttcatatgtgtatagcttttgttaatgcagttttacagagaaaatccatattccttcctaagccttcatctttgtgatcccaggtcttacatcaatggggactgggcttccccaggtagaaaaggaatgcttatccagtaaccatcaacatttcctcctttaatagggcagtcttccacatatgctaattttctttctctcatcatcatatttattctacaagtgagttaacatatcatatgctatggtaataagttctagataaatgaacaaatgtaatggaataattttttttctcttggtgctttagattttctatatgattgttgataaaacatgtcagattcacagccctggaaattaaaatctgtagtttacagaattgattcagcaactgggagagcacaagttatcatcgtcaccaaccaatatttgttgaactaaattttaaatatctcagctagttcagacataaatctctttacttattaactctttacagtcagagtactgttgcattaaatggaaattcatgaacgaatgaatgtatgaattaatatagatgcacaaactatttgttagctagtcatgtgctccaccagtttctaattcttaataaattcgggaaactcactatggatattttctcagggaagtactgactctggcggtacttgttgctgtgtcactcacaaatacaagtaaatactgaaaaattaaaattaaccatctcttgtaacatctccattccgagacaaagagagtaatagtgaagcatacagcattttttcaatggaaaaattaaccatgtgtaaatatgttacataattcaagagactttttctttctacacatggcttacacttgatttacttgaagactctttctaattcaaactaacttaatttagagcctgcaaactggagaaaactttgagaatattttaaaaagtgaaaaagcaagcatttaattatgatttctattaaaatttgagggcatcattaaccactgcatttttttttttttaactcacctcctggttccagctcatggctttttttgtaaaaccttctgtaacatactgcctccacaccacactcccatctcagcaaatgcctgctcctgggccagttgtccttgttcctcttttttggctacctttctaacttattcatgtattctgcagtatggaaaccagttgtttgaatgtatttttttctacaaatctgagagttcatagaaagaagggtcacaatcgaagacacctttgtaaacgtatcccctttgccttccacaggatctggcacaatgtggatactcagtcaatatgcatagagtaaatacatgtgtcttatgacaacatctgtcccttccaatcattactgccactcatatttcatcctgtgcttactttctggatagccccgtaaaacttttgattgctttgaggaaaaagttatactttttttttgaactaatattttcagatcttgggtacactaggcctaaatcccctaaataagcaaatagttttcagggaagcaggctaccatccagccctcattggcagagtctaaacttctctaatgaggcctggctgctattttgagccaagagttctgactgtttccatttagcagcaaaatccttagtcttcatcattctcaaaactccatttgttttccaattttttctcacattcctgacatcagccaaataaagtagttccatttcttgtccattttaatatcatatttttataggatattcatggatatcagatttttttgcatcttctctgctagctaaatcattatttctgcttccaatctgtagagaaaagttccattcccctggcttttgattttagttaagagcagccttctctattgtgaaatgctgatagtatagcatagtagatggatacacacctaaatgatcttaatgcagtttccagtgctaaatgtgaaatatgttaaggtaccaaataatacagaggacagaaagctgatctctgcttggtgctttcaaggactgactctagagtcagattaacaaagtgtaaagatccagaggtatgaaagagcctgtcatggggacttcaagaagttctgtgtctctgaagcattggagagttgaaagggtgttcaataattagggggatggtgtgattggcttcgtcttttagaaagttaactctggcagtatggtagaagctaagttaaaggggatgagaattatgagtgaatctgaaatcattctgaagtgaactccaaggcacttaaagataaaacagtaaaatggcagggttagggaattaaccattttctatcctggagaaaggaggacatttagagggttatacattaggaggaagggcaagaactctagggataaatgtgcacagaaatggggaagttgtaatcttgatggtagaacacc

SEQ ID NO: 477555 - DNA, 946 bp, Homo sapiens
tattccccaagcttcactcctttcaggagttgggttctgtgtgaggaaacacagggaccctggtggcttctgcctcctagggctgtgctgggtcctgccaagagcacttcttgagccctcacagtggtctgtgaatgaggcctttgctgtcagcttaatcagtctctgcagggtcctacagctagcagtaagcaggctgggactcacctgctcctgccatctgctctgccgtgtcctctccccatggtgggaccctttgggtctttactctttgccccagggggctggaaaaggaagtgtgcggtgggaacaagtgaaggcagcgtgagtggatgggactaatggaggctcatgataccccaggcagaggaggagcgagaggacatggagaaggtgaagctggacaacaggcgcatcctcttcaacctcctgccggcccacgtcgcccagcacttcctcatgtccaaccctcggaacatggacctctactaccagtcctactcccaggtgggcgtcatgtttgcctccatccccaacttcaatgacttctacatcgagctggacggcaacaacatgggggtggagtgtctgcggcttctcaacgagatcatcgccgactttgacgagctcatggaaaaagacttttacaaggacatagagaagatcaagaccatcgggagcacctacatggccgctgtggggctagcgcccacctcggggaccaagggaaagtcagcacagaaggcaccggagcttcctccagccccagccctgccctgctagacacctccccctagaaccctcaccctgcccctgctccattacctcccgcactggcccacctcctcagcagcccagtccctcccccaccagcccccaccttcctccctgcttgcccctctcttctcctcccatcagccttgcactctccttttccacagtagaa

SEQ ID NO: 477556 - DNA, 1144 bp, Homo sapiens
aaaaattagtccacaagtatggaaggggaagataggaagtggcttcggtcgaggccagaaagccccagttgcaggaggtggctgccagcaggctgtaacaggagagctgacagcatgcttggtccccctctgtcctgccgaggacgggccaggcgtcacagcctggtatgtgccctacttacagggaaggaagtccaggctcagagagggatcaggactcgttttgaacagccagtgctgttccccagtgcagtggacagtgtcgtgaggagaccctgcccaggggagcccgtgcagcagggcagctgcctctctggtgctgtgtgtgatgcttcaggaaggagcctggtgctaggcatcaatgttggccctgtggtggctggagtgattggcgctcgcaggccccagtacgacatctggggaaacacagtcaacgtggccagtcggatggatagcacaggggtccagggcagaatccaggatgaagcccttaaaactaagatggagattgtgaggggccacacagccctgcagccaccctcgctgggaactgcaggcctccagaggccatggagggaaggcttggtccccaggcacgtgacagcagctattcacgggggcagtttaagggacaggtgtacggttgagtggcattaaatatatttacatggttgtgcagccatcaccaccatccacctccagaacttcgtgctgtatatatatatatatacacgtatgtatacacatatacacatatatacacacacatatatgtatatatacatatatgtgtgtatatacatatatgtgtgtatatatacgtgtgtgtatatacatatatgtgtatatatacagcatgaagtgtaaatatatatacttatacttttttacaatgtactttttaaaatatacaatatttaaatattaatattaattttattaatatatattaaatatataaatatatttatatattatattaaatatgtaaatatatattatatattatattaaatatataaatacatattatattaaatatataaatacatatattaaatatatattttatatattatattaaatatatattttatatattatattaaatatatattttatatattatattaaatataatgcg

SEQ ID NO: 477557 - DNA, 640 bp, Homo sapiens
gtccaggaaagttgggatggctgaacaacagagggccaaccttgttcctggggaatggtgagtacattttctagcaagttccttgggactcctgaccaatgtcagcatgtccgcaatgccccatctagattctgccctgaaagagccaaacaggagagcagtagtgtctgccacatctttgtggaatcctgcccttttgcggtcaacctcaactcagggaaagtaaaaagattaacgtttcactgcacagccaataagcccaagacttcagaggactggctgtatctccagatttgcggaggggggaatggctcactgtggataggtacactattctgccaaaaggcaaatgtctgccaaaacacagactctggaaaaatctgtctaggtgcttctaataccttctgtgtatgctggttcctagcattgggagtgggggaagatgtgtctctctgagtctgggttggaaaaatatagaatggcaaagtcctgtgtgcccaggggaaaaaaagaagtccatgattctgactcctttagggagaacaaacgaaccctgtgccagagattcacctctatttcccagagatattgctttccaaatctgccttctttcaaaagctgtgcagaagtacctggctga

SEQ ID NO: 477558 - DNA, 696 bp, Homo sapiens
actctcctctttgcagatagacatgctgcattttcctcctagaacacagattgtcccctatgcagcttgggttgctctgccgtcacctttcctgctcctcagcaaagtagaaggtaaagccgacaaaggcgatttttacaaccacaccaagaaaagtcgacctgggcttccatacgccccactgactgcaggggtgctggagcgaagacaggccttgggtgaactaaatgtggcaatctggcttctggggccagtcaaggaaggtcctgcagtacccacagcagtcagagagcccaaagaactctccgatgctccatgtagctttccaattgataacttctgcactggtgacctgccctggggccaaggcaaaggtagaagagaacaaaggaaggaggaagtaacttgtggaatgctgagaaaggtaaaaacacctttaaataaggaagaggaacagactatgacctactgcttgcttggaccagtataagtatgctagggcaaatatttaggctaaactgtgggagctaagaacataaagtacattgatttctttatcaaggctagcagatatttaagaatgttagcacaggtctttgaataaattttgcttctaagagaagttactatttattcctaattaaatggggaggaaagtctttgaagaggaacttttactttattttttacaatggt

SEQ ID NO: 477559 - DNA, 525 bp, Homo sapiens
cgacaacatctgtgaattgggatgagccaaaccccagtgccgctgtgtccccactttaagactggagcagccagattccctctggcccccactaaaccgctgaattctaagaaggctgagtgtctgacatccctcagggagtaccaggcctccaaccccaactgccagaccccacgtctctgctttcatccaagtccacacatagaagtccattcagtcttttattctctatgcttatcatgggctgcgctgcctctcccaaacctaaccacccccaagtcttgccatggtccagtctgtaattcccagcccttcattactccattctctcatagttctgggcccacatctcctgtctgtgtctctccctcagactgttctctgagctctagacggcaggtgcagtgctcgcagacttgtgcatctgagcagcctgcaaacatgacccaaaccagcacagcccgagcaagctcgatgtctgtgccctgacgtctgctcttcctaggcgctattgttagtgttggc

SEQ ID NO: 477560 - DNA, 607 bp, Homo sapiens
aataggaatcagggatgctcccaggaaggaacctccttgtgaagtttaacttgctagctctcaaaaagaaaaggccatttaggaaagttcacagcagggcagccccacaagggaaggaggctgcccacacccgccagcaagaggaagcccctgtgctgaagttcctctcgagccatatgagggtaacaggctttttctgcacagagatcaggataagaaaaggaaaaacatcccaaggcctaacagtgaaggcatctgttgctgaccacactgagggctgtggcttctcttcagacctggactgggcgtatcttggtattaccacggcctatgattcaggtcaatggaaagctacaataactgcaatggaaaactacaataagtcaatccaggcaggaatatgggtcagaccctttagcaatgaaggcttgggtcaccccacagaagaagaaatgaatgctcatatcatcttaccatgtaaagatatttattaactttttaatgtgattttcattctatgtgcagctttctgttctttttgtaccgaacattatatgatggtcatttttatatatttttactaaaaaccattcataatcattacttg

SEQ ID NO: 477561 - DNA, 3062 bp, Homo sapiens
tggaatcgaatggaatggtttggcatggaatggactcaaatggaatggacagtaacaaaatggaatggaatagggattcgaacggaatgcaatggaatggaatggaatggactcgaatggaatagagtcgaatggaatggagtcgaatggaatgtaatcaaatggaatggaatcaaatggaatggaattgaattgaatagtaaggagcagaatggaatggggtgttatcgaaagatatcgaatggaatggaatggagtggaatggacttgaatggaatggactggaatggaatggactcgaatggaatggactggaatggaaatggacacgaaaggaatggtctcggttggaatttattggaaaacaatggaatcgaatggaatgcaatagtatggaatgatatcgaatggaatggactcgaatggaatggacttgagtggaatgaattagaatggaatggaaacgaatggaatgcaatggaatggaatacaatggaatggaattggatggaacggaatggaaaggaatggttgaaatggattcgaatggaatggactggagtgaaatggattcgaatggaatggactggagtggaatggactcgaatggaaaggaaacgagtggaatggaatggaatggaatggaatggcttgaaatggataagaaatgaaaagaatgtaatggaatcggatggaatggaattgaatgtagtggagtcgagtagaacagaattgaatggaatggcatcaaatggaatggaaacgaaaggaatggaattgaatggactcaaatactcgaatgtaatggattgctatgtaattgattcgaatggaatggaatcgaatgggatgcaatccaatggaatggaatgcaatgcaatggaatggaatcgaatggaatgcagaggaagggaatggagtggaatcaagtggaatggaatggaattgaatggaattgaaaggaatggaatggaatcgaatggaatggactggaatggaatggattcgaatggaatcgaatggaacaatatggaatggtacccaatggaatggaatggaatggaatggaacagaatggaatggaatggaatggaatggactcaaatggatggaatggaatcgaatggagtgaaatggaatggaatggacttgaaaggaatagactggaacaaaatgaaatcgaacgtgcaatggaatctattggaatggaatcgaatggaatggtttggcatggaatggactcaaatggaatggacagtaacaaaatggaatggaatagggattcgaacggaatgcaatggaatggaatggaatggactcgaatggaatagagtcgaatggaatggagtcgaatggaatggaatcaaatggaatggaatcaaatggaatggaattgaattttatattaaggagcagaatggaatggggtgttatcgaaaaatatcgaatggaatagaatggagtggaatggacttgaatggaatggactggaatggaatggactcgaatggaatggactggaatggatatggaatgatatcgaatggaatggactcgaatggaatggacttgagtggaatgaattcgaatggaatggaaacgaatggaatgcaatggaatggaattgaatggaatacaatggaatggaatcggatggaacggaatggaaaggaatggttgaaatggattcgaatggaatggactggagtgaaatggattcgaatggaatggactggagtggaatggactcgaatggaaaggaaacgagtggaatggaatggaatggaatggaatggcttgaaatggataagaaatgaaaagaatgtaatggaatcggatggaatggaattgaatgtagtggagtcgagtagaacagaattgaatggaatggcatcaaatggaatggaaacgaaaggaatggaattgaatggactcaaatgttatggaatcaaaggaatggactcaaaatgcagtggaagggaatggagtggaatcaagtggaatggaatggaatggaatggaattgaaaggaatggaatggaatcgaatggaatggactggaatggaatggattcgaatggaatcgaatggaacaatatggaatggtacccaatggaatggaatggaatggaatggaacagaatggaatggaatggaatggagtcaaatggagtgaaaccgagtggaatggaatcaaatggaatggagctgaatggaaatgaaaaatcaaatggaatggcatcgagtggaatggactcgaatggaatgtgctcgaatggaatagaatcgaatggattgatatcaaatggaatggaatggaagggaatggaatggaatggaattgaaccaaataatggaaagcaatggaatggaacgcactggattcgagtgcaatggaatctactggaatggaatcgaatggaatggtttggcatggaatggactcaaatggaatggacagtaacaaaatggaatggaatagggattcgaacggaatgcaatggaatggaatggaatggactcgaatggaatagagtcgaatggaatggagtcgaatggaatgtaatcaaatggaatggaatcaaatggaatggaattgaattgaatagtaaggagcagaatggaatggggtgttatcgaaagatatcgaatggaatggaatggagtggaatggacttgaatggaatggactggaatggaatggactcgaatgaaatggactggaatggagtggactcgaatggaatggaaacgaatggaacggaatggaatggattggaatagaaagtaatagaatggaatggaatcgtttggaagggaatggaatggaatggagtcgaatggaatagaattgaatgtcatggcatcgaatcaatggaatggactcaaatggaatggacttgaatggattagagtggaatggaatggcaccgaaaggaatggaatggaatggaatggaaaggaatggaatgtgcagaaatttaatggactcaaatggaatgcagtcaaatagaatggacacgaaaggaatggtctcggttggaatttattggaaaacaatg

SEQ ID NO: 477562 - DNA, 551 bp, Homo sapiens
gcaaactggcgtctgaagaccagaaaaccatggatatattcatgtggcttaaaccagagggtgtgccagaaaaatgttccaaagacccatgtggactgagtgacacatcagctgggaggggaccaggccatgcacggaggatccagagggctctgacatgcctttcccttgctaccacacgattatatcagccccagcctctggggagagagagcaagctgggaagatccagcattgggaagagaggaatctgggaagatccagaggaagcttggaagatcctgaggaagcttggaagatcctctggagagagagaggaagctgggaagatgcaaaagaactcaggaggggtaggagatccccacaacatcatccacctactgtccttcctttctgtacctccatatggatgtaacgatgcgttgatggatatgaatgaaactgggcattctgtgacttattgatttgaaccaacactggttaataaagcattcatttaactcattctctgttatagctccctctactgagggccatggctcttctctgaa

SEQ ID NO: 477563 - DNA, 523 bp, Homo sapiens
tactcatctgtgaaatggggataatcatagcccttatctcatacatttgtctccttgtagagtactttataatttatatatttttaaacaatgtccgtggcctaaccctcggggaccttctcatgagatgtactaggacctctcgactacagaaagagactcaaaggtctattagtgattgtcagaggtgggatcccacgggcacagggacatctggggccctaattgagaaacgtcagcccaagtctgagcgaaacctctactggtcagcttccactttgatattagttcgcttatcagacatctttgaatctaaaaatgatcctcagagaccacagaacaaataccagcaaccaacccatttcacacttctgaaaaaagagagaaaggaatggcaaaggctggccaaagcaaacaggctttggaaagcttgaaactgtgggctggaattttcagttgttcctagtcttttcacactcattttggggaactttctccactcagaagcgcagaaactttttgc

SEQ ID NO: 477564 - DNA, 563 bp, Homo sapiens
tcagtgctagatgttcttgactcacagctggacccttcagagaattacttgctatcaggagctgtgccacccagaatggcctgggaagctgcattctctccagaagtctgtcagtagccaatggccaactaacacaagggcagaaaagtttggcacccttgcctcaaggtgggaactctgtggttccacgcaggctccagagctgcctcatttatcaattatactacacaactatagtagtagtgtaaataactcctactacagccattttcaagctgccaatgtgattgctgctgaacacaaagttgaaaagacatgcatgcaattggctcatgggagtcaaacctcaactctcaatgacagcttcattaacctctggatgtaaaatttagccaatccttatccagagaaggccagcattcaaggtattgaatgaaacatcattcatcaattcttcagcggattgggcacctactgtgtgccaaccaaggttacgtgtaatttcaagtaaggaagaattgctatcttgatggttatagacttgaaactctaaatcaaatact

SEQ ID NO: 477565 - DNA, 685 bp, Homo sapiens
accttattcctgatcttgtagatgtttgttgtctttctgcgttttgcatacccttttcatgcttatctcccattcctgtctctgcaactaggggctctcattttcctcctgggaatgaaagccaccagtccagttatattcttctcatggagatgggcagaaatgcaggagaatgagtgggaatgtgccttcaacgaattagatgaggtctacctaacattgagcattgagggcggtgatcttctttacagcctactaattcaaatgttaatctcgtccagaaacaccatcacagacatacccagaaatctcaggaaagagattccaatacattttgaaagtgaggaggaaccaaataggtacacttttcaagtactttatggttatggtgccctttctgaatacttggtcctcgatgaaatgacagaaggtgttcatgaatttgtggtagaaaaaagcaagttaaacgctgtagtgcaagatgataaaaattatggaaggacatgcacagatttctagaaacacaaacagtgatgtgctaataaatatttaaccggctcacccctgatgtctgccaatatccttgagggcttttcctggttatgccttcttctgggctctctgagaagatggcaagcctatcaccaaaacatacatgtggcgggtaacttctctggttgctatc

SEQ ID NO: 477566 - DNA, 666 bp, Homo sapiens
aaccactagacctgattatcactttgcaggcttggagagctgacactcctctatcagagtcagtgtttctacaagaacataaacaaagggcagccagctcgctaccaagacccggctccacagattttcctgagagtcatcaggtagccctgggtgaaagaagaaagtccctaagatcagctccctctctacctgccagaggtgttcccaatacctaagacaaagccagggacatgatagatcgttcaaccttacctcctcccacaaggtctctctttcatagtgtttgcctactggagaaatttctcgaagtggatcctggagtgtcacaagagcccttcacaaagccattcctacaacaaaacgtggcctggcatggagctctccctccttgcttcttgtcccagagtctacgggcatcagaaagtgatatgcagggagatcccaggggcttcatcagcacgttcagagccaagtcacaggggtcaatgtttttccccatttctgctcataatcagggaatccaagcagagatggagacctgctatgttccaggaaccatgccagggatctgcataaaattcccagggaaccagatcaccgaagttaggaggaaccatgccaagcaggtgagatacagctcagtctaacactaattcacacaac

SEQ ID NO: 477567 - DNA, 510 bp, Homo sapiens
caatttccacctatgaaaatgattgttaatcttgcatatcaactttggagaaacgacgtcccattcttcagcctcaaaggtggtcgcacctggcagaaacagcttcagttctggatgacagccctgcaaggccactcagccccagctctcacctctgcagctggaaagacagagatccagcaagtggcttcttgctggctggctcagagagtcctcctgctggctcctgccacagtccagagcaggcagagatccctcaccagcctctggctctcttctactgggctgcagtgcctgcacagcaggaatcctagcctggccacgctctggcctggactggtggattcagagcattggacttctcatgtgggaatgaccactttccagtttttatgcctgaagaaggggcagacaccaccagacactgaccccaccccacccctcataatcagaaggtgtgacttgagcttctcaaggcctcagttttcttatctttaaaatgggaatcat

SEQ ID NO: 477568 - DNA, 1068 bp, Homo sapiens
gatgaggaaactgaagttggaaaataggcatataaaaatcttggctggcagaactagccacccagaaacagtgcccccttgccagagagggagctggcaggacccagctccgcatcaccttccagcacccacttgctggaacctcattttcgaggtggcagcagaacgtgtggtattcccaccagcaccaacatctggggcagaggtggaggtggggcctttattaaaatgcagtgactccattggcaccaaaataaacgtgacatttatcagaacctgctaaatctattcagcgcttgcttcctttggaagcgcagggttcatgccgtgggcctggagagaaaaggtctttgctgtgaagaagatttctgcttccccttctgccgtgattactatatgcttcctggcaggcctgtggtgggggctaggcctcctcaaatgttcctgctgctgctgctgttagcagtaggcagtgagaggtacattcagcgagtcatggacccacctcgaagcttacattttcccacctgtctacaaggatatcttgaaagcatttctgctgaatggatgcatgcttcattctggatccaaaatgtggaaccccaggcacttctgggagtgcaagatacttgctgttggcagttagaaaaccatgggcttaagcagttcgagagcattgaaagagaacttgatggagctaaatctaaatctaattatcatgctgaccaatctcaggagagccctctaaccaatgatgttagtaaatggttaacaaccagctctctgaaaaaagaaaagtcctcatagcatgtgcctatttctttggtgtaaatactctaataatggccgactttgtgagttaccaacatgatgttaaccagcttgcaaatttcctgaaaacgttaacagttggctcttgggagctgatatgaactgactccagcaatactacagcttccaaatcttcaaatactttgcaagatttggattttcaaactttggtagcaggcttcctaggtatcagatgaaagaaatgggtaagagtgtacagataacttgaatatcgca

SEQ ID NO: 477569 - DNA, 512 bp, Homo sapiens
agcacacgtacaccagccacagctatatgaccccctgccagagtatctatgttaatcttcagagtcagaacagtaaatctataaaaaggaagaggttttcctacctgcctccaagagctcttattctggaggctgggaagtccaggatcaagatgccagcagattcggtgtctgggcagggtggtaaaggtcactggtatccccgggctcaggcaagtgtggagatgggggtttgtctccagaatatgttagctctgttacagtcctctctatggggcccaaagctggctcagtttctagaagagacttctccaggagccctacatggcaagaatggtgtctatcctgcatgggaacagcttcccccgggcagcagccacagttgctgaatccgctgtttctgagaaagtgaaatttcagtccctccgctccctcttatcagcggggctgtcagggcatgtggggaagggtcagccaacctcccatgcctcttggtagaaagtggacattct

SEQ ID NO: 477570 - DNA, 723 bp, Homo sapiens
cttgaagaaagagatgatcagaatggcgtttccaacttcaagagtaccctctcctgtggttttcatgtgcaaaaatgtgatggcttgcttcctgaggctctaccgctgcagtcccttagtccttgctgactctcacctgctcccggactgggcgagaccctcccagcttctgctgctgtctccagttgtccctccttgcttcctcgtctgcagcttcactcctgaagccagtgagaccacgaacccaccgagaggaacgaacaactccagacgtgccgccttaagagctgtaacactcaccgcgaaggtctgcagcttctttcctgagccagcgagaccacgaacccaccagaaggaagaaactccaaacacatccgaacatcagaaggaacaaactccggacacgccgcctttaagaactgtaacactcaccgcaaggaaaaagggctgttattgggaactgggcagccaccctgccctaaccctcatcctcctccaaagagaccaccatgggcttcacaggcctcaaggtcagtgctgacgatgtctcctctagacctgacaccctggaaaccttcagtttactcgggcacctgcagcccaggtcaggggccataacacatgatgggcatcgatgggaaatatagtgctggctagctcagattttcacaggagactcctcacaggctgggaaacatgggaactggtccacccttggatatc

SEQ ID NO: 477571 - DNA, 1098 bp, Homo sapiens
cgggatattgcggtcaacaagacaaagcccttgctttcatggaataggcgaaagactaaatacaaggggcaccaactatgttccagatcctgaggatctccaattttgccaagctgctggtgagccgtccaggggtggcatggcagctgtccggtaccttcaggaatccaggcttcaatgtttttgctccattatccttagctttcattcccaaggtcacttcatggtccaagatggctgctggagcaccagtctacatgtccttggaaggaaaaaggaaaggcaaagtggaaaaagtggaagagggagggcgtgtggcagaaaagatactgggacacacagttttaacccagtacctccctacacactcacatattgcagggttacctattgccctcactccttctgggcataaccaggagaaaggcatatctgggtcaatacagacaaagtcagtactggcatggctctgtaagctaagtaagattctggaaagatccattggcatacaccagtacaaagtacctcaggcaaaaccgagtcagggttaggagctacaatcaaataaaaagatgattgagaagaaatgacaaagatccaggcagaatgatctgttttggtaagttggtccaaattgtggagggagagagagagagagagagagagagagggagacagagcagaaacagggacagagagatggagagagggagaaagaacagggagagagagagagacagagaaagtgtgtctttgtggtcttagaagggtactgtttattataattgaagggtcagaggcaaggcagataagggtagctcatgaatgattagatggagggttgaataaatggataaattgatgcatggatggttggtgaatgaatgaatggataaatggatttaatgaaattaggatggatggctgatgttactgataaatgaatggtgggcaagtgaatgattagttagatgaatgaacaaataaatggacaactggattggatatacgtacggatagaaagatagatagacagacagataaataagtacatacatacatacattgtgagtgaatggatgaccaaagtgatggatt

SEQ ID NO: 477572 - DNA, 521 bp, Homo sapiens
ggtccctttactattatgtctgagaaagaaacaaaaagaatataaagaatgttagtccaaggaagtccccccaaaactgctggaagtaggcatagagcacaagagatccaggttggagaaaaacaacaagagatctccaggagagatttctccatgaaaaacatgcacgtggacagtttggttgaggcaagcaggaaatatgctaagtgtagacccaaactccctggaagggtgagctctcctaggtatgcatttaattacttaatatgcccctggcattatgaggaagttacaaaaggcagaaatgggacctcaaactcccatgagtcaactcttgtacatggccattgggtttacaacaacagggacagagcagaggaagcagagaaaaccaaaataaaaagccaaaaagcccagttgttagtggctgccttaagccacctgctgcctcgaggttattcatcccagggaagtgttgcaagatcggtgtctgggctgcccagacgatagcccccaacttg

SEQ ID NO: 477573 - DNA, 755 bp, Homo sapiens
tcttaactgctcagtttggctctgagctgcctggacaagtgggaaattgtgtcaattgccctatacgtatccattgggatcttagtatggtcatgtttgttgcctgatttccaattgcccgaggctttctctggcagccagagcccactctgctagcaaagcacagcaggccagaagtaccagacaataaacactctctgggagaagccctcaacaagtgcgttatgggagttggtggatgtattaagcatcctagatctcttaaccctcagtacttcctgtgggactgggctctagtggctcacagcaggaacctgctcatgaacatatgcttgattggctttccctgcttcaccgcttcctcactggctacagaaaatcaccagcatccaagtccttatctcaaggtctcctttgaggaacccaagacaattgaagataatagaaaagtggttttggacacctttggaaatggaggacctgagataaatggtcttcttgacctgtgcaatcataatccttcttttaaacacctggtttatagtcaccaatttaatgtgactattccttatctttattctgggacacttcctactctcctcggactcttggataaatttagtgcaaaaaaaatctctttggacagacttgtggttaacaaagtataaaagaggagggccttttagtatatctgttagatgattacgtgttcttcctctttgggtggaaagattttccctccaagcagctgcatg

SEQ ID NO: 477574 - DNA, 654 bp, Homo sapiens
tcttttctcttaacgctttaagtttctgcctaggtcctgaagaaagaaatttctacccacactttcagccccctggagaggaggaatggctaatggggtcattcagggggtggcatttactgagctccacttcaccgatgggtggtgtgccatatacccttgccctcccttctgccaggttgttcattttctctgtcgagttataggtttgtttgaaaaaaacaaaacagaacaaaaaaacctccgatttaagcaaaaaggacccgacccagtggggtgtggagaggagtggctgcatgcatataggcctaacaactggactcccaagttgctaacactaatgactgactcaccacaaagccagaaacgggacatggatggaagaaggaagacagaaggcaggaaggccagccaagaggcttttgcaactgtccaggtgaaagatgacaatgaaccacaaaagagatccatcatgtggattaggaaactgaggctcagtgagtaagttggccattttattactttacatcattaaaggaaaggagtcaagggctacaaagaacacattcctagtcataggaggagatcataagagttggcaacaggaaacacatgtatttatgaaacatgtactaatatgccagctatcgctgt

SEQ ID NO: 477575 - DNA, 853 bp, Homo sapiens
cctgacagtgtgttctgataccttggagcagggctctgccaagcaggggtttttctgacagacagtatgcagctgctattcccttccccactgtcctctgcagagctagctcatggcccattttccctgctgttcctaagcacaccaaaatcacagcagattcacagagactccagcgcagccacatggtggaagaaaatttataaaccaaaaaaggaaatgacgtacagacatcggcagagaggtacagaaacagctggattggttccaggagcattttgtcactttctcttctatggagggaaggggccatattctatggcctcggatgatgttaagaagtcaggaattacagctcagctagatccttgccatgtgaaggacagaatgaatctaatacagaaaactgcacccagtggagagagtgcagatggcatgagtgtctggctgcagctgcccttgacacgcagctctggggaggggatctcattcctatagttatttgagttgccccattatccttctaataaattcccaagatggatcactctctgtttggagagagaatttcaaactctgtgctttctgtatggtcctatctcctcagtatctatgaggactcttgaagtttctggcatgtatttatttagcaaatacttattgaatacctattattttccaggtattcttctaggtacttgtgatccatcagtgaatgaacagatagataaatacccctgtttttttaaaaaaaattatttgcgatagcggtaaaatatatgtaacataaaatttaccatattaaccactcttaagcacacagttcaatagtgttaagcacattcacactggt

SEQ ID NO: 477576 - DNA, 722 bp, Homo sapiens
tgaccttgactctttgagagggagtcctgtactatcagccatggtcaaccccactgtgtccttcgacattgctatcaacaccgagtccttgggctgtgtctcctttgagctgtttgcaaacaagattccaaagacggcagaaaattttcatgctctgagcactggagagaaaggatttggttataagggttcctgctttcacagaattattccagggtttatgtgccagggtggtgacttcacacgccaaattggcactggtggcaagcccatctgcagggagaaatttgatgataagaacttcatcctaaagcatacaggtcctggcatcttgtccatgacaaatgctggacccaacacaaacgattcccagtttttcatctgcactgccaagactgagtggttggatggcaagcatgtggtcttcggcaaggtgaaagaaggcatgaagattgtggaggccatggagtactctgggtccaggaatggcaagaccagcaagaagataatcattgctgactgcagacaacttcgataagtttgacttccattttatcttaaccaccagactattccttccgtagctcaggagagcacccttccaccccatttgctcgcagtatcctagaatctttgtgctcttgctgcagttccctttggattccatgttttccttgttcccttccatgcctagctgtgttgaagagttaagtttatgatta

SEQ ID NO: 477577 - DNA, 912 bp, Homo sapiens
tgtttcccatgtgtccggtgagggcttcccgcttgtcaggaatttggctaagaggcttaaacaatgaggttgcggagttgaaaccttttggtcaagaggccttggtgggctggactggttgttttaagacgtgtgcaaacgagttagaaggcagaagaggacagtgtgggggaaggagaactgccttcacaggctggggaagcataaagagaaaacatgccagcatgctgtatgattttcaaagcaccatggaaatgcgggtgttcaaagattttagattagaagctatttgtggaaaagctgtatggagcaggagtcagaggtgtgcatcccattttggagagtgctgtgttctgctagatctgcctgagattggctgtggcagtgaagtaggagactggctggacttcttttctggtcataaccctgctgaccaaaacaggatctgctttggacaggataaagtgaagaaactggcagaaaccagcagatgatgaggagggcaatccctggccaccaccgttgctcattagtatgcgacaggatcatcacagtttacaaatgccatggcaacaacttagtagttaccacccctttccatggcagtgactcagaagttactgccctttcctagaaagttctaaataacccacccctcaatttgcgtataactgaaagtaggaataaatttaaatttcaggaagggaagccagttacacagagcatgagatggcacagaatactgccacagaactagatgcacaggctcctaggatgcctaggatgagaaaagatggcctttgccactctcttgggagtcgttatgcaacaccttgccacccctccagttgcaacaccttccccacccctccatgactgttttggacactctggcaactaactggggaaaaa

SEQ ID NO: 477578 - DNA, 3184 bp, Homo sapiens
tatttactaagctctattgatggtgtcttttcagaagaaggaagaggatgtggggagtcatgcgcgagcttccaccaggaaatgataaacatcacttccgctactgtttcatggttcaaagtaagtcctacctaacttcaaagagcaaggagggccggcatgccccccagagcatccctggaggatggtcagacagcgatggggagctcactacctctccagacagttcaattgttaggttgcacaccgagctgaccgcctcctcataccctgtagcagttagtgtcaacactgtgccctctgccccaggcacctcctgcaggttaaaggagatcctaagcatgctaaactcaagctgtgtgtatgtggcgttagtagcccccatgggcttttgggctctggctcagggcttctccatgctgaccacctctgtgggccaccccttgcccaagggcttctctggtctcagccgtctgggcacctgccaactcctttgactcaaggaccttatttagaaaactctcttcatgtattttaaagttgattccctggttttttacttctcttggcaattctcatttttctagaaaagtgtgctgttatggactgaattgcatccctctcaaattcatatgttgaagcctgtgacccccaaatatctgagacaggtctcactgtttacaagaaaccaagtctttgatttatcagttctatggatttttatgttttctatttcattagtttttatctgtatttctgcttctctccctgggtttatcgtgttgcttattttctagctccttaagttggatgcttcatttgccttcagtcttccttgttgaataacagaaacatttgcagctatggggcgtacttcggtttcattccctaagtatggctacgtggagttccaattgtcatgacgttctgaatggcccataactgcagttttgttcctttctttgattcaagttatttaggcataaatttccaagtgatttcatttttttgttgttgttgtctatccttttgtttttaatttctgtttttattgcacggtggatagataatgtggcctgagaaaacgatggcttgttagtgcctgtgaggtgttcttggtggcctaaaatgtcatcagttttggtcacttccttacagatgtttgaattaaatgtcttccctgtttatacctatttattaaatgatgcttgtttttccacgctggcattgcttggaatgtgagtcctacaagctgctctggggattgtcacactgtaccttctcctggggaatctcagtggacatcagcacagatccaagaaggcctaaggaaaagccaaccatgaacctttgcttcactcagtgtctcccaggtgcagccttttctctttagcacctgttgctacctctaccagctagtttcctgtggaactagttgagaaaactctgttttaaggttttctcgtatttcttggggagtaactatttgttaagggtcatcagtactcatttctcagaactaccccacccaaggggtgggggagctggggcatttacaccccaaccctcaagagagtcatttgttaaaagctatttctggggttgtgagataggaggtgagacttgactccagaggtggggctcaaacactggtctagattgaggactagctaaaacagggctggggtgaaggcagctttcaatctgacacagccaccagtgtgttaagtcagtttactgttgccatggcaacacccagggttaccaccccttttcaaagcaatgacctcaaagttaccaccctttccttagaaatttctgcataaactgcccctttatctgcatgcaattaaaactatgtgtaaatacgattgcaaaagtgccctgagcagctactctctgccaatggggtagccctgctgtgcaggaacagtcacagagctataacaccgtcttttcaataaagctgttttcttttacctctggcccttgaattctttcctgggcaaagccaagaacccttgtggactgagctccactttggggcttgcctgccctgcatcataaggtctttggcagttccatcctgtcaggcatgggcagttctgggagcaagagcctcatttctagttgcagaggctggaagtggaagctggccagagcacactgaaaagtcacagggatacaggtggggtgcaggccacttgtgccatgggtccctccaacttagagattcatgtcttcttacttggtgacttacggggtagtcagtcccacaaatgcttaaacagccagcattttaaaaaaagcatccatttgtagcatctgccaatttccatgttgtcaatattcccaccatggccaatttcaagctaccagtggtttaacagcagtcaacaggcgaggaaaacagaacttgtctcaaaaaataaaaataaataaaaataaaaaagcagagattagagaaatctgcccagagaggtggtttatagaagcccacccacacaaagccatggtctaagcacagctggactgtacaggaacccaagcacacagcaaccaccattctcaagcacaacaggaggatcccctctgaaagaccagggcaggagaacacatcccagacagaggacaggaccccctgccagcccttgccagcccctcccggcccctctcccctggtgagggccacactgctgcagagggtaaggagaattggattcaaaacctaatagactggtggctttgaacaaaccagtgcccctccagtgcaggcttctcatctgtaaactgaagactgactagaagatcgtattaaacactgccgtgctcagggcaatcttttcctagactacgcatttagcaaaagtgaagctgattgaattgagaagtaaattctagccctattgtttcagctatcctggtctttcagccttgtggaaatgtgatttcattcatagaaatcgcaaaacaggcacaagtcatctgtgatattagaggtcaggatattggttatgggggtttgccatttttgttgtaaaatagaacagatagaaataatgcagcagggaggtgaattttgaaatattgtatatttcaaaatagccaaaagaggattttaagtgttcataccacaaagaaatggttaatatatgaggtgatggatatgccagtttaataccct

SEQ ID NO: 477579 - DNA, 675 bp, Homo sapiens
acagtggcgtttattcagataaatatgagagccgtgtgggactggctgtatgatgacggggatatcctcccactgaatatgcctattacccaggtcatgaaggcttctcaacttgtcatccgtcatgggtcttacagatgccactccctgctgggaaccagaaaaggatctcctgagggctgtgtcatgggccatggttactcatatttggctcagaataaatctcttcaaatatttacagagtttaactctttccatggacatgggggagcacctgttggagacacagcatctcatcccccagacctgctgaatcagaatctgcatttcaagaagatccccaggcagttcgcaggcatgtgcacatttatgttgacaaaaagagtccaactctgtcaaatatttgaagagatctattctgagtcaaatatgagtgaccaatggcctgtgacacggccccaagagaccctgagaacatgtgcccaaggtgatcaggctatagcttggctttatacagcttagggagacataagacatcaatcaatacaagtaagatgtacattggtttggtccaggaaaatgggacaactggaagcatggggtgggggcgcttccaggtcataggtggattcaaatattttctgattggtaattggttgggagtttatttaaaga

SEQ ID NO: 477580 - DNA, 737 bp, Homo sapiens
gacccggaatttcaacatgtggtctctgggcaagatggaagagcagaaaaatacagaaagaaaaatttacaaaatacagaaagagccccctctgctggagaagaaatctccacccactccacctccagccccgactcctcagcctctcccacccgctccgccgccacagccagccctgccctcaccacccccgctggtggcccccacgtccagctcaccaccgccaccaccgctgccacctccaccagctatgccttcgcctccactgccacccccgccagccgctgccccaccggctgcccctccaggggagcccgccccccatcccccgaggacgctgagctgccggacacctggcctctgcacctggccaagaagcaggagacggcggccgtgtgtggagagacggactagaaggctgacgagagacgagttcgtcatccgcgcagaggacatcctttccctcaaggtttgcattctgaaagagtggcccaggcagggtgatgtctaacccagggatggcaaaggtgtccacatgccatcatttcttccaccagcacccatatcacatgattgctgctcctttccattagcccatgtgtggccacagagccctcagcacagggctccaggcagctgctacagctgcccattgattggggttgatagatagatttgctacccctgatttaactcaagaaataaaatgctaatggtgaaaagtcagacctggcagt

SEQ ID NO: 477581 - DNA, 486 bp, Homo sapiens
ggctgcctctactctattattgtacaccttgaagggtctaggctgtaaagcatctcagggttgctgccaaatgagccatgaactgggctggatttttatatttgatgaaaaagagcctaaacgctatctgatgtgggataaagaaaaaggagcattaaccttgactatggctttagctccagccacctttttaagagtaaattgctgggcaggagatcatgtatggttcttccaagattgccaagtttatgagctaggaaccctccatgcaggctctgaacctggtggagctcttccttgcagtcaggctcctcttctgcagggctgctgcagtttgcttgtggtccactccagttcctatttgcctgggtccctcccatccctggagttatcaccagtggaggctgcagaccagcaaagatgccaagctgctccttcctctgagagctctgtcttagaggggcactggcctgacgccagctgaaa

SEQ ID NO: 477582 - DNA, 3045 bp, Homo sapiens
tatctggagaaaagtcgacctcatggaagtaaaaagtagaacagcagttactacagacactcaatgcagacaccttcagagtattgggaaaagacttgccttctgccagaacttaacccaaatacacacagagagcaccatgaagccctggattcttctactcgtcatgttcatctctggagttgtgatgcttctgcctgtgctgggaagcttctggaacaaagatccctttctagatatgataagagaaactgagcagtgctgggtacagcctccatataagtactgtgagaaaaggtgtactaaaataatgacttgtgtacgtccaaatcatacatgctgctggacctactgtggaaacatctgcttagacaacgaagagccccttaaatcaatgctaaacccctagattctattggccgatcactactgtgggctgaaggatgaccatctggtctaagaagagtgctgcctacttccttcttgggacacccactggctctagctggtaacctttctgctatttccttgacctctttaccctgaagcttttgtcaaataaactgctacatcaacctgagggctctgcatatttttttttaacttcctccctatgacttaatttctctcattgcaatcctcagcagtcccaacagttgtttccactcaatcatgggcagaggtgcccagttctgccttcccagttagacccatgtatgaaccagtttggttaattgctggagcaaatattcaagcagatttttacaaacctcatggggtaatacagttaacccatgaaaggttattctcattcacaatgcatttcactgagggtggtcagtgggcagtcatccctgccatgattcaaggaatgtagctccttaaatctgtagctctgtcatctcgcaggggcttctctactggttcctctacattcaaccagcaatagggaaagaaaggtatcatgggggctcacacagaagcttttaaagggctaggcctagaagcaaagtttattattttaatccacattccattgaccataatacagtcatatggtcccacatatttgcaaaggagattgggaaatgtaatctagctgttttctcaagaagaacagaaaatgggatttggcaagtacttggcaatctgtgacctgtctactcatgcaaagccagactcctcaacacagacccaagaccctggcctccatatcaccctgtccaatgaaatacatttaatcaaattgttaaaagcctaggttaaggaaggaattctgaaagcagcaagagaaaagcaactcatcacatataagggaacccccatacaattatcagtggatttctcagcagataacttgcaggccaggagggagtaagacaacataatcaaagtagtgtgagaaaaaacttgccaactaagattactatacctagcaaaattatcctttaaaaataaagtactgataaaacatttcctagacaaaaactgggggagtttgtcaccactagcctgccttataagaaatctttagagggttcttgaaattgaaatgaaaggttgggcacagtggctcacacctacagtcccagcactttgggaggctgaggtgggaggattacttgaggttaggagtttgagaccagcctggccaacatggtgaaacctcatctctactaaaaaaaacacaaaagttagctgggtatgatggtgggtgcctgtaatctcagctactctggaggctgaggcaaaagaatcacttgaacccaggaaacagagtttgcagtgagctgagatcgcaccactgcagtccagcctgggcgacagagcaagactttgtctcagaaaacaaacaaacaaacaaaaacaaattaaatgaaaaagcactgaatagcaatgcaaaagcataaggaagcataaaccttattgagaaaggtaaatatataaatacagaataatgtaaaactgtgaaggtgatgcatgaattactttgaaccttaatatgaaagtaaaagataaaaatttgttaataaacacacaatataaaaagaagcaaaccctgactacaggtactcaaagtgggtggttatgggagaagtcaaagtaaagttttcgtttgcagttgaagttaccaacttaaaataggtggttataactacaagatattttacacaagctgggagctaaccacaaaggaaatatcctacaatagatataaaagataaagagaaatgagtcaaagcaaatcactacaggaaatcatcaaataacaatggaagacagaaagagagggaaaagaataaaacaaccacaacacaggcagaataagttctcacctttcagtaattaacttgaatgtaaatgcattaaattctccaaccaaaaacagagtggctgaacaattatctaaaaaagatccatcaatatgctgtctaaaatagactcacttcaaattggctagaagtaaagggacggaaaaatatatttcatgtaaatgataatcaaatgaaagtaagggtggatatacttatatcagacaaaatagactttaataaaaaactatccctagagacaaaggaagtcattatataatgataaaagggtcaattcaacaggaataaacaattgttaagacatgtgcactcaacatcagcttaaatataaatatataaatatataaagcagatattgacagatttcaaaggagaaattgatagcaatcctgtaataggccacttcaatgctcactttcaatgatgaataggatttccagacaggtaatcaataaagaaagagctaactggagcaacactgtttaccagatggacctaacagacatatacagaacattctacccaacaacagcagaatacatattcttctcaagagcaaacagatctttctccaagattgattacgtgttagattagaaaacaaattttgacaaatttaagaagatttaaattatgtcaagtgtcttttcagaccacagtagaatgaaactagaaaccaacagcagaaacaaaactagaaaacttttaaaga

SEQ ID NO: 477583 - DNA, 909 bp, Homo sapiens
ataaggagtggatgcctgtcaccaagttgggccgcttggtcaaggacatgaagatcaagtccctggaggagatatatctcttctccctgcccattaaggaatcagagatcattgactttttcctggggacgtctctcaaggatgaggttttgaagattatgccagtgcagaagcagacccgtgccggccagcgcaccaggttcaaggtgtttgttgctatcggggactacaatggccacgtcggtctgggtgttaagtgctccaaggaggtggccaccgccatccgtggggccatcatcctggccaagctctccattgtccccgtgtgcagaggctactggggcaacaagatcggcaagccccacaccgtcccttgcaaggtgacaggccgctgcagctctgtgctggtgcgcctcatccctgcacccaggggcactggcattgtctccgcacctgtgcctaagaagctgctcatgatggctggtatcgatgactgctacacctcagcccggggctgcactgccaccctgggcaacttcgccaaggccacctttgatgccatttctaagacctacagctacctgccccccgacctctggaaggagactgtatttaccaagtctctctatgaggaattcactgaccacctcatcaagacccacaccagagtctccgcgcagcggactcaggctccagctgatccaacgatgatgcaacatatacaaatccataaatgtgataacaccacattaatataacaaaggacaaaaaccatatgatcatctcctcagatgcagaaaaaacatttgacaaaattcaacacgctgtcatgataagaactttcaacaaattaggaataaggcaaggatgcccactctttcttgtcacttctattcaacatagtactga

SEQ ID NO: 477584 - DNA, 1267 bp, Homo sapiens
tgctgtggtcctggagttggggaaatggaggaagctcctgagggggctcctcctgggatgagcagtatggttaccgtgggtgctccaggagaagcccagcaaggtcggtgagcagcttgggcccagccagctacagccagtgggcagggggtgagggcgcctctctcttcctatgctcgccctcccttcctgtccctggggctccctgctgactggcacatccctctgggccttggtgcccagctagttctctgcctcccgctcactccagtgctccttcccatcctctgcagcatctgcccgcaccctccttcctgctttctccaatgctttctaactacctcctttcccatctccagctattccgactcaccttgttctcttttgaacaagtgttattattctgcctaattataaaagtcatgctcatgcaccacacccctcatccaagcaataaacaggaccagggaaaacctagggacattctggaaaattgtgttcggattgaagtgggatgcgagtggggagagcaggtccaggaggtagctgcagaaggagcagccaggatacccgggtctttggcaggaaaaagtttgaagtcaaatgggtcccgaggtggaatattttccaaatgtgaggaccatgggcctctgtggggacacggagtgggctttgaggggtcctgtgcgtgtgatgtgtgcatgcatgtgtgcacatgtggcaatgtctctgtgcctgtacacttcctcttcggtgtgcacaaaggctcagacaccctgggagggagttcactaagcacagctggagatctgtgtgtggctgttgtatgtgtgttcttcatctccatctccatcatgttctccacctgcagggatatgctctgtgtgtatcgctgtgaacatgtctgcattgtgcccacaggtgcgaacatgtctgtgggtacaacctgtgcatgcatcatgtgctggcatgctcatgcacacgctggaacgtgagccgtctcgcctcagagtgagggctgacagggttgcattttccaaaagctcagcgaccagtgacagagctggcctgggagtgcttgctggcaggaggtgagtggagctgctgatttgtgacctgggggtgggctgtgatgacggctggctgatggatgcaggcgcttagacaccctgtatgacagcagccagctctctgagctgcctgaatcaggaggtgggagtttagttcttgacctgtgctgctcaatgctggcttcccacctccctgg

SEQ ID NO: 477585 - DNA, 2152 bp, Homo sapiens
gaagtggggaagcaggggtgaattccagcgagccttctgcttgcccagccacgtgtcctagaccaggaagtatcaaaggggggcctgtttcttatttatacaaaggggaagggaggggctggaatctaaatggaggcagctgttcctaaggccatagggcgggggcagcggggacccgccattaactagctaaagacctggggctgggggtcagtttggctggctgagcccaggtgtttttattccagctcagggagccagagagggccttttggggcaaacctctgtcactccccttcctggtgcataaactactcacccctccctggagctcctcaagcccctgcctcagcccaagcccacttggacctggacctgtcactggattcgttcacacgggccaagctttcccactggcccatgtctgaggccatcatctctgtggccagtgcacaggggaggacgctgcaccagtttaggaactgcactaaccacaaggagagtaagaagcaggagtgaaatggccaaaggctggattcaggaagtgtgcagataaaagcaggagggaagggagccaaagcggggaggaggaagaggactgagagggggtgtggagagtggaattggagaggaggggagctggcagatgggaggactgacctggggccaaggactcgcctcccgctccgtgttcttacctccctgggagagcctgcagaatcctcctcccctccctgggcctcaactcccagacaaacagagatggagataacggcaggcaaactggtgggttttttttttcttttgatggagagaccaggaacccagttctgaacttaagtttgaggtgtctagcggaacaccaagggagatgatgagagggaagggggtgcagggagaagactgggggagtcctgggcacagggatggcccagtcgagagatcagggagccagtgtggctgcagccagcagcgcggagaccccgccagtgcagtgcccgcctctgtgtctgtccctcctggttctctcccttattggcctggctcgcctgcctgtctcattgactgttctcacatctgcttccttggctctttggctccgtgcctgtttctctccacccgtgcgcctctctccgcgcctccctcccccacgcagccccttccttcggccctgcccgccccagccctcctcccctctgcccgcagtctgtccgcgggggtgatggcgggatagcaggcagcaggcgtcggccccgggcgggggtctcaccggacgggccggttggcggcgtcggggtcccgcgccgtcaccacgccgaccagggagcccacctgcgcgtcctcctgcacctccaggaggccggagggcggccggaactcggggggctcgtccacgtcggtcacggccacgcgcacgatcgcctggtcgcggaacgtgcccaggtcggcgaagcgggggtccacgaacttgttgagggcctccaggatcacggtgtgcacgggctgggattcgaagtccaggcgctgcgggagggagcagagggccgcatctattttctcagttataaaaatgaggatagtaacctcagcttcagagggaaatatgaggattaaaggcaatgaggagtgtgaagaggctggcaaggatgtgaagcacacgcagctgcaccttctgcactacgatgatggcctcctgagtgtcgctgtctgtggtgaccttgaacacatcgccgccgctgctgctctcgtccttaaggtgtcctcagccttcacacgtcccacagccgttccaatgggggctgactcctggatgctgaactggtacatctctgtgggggacacggccatgagcagggatgaaggcagccccttccccagcctctgccagcagtgggggaggggacaagggggcccagtctcactgaatgttacctcctccagggaaccttcccagacctccaggctctgctcctgtgctcccttggcccccaagcttatcccattgttagaattactgcgtttttactctcattttctgtttattctctctcttgggtatgagctgctggaagaaagggaccacatctcttattcatcaggcattcccagtgcctggcagaatgccaggctgtcgcataaatgaaatgtgtga

SEQ ID NO: 477586 - DNA, 575 bp, Homo sapiens
acagctgggaaccaccccaaggggacttgaatccagatctgactccatggtcacacttgcgccaccagaaaggcctcaaaacaggaagagggttggggctcagagtggggatggggaccgtgaggggctgtattcgatggcctcccgcaggtctcccgagggtctcctctcccagcttccctggggcacgtcggtgatgcaggtgatggcctcggatgcggatgaccccacgtacggcagcagcgctcggctggtgtacagcgtgctggacggcgagcaccacttcaccgtggaccccaagaccggtgaggggcagggcggggccagaggcggagccgtggggcggggccaggggcggggcgggacgaggaccaccccagacgtctgctctgagccttctgtcccagaagctctgaggacagcacagggggcaccttgtgcacagcaggagagtccagggtcgcggagagggaggggcagccaggcaggaagatggacggactgaggaacagaaaaggaatggggtggggggttcttccaaaactggaagagaaaccgaaaggcaggaagcagcc

SEQ ID NO: 477587 - DNA, 931 bp, Homo sapiens
ggaagcttagagaggagcagggacctgcccaaagcctcatcggaatggattttcctctgcttgaagctgcctgggagatttgggcattggaagataaggacttaggtgtttctgattgcaagaaaacagacgtcttgctgccccctgggcctctctgtgatccagcaactgaagggttcctgcctggcccagcagggatcctgctgcagtaccactgcctgggcagtgcccccaccatccactccgactcagacgagggtgacggggccatcaagtacaccatctcaggcgagggtgctgggaccatcttcctgatcgacgagctgacaggcgacattcatgccatggagcgcctggaccgcgagcagaaaaccttctacacgctgcgggcccaggctcgggatcgcgccaccaaccgcctactggagcccgagtcggagttcatcatcaaggtgcaggacatcaatgacagtgagccccgcttcctgcacggcccctatattggcagcgtggccgagctctcacctacaggtgggctgtgggccctgggggtgggggatgggatcaaggtgatccccaagtggagcctgctgggaaggggagtagctgatcctctggggagggacagaaaagacagagcctgctgacctagggtacagggtacagatgtgagctcaggtgccccctggggtcaagcatagtcctggacaaaaccacacacatgacttcagccacatccatggacacagccccccatgaacgtggacccgcatgtggacacagtgatgccctcggacatgctcatacagccacacccagtcacgtatggagacacagctgcagatctggacatgccacatgcacaagcccagccccgcatacaactcaccactacactggtacacaacctcattcatagatccagtcccct

SEQ ID NO: 477588 - DNA, 785 bp, Homo sapiens
ttgtgaagatgcgaaatgaagaggagaagggctttcaagaagaggttctcagcttggcaaaatccatccagcctcagggcctctacccaggctgttccctccacctggctgccctcgccctcgccacccccacactccagtctgagaacaaatcactttctcagggaccccttcccaagagccccagactagtccgagctccctgtcagatgctctccttgtacctttcttttatagtcatcatcgcatgttttaatgaagtcaggtctggattccctgccgctgactcactgaatgactatggggaagtctctgtgactgcaggcctcagttttctcatctgtaaaatgagggtcatttcttgtaactacggtaatgacagcaatatccagcttccatggagggcaggcatcgcatagtgattccaccccctcttcatcctcaccatagccccgggggcagttcctatcattactgcagtgtacggatgggaaagtggaagaccagagatgttagggaacgtgtcccaggtcacgcagctggaatcggaatctgagtctgtgtaattctggagctcatgtcctgtccactctactcagactccagacctccccctgctcccagaatgcattcccagtgcacttggaggctgaagacataggttccaaccccaactcgagcttgcaccacttgtgtgaccagaggtacatccaggcatctcctctgtaaaatggagacagttatgcttcttgccataactggatgtggggggcaccccatgccgt

SEQ ID NO: 477589 - DNA, 1359 bp, Homo sapiens
tttggaaaatttagcaagaaatcaaactttacccaacatcaaagaatgtacacaggagaaaaacctgatgagtgtaaagaaaatgagaaagccttgaagaagttataccatactcaaaatgagagaactcatgcaggagagaaagtctatgattgtaagaaatgtgggaaattctttcatgaaaaagcatgccttactcaacatcagagaacccacacaacaggaaaacccagcaagtgtaatgatagtgaaagagtcttgaaggaatcttgcctcactcccaatcagagaattaaaacaagattaaaacaagagagaaaaactgtaaaggaagtcacaacttacacaaagccagagagctcacaaaaaaagagaaaacctatgactgcaataaatgtggagaaagcttctgtaagaaaacagatctcagatagcatcagagcacacacacacggaagaaaaccctatgaatgtaatgaatgtgaaaaatccttctttgtgaagtccaactacgctgaacatcagagaactcacacaggagaaaaaccatatgaatgtaatgaacgtggaaagtccttctgccagaaatcagccctcacagtacatcggagaactcacatgggagagaaactatataaatgcaatgaatgtgagaaaaccttctgtaactcaggagaaaaatcctacagatgtcctgagtgtgggaaaaccttctatgaaaagtcagccctcacaaaacatgagcgaattcacacaggggaaaaaccctatgaatgtaatgaatgtagaaaaaccttcagccagaggtcagccctcaccaaacatcaaaggaaaacacacaagaagaaaactattatcaacaccctccatgtgcagaaacctgcatcttcaaggcaaatttgtcaaacatcagcaaaatcatagggcagaaacactaaggtattaatacatgtaggaaagtatttgtttgtaggttataacgaataggaattagaaaattaacataggagtgaaaccacatgaatgctttgaacatgtgaaagctttcagcaagtattcagagctgtggaggaaaaattaattttaaggtatatgaatgcaaaatgttcttgtgcataaaatgtttaggtagaagtcatctttcagatgtaatagcagagtaattaaagaaaagattagaaaatgacttgttcttaatagaatgtgaaacatgatccttttgtaaaactatgaattatttaagtcattgacacgatagcgttgaatatgtgtgaagatttcctgaagtatattgggctatatatagttacataggatacgagtgtgctgtataacataaattatgtgtatgttggattt

SEQ ID NO: 477590 - DNA, 976 bp, Homo sapiens
ctgcaggtcctacctccaatggatgctgcccagagaccacagcatataaaaatcttgtcctgaggcccatgagaaggaaacggagctctcatttgctgtgcagtgcagcaaggatacgatgtgtgggatctgcatggaggtggtctgtgagaaagccagccccagtgagcgtggctttgggatcctctccagctgcagccacgcctactgtctcaagtatattcacaagtggaagggcactaagctatttgagagcaagatcatagtgtcctacccagaatgccggatcacatctaactttgtcattcccagtgagtaccaggcgggagaaagaagagaagcagaaactcatccagaaagtcaaggaggcaatgagcagccaggcctcattgaggaaagagagaacaatgacccctttgacaacaatgaagaagaggttgtcacctttgagctgggtgagatgttgcttatgcttttggcagatggggacgatgaactgacagactttgaaaatgagtgggacttgttccatgatgatctggaagatttttatgacttggctcagtagccaccttgcgtggcatgtgaactggcctgctgacctcagacagcagcagtcccctgtggtggtgtgacagtgcccatgtttctctcctaggcaggcctatcaactccaggtgctgtcttaataatttttacctagggcctgtcttctcaatctgtgacctttccccaaggagtgtgttattttctctgtggaaaaaagtttcaaaaataaatcctgaagttagtgttttgtaacatgaatttaacagtcagacagttcgtgtagtatgtgttaattttagtgtaaaagtcatcatccaacttgagtcaatacaaagtctgtggtactttatatcttttggctacctgtgctagatttgtgatcaaggaattgttaccaaaagggtagattaataaaggagacttgtgc

SEQ ID NO: 477591 - DNA, 913 bp, Homo sapiens
gggggtggggcagcagatcaccttttccaaggatgctccaaagatgcacctcacatgctcttttgcaatgtgatcttgaccttgccactgctagtcaagaggctcatcccaagacagttgctgcagctccaaaggcaagtccctgtgctcaaccatgctcaagacaggatgaaggggcaagaggtcgatgctagaaagagcaccttccacgtctacctcattgtcagtgccataggctcagaggagcctgccggagctggggacaaacaggagccctgccccctccaagttggggcaggagctccccaggcacagctgcagccacccaacttgccgctgcagacccaggccttctgctccatgggcagggatatccatgccgtcctgggggtagctgcagccatccaaactatgactgaagactcaggcatccatgcattcttgggggcctgccacttagatctcagagcaaagtctgcctggtaccatgaagacagcaggaagcagatggattcctgggaggaggaggacaggtccctggtaatgcttcaccttcaggccaggcagggcctggagtctgggggccaggctgccagtcctgtggaccagagtggggacttgtggtgccttttctggccctggcatggacactaatggaccaatgcacaggcacttccatccttctgaggtttataaaagccctgggctcagccagagcagggagaggactgagaggaagggatgaccactgcagagaggagctacccactccagagcctcttctctgctgagagctgcagacgtgggaacaaactgcctacagagagtagctatacactgtaggtctcctctgagctgttctaacactcaataaagctcctcttcatcttgctcaccctccacttgtctgcat

SEQ ID NO: 477592 - DNA, 1687 bp, Homo sapiens
tagcaagtccaaaatctgatggggagaccaggaggctggagagccaagaaagtgctgcagttggaacctgaaggctatctgctgcagagcgtcctcttgctcaggaaggccagctgtggccagctgctgacccagctcctcctgtgtgcctccctggctgctgctgctgcaggtctggtttatcactggctggcatccttgctgctttatcctcctggaccttcagccatggttgccactgtctgtggcctcctggtcttcctgagcctgggcctggtacccccagtccgctgcctgtttgcactcagcgtgcccaccctgggtatggagcagggccgccggctgctcctgtcctacagcactgccaccctggccattgctgtggtgcccaacgtcctggccaacgtgggtgcggccgggcaggtgctgaggtgtgtcaccgagggctccctggagagtctcctcaataccactcaccagctgcatgcagcatccagggctctgggccccacaggccaggcaggcagccggggcctgacatttgaggcccaggacaatggctctgccttctaccttcacatgctcagggtcactcagcaggtcctggaggatttctctggcctggagtccctggcccgggcagcagcgctagggacccagcgagtggtcacagggctgtttatgttgggcctcctggtggagtcggcatggtacctccattgctacctgacagacctgcggtttgacaatatctacgccactcaacagctgacccagcggttggcacaggcccaggctacacacctcctggcccctccacccacctggctgctccaggcggctcagctgaggctgtcacaggaggagctgttgagttgtcttctaaggctggggctgcttgccctgctcctcgtggccacggctgtggcggtggccacagaccatgtagccttcctcctggcacaggctactgtggactgggctcagaagttgccaactgtgcccatcacgctcacggtcaagtatgatgtggcatacactgtcctgggcttcatccctttcctcttcaaccagctggctccggagagccccttcctctccgtccacagctcctaccaatgggagctccgcctcacctccgcccgctgcccactgctacccgcccggcgtccccgcgcagctgccccgctggccgcgggggccctgcagctcctggcgggctccacggtgctcctggaggcctacgcccgccgcctgcggcatgccatcgccgcttccttcttcacagcccaggaggcgaggagggtccgccacctgcacgcccggctccagcgaagacacgacaggcaccaaggccagcagctgcccctaggggatccttcttgcgtccccacacccagacctgcctgcaagcctccggcatggatagactacaggctggatgccttaagaaccgagagcagtgagggagaagggaaagagctttggagttgcagagacctgagttgtaaccttggtcctgtgccgcctccctgtgtgaccttggaagaaacggcaggccccagaaatgtattctgccaacagccttctaagtgagtttggaagtggatccttccccagttgggtcttcacttaggactcgagacctacctggctgacgccttgattgtaaccagccagagaccct

SEQ ID NO: 477593 - DNA, 1253 bp, Homo sapiens
gctgtgcatacaattgaaggtagaacccacaggtttttcagaccaattgaagttcttcactctagaaagtagttcgggcttcttttgatctctgagagaccctgcttaatctcacgatagccctgcaggtgggtttgattgtttctgctgcacagatgagaacacaggtccgggtgcagcaggggctccccgggccagtcctccggctcagccagctctctcctctaaggacttgcaaagaggcacttggtttcaaggttctctttgctggtagcatgaaggcagacatgagttcagaccttacatcccattctctcagcaatccagagatgggtggggtccctgaggagcagatccgtaagagctatcagcttagaggcgaatggaagtggatggcgtccaagcaacagatgcccgcttctgtgactccaccccttacggaaagtctatgggactctctgaaatgtatgagtgatactgttagaaagcggcaagaaaatgaaaagaaaacgtggatgttttccatatttgagttgatgcaggctggagacaacagctgccagagctgcaaggcagaacaccctgagaagtggaaccggaggatccaggcgcctgttgaagggataaatgagagccgtggcgtgtggatgggactctttctgtcttccgtttggctgaagctccaaacgccaggagtaacccagtggcacctccaacgttatgctggagaaaaagccgttccaactcttcaccgaacgccgagtcagagagatgtggggaaaccaccgaaagagcttgccctgtgtcttctggacagactagtgccaaacccatgcctggaaatggagcccaagggggctggggaggagaagaaatgagagtggaggaggaaagaggtttaatatgaatgaagtttggagttttgacatgactcgacattctaatgacttcatttagactgttgctacactcagaagtgacttggagacattttatttttataatcatcaccatattgttattggtcatgatctaaggtgggtatacgaatctgttggtcctataacaatagtatccagacaataatcactgtttggcattaggtctagctttggcttttgaaaagtcaaaaagagaaatactcactttatagttacttctggcgcgcctaacactatgtgacatcagagattctatagtcatgtgggcttctatcaatctaatcaaaaaacaaacaaagcatgttattcacc

SEQ ID NO: 477594 - DNA, 1581 bp, Homo sapiens
gactcctcttcctcattgacgttacctgcccagccctggtaaacatggagtttatgacagcctctcaagccttccagatgtggcctcaccagcctttatggggctgcttgtgagagaaaccagaactaggagtgggttctcgggcgggggcacagctcagagggcagtcagtaccgaggaaatggagatgcggagatggccatgagcttggcggctgcactgagctggggcagcaaggttctaacaggattctctagctgctgtacagagaagaggctccccaggcaaggacagaaccaggagaccaatgagaaggtgaccgcagtagttcagcttggttttgaagattgtggtcctccccggcactttctggagtttagatatgggacgctgtcagcagccatccctgctggcacaatagcccacgcgctcacctcctcccccatttatgagcgaaaactcgctttccaccagacacgacgttcagctctctcatgccttagccagtcttgccggtgtaagcagcaagaggctgaaggtcaggaaacccgcatcctggatctgtccccacctcacattgtggcccagggaaagtcacagttcctcatggggcctgggtgttctgacctgccaaatgagtgtgatggcactgggacctggaacctggcttggctaaagaagtttggccaagtcagcatcccatctgcaatcagcatcaatggcttcccatctccaatcagcatcaatcctaaggtctttgccatgacttctagggctccaaataaaccaaagcgcttttgtccattgaccctactgagccatcctcgttccatccaccccaccccagttaccagtcagacaacatttcctaacacaagaactgtggaaggagctgcggtggggatcgggtattaggagggagggggcttggagagatgcgtcagaggccagaaaggaagacacaagttgggggttcgaaagacaagctcagaaatgtctctactgataactttcttgaagattactcttcaaaattacggccttacgatttaacacctgagctgaccccagctctctctgagacctcatttcctaccacacctcccagcaccctctttgctgcaaccccactggcctgctcgctcttcctccaaccaggcaagaacagtcctgcccccgggtctctgcagttgctggttccatcacctggagagccctttccttaaatatctccgcggctggctcactctgttcagatgtccctcctcagagatgctctccctgatggccaggtctagaatatctgctgcctcccctctgcctcgcgcttctgtgtcttttctcttgtctcgttttccttcacggcacttctcactacctgctactagacgacgtatttcatcgtctgttgatttgcttttcctgtctccctcgctaggctccaggagccaccgggggcttgttcacgcttgctgctgtggctccagcagtaagaacggggcctggcacctagtaggtgctcagtcaatagttactaagtgatgctatagtgatacattctcagcgtaaaaatatttaaac

SEQ ID NO: 477595 - DNA, 1552 bp, Homo sapiens
atctgacagggactgcctacattgaaagtgtgtgcacgtaggtagacacatgtgtgtgaacatgtgagtgaaaaaatgagcacgtgcgaatgtgcacgtgtgtgtttgcgactgtgcgtgtgtgtgtgcatgtgtgcgtgagtacatgtcagagagaactccataagctgaccaggcaatcagtgtccctggccctagtgactggttcaggggagtcctatggcttcagccaagccaatcaagccaattcaggggaaaccatggcttttgctttccacacgagcaaagagcttcccatggctacctgcttctcgtccttcagctctgggtcagacgtcaccacctcagagaaggccttgttgaccaccttgtctaagatgcactttgcccctcagacatctaaattttcactctactcatttcctccatggcatcagcattatctgatcattttcttgtcagttgcatctggcgtgcttgttgatgatctgtccaccccaaccggaggaaaaagactctacatcagacaggccacggctgcatctgaactctaccactcgggcactgcacagcctttagccctgcgtggacaggtggttaaggcggcttctcttggtgctcatggcccttgccatccctttttctgcagcgtgggtgcaacctgcaacctgcttctaggcgtgggcactgaccagagatggtcaatgtcctgcaatgcatggactgtcagcacactgacaaattgtttcatccaaacggccaatgacagccccattgagaaacctattggtggttatagttagatgatgtaagctgtaaatcctcgtaattgggcacatagaaaaatatggcgagtgacacatgctgggtcacatattcacccctagtctaatcactgtccaagaaagactgagtggctcagattggctgggattgactgactcacctcaagggtctagattcagtacctgggaacaaaaatcaggattatatgagcaaagaagagggaatggctgttgggtagtcaacttgaccaacagtgtctgacattgagaattatttcctttttctcttcttatggtttctaccaacaaaacaaatcagatgaataaaaaaattccttgctcttccaattacttcccaccccaaaatccacctttgctgatctgactccacttcttcagcttgctggagaaaagaggaaaagtctttccactgtcccccatcagattgcattgggtgcttggtgtgctttggaacccaggtcaataggattccccttccagtgtccctttaaaaaacccaggccccctctccttcccaccagaagtctcttgctggtcctgcagacctaagctgcttatagcagcagcgaacatccaagttcactaaagaggcctgaccccagcaaggcaggtgggagttaagcaacctgagctggtccacaaatgccagacagctgtgcacatctttggggcggagacgaaaaacagatacttaacgtatctggttagaaatgaggattttctggtttggttatgcctgtcatttc

SEQ ID NO: 477596 - DNA, 670 bp, Homo sapiens
ctccccaaacttcagacagaagcaaatgtattcagtaaacatgtatttgtcctcatttgataacaaccagcaaaatgatcccaaacaaaatttgaaagtgctaagccatacagcagattctttgtggtgtagtccacagtcatgcctaccttggagtaaaacacatttcccccactccagtcttccaagtaaatgccctctaaagccagaaaaacacattaattttgaaaactatgaacctcacaatatatccaatgtatgtatattcattgtaggatatgtatatacatatcctacaaacacacatgtgaattctacaaatcatgccttttttctaaacatattcctttcccacctgcaaaggtcacctctacagaaaaagcattcaattttttaaaatacattcacttaaaccttggctctttccaaaaaggatttgaggcaacatataaaaccatatatatggcagcagaataaagaaaacaagaaaagcagacaacagggaaacaggaaagaaaacaaaagaaagtcaaggagagaaattttctcatgagtctttacaaaaaaggcagtttatgatacagtgtgtatgtggggatgggcaggggctttttgcaaacattaaaaaaaaaaaaagagagagagagagacagagagagagaaatctcac

SEQ ID NO: 477597 - DNA, 584 bp, Homo sapiens
caccctcatcacctgctgggagtgctcgtcccatcattcaaaccccgtgagcgtgaagtgaggggacatatgcaggatcgagtgtactggcaggtaacctctgtgaatggcagaaatcgtgacgatgatgattttggacatcccgtgcgctcaggatttaaacactggggttacaataagattctatggtcctttcaagccggaattgctggtcacatgaacaaatttacggggaaaataacagccacgggtaactcaggcaagtggttccactctatactctacagaacatgtgcttcccattccatcttccagcatctgctgaccctgaatggctccccagccttgccctggcctcccgtcctggtcatgagcagccccttccccacacagcagttagaaggatccttctcatgctgaatcagccctgggcagctctctgaccacaaccttccagtgtccccatcacgggactgatgggccaggccctgccccctctcagctcctgtctctgcccaagctcccctcacacctgccctcagtccctccagcctccctgctgtgtccaaccaccaccccctctt

SEQ ID NO: 477598 - DNA, 1798 bp, Homo sapiens
gacccagaggccatttatcctgcagcgagtgggggtgggacaggaaaacctcatgaaaaagaagaactggggagagttaaggaagagactgttcagcgaccatgagcagtggagctgggttgcagggaccaaggtgggggtgctgcccctgggacaagccccagcctcccaaggcctgaaggggcaagaggaggaggaagcctgccccagaagtccctttgtggcagctttgaaatgcacctttctggcccaggccaagggctgtgctattgtgatgatgcgtgaaccagaaaacacccattggtgtgcctgtaacacagctcacagacccgagaccgtcctctcctcccagaacctcactgccatccccgaagtctcgttccaccagacgtgtagcctgtggtccgggcaggccttgtctctgctccacgaccagcactcgcactaccagaacatccttgtcttctgcagtaaaacctacagcaatatgctggtgttggatggcatcgtcctgggcatagggagggatgagttctcctgccaggagatggtagccatcctgcctctctgcagccaccccaagccacgaaaggtgctgatcatcgtgggcagagatgggtgtcttgcacaagaccacatgggcccggctgaaagcctcttcaaggaagcctattgtcagcagatgaaggtgaaggtggccctcgcggaggacagcattctctgctgccagggagagcaccagtggctgcaccttcacctcataaggagatgtggcagttctgccagtagccgtggtgggctacacctactgcatggtccccatctacccctgcagccagactggcttcatgctgtgcggcagaacatgatcacccgtgaccgggagctggtgcagcacctgacacagcagcagctatgggttacatctggagagccccctattgcccccaatagatgaccacagctgtatagattgtgactatgaagatatttgtatgcattgtagaatcagcttaatatgtgaaatggtagatgttattcaagggtgctagtctaaacccacaactggagaagagattgtatattccatgtttctactagactgtaggaaagtatatcttccccacagcccagctgcaataggatttatggcacttttaaatttttgccagtacgctaggcataaagccataactcagggttgaatatgaaatttcttgaatactgaggaattcaaacatcttttattttcctttactttctttcttttttctttttttttttcctttttcttccttcctctctccttccctcccatctttccttaattttcttttttaaatattgagatttgctcttctgggaatggtctctttataacctttgcctctttctggttagtttgtaagagctctctgtatataatagaaattaaccctttatcatttgccttacaataattttgcagatttatagtgtatatgtatattttatttacataatcttgcaatgtacaaaattttaatattcaaatatgcttttttttcttttattgcttcaggatttccattcttggtttgtaagatatccctaacctttagattatatctgtagtatcttagattttcttgcaaaattttaatttaacttcgtacaatgaagtcttcgtcttgttagaatttaactttgtagaagacatgagacagggatgcattttagttttagccttaattttctggcaaataggaaaccagttgttctggcatcatttgctaaacaagtcatccttttcctgttc

SEQ ID NO: 477599 - DNA, 1602 bp, Homo sapiens
aagctatatttctgcatcaatattacattattggagaagaggtggtgagtgtgtggctgacagcaggggctctggtgcagggtgacctgatccagtcctgatgatgccaatttctacacaagcaaccacctttctgtgcctctgtgttttcatctgcaaaatggggacggaggaggggccagcacgtgccaagaccttgaggttccgggaagcctggtctgtccaagaccagcggagaggccagtgtggccatgaccgagtggacacagggttcagtcccaagaacaagatggtgtcactgaccttgctctcagacacccgcttcccacagcagagttcccggcctgcctgcaaagtgctaaccacactgttggaattcctcaggggtgagcacgagcctctccgtttcatctgtgcctatcgtggacacattaactatttcatgaagtgcacaccctgtggctctgcagggcgcgtgttatcctcccctgcgggctgtatttgtggccgacccactgcccgtctcatgtgtgcagcgctgggtgttgtgtgctcggccatctcatactatttagggcgaggatgcatccctcaccgatggggtgaacgggagctcatggggcacagcctgcgctacctcctctgtcctggaggacccagtgcccatcctccatggctccaggatggagctggccctcccacagccctcaccatgggctgtggaggacaggtgcctgctgaatgcacctgccatgatgctgagtgtgagtgcctgctgaatgtgacctgccatgatgctgagtgtgagtgcctgctgaatgcacctgccatgatgctatctgagtgtgagtgcctgctgaatgtgacctgccatgatgctatctgagtgtgagtgcctgctgaatgtgacctgccatgatgctatctgagtcaggcaggcagtcttgctaatgtcagaagttagggtttggggtgatgtgaaagttaaggttaatgtttagcagatagtcaatcccctcgctctctgactgtggttaaagaactcatccctgccccactgactttgggcttggccatgtgacttgctttggccaacagaatatgagcgcacatactgtgagcagaggccgtgagtgcactgccacgagaagcgtgtgtcctggggagctgctgcctcttgtgcccgggtctagaagaagtcatgtgtcgtcaatccaagcccaacccgtagcctggagcagagctgcccttagaccgccccagatcatccaaaccttagtcaccctgcagactccaagtgtgaggacagaagctcgtgttataagccattgagtttgggcgatggtttgttatgcagcaccactgtgacaacagaagactgatatgggtggtgtctgctgggaggaactgggtggcaacggcaagtgaatcgaagaaggccgaagttattggcttttgcaaaatactgaaccagtgaagagatttgcccaagtgtccaggagggtgggagcctttggccagcagccaggtgggccgagccttctgcagagctgcgcaggcttgctgacgcctgtgtttggacagtggtggagacctggctga

SEQ ID NO: 477600 - DNA, 665 bp, Homo sapiens
cagacgtgctgtggcctctcagtgctgggtgtgtgagtggccggagagggcgtctagatgccccaggtgtcttcacacccagaactgggtctgccagaccctgatggccccgagagtcctgaccagacccccgaaggccaacccaacatgctgggaatgaccattggtgccaagcgggccctgggcagctggggaagggctgtcacctcaaatgtcccactacctggctcctcctctttcctcagggacccgaatctgcccgctgggcacaggtcctcacacaaagcctgtgcccggtgtcaacgggagaagcagcactggcctgagcctctaagccaaagcgtccgggcacagctggggacaggcaacatggacccggtcactgtggtcctaatggtagattgtggtcctggttggcataggcagctcatcacggtctcacctgtagctgctttatggaaggtctgaattggataggagcagaaaacagcttcattgttctctagccgctgcattccagcagcttctgtgaggcaggggccagattagggaacagcattggcctaaacctgcaggcaccattgcaaaggggagtcagctcaggtaaacctgctggtgaagcatgattccagcgtggggacacagaggctgatgtatcttgctgt

SEQ ID NO: 477601 - DNA, 675 bp, Homo sapiens
gaatgttctgctgccaacctggcttgtcttttaatcataccctttgcttgtcagtttagacacccggactcaaatgcagcattgcagaggatgtttgctgagcacctgctatctgccaggcactgtgttagatgtaggggatcttgcaacaaacagaattcctgcttttatggagcacacattcaatcgtgtgaaagtttttcgtcatgtccaggcaccacctcttcctggtcaggcccacgttacatatgagaacaatggaacaagtcaaaggaagttccagtctatgaggatggacagcatgcagtgtggcgagcagaaggacctagaccaaacccctggtgttttggtaacagtcaggttgctgaaaggtccaaaactaagtcagaaggaattgccaaggaacaatggggctgaaagtgtcaggaaggattgtctgatggcaagcaacagaactcaacttgggctgtactcacagaggagaattgatcggtaggctatttggcagctcagagaatcaaaagaaaggcaagaaaccaggtttagaaaaagaataagaaccgaaaccatgtcagggcatggagagtaggaagttatgggcaggcccggaagggcatcactggtcatatgaatagttcttggttgtttctgtagcccgtgctgcttctgttaaga

SEQ ID NO: 477602 - DNA, 580 bp, Homo sapiens
ccaccaaccctgaggcacacccacacagctttcctgctgcctgtgctgagccaggcactgtgcttgagatgtgcacggtatttgacatagagtcggggacaggcactgatcagctgagggcacaggccctgtgccgccacggctcctccaagccagcactgctcactccgtccgtgaaatcccagccaggaaggccaatgtatctgtgccagtgcctgaaatgtcaatatcacaaagccagcaggaggggtgacccggtggagctcagcaaagatgacataaaacaggccacaaagctggtttgccagggtgcaggaggatttgtctgttttctcctgagaatggctgctcagctcactccacacagcatttccatgcttcatctgttagccctggaacgggtgccctgggagccacggaccttggcaagctccactgtaggggaacctcatgctgacagctcactcttgtggattaatcctgactgtttgctgtatctggagccacccccaagaacctgatcatacagcacacaggaggggctgtgagcggagatgaaatctgggcattgtcttggttg

SEQ ID NO: 477603 - DNA, 838 bp, Homo sapiens
ctatgagacgaatgaggagcatgaacgtaactcaaacagaaggaaaatcaccactttataaagaaatagataataatgatgctgctgatggcagaggtggtgatggtgatgatgaagttgatgctgctgctgatggtggaggtgataataaagttgagggtgatattgatgatggtggctgtgttggtagtgatggtgaaggggatggtgatattgatggtgattgtggtaatgatgaaagtgagggtgatatgatggtgatttgtggtggtggtgatgatgaaggtggtattgatggtggttgtggtggtggtgatgatgaaagtgatggtgatatggttgatggtggttgtggtgatgatgaaggtgatggtgatattgacgatggttatggtggtggtgatgatgaaagtgattgtgagatggtggttgtggtgatgaaggtgatggtgatgatgaaggtaatggtgatattgatggtggttgtggtgctggtggtgatgatgaaagtgatagtgatattgatgatgatggtggtggtgatgaaggtgatggtgatattgatggtggttgtggtggtggtgatgatgaaggtgatggtgatattgatggtggttgtagtggtggtaatgaaggtgatggtgatattgagaatggtggttgtggaggaggtgattggaacctgggggcagacttccccttttggtgtttttgtgatagagctcttgtgagatctgattgtttaaaagtgtgtagcacctcctccccaccttcctccttctctggacatgtaagacgtgcctgcttcccctttgccttccaccatgattgaaagttt

SEQ ID NO: 477604 - DNA, 795 bp, Homo sapiens
aggttcctggatggaacgccgtggatgttcctaatgttccttcctgatgttcacctgccatcttgctatttaatgcaatgtcttctaaatattgaatagaaaaaagtatttgtccaatatgggcaagatgacaggaatgtctttgaacctggacaactcacaggatagtggggtctgcatggaaataggaaagtctggggagacgctgtatcggggatgggaaagaaaaggtggactggatgtggcatataagagaaaggaagaagagaaagatggtgcccagggtttggtcctgagcacctggaagaatggacttgcttgggccgagatgggaaaggctgcagaagaagctgggaagcttgtcaacaacagaaatttcttcctcacaatcctggaggctgggaagtccaagatcaaagtgtcatcagattcagtggatgacgggggcctgcttcctggttcagttagcaccttatccctgtatcctcgcctggtagaagggggtgaatgaactcccttgaggtttcttttataagggcattagtcctattcacgaggctctacccctaagtcctattcacctcccaaaggcccaccttctataccgtcaccttgggagttcaaattgcaacatataaatttgggggaggggagtgcataatcattcagattgtagcacaggaataaagagtttcattttgaacagattaagtcttgatatgtctggacagctgagtgcatgagttctgaatccaggggaatttcaggccagagatacaaatgtgggagctgtgc

SEQ ID NO: 477605 - DNA, 579 bp, Homo sapiens
aacgaacatgcaaggcaacgggaacctctcccggcacgcagaagagctgtgctcggataagctgctactgtcctacaaccatgacaagtgcttttatgagacagaagagggagacacagacacagaggggaagacctgtgaaaatgaaggatgggactcaactgaggccaccacaagccgagaacacctggggctgcccaaagctgagagaggctggccctgtgatttcttgaggattgttccaggaaacacacttaagacacctgggctcagggacactgacctgtccagacgcaaacatgatccaggtggggccaatgactcagtgcccccatcccagccccatcaccccaggaagacgagacagatggactgctgggtccagcgtaatcagggcttggaatgggggcctgattacctgtccatggaacattgatttatagatgtccttgacccagccttcctccaatcccacccctgaatcttttttgagatcagctgagaacttcctcctccaggaagtcctcttggattgatctctccctacagtgatgccatctttctataacagagttactt

SEQ ID NO: 477606 - DNA, 1282 bp, Homo sapiens
gcactgctgatgttttgctttggggtgagtccaccatgaggtgcttatccattctgctgctgatggctgccggagtcatcagcagggcacagggactgttccccatgccgcttcggtggacgacttggacattagacaatgccaaactttccaaagggttggcgtcagtgtctatggcccccagcatcatgcgtggtagctccgtgttcttgctggcacttggtactgtgggaacgtcacactcctgcttggttgcctgcccctggccagaggctggccctttatcggaggaggccagtgcacagcaagagcctccaaagcagagtggggaccattcacacctggacatgactcctatctgtcctgcaggcaatgactccagatggcaaagggaaacagaccctggagctcatgtcccagctgcccctcttggcagctctgttatttcaggtgatgtcagtagcctcctgagcctcatattattggatattgaatgtgggtaataacgtggatctcactgggctgtcgtgagcattaatgagttaatgcctgcaaaggatttagatgtggcaggcccacaagatccagaagaaggtttggtccgtgtctgggtgccagcagagccggcattcacattttcagttatgatttcctttttctctgtacatcgttctttctttgtgtcttcagttttgctgggcacaggcagatggggtcttggaggttaaccttgcctgttgtataagtccgcagagtgggccccaaagcccccctgctggtcccagtcctaactgcggctcaacaaatgcatagccttgaaccatccagccaccagctgtttcttcatctgtgcaaggctgaagtggagctggctcctccacttttcagagtctgagaattgcaggatgccctctgattcattccccccacctcctaccccacccctgcccagtcctgacccccacacccatcccattctcctctccttctccctctacctcctgctgcccagaatcttctctcttgtgctagccctgagttccaacagaaccctgtggccaggtctctggggagggccacccaaaggccccattccaaaccctgcagatcctctggacagggagtggggagcaggcactgaccaccccagagacagcagagagggatacatgctgagagacacatgctccatccgtgtgacttttgcttctcggaccacgtgatgctgaaatgtgattcatcaatattttgtgcccagaagccatctgcagaatctaacagc

SEQ ID NO: 477607 - DNA, 981 bp, Homo sapiens
agatcctgcagaaccttgtagaccaggaattaaacctccaactgggaagatttatgggcacagcaaacagcatgtccccaactgagctccgatattccccactctgaacctgctcccctgcaagcatccccatctgagttgacggcaagtgtccaagatgttggacaaaaagggtcttaaccaagactgtaaggataagttgagagctaagatggtgataagtggaaaacattatctgcaagatctgattaaaacaatctggcaaagcagggactcagagaaccagaacaaggcaggccttggtgaatatctagttggtggcatttcaccagccttggagattgtgcaggtctggaaaagtaaatgccgcagggaatgggagaccatacagaacgctccatcctactggactctgattggaagtgggagggacattgtttcctgtggccactatgacaaattaccacaaacggtgcagcccacaacaaagaaattcacatctcacagccctaagaacccccaggggcttttcatggcagataaagcagaagtcaaattccttctaatggcccacaagggcctgcaggatctgccccgtcacactggcttgggccaactcatcttcggccccaggacctttgcacctgcttttcttctgggatttctattttctgaaacatccacaggacttatctccttcaaggacaagatccaggtctgtgaactggcatattcagaatcaccagagaaggagaagggagaccccacgggaaggcccaggggcaaataccccattggatgcatctgggaagtctggagtttaggggccattaggactgtgtcgtggtggcattttggagagggcacaggtccaaccacctctccttcctgtgagcgcacataacggcacttgcactgacggtagggttgctgtgaggtctaatgacagtgcatgagcaaaccggcaattcactggcattc

SEQ ID NO: 477608 - DNA, 430 bp, Homo sapiens
gcagtgaaaacgggaccttgtctgaacggtgtcctttggctagaaagtctatggcaggaatggattttttagaaatacactgtgaacaggtggtgtttgcagtgggccaggtgggagaggctgatggcgcggagcagacggggcgctgcagagggagagaggtgagtggattgcggtgctgcttggaagatcggcagggcttgctgatggatctcaggtgggcagtgacaatgaccatatcagaattttctcccagaagcttctacaactacagccagcagaaggtggaggagaaaaaattcacattgttctttaaagatttaaataacacaaagcgcttcattccccacccaccgctaacacaggccagtatcatgctcaggttcttctgcatcctctgagaacattttcccctcatttactcaatgac

SEQ ID NO: 477609 - DNA, 883 bp, Homo sapiens
tccgtgggggtggagccctagccagggtgctcagagactcgttgggacactgagtcctcacccccacccagcagtaatgcgatgtgcctcccaccccagggtataagtggaggccaagtggggaactggggctccacccaacctggcaataacgaggcgctgttgctgaacccccacccccagtgtgctgtgcagcccaaatcctgggagtcctccctcatctatgcatgctgtcctcttactactgctgttcaatccatccacaagtgcagtcagcctgacctctgtgaagacctgcttagaggctctggtcatgacagtgacagccagcgccctttcagcggcatgcaagtgacgcacaaccgccgccacgtctcagctcctggggctgcaggtcgtcggggctcagctgatctgagctggggtcccttgggcttgttgggctccatcgggggactctgcttcctgctgagaggcacgggggctgggccccgggatcaggttcccgtccaccctgcggagctctcctcagcctcagggcggcggctcctcagggtccttttgtagtgaatgacagaagcccagaaccaaaccagagccccaggcgcatccccagtccccgcctgcatcagaaccacaggggctgcatgtccaaagcaggtcactttcactgcacagggcaaggagggggccctgggacagcacagggcaagagaagggggtgtgccaacctatagcagggagtggacagctgggaccctgacctgctgagcacaggcagatggggtggtgaccagctgggccctcacctgggcatcgggctctgcaccttcacccacatccgccctgtagcctcagtcatgggaggggtttggatgctaat

SEQ ID NO: 477610 - DNA, 707 bp, Homo sapiens
taatgctgttgggagcatgtctcctccttcccccacttagttttaaaggcattttttaagtgtcagatttgcatgcaaacccatgaagaaggtgccatctatgaatcagaaagcaggccctcaccagacaccaaatctgatactgccttgatcttggccttctcagcctccagaactgtgggaaatgaattcctgttgtgtataagaagagaagagtatttctcaggccttcagaaaccaagagaagaaaactcattttatgatctgaaaggagatgaaaagcatattttagcagggcattgcaaatgcgttccgtgctcatcacagaagcatctacaatacctacattatttagaacgctgcaggagacagaataatgaatgtagaatatgtgaacgattcattttgatttttaaaaatgcaaccaagctagagaaagtgttgcaaggtatctgaagacaaaataaaatctctgctatttgtgaagtcacaaaattaaagggatgattaaacgaaagcaaacctgagatttaacctgaaaggaatcgaggattttaatttttgaaaaggtgtcaaaaagtgctgtaaagagtgtctgaaggttaaggaaactgttattaaaatgagaattatgagctcggagctgttctcagctctgtccctggagtgtgaaattagtgactgaaggcagatttcacaggcacttc

SEQ ID NO: 477611 - DNA, 880 bp, Homo sapiens
gcgagcagtgacgctagagcaggttggtgcaaaagtaattatggtttttgccactgaaggcagaatctgcagacccagagaagacaagttctcatcaccaactgcctcatcctggtttgaagacaggttctcatcaccaactgcctcatcctggtttgagaagagcgggcaaaggattgattctgcttggactggtctggattcacgcattcaacaaatatttgcaccttctacgtgccaggcactgtacttcatcaagacaccaaagggcttttggcgtagaaataacatgaactacaataccccgtggctgcaggctgctccctgggagatggaggggcctgaagccgccaaggaagaagatgatgcggaagccagcaagcgctgcatggtgttacaggtggaagattggagacaccctgccctggagctgggcgcgaagccctgggctgaaagttttcctggccagtttgagctccgtgaccctggagaggtgcctcccacctctcagactcggtttcctgctctgggagaagaagccacagcggcatccgacccgtgacagtatttagggtccactcaaaataatccagaatcatttcctcatcccaggatccttaccttagtcacatctgcaaagacctcttttccaaatacgtgggcaccgcaggttccagggctgctccccacaggagtctgttcccctccccagtgcagcctctgccccctcctcaaagaaagtttcagcactcacagctcctctctctcagctgagtgattttctcccttcctattttgtcatcttgaaagatggcaaattggagcacttaattttccccctccaacccaattaatatgaaagtgcacagcgctgatgtgc

SEQ ID NO: 477612 - DNA, 482 bp, Homo sapiens
cagtgtattaaaagtgaaggaatgccaagaaagggctatagaaaccacgggctggctgaaatgttgaaggaacaaacgaactctttatcgtggtgctgttcaggaaataagaactacattgactttgtaaaagcaaagcctttgatcagcgccaggctgtgggtgactgccccaagggggctactgggtcctcacagtcctcgtttctctgagactctagacgcagcctcatttgaagtcctgttgcttttgagtgaactcttgagtgtctatcctgcacatccaggaagtggcatcggggcacagaacattccagggcacacagtccggtctggccctgggtcaccgggtcctctgcctgatctgacagtgccctcctgagtttccagtcctccatagagtaaggattcagggtttctctctggcctctttcgatcctgctgcccgctctgcatgctgtcactcttccctcatgccaggct

SEQ ID NO: 477613 - DNA, 823 bp, Homo sapiens
cagaaaagaaagaaaaagatgagagtaacaacccccgtgcaggtttcctggaactgctcgcaaatgaaggcccatccacttggcctcacaggagaaagtgtggtgcagtggtggagtgcagactccaggcataaatgtccaggtttgaattctggctttgcctccttgctggctatgtcactctggcaagtcaaagggccagtgtattacttgatcagcagatgcccattaggtgaatcactcactgaagtccaggaagggacacaaaagagaggacagagtgtccagggtcttatggtttattattattgggaggcagaaaacaagacaaagatgaaaggatgcaagaaacaaaataccatggatataggcaaatccacagacactgagagtagattcgtggttgtcaggcattaggaggagggggaaatgaggagtaaatgctcatgggtactggctttcattttcaggatgatgaaaatgttcccaaattagatggtggtgatggttgcacgactctgaatatactgaaggccactgaattgtacactttaaatgggtgaattctatggaattagttgttgtggctgttttgaaataaagtccacaaattcgttgacactcttctcattgaaagatggtgaggaggtcgtttgcttctttgtttatcagttcctggtactatgggggaacacacaggcatgtagtgaaattttcatgaaagtaaacttaaacaactaccatttatgttaatatattaatctcctttcctttttgggggtagtgatgttggtggttaaaatgttcttttactgtgaagtaa

SEQ ID NO: 477614 - DNA, 836 bp, Homo sapiens
attattgccccaagcaagggcacagtggggagggctggcctctggagagatcaccatggccctctggggatggcgtcctgtctttccctggactcagaaccatgccagagacggagaagatgaacagggattttataccaggcgtcagaagggaaccagtgctaaagaaaatgaaaacaccaggccgggagaggcagctggcatgcgggccgtggtggttttacgtggccgatttgagagagtgagacccctggggtcttggagccaggcctgggaaaagctacttcacgtcaggccaggggctgtagccctggcaacctccactccgcctggaaatcctccacctcggggcctctctttgcccagacctggcccaggaggagcacatgggagccgggaccttcccaacaatccttgccgttggctccacaaacctcagccagtcctgcaacctgggatgccttttccaccaggatgcctgctactgtcactgttgtcattagataattaatgaactataattagaaatcatatcaataaaatttcacagtctaaggctgttgaaataggtaccatcattatcctcattttagagctaaggacagttttgggcggtaggggaggtgcgggtgtcactgcctgaggtcacaccgtagcaggactgggattcaaacccccagacctccggttccagaggccaagcttttgtcaaagacatgcagtgaaacaggcttctcagaggttccagccagtcttcattgcaaaacaagagggaaaaccgaagccaggacaggctcggggacctggccctgcccctgcccctgcccccagtgcct

SEQ ID NO: 477615 - DNA, 757 bp, Homo sapiens
tctgcgtcccttgagactctgagcttcacgaggggcacaggctttgccatcttcctggcacctctcacctgcccaagcaagatgggaacgaggcgctgctgggtccctttctcaggaagacgcccctacctccgctccaggcttctggggagagaatggtgccagacacagacacgatcctgccggcaaggcactgactttctggttagtgagaaccagtcaggttcagtggcggaaagtgtggggaggcaaggtaaggtgggcgaggggctgcagacagcatgtcgggggcacctgggccaggctgctggcaggagggctcagctggcagggacaggccccggctccccctacccccagctggcagatgcacagggctgtggctctggggacatggacgtgaataacacaggccaaaatctctgtcatggtggggctgacacctgtctggggagacaaccatcagacaatggttgtggcactgggtgacccaagtcagagggaagggaggggagggagagggggctgggccttatcctgagggtgatgggggcacatgagttggcagaggccagacttgatatacgttcttcatgcttcactctggccccagcagaagcgtgtgctggagtgaggcttagcacagatagagcaccagggaccggtttcgtggaagacaatctgaaaggggctgggggttgtgtggggggttgtgtgttgtgcatatctctcgtatatgcaatctgcaatagggttc

SEQ ID NO: 477616 - DNA, 795 bp, Homo sapiens
gttgctacgaggctcgcggttgcttcccttctgatggggcttccgacagctgctgctctcctcgattttcttctctgagggcccagtgtcctttgaggtgggggcctcaggaaaagcctaacaaaagtctctggttccatccgagcagctgcagaaaagtcttcaagaatctgagtcttctaaaagctgcctccataatgaactagtcttagtgaagagagaaaacatagacagtgtcaatcatggccagtgacagggtgcaattaacccaggatcaaattgcagcaagatggatggggccagatggtcctgttattctaacaaagggattttataaaacctcagtggctccttactggctgaagagcagacctttcacgctggggagagctagaggaggcctcgacttcagcccaacgagggactgggcattgcattttgttccgctgtggaatgctggctgctgtcggggcccacctctcatggcactctgtgttttcccatctctcagcatccacattagaatttctgttcctggaaggcagggactgtcccaggcatctgagtgtaaacagcatgggaattccaagtcagtgactctatgtctgggagtgctagaagtgatagacatccggtctatcaccagcttctcagataggcaagtcattcttcttgcatagagaaacctggaggcatcagaggtcgggtggtgctcaggttacagtactttggcgcaggtacgggagaggtggtccctcttctgtttggaaatgtgaagcgcgtgtgtgtgtgcac

SEQ ID NO: 477617 - DNA, 760 bp, Homo sapiens
tatgatggatttcagagtgcagcctttggatagagaggaggacttgtggtgttgtgtgtaagggtatcacctgaatcctaaaaagtgtgatggagccaggtctacctggaagaagaggaaactttccagggacatcctctcctcagttccagctgactgttgccttgctggaccctggaccccgtattgctagatctgatctggggacacaatgtccaagactgacaagacgccgtgaaactggcagtttagtgggagttgccaggagaagaagctctccaaagcccatgcaagtgaaagtcagtggaccccgccctcctgtgctagctgtttgttattggtgccacgtgctgccatctgtgaagtcgagtcacacaccacagacatggctgccagagaccaaggcgggaggatgtttgcagggaaggcggcctgagaaacactcccaagtgcacctgcaaccggaggactgttcatctgcagctccaaatgcattgtacaggcacaggctcactcttcccctttttctcacagttgtttagattgtggtttcctctgtcacatccgtatgaagtgtaaattatagtttccaatataaatggccattttcagcaaattttagcaaggaacaaaatttcatttgagactgaaatttggcatccctttgcctcttcatgctgggaactattttttgtctttacaaaatgcaatgagacataaatctttttgcttttatttctaaatgatactacaccaagcc

SEQ ID NO: 477618 - DNA, 606 bp, Homo sapiens
tggttcataggaaaaggtttgcctctgtgtcaacaggcagatgattcgtaattcatcaagatttagccaagacaataagagaaatatatgagcattgcaaaggactcatctcaggcatcaccttctcaggggaagactcttctaacacccttcttccctgcgcaagacctagtgtcatcccattcctccagggcccatccccttctggacaaaggacttgctgagagtgatgcaggcagatgttcctccgtggtcatcccactttcaggggtcctgcagctgaagagagacactccacctatttcctgggacgacaagcatcttttgcttaacgtgcttgtcttctctctggacattgcatctctgctaacactgcctggcccctgtgcctctcaaggcaggtgtccagatgctggctctcttggagtatctgacccagcaacagtgggtgacatgaagtactggctctggttcaacccatttagcttctaccctggaggaaaatgaggccaaaggaagttaaagacccagcgaatcagggtcaacttattgacttggtgtcaggtcttctgtcctcaatccagcattatttcttaacctgatatg

SEQ ID NO: 477619 - DNA, 511 bp, Homo sapiens
ctctcgaagcgcaagggaactgcccagcagggtgccacttgggcgccatgggtgtgacaagggaatatgtgcggggagctgactgtcctctggagtcctccattgatctctgttccttcatcccgtccatggccttgaaagcacttactacaattgtgaatcatacccttcttgtgatcagcaaaaaggtgataatcaaagtatttaagcacctgaagggcagggttgtcgatcatccaaaagttcacccatcctgctttgtgaatccaagctctgagtcagcgattttgccagctgctgtggctcatcgtgttgtcattaaattcgatgagtctaccattggcttggatgttgctaaacatcctacagtacacaagacagtccttcatgcaaagaattatcccaccccaaatccaaatgtcaatagcgccgaaagagaaagcctgctttagaggtatctaatacacacccaaaatgggagatgaatttcctgtgacactcataaaacatt

SEQ ID NO: 477620 - DNA, 1431 bp, Homo sapiens
gcgtctgggggcagatttccctgagcttcttctcagtatggagcctggtcctggcagggggctttggctgttgtcactgagggctcctgtggcctggacagctcctgcccctttcaggactcacactggcctcttacactcaccagcttttagagtggtcatggcagccccatctttgcctgccacctcagctggtccactgtttcccaggatctattggctactcaaggatgctagtaaacatcctatgatgtataggacagtgccccacaaccaagaatcacctggccccaaaatgtcaatggttccaaggttgaaggatcctgttctagaacttgcacaagtaatagagacttctaaatatttagatttagaagatgttacaggggcctctagcttctttctaaatcccagggaagcaatttgggttttacattgtggttgggaaaatgggacatatgtatacacatggaaaatgaaataactaaacaaaaggcccgcaatgtattggacgatgccggcccacactggggaggttgatttttgtttactaagtctacagattcaaatgttaatctcttctgggaacaccttcatagccattctcagaaatgttttaccagctatatgggtatcccttagcccagtcaagttgacacataaattaacctttgcaatccagtctcagcctcattttaggcatctttgcacccaaatcacaatgtcccagctccactgtcttctttcttgattacgggattcctgtttctatcaaaggagccctctacttgcttggcctctgacttggatcactcttcctctgcatttttcaatgatccattgatgtctgcattcatgtctaagctcattccacctccttggattgctgtcatatgattctggtatattttcttcatagctcttatcactgttaaaactattttatttatatagtttttcattttttgcttccacactaacatatatatgatatatagagagaaattatttacatatcacttctccttatatatcatatatagatatatatcttataaatatctatgtattgatatattatatatagaaattatgtatgtattatttatctttatatggaaataacatataacataattatatataattatatatttttatatataatattatatataattttatattatatatgttataatttatatatgttatgttatatataatttttatatataattatatataatatataatttttgtatataattatatataatatataatttttatatataattatatataatatataatttttatatataattatatataatcatattatatataattatatatttatataaatatattttatataaaaatatgaaattatatagattaaaataaaacaggacagaactgcta

SEQ ID NO: 477621 - DNA, 1487 bp, Homo sapiens
agcgagggctgctagcacttcccccatacctctctggagcccctgatcgcttcctcgggccatgtacatttccaaccatcaccagctctagataaacaaacagacagaggattcgtatgtggccttcgttaaggtgggtgccaattgtcaaattagtttctgcccaacctgccgagtgcaaatgcaaatccaccacccccggcgctgcctcatttgcagttattgattcatgtttgactgtgagttcaaaaaatgttgtctttgaagcttccccatctatgcttggcttcctgggtccaggtggctcggggatccctggcagtcattttgatctctgtattccaaacaccaacgcaggtcatttcagccttggggatactctgattaagagaggaagtcctggtgctcatggagcttgcattctactgggggagacaggtgagaatcaggcaagagatacgctggtacccggggtggaaacaccgaagacactgtttctgctctggaaagacaccaattaaagtggcagacagagattcgtgtgggagacagatgtattaaagttatctgtgcacttaaaaaaatcagagttagaagtcttaaaggcaaaaggagctattttttccttagatagttggacctgttaaggatttctgcaaaatgtaaaaagacctacattgaaattatccaaagcacccatctatcttattataagctttgatcatataaagttgcgctgatgttaagaaaaaaagtatcattccattgttcagatttttttcttgagttttgttcgttgattataattatgatgtgtgaagtaatgagcccatacatgatcggtaagacagaaagatgatttattgtttggggaagatttatgcaggaaaaatatgcagacaacagagaactaagtctcaggatgtaattgattaaacaagacagggatctaggtcttttgccttgacacggtgtagttgcctcctgaatcacacgggttgatttaggtattttgaagctaacaggtagatgtaaaagttggatgtttgctccacttatgtatgtgccaaggacaattttagattttgtgaattagaaaagggctgagtagaggttggaggagccaaggggattgggaagtatatcagggagaggctaatgtgcttcagttttattgataaatattacttttgccatgattattgcactgtattgggatgtatcattgactaaatgtctgtatggacaatgggatgcaacccaggtgatgtttatctcttcttttcccatgattagatttgactgccttttagtttacaggtgaatgctcacattctaatcagagaagatgattgggatataaagcattctcagaaaccaggaagtatgcatttctgaattcctgtttctccctttgcacatcactaaagtattttttcctttccatctattgcacctgtatgaatttgaaaagaatctaaaaagac

SEQ ID NO: 477622 - DNA, 1307 bp, Homo sapiens
cgggaagcatagtgacttctgctcagcttccggggaggcctcaggaaacttacaatgatggcagaaggtgaaggggaagcaggcacatcttacatggctggagcaggaggaagagagaatggagggaggtgctacacacttttaaaacaagcaggtctcagtcatttactgaggacccaatggcttgtgtcctgtgacggatggaagctggaggcttgcaaataccaaccaggattctctgacgaatcaccaccagcagctttctccaggacgtccgctcctcctccggtgcctctctctccccatcgcagagagtttccaggaaacttgcttttgggggctgtcctagggaacgatggcaaaattcccctgaaaggacacattctgaaggtctggttggttgaccttccagagctttacagatgccagaagtcaattccctgctataacgaggtgaccagttgtcccactttgcctgggactgcagatccccagagcatgaaacttaccattttgaaatcaggaaagttccaggcagttgaagatgggttggtcaccttcgcttttcaaaaagctggatggtctctcagccttggacctggcactcatacagcccctgtggtggaagggcctagctctgagctcttgaaagaggatgatggctctcagagacacctcatccttacccatgtcttctctgctttttggaatttgaggaacctcatctaccagcctccaacttgggctctggacctgtaagaagcccttataggaaggaatagagatgcatgggctgattttaacattacagtccactaatgggcgttttacccagggtaaatcaacaaatcaagtgttggttcgcttgagtgtaataatagtggttctctcctaatcagaaagttctgattagcagttgatgagcaaatagaaatagcaataaaataagaggtgacctactatgtgaaggttgacagtatcttattcatacttgtattctcaccaccagctccatttcataacatattgcctggtttatataggagcttaataaatatttgctgaaggaagggaagaaagatgaaacaaagagggaagaaagaaaggaaaagataaagagagggaggaaagaagagaaaaaatgaaagaccaaaagaagaaaagacaaaaggaaggaagaaaaaaaataatgaaacagatgcatgaataaataagttaggttccaggtgaggacatcctgaggaaatacctttggattggtcttgtgaaacttagaatacttcactcatttattttaaaaagtattt

SEQ ID NO: 477623 - DNA, 674 bp, Homo sapiens
ctctagaggagttcctgcttcatgtctttcctttagcttctagttacccccaccccactctctctggtcatgatcatttcaccttatccgaagcaatcttgcttatttatgagtttagttgtgtattggctgtcttcctcactgaagataatttgtggctttcaaggaattcgtccactcactctaaattgtcaaattgattgtcacaatggatattttatgaaatacctgaccattaccgctgacaactctcaaggcaaccaaaaacaagaaaaatctgagaaacagtcacagccaggaggagcctatggagacatgatgactcagtgtaatgtgggaaccaggatgggagcctggaacagaaaaaaaatcagcccaggtctccaaggacaaatgggccctcaagttcatcaagaaaagggtgaggatgcacatctccacaaagaggaagtgggaggagctgagcatgactgccaggaggaaagcagctgccaaggaggactgagccccctgccctgccgtctgcccaaaataaaagcttcacagaaaaagaaaaatgcatttctgatcccttctgaggtttgattacacatgtcatgtataggttccaagaaattcccctatatctttataataaattgtccacattggtgaactaacttaaaggagttctt

SEQ ID NO: 477624 - DNA, 846 bp, Homo sapiens
ctacgtaaagggaggtgagaaaatggaggtgaagtggacctccggctatcgctggggtgcaggagacagcttcagaaagtcccgctgcaggagtgggaccagctcctcacatttcaaaaatattatccaccaacaatgtttagaacattacccagaaagccctcctgggcagtgcagccaagtcctcatcagtgccaaaaatatacatttagcaaatgtccatgccagcgcctcactcccagaatgcacagttctcccaagctgcttccagagccttctaaagtactttcccactccatctctgaccctctctaacttggtggtgttcattctgcagacaaatagatcttttgaaaatgtaaacgtgatagatacggtcactttcttgcctttaaaactcctgccttccctggcagttctgctgtggttctctgggtgtgttagtggctgctgggacaaagtgccacaaactgggtggcttaaaatcacagaaatgtactgtctcagagcttcagaggctagaagtgcaaaaacaaaggtgttggcatggcattgctcccactgaaggctctggggaggacccttccttgcctcttccagtttctggttgtggccagcaatccttggcttgtagacacatcactctaatctctgtgtctgttgttacatggctcccttcccctgtgcgtccgtgttgtcaggtggcatcccctcttttggtgtctgtgtccaaatttcctttgatttttaagaacaccagtcactggacaaggaccaatcctaaagacgtcatcttaagctgattacacctgcaaagacccttcttctgaataacgtcatattcac

SEQ ID NO: 477625 - DNA, 1026 bp, Homo sapiens
tcagtgagaggacctgggctgctccattgtgtacgtgtgtgcatgtgtgaatgcatgctgtctgccatccctgcctttgtctccttctcatcctcttcttccacctgccttcacatcttggggccccggtgcatgtcctgagctccaccctcctcctctgcaccaccttgccctgcccttgccaggagccccaagtcatctatgagtcctcactctcctgccgcccacagcccatctgttcttcctgtataatctttccccaaaagctgctcagcaccccccaacccccaccatcttatcagcccctgccacagccctggcctagaaaattgaagcctggaccactgtacccatccatccatccatctgtccatccactcatcacccacccatccattaatagacttgcactgagtacacactgggtccctgctgagcacacaggccccaaaggcaggagctcagagtccagaggggtgacagaatagttgtcactgcccttcaagatgggtgatggagacttcccaaggctttatgtcccttttgtcatcacacacccaaaacaaagccaatgatgatactgctttcccttaagatcaggaacaaggcaagggcacctgcttttagtctttctatttaacatgatattggcagtcctagccagtgcaataagacaataaaaagaaataaaagaagatatagcctggaaaggaagaactaaaactgtctccattagcagatgacattactatctatatagaaacttccaaagaatctacaaccccccacccagaactagaaagtgagtttagcaaggttgcacaataaaaggccaatgtaaaaatggccaatataaaaaaaagtcaatgaacagttggaaatggaagcatatatattcctctagaaaatgcagaatactgtttggtgttttttaaagaaatggcctcatactgtatacattattctccaggggcttttacctccagcagcccccatagggccctcttccccctttagaacagagag

SEQ ID NO: 477626 - DNA, 713 bp, Homo sapiens
ccaggcttccccttctccccacctccttcctttaaacttgtgctgactctttctcccaaatctcccatctcctcctttgctcctttcatcccatggccagcatggttgccctggtgacagccatcctcttccctccttctgagtctgctttccagcatgagagatgtgttctggtgacctgttcctcccatgctctgtcttctctctctgtccatctgcagaaaatctgggaaagggacccttggctttacttgcttccattcccagcccacgcataccccatccttggcaagggacctcagccacattgagcccaccatggttctcaagagagctctccatagacctccttcttgccaaagcccatggtccctttttcctcctcatttctcctggcccattggggtcctgattggggtgcccatccttgcttgggaggccactgtctcctccttcaggacactgggtgctcctggcttttctcccacccattgggcagtttctctcttccatccacctctcaatactgatgcttcccagagctcagtcctccaccgcttcctgccctgcccgttccccaagggcagcttcctccacccccaggacatctgtggccacccattgtccttcttggacatagagctctctcctgaactgggacttgcacatccatgtacctgaacacaggactagacacttccctgcccttccca

SEQ ID NO: 477627 - DNA, 664 bp, Homo sapiens
ctggcagtttgaaggggtgggaatgggccctggggtctgcctgagccttcagaggtacatcctcggggagccagacacgggagacacagcagaagatgccagaagccctggaccacacaaagctcttaaactagcagaggagacagacaaaaaaaaccaggtggtcatgcgtgtgagggcgaacatgcaggatgagggcgacaggctggaggatgacctgagcctgcgcttgcaatgggtgagggaaggggccaagccatttagacgggatattcagggaaggcctcttggaaaaggtagctttctgtccgagatctcaatgacacgaggaccagatctcatgagaacttatgagaacagcaccgagggggatggcgctaaaccgttcatgaggaaccgccccatgtcccccatgccccgtgcccagtaaatacttgctgaaatcactgaataaataaagcactgaaggcatggcagatgggacactcaggaaggagggctggttctgaggaaagatagagtttgaatctttgaatctttgctcaaaaagcacctcttaattttagcaaagaggctaagacttttcaaaaccatcaggttccggcttcttcatgtttttaacagttattcacttagttcacctatttcatcttgcatttaccat

SEQ ID NO: 477628 - DNA, 1959 bp, Homo sapiens
agccttctaggaacacttgaatgcggcctccaggacgcactcgcgtgaggaaacccggcccgcgtgtccgagttctgtccacgccttctgccaacagctgtcctttgctcttcggggctcctgggaccgcgggaaggggccggggttgcctggggaaggggcctggtggcgctgcagaccccaagaggccgccctccgccttcagacagctcccgccgcctcccggcgcctgggaggagacggtgggaaaatcgcggcggcgacgagagcccggcctgctctttccgttccgctcccgcagggggcgccagcgctccgtggagagcggctgcggccccagagaccacgctcgggccgcctgacgcccagagcccccaggaaggggaaactgagacccagggaggagaagggaggctactcagacctcctaaattctagtcccaaattccacagcaccaagcttgtccctagacttaggaaatgcagtgggagcgctgttctctacctgggctgcacaggctggctcagaggtgggggattggactcaatgacctctcagtcccctcagagaccctcgccagctgtggggaggtggggacaggtgtgtgaaacgcgggatgggctgtaagggatcccaggacggaatccagccctccctacgtattccctgtctttgcaggactgtggtgactcccgtcttcctcttctaggtggccagacccaggagctgactcccagaccgaggaggcctgctggcactgagtccgtcctgtatctagaaggactgccatggccctggcagtgggggagggctcttaggacctggggcaggctggggagtcaggactgagaagggagtgggatctctgcccaagcaccaccttttccaagaagccctccctgaccctccaggcctaacttatgtccccgtgtcctcctggaaaccatgctccttgccttcagagcccccacttctacttgcactcttggtggcccagggtgggccttggccttcagcctgctgacccaggaccctcactccttccatagtggggaccagtgcctgtctgagccccatcatgatcccactgggagcagccggcgcagtgattgacgcggtaattggcgcgcttaggcaccgggctaattgaggtcaggctgcagattgcagtggctgcttcgcagaggcggtgggcgtgggggctgcgcgcgctccctccccctgcagggcctggtgtgaggacgtcgtggagcggggaggtccccccaccccgccccccgtcctttttcccttgggagaacgctctccagcggcaggactaaacacacagcaggtgctaatccacctttgaatccactgtggccccaaccacagatctctcctcctctttctgccccctcacctcttcccaccccgccgcccacgcattttacatcatttctgagagatggcaaaaccaaggcccagagagggaagccccttgcccaaagtttcatggtagactgtctccagcatggctgaccttgcagatatgctcctggatgctttcagtgaaaattcagtttacacccatgctgggagtaggggttgggggagacaaaattaccagggactgaggaggcagcaggaccaagaaggcagcagcctggctggagaccatggatgtaggggagccatggtcatggtcatcatggttggggctggcattcaaggctctgcatggctttcctcctgtccacacttgcagtacagctcctaccactcactctttgcttcagccatgccttattggctccagtcttatcatgttgtgcctgttcatgcctccgagtctttgcacctgctattccctctgtttgcaaagcctgccactgcatttctctgctttgtgaattcctatgcatgggctgtggcttgtttttaactaactttcatttcctaacattcactgagctctt

SEQ ID NO: 477629 - DNA, 638 bp, Homo sapiens
aacaaatagaatagagcaaaggggatgggatgtcatttccacgattgggttgcaaaagattgtgactttcgtcttgctagcagactctctctgtggccttctcagcttgcacacttcgatgaaaggctgcctcttttgagaagagggagaaaagaagaagaagagggagataaaaagaaaatgtttgtgaagcagccaccaaaagttaaaagaaaaaactttatgtctaaaggtcaagtagttggtggccacacctgggtgaaaggcagggccaatcctagcatccggaaagatgcggtctgtgggtacaacacacactatttgcatgatagttgtactaaaagcccagactcaaccataacactatataatcaagtactgcacttggactgcctaaatgtataaaaattaaaaattaaagaagagaaagaaaaccaaaaaagacggagaaagaaggaaaaccaagaaagaagaaagaaaggaaaaagaaaggaaggagggagggagggaaggaaggaaggagggagggaaggaaggaaggagggagggagggaaggaaggaaggagggagggaaggaaggaaggagggagggagggaaggaagggaaagcaagcaagcagggagggagggagggaga

SEQ ID NO: 477630 - DNA, 507 bp, Homo sapiens
gcttctcgccgcctggatccagcatgcctgaagtcagcagtaaacttggatgcttcagttacaagagaggcaacggcaggtgcacaagccccgaggtaagaaagggaaatgtcaagaccagaaggcaggctgatacggaggaatcttccagaagaagtccaaaggatgaactgagactggacttgaggcaggaccttgtgagcccagaactgaacgtgggccacagatgggagagtttagaagctctgcaagaacttctgatgtcctgccgaggtacagaaccatcagctgaaaagtgtgattctgaagcttcagtgatccccaaatattccttgccctctgcacactgtgaagaccctctgccacagggcttccaggagcaccgcctgcagcgggcttcccacaccttcactgagatgaaccatcgaaagccctgccttggcactcaaacctccaatttcaagattgggaaagacaagtgtatttctgcatgttgaattttctttc

SEQ ID NO: 477631 - DNA, 543 bp, Homo sapiens
caggtaacctgagggtggtttattgctctggagacataccatgatgttggaaagggcattctttttctttgcaggccagaaattcgacaggctatgcaatttatttaattcaagcaaggatgaaatccacaggaaggtgcttccggggctggtgcagccgctcaacagtgtctttgaaactcaggttctttctgattttctcctctgccagactcagagtaatcgacttctcttcatgcctcacttgtcagaactggatctcaccactcccattcgcaaaccagtccctgcaaagggtagtaggattgctgtaattggcttaggtcaggagtcaacaaactttttctggaaagatccagatagcaaatattttaggctttgtgggccaaatggtctctgtttcacactacaattctgccattgtagtgtgaaagcagtcaaaggcaaagtttaaatggatgtggctgtgtttcaataaaactttatttaaaaaaatacaggtggtgacataacaactaaactctaagagtctggacagaagcc

SEQ ID NO: 477632 - DNA, 584 bp, Homo sapiens
tcctgaccattggaacagggcggggaggcccctgggttttaatgcacgtttaccaccaggatgtgggtactgaatgcgaattagatttgcatctcattgttaaagtgcggtggcatttcaaacccaaacgggaacttgcagatcagattccagtgctttctggagctagaaaaatggtatatatgggcaaacgagccagttgggtcctggacatcgtgactggcaatgtcagtctggaaaccgaagatgtcaccaggaagaaaggacaaagatgtaccagggaggtccaaggtatttggaaagaggagaggttatgccaagtaaaaacaagcccacaaacctccctaggagagacacacgcataccttccacatccggatcagggtgctgatgatgatggtgatggtgagtggaaaatctcaagttccccacatctgccaaagttggagcagctgctactaggagggcaccagatggtaggtccttgcttcctgtactgctcagagtcccagcagaaaacagaattccattcagatgtttgaccagagacttttttctttccttttgaaattatactttcagtt

SEQ ID NO: 477633 - DNA, 614 bp, Homo sapiens
ttctgtaggatgaaaagggttctcaaatatacctccctagtcccgcatatcctaaacttcaacacacttttccggttgccaattacatgtctccacgtggctgatgccctgggaagtccaagtgctgatgccaagctcgtgcccttctctcaccctccccctcctctgccctgcttcctgcaaaccagacacttctttctttcctgcctctgcttacactaccagcaggcatccagagattacaaagcaaatacagacaggcaccacgcagaagccaaagaaaacctgttgcaagctgtactggcctgtgctcaaaaccaacttctctttgggtttctccttctagcttcaccttcgtttctccaatcattgacaaaatttgttcatttcaccccttctctaagtcctggtgtatcttttcttcagccaactgattcggctcaccagaaaagatgcaccgcgtgctgttccccagtcttcagctagcccagggaagttactattcacaaaaataagcaaaggctttagaaatgaacttaaaatgggaatcaaatatttgtaatgttctaaaatgtcacaggtaagttaagaaaatgaagttagcaacatcacac

SEQ ID NO: 477634 - DNA, 2532 bp, Homo sapiens
taacgtaagcccaggcacacagcaaaccagcaccagcacagtgcagctcctagtcctactgtcaactattcctcacccatgtttcaaggttaaaagaaatcgggcagaacattcggcctgaaattcagatttgggggcatgtggggaagcttagaatgtccatgcaagtctctcagtagtaccaacagtgccctaaccatgagcacatctgaagatttttcaccaatgttgaagtcagctcaaggatgttcatacccagcccatgcagtgaaagcaggactatctgttaagaaatgcacggagctgccaaaacccgctgagcagcgcccaacatctggaattcaaactgctggaaatgtagggagtaagaaagctattcgcctgctgttcactgcagataaaggtgatttaaggagagtctggcttctggatgcattttcaccctcacagaccttgtccaaaaactgggatctagaagactttgtgcaaagcaatcagatttcatttgctacagatggtattttggccatcctggcaaaaggctggctttcctatctgagtgctaaatcgatattccaatctggtcttttgggaaaattggcttgaacctgcagaagaaattcaaccaaaaaaaaaaaaaaaaaggaaaaggaaaagaaaagaaaatagatttgaatgtgagctgattccattgaaacttactgcttctagacttacatttttcttttgaatgtccacgaagtaggtcaaacacaaggaaaatagacaatgtctagttagacgtctcttaagaactagatctttctaaaaagactaagtctcaatggattttcctgaaaaatgctgttgctgttggatgaacaccatgagaatcctttcttcaagcagtaaatgtgagaattgctggcctcttcccgaattccaaaagttgggccagtgatactgacacaaccgtgttatacatgtgtcagtatgctggcagtttcaaaagacaaaaacccaacttaaactgtcttctgtcagaaataatttattggctaatgtaacagaaaagttcaggataatcttcaggtatggctaaatccaggtgcttagactctgtaattagagagccacctgtatctcttgtccttgctttcttctattttggctttagtcagcctttttattcattgcagcaaaatgtcctccagcacttctagacatccatcctgttagaaatagtaacacactataaagtgaatttcttttttgtaatgatttcagccaaatctttatgttgtgacttattggttatgcttatgtacattcctgaaccaaaagtggtatccaggtggaaaaaaatgctctgatcattcatgccttagtcagatgactacccttggagctaccctaaaataaattgattcaatctcacataaaccaaatggactagattacggagcatttctttccaaaggacaaaacatggactttactataaacagagaacaggtgatatgcagcaaaaatcaaccaaccaaccaacaaaatacatttgtccattggggatggagatgggaaggctactggcatcaaaatttattcacatccatcaacgttttctttggcgaggtctctaggggaataatcaaactgtgaccattgtatcaagccttaggaaaaaatattttaagccactttaacttcccttaccctctcccattcaaagccttactttagaagatgttcacaaaagtcaacttaatataacttacattgaaaattgttaccagttccttgcattttattcttgatgaaaaaattgaaaggtaccagtgatcccgacattctaaaagaaaaaaagaacttccaggattcatatacagcatatgaaactggaaaggattgtttaatgagagcttgagtataagagtgcttacatttttaaacaccaaattgagaagaggagtaatggttatattaaattttaatgttagggaaatgggctctgtcaggaggtatatggctggataggttataaagtaatgtgagtgcattcagactttgaatttttcctaaatgccatagaaaccattttacattagtcacgtctaacttaagagagagagagcttcagttcctggaggaaaactgcagctagaagtcttgcctttttatcccctatatggactcttcattattcagtgaacctcagaaacaaaagggcttattttaaagccaaaagatttgtgtccatgtcacagtgctggaattttaattctttctcttggaagatgaatacaaagtaggagaggttcaagaaggatgaaaagaccaaatgagtatcaaagaagaagttgaccctaaaatgtaataccatggctcatcgtctaattaaataaggatccaaatataggcttattaacaatgaggacctttctgtatgaggcattttgctttgaaacacgaagtatatagtctattttgcaagacaagaaaatgaaggtaattatagcatagagagggagagagtgtcaaaatgtaaaataa

SEQ ID NO: 477635 - DNA, 1007 bp, Homo sapiens
cgttagagcaacagcaaagaatccagtgcagctgtgatgaagccgctgtttgtcagctgtcaccggatgcaagggtaccgcagctggagctgagcttgtcacttcaacttctgctagaaaggaccggagggcccaggaagatgtttcagcaggctgcaacaggaatgctgctggcaaggtggtttctttctctagcttcaccttccatgcttgtctgttttcacactgctgttaaagacatacctgagactgggcaatttacaaaagaaaaaggtttaattggactcacagttccacatggctggggaggcctcacaatcatggcggaaggcaaggaggagcaagtcacatcttatatggatggcagcaggcaaagagaggcttgtgccgagaaattcccatttttaaaaccatcagaacttcatgctgaaaagcttggagatatgactaaggaaccaacaaaccataacagatggtattggctgagtgaaggatcaaatttggagacaaacttgtgtactaatgttgtaaaaggtggtaaattgtcacttctgggaaccatagaccagaatgtgaggtgcccagatcaaacattacctctgcgtatgtctgtgagagagtttctgcatgagattagcctttgaattgatggacttacatttaaagcaactgttattttgagtgttcttttaagaactcaaatgatatcctaaacagttcaataatagtctctcctttcagcattctgactttcataataagattttgtcattcttttaaattttccactgaaggatattcttagcttgaatttttcaagacctaaacaattaacacagaaaagggctgaatgtcagagccacaaaacaatggttgaaagttagcttttcaaatttattgtatttaatttctgttcatttgaatttagatagtgtaaatgtactgcagagtgcaatctttggatacaaatttgagagctagacacggtaatcagactttcttatgcc

SEQ ID NO: 477636 - DNA, 1438 bp, Homo sapiens
gtgcctctccccacgggactaagactatgcattcttatacaagtcaacttaacatcgatgaagaaggtgcttggttccccttcactttccgccatggttgctgtctgcaagctgaggagcaagggagccagtccaagtcccaaaaccttgtaagtagggaagccgacagtgtagccttcagtctgtggccaaaaatccgagagcccctggcaaaccgctggtatagtaaaagcttcctaaggcctcaccagaagccgagcgatgctgttgccatgcttgtagtctgcagaaccataacccaaataaacccagtttttataaattacccagcttcagggaagaaacacatgacccaaagctggacaatccactctatggtcaatgaccaaccaggtacccctgttaaagaatctgagctaaaagatattgcattagtatttaagaaagcgatgttagacaatgaggagagatactcttggccttgatctcttggagaacttaaagtctaaagaggaagataaacagaaaaaagccagcaaaaaccgtgatttgtactataaagaaaacaaggaggaaacagagggagaataacccctggttggagaaggtgggcattttgataaggaattttgggaattttctctgaggagacttctcagggaaaatacagtggcccacatgtcctatgaattgacaatacttacgttttcaatttcttgatagatcattttgtttatttgcatattccacaaatgtttattgagccttttctgtgttgtgtcgggctgtactggcactgggacacagccatgagcttgcttgatctatcatgaagcttccttctaggactcagtttccaataaaggagtgatgcaagcaaagtgaaatgaagatttgaagactacatatggaaaatggaaatataccacttttcacatgaaaacgcccatctgaaacctacagacatcttagtcccctcttgaattatctggacaaaatgcctatgtatttgtggatagaatgtgtaaagataaaatgacagctgacatttcatgagggctcattgtatgctaggcattttatgaactttatttcttgcaatattattcccatttccaggcgagcaagttaccaaggacacgtagctaatggcggactgagtctggttttaagccaaagtcttactccagagatctaacacttcttgctaccttcaactgcttctcactgcttaggtgacaagtacaccaaaatctcagaaatcacccctaaagagcttatccatgtaacctgaaacagctgtgcccccaaaactgttgaaataccataaaaatttgaaacaataaaaatgacagaaaatgacagaatatatatgtttgtagaagcacaattcacaattgcaaaattgtggaaccaacgcaaatgtccatcaatcaac

SEQ ID NO: 477637 - DNA, 1069 bp, Homo sapiens
tctggtcagctgcctcactggggtctggggtagtagaataaatttctatgacttctccctgttggctccatggacagctttcagattttcaatgacgtctgtttccttgccagccagcaagcacgtatagggtataccctcatccaatatgactggtgtccttatgaaaagaggaaatttggatgcagagacagatatgcacagagaaaagaccatgtgaagccacaaggagagctccatgtgaagatgaaagcacagattggagcaatgtatctacaagccatggacaccaagattgctgatgaatctccagctggcgaatcatcttctaaaaatgggctaataaaattggcaagcgagattggcaaatgggttttggctaaagattattggtttgctgctgttgatatcacgatcaaaagcttcaggctatttgtccttggctgcccctgtactgaagtaggcaccctgctgttcaccttctgccttgttcacttacaaatttaggcactcagagtcatctggttgcgttactactgtgtatgctgtatgcttagccacaaactccaattgctgagtaataattgatgagtgcttacttcttaaatcaaatgacccctccagcctcttttccacctggcctggtggtgcaggtgcatctggtgctcacatgcccctgttgctgagtcaactacccagagcctctcgtcaacattgctgccacccttgggaaggtcagcaatgattggcaatgctcagagctaagtaataacaatttgttctctcactttgagtcttgaaattttctccctaaataatgtttttgatgaatagtcttttcctttataatcaatgtgtttcatgtctggttgaaaatatctttgcctaccttcagatcatgaagaaagtggaagggaatgatgtaattaatgggataattctcaccctggggacacttgggtttttcttcatgctattcacaaattatagaaagtcaaaaaggtccctgtaaatttgttgaccaagaatcgtattacgtccaaaatatctccctcaagtttaactttac

SEQ ID NO: 477638 - DNA, 580 bp, Homo sapiens
gctgcagggcatgtggttttgctgctctggttcctgcagtgtatgacatgaagcaaccagtagcatgtagcatctcctgtgaacagctttcctccggcaccccctcaggtggctttgcagagtttgccttgacaggaattgatgactgtaaatcgaggtggagacataaagaagttgtcaagaatgactcggtttctgactttagcaacccaacagatgaagaaattcacccaagactgaaaacatgttcacaaaaggacttgtacacgaatatttatagcagctttactcacaacagtccaaacctggagaaatcccacgtgaccatcaacaggagaaagaataaggcacagcctagtagagctatgaaaagagggccaccatcctccagacctcagaatggtaggtccactgacagcttgcactgtgtgcctggaaaagctgcaggcagtcaatgccagcccttgagagcaaccatgggatctgcgccctgcagaaactcactctttgcatcagtgtggcctgtatgtgagacatggagtcaaagattattttggagctttaagatgtaatgagtgcc

SEQ ID NO: 477639 - DNA, 709 bp, Homo sapiens
ccgatccttctttttggcattagtgctctgaaccctggcgtctcttttgaagagaaataaatccaaaatatagtcaacaccatcatgttgctgctgagtatttggatggcttttgtctgttcgtcaaccctctatgctagagagcaagccgactgcaattcgactagttctttgatgataattgactgttttgaaaatattgagcccctgtgtgtcagggactccacatgcaatatcatcatcattttcataatgaccccaaggcaagacctgggagatctggagcagccaaagacctgggcagcacagaaagctgggactgagggaagcattcgtgacagcagatgcaaagaacctgtggccaaagacatcatgtggctggctggcaagaggaagggccagcctggagaaagaagcttctggaagaagtatggaccaagaggtccggagcctacgtctcaagagggattgctttttggactgaagctcctattactgagatatcgggcaaatcaacatgatttgggtcattattcgaagttgtgactctcgttctgtgccttaatccaggctatatttcccccatgattgtatagaggtaaaatctaatttaaattagctaagacatgattgaagatagtaacgtgtataaataaggaatccaaaggattcatggaccacaatgaggtttaaaaataaagacatccac

SEQ ID NO: 477640 - DNA, 784 bp, Homo sapiens
cagctggccagtgttctcaagtttaggttggttcaattggagctaactttctaagtagaagacactagagctggtggcatttctgtaacacttgacagcagtccggaaatacgtggggatgtgaatgaagaacagggcagcacagcaagacagaaaggtcaatgacttgtgctgggttctcctgctgactagccacgtgaccttggaagtttccaaaattaagagaacaaatagtcgtggttccaaacttcacagaacttatagcctacaaggacttagtgatcatgcaattcaaggctctcacttagaagatgtgaagtccaagcatatagataatattcctttcaaagccctgggaaatagcaaatcttcaaatgttaaagaaacagaaagaaaaattgcgagtccaggatggattgaatgtgaggcagcagtaaaatgcaaagaagtagatggatacagactatattttggaagtagagatgatggcattagcagtttggggaagagagtagaggaacaaagaagaatcaaggacgattccaaagtttcttacttgaacaaccgagaaagtcaatattaactgagaagtattctttcttcctctacataaagattgacattcattttcatagagcacaattttgaggcttagattttaagctttctaattgcatttgcaaataaatgttatgcttcctgtaattgaataatggaaacaggaaatgctagtttatctcaataagataagcatcatcattgttttcctatttttctggaaccc

SEQ ID NO: 477641 - DNA, 506 bp, Homo sapiens
aaaactcctcaggaccccccgaatggtggggctaaaagagctggagcccagacttgagagctcccaaagccagggctgtgactccctctttggggccttgtggttcctggagtccccaagcttccaggtgctgccgcattccctggtgccagcaggggaagctgcagccttgcagacagctggtgcctgtgctggcacctggagctgcccacccctcagcaacagccagcatgtctggctgtgcacagtggctggaccctacacttgctcacacaccccttgccactccacacctgtctcgcccgtggcaggcatgggattgagaccggtagtgaaggctgaatactattctcttgtgtatctacaccacactttgcttacctggacatccgttgatggacacctggattgcttctaccatgtggatttgccattttaaaaatgccttttacttaccccaaagtaaactggatagctttttgaatgttttatagtgttatattttc

SEQ ID NO: 477642 - DNA, 560 bp, Homo sapiens
tcaaaaggttatgtggcagctcctctcccaaggatgtaaatgttctgtatttgtgccgtccggtatggtatctactagtcactatatgaaaagggtgcaatttcattcttttacttctggatattcagtatttctgacatcatttgttgatgagactatcctttccctgtgtattcttggcacctggtcaaagatcagtttctgttgcgccagtgacaatatgaagatcaagtgtgctggggacaagaatggaatcaccaagaccagtcaggaagctaaggcacacagatggagcctgtggcacgctgataaatggcccctcaaagatgtccaggttctaatttctggaacctgtgcatatgtggtggtgaaaaagcctttgcagatgaagttaaagagcacaagaaggattgatgatccttccatcatcaccagtaataaagagcctgcaaatttgtcagccaagtcctgacagtaaaatctttattgctggtgatgatgtaagaggctaaagggacacagcttgagttgtagatcccagaatatagaaagctgatgtc

SEQ ID NO: 477643 - DNA, 852 bp, Homo sapiens
gttggttggtcacgaaaatacttatataaaaacagctaacaggatgtcaccaaaaagtttactggggttgtcttggaatgttggcagagagagattatctggagaaaggagcatctgtgaatcattaacagcccctgaggcttggtgctcaggcccggtgaaggaccctagcagcaccagcagcagccacttctgggactgccttagcttcttagggctgctgcagcacattgtcacaaacttggcaccaacttattctgaacttggcaaggctgcacttgctatcttgggagctgtgcccattcacaccgtgtcagcaaactccactcaaagaacacaatacttcaaaaaaccccacaatgccagtgcctcactaaacaccttccctatggagtacagaaacaactcatgcttgtctggatgggcaggcagcagagaaagtcaaacgggcttagaaatattagcgactgtaccccatggaatcctgggcgctggcaagggagaaaattcacctggacttgtggacctgcagcctgaaagctgggcagacgtggattcccaaggaatgttaggaagctgtcatcaaaagacgggagggtgagtgctggtcaggcagatcacaaccgtccactctactaggagtgccagtaatttgtaggtttgatcactttacataatcccatatttcttgaatactttgttcatttttcttaattcttttttctttatcttgtctaagttagttcaaaagaccagtcttcaaggtctaaaattctttcttctatttgatctagtcaaatagaagatataagcaaatataagctttcaattatattttgaaatttaaatgag

SEQ ID NO: 477644 - DNA, 646 bp, Homo sapiens
cgtgggcagaggtccctgcggctttccgcagtgcattgtgcccccgccgcctccttcctcaaggtgacttctatattctggaggcttctgtgacatcaaacatccaggcagggaatgcctggacctagtgtcacggtccaacttcaccacgtgcggcagtccaccatgctgcctcctccccaactcctaacactagcttgggctcctgggaaatactcctgctccctgtcctctccaggctgtggaagatctgctgctgaacccctctggtcccacaaaatcatcctgatgcctcttaaccctgcggaggcctcaggaaacactgtgagggttctccctaaagccgccaagttggctagaaaacatcttaagctggaaaaccgtgggtccaactacaaagtgcactgttccatgacagggcagtctggatattgggactacctgcggcagtcacatcacctcagctcaagtattgagagaggtagaaaacaggaactggttaagatttcaaaacatcctgccatgctcatcatcccaagttgtgattctttgcttacaagctcttctctcccatttatctcagtgttcttaaggccactgacccagaatttacttttctgttcgtgacccctctggcctgagcctc

SEQ ID NO: 477645 - DNA, 678 bp, Homo sapiens
tcccaggagggcagggaccgtggccaggtgcaccccgtgttgtcataatctctccactggcctgaatgctccgaggagaccaggatgaatgtgaatcaaagtgtggagcctccactcccaagaggagaagagaatcgagaattaagcctgtgagatgtagctgtacacagagaagagatgagggcggcagggagccctctgaggagacgacattcttgattcttgagcatgagttggaagaaatggagtcagccaggtggatatttggaggagcagaatcccgggtgaaaggaatgactgtgccaaggttggcagagagacagtgctaccatgatcactcagagacccagacagatagagcagccatcatcttaaatgtggccagtaggcaggccagtgggaaaagagaatgtggcctcggcaaatctcatggtcacccctgacgctaagaaggccgggaggcgccctcaagcagagagagctggagtgtttttgaatcttccgtgaacactccgtgaagtagacttgtttttaaaaggattaaatccttacagaaacagctgaggcccccatactccctccctaatcccatgcccatggcccctttaggaattatcattatctaaagctgctttcctgaaggatttgaagcagcttataatagcaagcacaagactc

SEQ ID NO: 477646 - DNA, 914 bp, Homo sapiens
agcacacaccacgatggcagagaaaggaatgttatttcattgtttatgtgaaattcaaacttaactggcatcttgtattttatgtagctcctctccctctataccatgtcatcccctgacagacttgtcctagatgccaatgagaactttgcctcttcccaagtgtttgatcttgaggaagtgatttatccttctctgagcctccattttctcacctgtaaaatgggaataaagatgaaatgggattatttatgtaaagtgcttgctctagtgcctagtagtcagctggttgaagccgtattgttgctagtggcatctagagaacagcacgcacaaggcctgcatggtggcatgattggggcgtttgaggaataccaaggcagccatggtaggcaaaactctagagctggctccagattctcattctccgattattcaaccaaacaggaatccaggtgctgctgcgaagggtttgcagttgaaatgaaagtcccaagtcagttgatcttaggatatgaaaatgatcctcatggccctaatctaatcagaggggccctttaagagcagaggatcctctctggctggtgcaggagaggtcagagtgtttggaagcacgaaaaggattccaggggcccttgctggctgaagatagaggaagccatgagacaaggaatgcaggtggcctctccaggtgctgagagctgcccctggctgaaagccaccaaggaaatggggactatcgtcctgtaaccacaaggacctggatcctgcagttagagaaatgagcgcagaagagaactcaagctcctgggcctgcgcacctgctgttcccgcagcctgtgatgccctccccaccccagccctgtgacaccctccccaccccagccccgtgacaccttccccaccccagcccc

SEQ ID NO: 477647 - DNA, 861 bp, Homo sapiens
tccctgggtctcagtcctcccacagcacccccaggagggcatggtgggatgcagagacactggatctcaggccacactttcctgaatttttccccaaattcagtgacccagcaggacctgtgcctcctgacgtggtttcactgttatttctagagtctcccaagggggatcccctaggcctccaaaccagcctcagaagccactgtgggtcctcggaagtcaccgtgggtccttggaagccactgtgtgtcttccctgccctcttcccactatgctctcactcgcctgtgcctgctaccccaaggctctggagaaggctgcctggggcccccatcccaggacaccagtgtccacaccaaggtctctacctgcaggcagctgcagagctctggcccctgggaaggcagggggaacagccgcggaaaagcttcgaggtggcaaagagccgggagagttctgtgtgactgcagcttggcaggggatccaggagaggctggaggcccaacaggccggaccaggaagtgccagaataaaagctcccggggtcctggctgaggatgctgtgccctcgcccatccgtggccactgccagccatttgcatcacaaatgaggcacagtcgtgccgttgggcaccagcctggtgctaccctcggtgactcaaggacacaggccaggatccagctgctgaacgtgctgccttgccccacccccagccgcctaaactgtggaggaggggtataggtgaggcccattcttggaagagcagcccccacccaccccagggctcagccctgtcacacccgtcccccgaggactggcatttgggcatcatcacctttttactactttcatcaccttct

SEQ ID NO: 477648 - DNA, 987 bp, Homo sapiens
cccctccctcctcctcctcctcctcttcctcctcctcctcctcctccttctcctcctcctccttctttgagacagaggactcgggctcagctgagctcctgtggcaagtcctgtgggactggcatggaagactcctgggcatgtggtggctatgactcttccctgatgatggtggccgcaccttgggattggcttctcctctccgagtcagggacctggcatttttggcagcccttgggggctatttttaaacctcacagctggttttcatcatggctgctgataggaggtcagctgctctctggagaaatgctgtctaaaaaggcaatctgtagttgcaagaaacccaccaggactgggagccttttggtaaatatttctttcaccctctgcttcagtgatagaaacagtaagtcccagttaagcaggatcaaagtttatcaggcatcaggacacactgactgctgtctttctgtccttcaggccattcaggtgtcttcgctctttcattcaacaacatcaagcacctactgtgtgccaggtgccgtattaagtgtagaggacagagtggtactaaaagacaacacagtccttgctgccaaggagccaacagttataatgacagcaacacacaccagttcaggtctatgtccctgtaataagtatcacacgtgacccccagtgccatggcctgaagtacctcttgattagttcacctgctccttaagtcaggcgtctgggtgggctccactgaccctctgtccagggtctcagtgagcccaagtcaaggtgtcagcagactgtgcccctttctggaagctcaaaggagcacctgtttcccgctcattggggtggttggcaggattcaggtcctcggttcctccctttccaaggcagcagcctcggggtgagtcttccctctgccgcccctcttcccattccctcttgcactttgaagggttcctgtgaggacactgggccctctcc

SEQ ID NO: 477649 - DNA, 622 bp, Homo sapiens
aaatccaatgactggtatccttataggagaaagaagagactccgagacacaaggagaaggctgtgtgaagacggtggcagggattagagcgatgccaccgcaggccaaggagctccaaggatctctgtgcggcacaggcccatcccggcccgaccatccctccccacgacagcccctccaacctcatcccgccacactccttcttgttcactgccctgcagccacactggccaccctgctgccgcccctgcctcaaggcctttgcactgcagcggaagcgctcccctgtgacctctgcagtgggaacagcagcatcccctctcatagccccgcaaagacaaggctcctgggcctccttctaaggggcagcaggactcggggtgcctggggaggtcaggcctgcatcccaacaccagcactgtccccatgggctgtgcgggcccgggctggttacctgacctctctgtgccttggtgttcttatctacaagatgggtacaaagaggatttacgtggctgcagggctgttgtgagaactgaatacactcatacgcagccaggctgagaatggtcccccgccactctgggcaggcagtttgtcaccgggagagatgactgccccc

SEQ ID NO: 477650 - DNA, 636 bp, Homo sapiens
gcgaatggggaagatggcaatacagaacaattcagtgtctaccataactgtataagtatgtcggaatattgccaggctgccagtgtttctaggagccgctgccccgggaatgtgggccctatcccaggaatccggcttcctgaggtttacaaacagcactgtagataccctgtggagatgcacatccctggtgggacagcagatgggctgggctgggatacagcccgggaagtgaatccaagggctccagaagcatgctgggcagcctggctctgcacagagagctggaatgtggtgccaaagagcagggaagcaccagcgagctgcccacagggacatcctgtgtttgctggaagccaaatgggaacaccacacaacagagctggaacagtaaatgcagattctgacccagagggtcagggtggaccagaaatgccaccttggtacaaagtattcataccgctacactccaagcccctgcttggagcagtatgagtctaaggtactatgtcgtgccttcaggtgcttaggatccagggtgggggataaaaaggacagaggagacaggtgtttatccaactcttctctcctctttttttgcatgcttgaaagttttcataataaaaacgtggggtg

SEQ ID NO: 477651 - DNA, 1487 bp, Homo sapiens
gttctctgaaggcggctggggcagatccagggcagtcgagcagcccttctgagatgtctcttcttcggcgtttcattcactccccgcggcaccctggatgcctgttcacagctcggtccagatttctagagctgcttttaaagggcagctgccacccaccatgattgtgccgcacgcatggctggcagcatggatgtcagtgtggggaggcccaggcccttggaggaggctgaggcagccttgtctgggaccccagacccaggggaggggagtggtcagggccggccaagccaagcaccgtatggcccctggttcaggacatcgctgggacccagaggccagagaccttcagctgggatccccaaggatcccttgggacccctgggactgttgtccacctctgtgccaccaggagaggagagccccactaagactggagtgacaccggaaggtgcaaccaagagcaggcagggagaacacggagtgcaggcgctgcctgagcccctgccctgggctgtgtcgggggagctactgtggaactttctgtctatgcaggctcagcaggccacagtgtgcaccacccggctcctgccagtgaacctacaaacgctgatggctagattatttgcatatgtgttttagaaggaaacctttgagccatttataaagacaggctcgctgacttatgggaaagtgggcttctctactgtcatttactaactggtatgctttagctctgtgtccccacctgaatctcatcttgaattatactcccataattcccacgtgttgtgggagggacatggtgggagatcatttgaatcatgggggcagtttcccccatactgttctcatggtagcgaataagtctcatgagatctgacggtttgatcgggggtttccgcttttgcatcttccttatgttctcttgccgccgccaagtaagaagtgtctttcacctcgcgccatgattgtgaggcctccccagccatgtggaactgtaagtccaattaaaccacttttactttccagtctcgggtatgtgtttatcagcagtgtgaaaaccgactaatacgctaactgtcatgtgtctggacgtgcgaaaaatccctaaatggtgtcgattcattctcacttaattaaacttcaagttttaaaaatgagaactgtccaacccaagtgtcatcaatagataaacagataaacaaaatgtgatccccctcatgcaaaggaaaattattcacccttaaaaagaaatgataacattacatgtaagtggtccaaatataccaattgaaacacaaagatggttggactggatgaaaaagaaactgtataaataataaacacctattttaaatatgaagatatgtcatttaaataaaatagaaataagtaaatataagtatgtagagagtaaagagaaaataactagagtaaagaaatagaaattttaaaacatgtccttaatctgataaagagtacct

SEQ ID NO: 477652 - DNA, 732 bp, Homo sapiens
gagggcaattccacacacctcgctagccctaagaagtaaataagcaacttgataagcaagaagtgtgggtacgaatgtgagcggtcatatgacgttcctaagagggaaggggaagaaagcagcttgtctagttcaaagggttttctcgatattagacactgtttatcatacaataccttttatttccctccccaaagatgagtccactattaagcagaattactgcaaacacattctgaacaaggcagcattcactctcactttcacctcatcaccctcctttgggacagcatctctggcgctccctgctgggagcctgactctccaggaccgcggcagccaggagcacccagcagtgctccaagcctctgcccacggccatgacctgcctggctgctctctactcccacatacctgctgtatgcctgctccagggcccctcatcctttccaagtcctatccatctttcaggaagccctcctatgaaaatgacattcactgagaaagtggctacttgagctggaaattcaaacaaacccccaggtgcttttcctccaagctttggaagacagtggaggtgcgtatgccggcttctcatctcatcacaaagattattaaaaagaaagtattccaggtaaagactgaataaagttaacaactttaactgcctcttcaagcacactgtcatgtaaaactgccctttatttttgctgccagtgtgtgaaggtgaag

SEQ ID NO: 477653 - DNA, 1180 bp, Homo sapiens
gacagctgcagggtgttttgtggggggccaatgatcctcctaaaactaccacaagtaccataaaattatgtcatgtcaccagcaactggatgtgaaactgaggccacagggggcaaagacctgcaaaagttacttggctagcagcagcagaaatctctggaatggaagtattcactacaacgctaagcttctggtgtggcctgaagacagtcccttcatctctgagcctgtttccccagctggacgggtgaagatagctccttgcacccagtggaagctggaagagctcgtgaaattctctgccaaggccaaggctctcaaatctagtgctgttcttctcaacttggggatatgggggccagagacgccatggagtacaggccctaaccctctagctattctgcagtctgccatcaatcaagtgctcatggctaaaactccagccaacaaggaacttgaacaacacaagtctagaaaacaggctgttgtcaagagtttgactgattgatggtttggagctcagaaaaagtttccccatggtcatttcttaatggccatttcagaacaaaggggcagaggaaaccaaacaccttcccagggtcttgcctctggcaggggagaaattgaggtctttgatggtttcagatgtaagtgctaccctgccgttaggctaaaatttccagtatttgaaaagtcccaagctaattttcagggaggaaattagatgagaagtggcttttaaaacatggagaatcttatgtttaaaaacttgggttgccaaggaaactctctcttcaatacttccttgccaccatgttgtaaattaagcccctaactgaaaggtaattaaggtaattggtggcactgctgcagagagaatgtggcaaggcagccggagggaaggagcccccaaccttttagggcacacaacccccttagctctgggggaagctgcatccattactgcatgtgagggccttgaaggcacctttggagaaggcagaccagcaaacagctgtgagccatgctcagtgaaaggccaaggaaaggaaatctgaaatgtcacgctgctaccctgttggttttgaataggtgaaagctccatgagtcagttaatgagcagattgggaagggctgcagtgttctggccccctgcagccaggttaatgtatgtggtatc

SEQ ID NO: 477654 - DNA, 647 bp, Homo sapiens
gtgatattaacagcagcagcagcgcctgtaacggaccttctcagtctgggccttgctggcactctgggctagatgtctgtgttaggggcatggggtgcgctgagcgttgaagggcatggggtagcctgcacattgaagcatgctcagcagtgcgggctgtgtgaggctccccaggacgatgcccgtgttctaatcccagaacctggaacatggtggcctcgatgtcatcacaggggtccatctaagaggaaggaggaggtgagagggaaagacagaggttcagagccgctgacactcccgccttcagggctttgccggcactggccctgctggattgcttctccagcagctgggggcattcagctgattgtggcaaaggccactgtgccccggggtgggcgtggggggcagtttcacctccctgaatgggctgccttggaatcatgcagcgggggctgcatcatgctgcgtatccacaactgtccaaggaacccttgtttcacaggagctcttgcagaagagggttttcatggaatgcaaaatcctggtcctgctggcccctccccatctgaggtgatgtggctgcccgtgggtgggtgccagtctgctgtcatccgtgggagctagcagcctggcagatgggagtg

SEQ ID NO: 477655 - DNA, 1220 bp, Homo sapiens
cctcacaatcatggcagaagctgaaaggcacatctcacatggcagcagacaagagaagagagcttgtgcagcaaaacttccatttttaaaaccatcagatcttgtaagacttattcactatcacaagaacagcatgggaaagacgcatccccgtgattcaatttcctcccaccagattcctcccatgacatgtagtaattgtgggagatacaattcaagaggagatttggcctctgggcctataatgggaagggctgccatcaccattgccttggtgattaacattcagctcctcattacttatgccaattctgtggccagcttgaatttgtcctcagaaaatggggttttcctttatatcgcattgtcaggctgcaaattttccaaacttttatgctttgtttcccttttaaaactgaatgcctttaacagcacccaagtcacctcttgactgctttgctgcttagaaatttcttctgccagataccctaaatcatctctctcaagttcaaagttccacaaatctctagggcaggagcaaaatgctgctagtctctttgctaaaacataacaagagtcacctttgcttcacctcccagcaggttccttatctccatctgtgaccacctcagcctggactttattgtccatatcactatcagcattttggacaaagccattcaacaagtctctaggacattccaaactctaggtgttcatgctattatgggttccattgtttctagaccctttcagctgacttagcaaggaaatatatgtgtgtatagtagcccatatttatacatatatttatcaatattttatatttataaatatttatatttatatatacatatacatatatttataaatatttgtatatgtaaccatctgtatttaaattaaactaaacatgaattcatactgctatctccaatcctaatctgtcaccgcatgaattattctagccttctccccttacttatctgcaatctctcaccccagcagtgagaaacatgggtcccatcactcatcatccatttatttaattatccagttcctgtgtacttaggtagcagtatcagaattgttaactggtatcctcataggaaataattttatcaactagcatccagtttttatgtacagtttcttttgtctttagtcttacagactccactcatttccaaagttacttgggttagcaccctttccctttc

SEQ ID NO: 477656 - DNA, 4936 bp, Homo sapiens
ccgctgctgaccttcacgagctcggtgctgcagctctgctgccatgggtccagcctgcaagtctccagcaactctagcagcttctggcctggaagcagctgcccaccccagtgtgcctgtgcccccacgctcctgccctctgaggctgctcaggaagccagaggccatgccgtgctctggtagctccacttgtgaaggtgaggacttgggtggcgcagcaggtgctgtccaagaaagggaaggaaggaacacctggggagcctgtgaaggtgaagaagtttgtgccttgatacgagcagacacgccagtgaagaggcaggggcacaagtcaagagggaccacaagcattgctaagagagcatggaggcatctcacgtggtttgtggggcacggacggaccatcttccaggatgaaggagcgtgcatctcacacccagcagatgaaccaaatttggccagaggaggaaagggatggggagagtgctccaggctgcagccacagctaggccaagactgggaggcagaagagagccagggagtgtgggaaggctgagctcagcatggctggagagaacaggaggggtctggggttggtgtcagttaagcacagctccacttgacagtgactggttcaagctggccatgtgaattgtcccctggggccatggcctggttgaccataggctggacccatgactctgatctagccagtcagagtggcccactcctcaggccccagtgattggctcaggcatgagcatgtgacccaaactggaccaatcagaagtcaaagataaggctctaagatgttgtgtaagtgaatgaatcaataaggaggccctcgctggtccaaactagctcagtctccaggctccccctccaaaatcatacgttgaagtgctaaccctcagtacttcagaatgtgacagtatttggaggcatagccttaaagagatcagcaacggcattagattttcataggagcacaaacccgattgtgaattgcgcgtgagagggtctaggttgcacgctccttatgggaatctaatgcctgatgatctgaggtggatcagcttcatccccaaaccttccctcacccccgcccagtcccgtggaaaaattgtcttccataaaaccagtccctggtgccaaaaaggttgaggaccaatgagttagaggatcagccctcctgtttgcccagccctggttcctcccaggccttggtcagaaaaggaaggcattcccctgtagactgaataatacctgacctaaaatgacccaggcaatgaggagttatttttcccacatggagagaagttcaaaagtaagcagctgagttgattcagcaattcaacagagtcaaggatgatttctctgcttctcttgctctttacaatacggacacaagatagccactatagctcatccatcacatctgcattgaagactggaagaagaaaggagggtagaattctgagtcagccacatctgtcctacaagcccaagccaacaaactgggttacatggctgactctagctgcaaggaaggcgggagatggcaaaaaagaaaagagatggaaatgaacttggggtagccttcaaataaagaacccatagcttaaccttattgatacagacctatgcccttgtgtagcttacagtcttatggggaagagagatgttaatcaatgcagcacactaatgggtgtataatgacaaactgaggtcgaggttctgcagcaaactttacattctacatccttagaatctttactttaatgccaccattcttggtgctcctacaccccagggcctgtgccagcccttcccatacatgatcttcctaaatctgcagagtctctgtaaacagatataagtatccccactcttcaggttgggaaattgtggactaagtcacattccattggtccccagttgggaagtatcccaggtgggattcacacccaggtctggttggcaccaagattgtagttttgttgacaggtcttcctaggagtcagctgacttgattaatgttttcaaagaatcaagttttcactttgttgctttctttattgtgtatctattttctattttgttttctccccttatctttattagttccattcttctacttgcattgagtttaatttgctctcttttcatagcttcttaagacagaagtttagagtattgattttatacctttgctctttctgaatgtatgaatttaaatctctaagtctccctctaagttttttgctttagcttgtcccacagattttgatgtgttttattttcattacatttatttcaaaacatttaaaaatattctttgtgatttcttccatgatccagttatttagaaatgtatggcttaatattcaaaatatttgggaatagttatatttttgtaattaatttctagttaaattccactgtagtcagagaacgttgtctgtacgattccagtcctttgaaatatattgagactcactctatggttcagcatatgatatattgtagtggatgtttcatgtcacttgaaaagaatatattctgtggttatggggtgggatgttccaaaaacgtcaattggccaagtcgattaataatgttgttcaaatcttctatagccgtactaatttttctatccatcactgctttctaaaaatcaattattcacagggctgtgttttaagtgctcagctgtgattgtggattggtctatttctcattttaattctgtcagattttgcttcaatatcttgaacctctgttattagatgtattcacctttagcattgttatatcttctcgatgcattcacctttttgtcactatgaggagtctctctttatttcaggtaatactctagtttcttttatgattggtgtttgcatcatgtatctttccccatcatctttcattcagttcatctgtgtccttaaagagtgactatcaaagtgacgcttgtaaacagcaagtagtcaggtactgtttatttttatctagtctgataattggtgccttttatatgaagtgtttggctcatttacatttaatatcattattgatatgggtgggttttagtgtagcatgttgtgatttgttttgtatttgtctctaatatttttgttcctttgctcctctttccctgcctttttttggattgagtatttcttagtatttttttaatctcctctattgtaacacttttctgtggttctctaaatttcagtgtgcattcatagcttgtcccagtccacattaaataaatattatgcaatttcatctacaaaattggaacctaaaaacaacacatactagttttctattgttacataacaaatgaccacaaatgtaatggctttaaacaacaactatttattacccaccattttgtttctatgggtcagaagtcccagcagggcctcactgggtcctgtgtcaaggtcctcagggtctcacaagactgcaagtgaggagtcagctggtggtgtcgttttatccaagtcttagggtcttctttccaagctcgcatgattgttgacagaattcatttcttcgggactagataactaagactctccccatccccacctcccaggccactcctttgcataggcagtcaaaaacatcactgttcacttgttcaaagatagcaagaatgtctctcttaaaaacttgcccgatgaggttgagctcacccaggaatatttctcttttgattaaactcaaagtcaaagtgattagaaacttcaatcacatctataaaaatctctttctggttgacgtatagtgtgatctaatcctgggagtaacatcccatcctattcccaggtctcacccacactcagggggaggggattgcaccggacgtggataatttcagtataatttcattaaccacttagttttttgtgctatttttatcatacattttccttgtacatatgttataaatgtagcaataccttgttatcttatttgttttcaatagtcaatagttttttagagaaaatttaaaaagacagtcccatatttatctatatattttatcctttctgatttttaatttgatttttttctgccagatccaggattccatcttgcatcacttctattaatcctgaagaacttccttagtatttttcatagcccacgtgtgctgctgattaattctcttagcttttatttatcagaaaatgtcattatttcaccttcagttttgaagggtattttcacggggcaaagcactttaagttggcaatttctcttttcttcaactttctataaatattttattcccttaaatatcttggcttccatcattcctgatgagtagccagccattatacttacttcattctcccgaaagcaatgtatatatttttttgttctggctgcctttaagattttgtatttttgcttttaaaaattttgatcatcatacaactagttttgcttttactcacacttattctgctgggggtttgcccagcttcttgacctgtctgtcctgctgttgcagctagaagaattccttgtttgtggtagagactcaataaatgttttttgaataaaataaacagatactgtgagaagcaacttatagtcataattaacagtgtgaactctggaatcagagagacctggatttgaattctgtttctagcagtgttatttgggacaagttgcttagcctctgtgagccttgatttcctcatctgtgaaatggggatataatagcaacacccacctaatgcggttgctaaggacattcactgtgtactgaggacagggccttttcactcgggggcatcccaagccttccttctcacccactggagaggattttccctttgctcctcagggttggcatccctccacaccttctgaggaaatgtcctttatattcacatttgtaactttt

SEQ ID NO: 477657 - DNA, 747 bp, Homo sapiens
ttattttctcacccaaagttgcacagcgagcaggtagcagatggagatgagctcaggcagaccggattctgagcctgtgcttataaccagggctggaaccagggcgaggtgctgcttgagatggccgcgcattacctgccaatccgagctgagaggatgcgctgtcccggctctaacgctgacagagggccacatgcctccacatgcagaaggctcttggagtaatggaggcaattacagcctgcaagtaactgccaataaaatacattacaacttgacttacaaatgtattcagggaggcttccagttactgctccaaaatataaagaccttagaagtggtcgttctcatcctcacaacaagaaaaaagccgaacaaactgaaaatcaacaattcttagatccattagagaattgtgatcatggtgtagaccattactccaaaatctgggagacagacaggtggctaaaatcacagcacacagggatcagaagctgctggggcccatggcaggagccccaccaagttctcagaaaaatcccctcatgctttcagcaggggggaaggaaaagcgagcattttgaaatatatccagaacattctgttttcctcaacaaagatttgtactcaagggaaaatcttttactgcagccttatctgccctagaagatgggcaattagacagctggatccccctctagccttcttgtctcacttaaggggagagggaaaaaaaaggctaagaaa

SEQ ID NO: 477658 - DNA, 3666 bp, Homo sapiens
gggctccccaaaggccaggaacgagtctggtttctggaacagcactgtctcctcagcacctagacctgggcacatagcagacaaccaaggaatgcccatcaacgagaggaggcctcacctcatggcggccatgcttatagttccacggctgtacaagaagcatggcaccagcatccgcttctggggaggccacaagctgcttctactcatggcagaaagggaaggagagctgatgtcagattggtttgaacgtgactgtgtctcttcttcaaagcgttggttcctggagcgctgggccttttcccgaggctctcagaacaacgagggcgattcaggggatacctggacagagcagcaggggccagggagtctgtgggagtgggcacagcatgatcagacgcgccttgtgccaggatctttctggctgctgtgggagcacaggttgtacggtgcaggaccagagctgggagaccggggaggccatggagcaatgggtcagggatgggtgctccccacgacccagcagctcccacctggcagatgaaccagaccctgtgattgcccctttcgacattgcttacaaagtcaggttgcttttcatctcctctcatctttaaaagagcacttccaggttaaaacaccggcatccacacccctgcccttcctctgcccctctagactctctgagggaggactacatctcagcctctccctcatggccctccagatgtccaccttcctctcagttgactgtgagctttagtggaggccaacaccatcccaggtggggtctcagaaccactgccagcggttggtttaaggctttgaaatttgatattcagaaaccaacgggtcctgttgttttattttatatttttaattacagtgtgaacagcagtgccccttatcttccaccacaggcgactgccccaaattctgctgtcctcatacgcttcatgctctctggtatgagctgggctccatggggctccttgcccaagtgtggataagcacatggcccagctgttaatttgtatagatgggcaccaaaggcaaaatcaagtagggtaactatgacccttgaaaatcactgaacctgcctactacctacagtgtcttctgctgagcatcaaatgcagcatgggcttgtttttagagacccagtggttggaaagtatatgtctttagactctagactccttttccagctgggaagctcacattcgtgtccccaggagccaagctgggctgatggctgattgatatctttgctatattgctatattgttacattactggggataggaaggtgggggtctaaatgcatgtgttcgggtcactaccttgagctgaaaagaggcatcaaaggatttcggaactggaattcccaattttacctacaatgaaacagaattagagagcttgccctggctctgtaattagagggtggcctggctaatgaggactattaaggtttcctaagttgtatgatgacaggagaggagtgagatttaagaaaatgccaaataaaattggacccaacactgatcctacttcagccagataagcccctgtcactggtcgccttcatttctttttgctaaactggttttatatccttgatacacaatgttcttcctcattgccattttgattctttctttaccaaatgtcttagtcagttcagctgctataacaaacataccctagactgggtggcttaagtgacaaattttaattactcacaggtctgggggctgagaagtccacaatgaagacatcagcagatccagtgtctgggctcagcaacatacagaggcccagagaggtcaaatgatctccttatatgtccctatccacccagcctctgccccacgagctcaggcctatggaggtggcatgcttcctactctaattcccatatgacttctgtctttcctccaaaaccgtgggctccgaattggcagaattgtctcttttgctgctcaatcccagtgctgagcattggcctgcacctagtaggtcctcagccaatgtttttcaatgaatgcagcaatgatgacatgaaaacagctgtttaaatccctgtgcctctgattcaagtatctttcctcttccagtgtaacaaaagtgtgggggaaaggatgcctctttattgtgattcgacttggattttacaatgtaaatattcagtagccaaagccaacaaacacatcatagcaatagatgtccagaacaggagacctcagctttggcagaggaggtaaataacagacattcgaataattccactcccaccccaactgatctgcgctccaccatactcccatggaaaaggaggctgagaggacttaggagtcagcactcaggctgcaggtgagatccaggctgggaccatgtagtaagaagacatgaggagttttttggtctcagacccctccccacccccaccctcaaagcattctgggatgctccgttccttctggacatagttttcttcccaattttcttgattcttaaaatgttcttaaaatataggtcttgcattaaggattagaattttccagtggtcacagagtaatgaaaaccaactgagagtctgttttggaaaaataaaagaccacaaggaaagactctgaaacacaaaaccaaaggaatctttctgccccataagtcagaaacccatggatatgctgtttatctgtttatttttattagagaagcattctaggagagcaagctctctcgtgggaggatttgcaagtgtgatgggtgggggcagatatggcattacttaattggcttaaaattttgtcttctctgccaaagctaaggagtccctgctctggttatctactattacctaaaaaccaccccaaaaatcagaacttcatgcagctgtttatcactatgctgcatcacaactctgcatgccaggcggatgacacacagcagggacagcacaagtctgggacctcagctcagaagacttgaacaactgggggatgactgggcatctttcctcctcctcctccttcccccttcctcctcccttttctcctcctcctccccctcttcctcctcccttttctcctcatcccccttcttctcctcccccccccacccttctcctcctccttctcctcctcctccttctcctcctcctcctccttttcctcctcctcttcttcaccctcctcttcctcaccctcctcttcttcaccctcctcttcttcctcctcctccttttcttcctcccccttctcctccttctccctgtccacctcctccccatcttcctcctcctttctctttctctcccttttccccatccttcttctcctcctcttattcttcctgccccttctcctcatcctcctcctccttcttgtctccctcctcctccttcttgtctccctcctcctccttcttcttctcctcctccttcctctcctcctcctcctcctctttgtctctctctcctcctccttatcctctatctacatggcccaatgtggctagtttgggcttcctcacagcatggcagcctcagagcagtcagaatccatccatgagtgctcagggtatcaagaggaaaaaagtggaaggtagcagtccccttaaagacaaagcctggaatggacagagcatcccttccaccatacc

SEQ ID NO: 477659 - DNA, 1048 bp, Homo sapiens
cattgtgccattgatgggattcacagagaatggagatgtaaaggatggctccattcagaggctggctcttcccctctggggggttgagatgttggcagaagctccccatccttacagctccaaagccaagtgtacagagagagcctcctctccagggtccaggcatgtctgaagttcgctctgactgccccagcctaaggtggccacacacccaccccgtgcccaggaagatgaagactgacagatgtgtgctggccagcaatggagccccatccagatctcatcgtctgagaaaagggcagggggaggtccccaaacaaagcctgaagactgtcattcaaagaagtggggagggatgccgggcagggtggcatcagctcttgttcaagcgaggctggagcagggatggtgcttccccgggagcatccacactggccacaagctggggctgtggtgccctcaggctgcaccggcctggcttggccccctgggatggtctacagtgccccagctttcccccaggggtctgctgagtcacatctaggggctgggatatcctcacttctgaagacgctgatgcacaaaagatgccaagaaaaaaataatccccattgaaacaaatgaatagctactgtgccccctcctaacaatgccctgtgtgactgccgagtttcctcctgcagtgtggagggctggtagacgctgtttcatttcctcattgctctgggtgagggcaaatccctccacctctcccacttccaagaaggacaggaaaagccagcaccattcctggacaccttcctggtaaacttcagggagttactttacctccctgagccttagtttccttatctatgaaatggaggtgttaatcatagcatgtagagtacaatttcaaaaatgtcagttagtacaattactacgattagtctaattacactactagaaacagggcatttatcctgacgtgccccaggcttgcttctgttgactccacacccctgttcccactaaccagagctgaactggaaagctgttttcccgggag

SEQ ID NO: 477660 - DNA, 1501 bp, Homo sapiens
gttcactgtggttctctgtaacagcagccctaggatagtaatgcagaagctaatttactgagcatgaagtaggcaccaagcattttgttaaacacattacagacgttatctccaatccacccacctgaggaagttgatgctatcatcacttctgttttacaaatggagaaaccgaggccctggtgctcagctgcccaagtgcacccagcagtgggacattgacactgaggaggtgaaccctgagagaaagcaggtggttcctgtgccggtcgttgtgctgagtgctgggaaggacctcacagggaaaagcagcacagaggagctgaggacgccgtgtgacagaaacggtgtcattgtgatgcctgggattctctccaagggcccgtgctgcatccaggactgtgagggcctggagagcagactggacttccaggttgggctcttggcaacaaaagcgggggccccacagcgacggctcctccagggaagaggttgtgctgctcagcctgggcctcccacactcccctgggaacaggtagcaggtgcagacagccagcccggagcctgggaatcttgtccaggaccacagccaggagcctggtttccagagcgtccccgcttcctggggcccacagccacagcggcccggcgccgtccccactgccgctctcgagaaccagccatcaacagctccacacaagctctcttttctgttttaccaacagaactgggactggacgggtttaaccccagggctctggcagtttccatttctctgtgttaaaaaagcttttagcctaaacttaagccaagtatgcctccaggaaatacttgcttcttccctgtcccccagggaaccaggcctggggccagacgaaagaagcaaagaaaagggaatttatgcactgaaaaaactggggcaagaaggactgccagctgttccggccacagcctgtcccatctttggggatggtgctggtccggtcactgtgtaggagtgctagactgtcttgtgcatggagaattgggaagaacgtggacctggagtcagaggcctgggtgctggctctgtctgaactggactgagaaggataaagggacactcgctggaaggatttgctgatacagtccacacagaggctctgcctgtgtgcacacagatcagaatacgcacttaatgagtggttatgcccacgaagaagaaaggggagaaggaggagacagaggaggaggtggggatggaaatggtaacaactctctcagccaaccctcagatgagtcaagctggctactgaggtcacaggagcccaacccaaagtagctgagaagcaaaagggagtttactggttcattttaaggcatttttcagaagtaggtctggctgcaggcacagctggatccaggaactcaggctctgtcttctggggtctttctccttctcgcctctacctacttgtactcagcttctggctctcctccatcaaaaaggctcctgtccttc

SEQ ID NO: 477661 - DNA, 1628 bp, Homo sapiens
aaggttctggcacaggcaccagcttattgtgaggctgcggctagaccaggcatattgcaagcagctgccacgctggctctggggaacatggtggcacccagaagcttggaggtgccaggaaccacacagccccaaagagggtgtcacagccctggcccggggagctcctaggactgggctccccaaagggctgcagctctcctctccttgtctcttctctccttctcatcacccacaacatggtgagcaaagggcatgtctcagcgccaccattcaccaggtcccaagtccttgtcctgtatccaggaagaatgagtccacagaactggcagcccagccccaagtcttcaccggggacccacccctttccacccagaagactgtctgcctccaccaccatcaacctgccatccacagtgcccatggtgcccaagctgctcatgcagaggggtgcccgcaggctggcattgagctgccctaagctcccccttggcctccccttggcacccaacgtccagagggggctgagggcagcagggggctgggagcagggagaggccaggcaatgggagcagctcccactgaccccttggaatgtgcagccctggctgcgcctcccctactgcagcctgcgtcatggcagcagctgctccagacgggccacctctgccatcaccaccatgtacggactttttctataacaccaatggtatttgggggctatttgtttttacttcccttcaaacccatccacgtgaggactgcagttgaggtgcactgcactttctgcactgcgttctgctcagagatgatcttcttggtcttcgtgaactttgcctcaagccacagatgctttttttaaagtgacttacctttgcttcaccaacagagagccccattaagagaggctctgtgtcctctttctcttgttactgtggccctgacagtcacattaggtggctggattctggcttttgtgcccagaagagagcttaccagttcagtaattttgcagtctgtagggcatggtaaccaaacatttgaggaggctctgtgaatttaggggcctttcctggaggagaggcagtttcggggtggcgtggtggacaggcttgttgaatgcaccctagttgataccccttgagggacattatcaaacacccaacttacagatggagaagatgaagttcagaccagtggagaagcatttgcctaaagtccaaagaggagtaggtcacaaatcagaggactgtggtgagggaagggggcgttggaggggggctggtggccaaggctgctcctggaccctgtatggtcgtgggaaagacactccaccctgggaatatggtcagctggacacgtttggctgggaagcactttgaagctgggcagcatccaacatgctggccagtccctggggctcccaaggctggggacacaggcctccactctgacaagctgttcagagcactccccaagcctttgtgtgggaagggacagcccagcagcagagcaactggagtgtagatgagagaggaagaaccacattccagagattttatattttatattggggtgttccacaaagaaagggccctggggtcaaagcaacctgtcccaaggttttt

SEQ ID NO: 477662 - DNA, 674 bp, Homo sapiens
aggaaacagccttcgtccccctcaactcctcttgcccctcctcttatatttctccctttaagtccacaaaaccgcaagccggatcagcctttcctgtttaggcagcttcgtaggcatctctcagtaggtcccaggaacacatcgggcctgctcagagcactcacccatgccatccctctgcttggtgtgtctttccctgctagacactagatgcgttttattatgaaaattttcaaaaatacagaagcattgaaggaatcggcgagcacccagacactccctgccgaggccgccctgacagtcggctgtgcacgttgtcactcctccatccgcctgttctctgtgccagctgcatctgaaacgacactcgctgtcggaggtggctttccctccacagggagggcattcccaccgccgctcagcggcactttctgcctttgcataaaagccagcacaatcctgcccgaggtggtccacgccctggtggctgcgctaagtgctccccacacaccgtgttcagtccttacagctgacctgagccccaggtattattattattctccccatattccatgggcagaaattgaacctcaatgaggtaaatggacatttccggggccccctggcttggaagtggcaggaggagggcgtagacccccagtcccagccacgtg

SEQ ID NO: 477663 - DNA, 1372 bp, Homo sapiens
aaggttctggcacaggcaccagcttattgtgaggctgcggctagaccaggcatattgcaagcagctgccacgctggctctggggaacatggtggcacccagaagcttggaggtgccaggaaccacacagccccaaagagggtgtcacagccctggcccggggagctcctaggactgggctccccaaagggctgcagctctcctctccttgtctcttctctccttctcatcacccacaacatggtgagcaaagggcatgtctcagcgccaccattcaccaggtcccaagtccttgtcctgtatccaggaagaatgaggtatgacgacaagtagaggtccacagaactggcagcccagccccaagtcttcaccggggacccacccctttccacccagaagactgtctgcctccaccaccatcaacctgccatccacagtgcccatggtgcccaagctgctcatgcagaggggtgcccgcaggctggcattgagctgccctaagctcccccttggcctccccttggcacccaacgtccagagggggctgagggcagcagggggctgggagcagggagaggccaggcaatgggagcagctcccactgaccccttggaatgtgcagccctggctgcgcctcccctactgcagcctgcgtcatggcagcagctgctccagacgggccacctctgccatcaccaccattgctccttcccctgacattgcaaatccatctctctacctccaaaacccaccctgggtccttcacttcccactggctcctggacaaggccagtgtcccctcttctgagcaatggcgccccctgcctagctggccttactgttttccacactcgcccttccaacccatcatctgtgccacaactgatcttttcagaaactaatagattgctttactctcctgattacagtctttcaatgatctcctctcattcttaggatgaagacaaaatcctccaagctcatcttttgccattatcctctctccatgtcgttccccacatgctggcttcagttcagtccccttttgtgcctcaaggtctttgattgaaccatcctccctgcctgaaatccctttcagcccccattgctgacatatttggctcctcctgctttcccaaggtcagcttaagtgtctcctcccctgagagccttcctgcattctccctaaatttacttccttcatcgcattgtcaatatttctggttatgcatttgcttcccttttaaatgttctgttttcttgtagcagaatgtaagccccatgagagcagggctgcacctcatcttccctgttccttctgtattccagtaccagcccaatggccagcatgcagcaggtgctcaataaataaa

SEQ ID NO: 477664 - DNA, 946 bp, Homo sapiens
ggcatctgccccacaccccagggcagaaataggggcacccagctggactgacgtccccttgtgagctatggatgcagacctggatccaccatgcgtgccatgcagggccatgtgccccaggcccccttcaaggaaggactgcccaactgtgggagtgtccttcaaaaggccccaaattccacttcagcagctgcttttgaagagcccgatgacgactccacgttctccctctcagtccagctgagagggacagacatcaatgcagggatcaaagaagggcaaagcagtgtgctgtcattgatttttccaaacctgggggccttccgaggcccagaggcaccagcagagtacagacgagtggaggcaaatgcagatgcagtcaccatagccccaggtgccggtgttccccagtggcttattagaaggattcatcaggcagatggaaactgggggagcagagaaggggaaggacggagggcagttgcatttggagctctgggttccagagtctgagggtcaaagcagactaggctctttctggaaaaatacagaaataatgcagagtccagtgccattatttttcatactttgtgcttatttttccggccagaccaggaaagctgtttgacacctacacaatgaggagcaagaaattcagaccttcctcctcctgaggccccatttccttccctctggggttgttgtgaagatgggattcgatcatgaatataacattcactgccctgagaaagttagcttcttccctcaccaaggctaaaagggcaagagatgacacacccagcaagaaaaccgaaaataacaaaatcagtcaatgtggaacaaacattactccccggcaactggggccaggaagcaaaatacagcaccaaacaagataagcatggtcactgccctgctcccaaggaaggatgctttggaaggcctt

SEQ ID NO: 477665 - DNA, 647 bp, Homo sapiens
ctgtaaatgaagtcaggatcagcctccccaccaggcaaggttcaccacccctccttccagcagcctctagaaggtggaacgggcaaggaaacggattctacgctagagcctcccgaggagaacacagctggccggcacctggattttagcccaggagactgtgacggatgctgacctccagagctgtggggagtcgtgggacccctggagatgacacaggagagagagagcgggtcaggggagaaggttggcctcactcacacaccactgaccctggatcagtctccttgggctgccataacaaacgatcagagactagggggcttaaaacagcacagattgactctcatagtctggaggcagaagtcaaaagtcaaggtgtcagccgggccacgctccttccaaagcctccaagtggggagctggtcatgtcttatgaacagtctttggcaccagagagacactgtgtcaatgctagtgctgatgacatgatctctagctggggaatcctgactggtgttggtcagactgccctgaccactctttgtgctgcccatagtgagctctgtggccttgaacaaatggccttacatctctgagcctcagttgcctggtctgtgaaatgggggaatggccgtgcccatctg

SEQ ID NO: 477666 - DNA, 579 bp, Homo sapiens
aggccagtcagggctaatgctgctgtccaggtgagagcggctggcagccaggccagaaggactgtcaggggagatggagccgagggggcacaccccagaaaaatgggagcaaagtcacattttacatggtggcaggcaagggaagcatgtacgtgggaactcccctttataaaaccatcagatcttgtgagacttattcactaccacgagagcagcatgggaaagatccacccccatgattcaattacctcccaccgggtccctcccacaacacgtgggaattatgggagctacaattcaagtgcacgaggttcggattccttcacatgctcatcagtccgtgtcattgtctgtcttcggttagagcaccccagtgagcaccccaacgggaaaaagaagatggggaagtatgactttgatgcaaatgcaaatattgactcagagcctcgtgcctctgggctggcggtaaactgagctttgggttcttaagcacatctgtgaagtccgttttgctacataaggtgacatattcacagggaacagggatttggacctagacattttggggggcattatgta

SEQ ID NO: 477667 - DNA, 1527 bp, Homo sapiens
gccgctcagaacagtcacattcagcttcatcccgacaggcactcgaaactatggcagaggggcaggcatcctcactctgccacctaggtgctgtgggcattaaccttggctctgagcctcctggcagccaaggcaagtggaaacatgatggctcactcagctgccatcatcatctgctcatgacaagtatgtgcatctctccagtgggctccggcctgacaggctggcgtaaggctcatggaggactcttggctcagagcagtggggaattcacccaaggccacatggcagagccagtaagatgcaagccaagatctgtgctgaccccaaagcctgtatccccacctccgcacaggcagctcttcccctctggtgactgcaagcccagccctacctggggatgccagacgaggcaaaggaactggatgtcagggcctggaagaccagaggaagctcgtgtctgccctacacagagcagagatgtgcctgaccaccatgccggcccacctccagggtccaacaaaaatgcttgagattgaccccccaacacacactcaaaaaaaactttgttggctcccaaaatgtggggaaaaaaaccttcaaaataacgtttaatgaaatatctacaaaatgtaacatatcacccaatggcaactcaatccttctatggctctggatatattttatttcatccatcactgccatcccaccggctgtggggtgatgttctaggtctttcccgctcactctcaccctaccttcccattactcttccagcattccctcctgccatactctcctcccccaccccaccaccaaggcaccaattatacctaccttccaccttcatccctaaaacacaccctgctctgcatcctgccccaggcccattcacaacattctcacccattttattctgggctaaatctgacctttctttaggtttcatttctttccttgggaaaatcttccttagttctcccaccccatgaaacctcctgtgtaagctcaatagacactctacatcttcacaacactgtgtacatcattgactatggaattatttgtaataatctactgacttcccctcataaactccaggagggcagaaaatacacacatctggcttgttgctgttctcatcccgagcacatagctcagtgcctgcagaagacaggcactcaggaaatgacgcaatgggcagcctgactcatggacagatttcacttcgattaaattccccaccgcctcctgcagatggatgggctaatgacaggtgtccaatatggagttgttgaattgaatcaaattctggataacaaatatgacacagaaaacaaggcaattcaattaaattcagctgacatttcagtagccagtttttatgagctccggctggttggtgaggtaaagttttaaataggctcttagaacaccagtgtcgaccatgacacctccccccagcagctgtctgcagaggacagaaaactttgcaaagctggctgtaattttttaactggtgccttc

SEQ ID NO: 477668 - DNA, 1171 bp, Homo sapiens
gaatacaaatctcatttgatggtgtcgcgtgggtctgtctgttgttgaagtggacagggtgcccttgcatgtggccagggaaggagtcagggcaggagccaccttcgtcgaggtactggagccgctggaggttgaaggggatgccgaccatcaggtccagctcctctttgagctcccgcacggtcatgtcgccgcggcagtttgccactcggaacatctcccccgtctcctccagccgcacccgcaggacgaagacgtcaggggccaagtcgggcaaggcactcgcggccttcgggtcacagacgagccgctggctccggccgcgggcacaggccaggggctgcgcggggagggcccgcgagtccgccgagcccaccctgggcccgccgcacccctgagccccggcccgcgcaccgctcctgcgtcccgcattggggtgcaggcgagaggcgcccccagttggccccgccgcccgcgctccgcccgcccccgccgccgcccgccgcatcccccaggcgcggccgcgcgtcatccgcggctcgagtgcggtggccacgcgtcatcgccgcccccgccctgacgccccaaggcgggcccatgcgccccccgccccactgtgacgcccaggccccgccaggaccgccccctccagacgcaaggcgaggcccctccctgcctgccgcccgagcctccagggagaccgatgggcgggcggccccccaaggtcccgcagtcctttcccgctccgcgatgaacaaagccgcagtttcacgcggccgcgggagacggttcttaaataatggaacaggacataagtgcttcccagagcaaccgggagatttattgataaatacagagacatcgccgggcagccacgctccgacaacccgcactgggcccccgtcccgagctcaggccacgtccccacctcctcgaagcctccaagctgctgttaatgtcagttcttttcaccaggcaaacggaaggggcattcttgctgctgttaggaaacgccgatctggtcccgacatgggggtggatcccagaagcgggagacagccttccacggaaacttgcaaaactgcaccaaaatctatcaattttgaaaatgctcttgaattcttggcggaagaaagatgctgataaacacattaagtggggaaatgctccc

SEQ ID NO: 477669 - DNA, 515 bp, Homo sapiens
cagaagagaacggctggcttctagtgaattaatgctttgcttaagatgaagaggaagcaagccaccttcctcacagggcagcagaaggagaagtgccaagcgaagggggaaaagccccttataaaaccatcagatcacaggagaattcactcagtatcacaggaacagcatgggggaaccacccccatgattcaattacgtgcatggtgcaagctgtccatgcatctaccattctggggtctggagaacagtggccctcttctcacagctctactaggtagtgcaccagtggggactctatgtgggggttctgacttcacatttcccctccacactgccctagcagaggttctccatgagagctccatccctgcagcaaacctctgcctggatgcccagatggagaggctgagtggagagctagaggacgaaagcatcctttactactgaccatgtgcactgtgttagtgttttgggtcaccagatgctcttcactgcacctgtcagcctttatt

SEQ ID NO: 477670 - DNA, 614 bp, Homo sapiens
gttgtttttggagcagattccccatgctccctgccagcagccagcagtgggaggacgatggggtccctacaagagcacagtattgccagggaggcctctgggacgagttggagcttggaggattattccagtttcgtcattttctcaacctggagggcaagtctcaccccggcaggaagagcaccataggcatgcatgtagcacaaactcaagggcccagaatgtactcccgaatccctacgagctccctgctggggaaagaaaattccagaacaaaactcaggattcatttgtggccctctgctgagaagggggtcttccaactcaaatatgagaacggttttcagaaagtctttcaaaagcagaaccgtccccatttcaggtgtgggattgaaggccccagtaattacctgggaccctcaggccacgtgactctcatctgtctcacaaaggtgtcttggtccaccaaccggttcctaacctccttgagtggacataacatctggtcaagagaaacttacttctctgtgatttaaaaaaataaataaataaataaacgagtcttatcgtccctccatgttctttttttctactagagaatgccagccttccac

SEQ ID NO: 477671 - DNA, 829 bp, Homo sapiens
ggtttcattacctaggcctgattgattaaatcattggccattggtgactgaactcaagccagaggtcaggctgctcccccctctctctcgacacctctttaaccatgtcttgcagaatcctaccggagagcctcttgtcctcagctcttttccccagttctacctcccagagggtctggagagctggcccagtgtgtagagatcctctggggtggtggggaggcaatcgggtgcaatgagcctgcagaagaagcttttccagagctgttgtaagacttctgcaggccctgggcgcagtcattttcagaggtttcaggccacggcacggcgatgccatgaaaacgcggatgcatcccatgctagggtggcttggatttggaggaggtcactggacgtccgtgcggatggcccggggccctggcgtgtgtcctcctctcatctgcacctggtccttgccccagcagctgagtgtgttgttggggaaggaaatgagaacaaggagtgccctcctggggatgccgtgagggtggcgcagcatctgctttgcactgggcccatgtcgctcctttgccaggtatgtgagctggctcagccctgtggggagcagacacttgggcatgtgcttggagacatggcttttgacactcgccgtcctttactgagctctgcgcactggccctgggctgtgcactcagctcgccttgtcccactgaacctcaccacattcccctggggaagggacggtcgctgactcccttctgcagatgtgggaactggggaaagtagtaaaattcaggaggaagtgggcgaggctgacttggactttgga

SEQ ID NO: 477672 - DNA, 834 bp, Homo sapiens
tgctgttccacctctctgtttattttctgagcatctccaagagcctgggacaccaggacagggcatggcgggaggagatgtttgtgtttctccaaagagagcttaccgtcttgtgagggatgcccctacctgctcagagagctgctggctggcccagaatgggcgctggatgctgcagatgcagttgtcaacacagatgtccgtcatcaacgcctgcctgccctggaagcgaggtagtggtgtggcctcagccttccaaccccaaaccagatatgccttttcccctgagctgacagtgggaaagttggctcggacccagaggatggagtcccgtctgtgtgaacacagcaagcagagatacctgcggccctggaggcagcttggtccaggaagcagaagcctgggctacacatggctattggctgccaccaagtttgctgtcctggcgacacaagcctggagctcttgtggcccctgtggcctcctgagcagagctgggctgggaatgaggcctcagagagggcactggagccgggaggtggagagacaggggtctgatgatattcagcagccagatccagatgtgaagcccagcctctcctccgggactttccggttacatgagccaacagatttgcctgcttcgagttgagtttctgtcacttgcaacctaatgagtcctgactatggcagttacttaacctctctgagcctcagtttctgagtctataaaatgggaataaaagtggtactttatatggttgttcttacatacgatgctctgaggatgtagtttgtgagaaggcagtgggaatgcagtaagtttaatcaagg

SEQ ID NO: 477673 - DNA, 1896 bp, Homo sapiens
tgggcctattgaggaccccctgccctgcccccagaggagacgccagtgtttctgcagtgccatcaccaggcccagaacaagggcgtcctcagcttcccagaagaggccagtaagtgtcaggaaagaacgtccctccccctgaatgtgaactagccggagagagaacagggccggtggcgcacagcccctggcagatcatccgaaacctgacgtctgctgagggggaacaactttgccctgggcacctgggaaaaatgagagcatagcctgccacctggcactgtgaccgtcagacacggtggacaccgagcaaaaataagggtcccgggaacagctggggctgtgcaactccaccaccatctggaagtagcgagccatgggccctgcggagtgggaggagcagcagggagctttcgagtctcgtccatcttctgagcgaggcctcctttgcacttcaattctgagaacattttctaaaagcacctcccgtgcgaggtactgttgtgagggttttgcgtgtattcacctatggaatccccgtgaacacctttccagcccccacactcatctctccacctgggcagagaccatcctgttgaatgctcgagagatcccttgtaagaaggctgcatgcacagcacacggtgttgggacctcttggttccccgaattaaatgatttgggagaactttccaaagcagcagtcagagaaaaccccaccctaccgattcggtacaggactcggtcagaagcttccagatgctggagctctcatgaccgtgccagggacctctttcaagaaggaggaatggcaccgaggagcccagcagggcgtctagctgcttcgcagaatgagattgaatctcttcctgcaacgcagttcacctgcagcctgggaaagtgttctagtgccatcttgagctgctttgtggaagggacccgaatgatccagaaactgctggaccttgtttgcaaggctgtcacccaaggcatcaagctgctgtctgtctccaggtttccagacccttggcatctactcccctttgaattctcaggtgaccttattgaccccacatcaagtgggaatgcgctgagacctttggaggtggccgtttgagagaagccagccacgctcacctccctcctcccaccctccctgaggccctggaggcacgactcactctagcaaaggagcattaggttgtgattagccttgtggtgagtccacctgggtctttctggaaggttgctgtccttcctgcttgggctatgtatccaggatccttggaagaaactgttctggtcagctgtgaggaaagggacatatcctaggctttttctgctcgtggtcacccccagacagccccagcttcttcaagaagccttcagagcagcgagaaatcatgcaggaaaacacctcctcccagctgttgggaagcccggcattctatacgaggatttgtttcattttttggatgttggtagaaatacgtaaaacgatgctcgtaaaaggctgggaagacggctggactgcacagccggccgggaccgcaatgaaattaaaaataaacaaggacaaatggtgggaaattattgcaaaaatattttctccgaattgaggagggcagtagggagatgagaagaagtaacttattggaggttggggaaagggcaggacttgctttaataaacatcttacaagaaagccaaggagcgtctttcttggatccataacaagtcgtgcactcaacatgctccaggaatacggcctagtggaattaacgaaggaatctgcgtcctgtcaacatgtggtagcaggcactaacgagctcacaccctaaaacgaagcagatggggctttgttggaagaaaaagccttacattaggtttcagagg

SEQ ID NO: 477674 - DNA, 772 bp, Homo sapiens
ggggccaacacatgatgcggctgggcccaaatacagaatctggctgccatatctggtttcccaattttgttcaaaattggtttcactcaatccccatggcatccctcaaaatgcctgctgactatttgaccggactacctcttgcagggttggaaagtacttctgcctgcaattttccaagccttgagcatgttaatcagttgctccagatctgctggttgaattttaggccaccagcacagagcacaatggctggactcaggtgtcagatgcccaaagaggggcaggggctgcgagaacctggcgtggatatcaccttgatctgtcacgctgatgacatgatcttgatcaggccagaaaagcaaaaggtggtggctgacatgctgcggcccttggaaagccacacacgcacacgcttcagagggttggagataaaccttatgaacatacaggggcctgttacatccctaaaacttttacgggtccggaaaaatgcacacgtgcaagtggaaatgatctctgtgttcatgtgcgtctgtgaatacgtgcctgtgcctgtgtgtgcccgtgcatgtgtgtctgtggtgtggtgacactgtggtcctggggagccctgcacatcaaagggccactggaggagtggttcgctttgcctttgaagagactttctgcctcttgaatgcaaacacagcctatccacctttcctccaactttaataatagttttgtgaaagccccagggactctttgccttgcctaaccttcaaaccag

SEQ ID NO: 477675 - DNA, 1319 bp, Homo sapiens
tcttgaacccccaagaacccagtgctccccaattgctgtgtccctcgacacagagagggtgagggatcatgacctgggaggtgcttgtggtatggggggatcgttgtgcacccctgctcacccaccagcctgggcagctgcagggacaccaggcctttggaggggactgccgtctccgaattcagcacgcgggtcgtggaggcctgctgtggatgatgatggctgcctctggcgttggaggcctgctgagttcctgcactgatcctgacctcctgctccacccacacagcagccctgtgtcccgtggtgcccaagaggggaccgagctcccacaccaaggcgctgcgctgggtggcagtgtcacggagaggtctttgggggcgatgtgcgaaggaacagtgttcagctttgtctcagcactaagagaaagggagatgatgaaaactagcccctggttacactgcgtgctcgccaagccccagggctgtcctcacactcgcttctcaacttggggtgattctgcccccctaggggacaactggcagcgtctggagacatttttggttatcacacaaggtgggcgcgcccctggcatctatcgagtggagatggggtgctgtgagacaccctgcagtgcacgaggtgacccccaccacagagggtcaccagcccaccctggcaatattgtcgaggctgaggagctcttcctgtggctgctgaaacgaccacacattgggtgcttgaaagcagcagagaagtactctcccttctagaaatctgaaatcaaggtctgaaatcaagatcttaacttcatcccatctgcaaagttgctttttacctgtaagttcacatttacagtttccagagattagggcatgaatatcttttggtggggggtattgttattcagccaaccacacatatattgacaaaatccccacagcactctataaggatgactgtgcttttatatttgttaagataatgtaaaacttctcattgatatgaatttttaaaaatatgtgacttgttgggaattttcctccggagtgctgtgcacactgtcttggatctgaaggtgggttagtttgccggagctgctgtaacaaagcaccatgaatgaggtggcatagaacagtggaaatccatggtcccacagtgccagaagctggcagtgtagaatcaaggtgtcggcatagttggcaccttccgaagcctcgaggaaggatccgttccagcttctccagcatctggtgtccccaggtgtcccctggcttgtggcagccatccccatgttcccatggcattctctctggatc

SEQ ID NO: 477676 - DNA, 628 bp, Homo sapiens
cagacatgaaaccatagatccaagaagctcagagagcaccagagctctccaacattgagacacaatcccactgagaatgcgggaggctagtgaggatgctgcaaaggaagaggagggcagccccctgtatggtgcaatccaacatctatccacggtcctttacttcacccttagaaatggaagttttcttctcaactgtatggatgtggatttgggtattgggaagaacagtggtgttccaattattttcctactacaagtgaggagagcccaaggttcatccgtggcctcacaggtggccagcacccagccaagggccctggtggtgacagcccagtcagaggtactgggactcagggacccacaagagggcctgggactggagctggcaggccacgcagcagcctcacacctgggaccccttcctgcccagattcttgtttcaccctctgtgccttccctgtctcacccactgcaaatctctgttctgctgctgaaattcagggaccatggtgaggctctgaagccttttctgtgcaggaaggagtttgagtgagtgtgtaacgacggcaatttgattaatgtatgatcatctgtttgtagcagtctgttctctgccaggtgcttc

SEQ ID NO: 477677 - DNA, 814 bp, Homo sapiens
gaagcagtgggaaacaaagatggaatttcttaaagttcttgtttcatcttttaaggtcatgagagtgttgcgctcagccctctttgtattcatatttaaacaacccaggtatgtacccagaggcagaactgccggaggctatggtaattctatttctggttattttgaggatgcatcatttttcatagcgatggcaccattttacgttcccaccaacagtgcacaagggttccaatttctccatgtcctcatcagcacttattttgtcctgtcttgtttttatgatagccatcctaatggatgtgagctgctgctggagatgctggttcccccacagcatcctggggtctgtgatggacaagtgctgagtggcagctgtggtggttcctgtccctggactgcagcacaggtgctagagcccttccagtacttctgtgagcacctaagcccctgtagtaactcccattctgtgcagaactgggacatggtttctatttcttgcaagtgaatcttgcctgacactgtcgattctgtgtgggatgaacacttttggaagtggagaggacttgattgtgtagggtcaccagataaaacacagggcacccagtgaaatctgaactttaggtacctaataaataacttttcagtatatatcctatgcaaatatttggactgacttatactaaaaaatgttcattctttatctgaacttcaaatttaactgggcgccctatatttttatttgctacatctggaagcttcatcatgttatgagtcctggggggccaatgccacacccccgtcctctctttcc

SEQ ID NO: 477678 - DNA, 1479 bp, Homo sapiens
caccaacaccactatgatcatcatcaccatcatcaccactatcaccaccaccatcacaatcaccatcgtcatcatcaccatcactgccatgatcatcatcgtcatcaccactatcaccaccaccatcacaatcaccatcgtcatcatcactgtcaccaccatgatcattatcaccgtcaccaccactatcaccaccatcatcacaatcaccatgatcatcatcaccaccatcatcacaatcaccaccatcatcatcaccaccatcatcatcaccaccatcatcacaatcaccaccatcatcacaatcatcaccatcatcacaatcaccatcatcatcacaatcaccaccatcatcaccaccatcatcacaatcatcaccatcacaaccaccaccatcatcacaatcaccaccatcatcacaatcaccaccatcatcatcaccatcatcaccatcatcatcaccaccaccatcaccatcatcatcacaatcatcaccaccatcatcatcaccatcatcatcaccatcatcatcaccatcatcatcaccatcatcaccaccatcatcataaccaccaccatcaccaccatcatcacaatcatcatcatcaccatcatcatcaccatcatcatcaccaccatcatcatcaccaccatcatcacaatcatcacaaccatcatcatcaccaccatcatcatcaccatcatcatcacaatcatcacgaccatcatcatcaccatcatcatcacgaccatcatcatcaccatcaacatcacaatcatcaccaccatcatcacaaccatgatcatcaccatcatcatggcagctcacatttacatggaaattactatgtggtgggcattggcactgttccaggactttaaacataactgactcatttaatcctccctccaactctagaaaaggtattattattattcccattgtatagatgaggagactgaggttttgtggcataaaatgaagttggccaaggacacttggctaataaatactagggaccaagaccacacgtgggcagttaggccccagctccatgctattggccactcttctcatcccttcagtctcattcaataaccaacaaaatgctgtgtcctaggaactggataccttgcagggtctattaaaagatatgagctgaattcctgtctttaaggtgggcaccttataaattcagaaggaaaaccgtcacattggaaaagttaggtatggggggggtagcccacccccatgccacatgaatgaaacagtccctcatgtcatggttcagcatctttgcattgttcatgcctcattcctgcattcattcagccaactggcagttaccgagggcctctggtccaggcagtgttgatgcagtgcaggggacaacaggcaaggctgccccctcatgatgggcaagttgtggttgggggaagcagaacccactggcagatacaatcaggccagactgtaac

SEQ ID NO: 477679 - DNA, 1444 bp, Homo sapiens
gcattatttagctgcctacagatgctcccagagaggccatctctctggtagcatgtgtgttttgggatgtggggccacctgcagtttgctatggctgggacaaccccgaggcctcatccagccctgcaggcctgggatcctgcgccagggaccctgcgccagggacatcggtcacctccacaacaccagtctcagcaaaacccttggtcccagctcctgaagacctatgttcttgctgcttcctcccacaccccaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctgtgcctgtggccccaccccatgtggcctgcctccctctcccggctcgcctctcccttggacccagcccatgggcctctttgatggtcctcacaccccaaccacagcccctgagactcttgctgtccctggaggtgtgcaaggctccaccgcgtttaaaacatcgctcagtgcaggaagccacctggccgctgtgtggcaacacttggccccttcttctcacccaaccttatttcccctacggcagcgtccctgacgccaataccattggctttgcccatgcagcctctctaccagcacatgggctccgcgagaccaagtcttcgcctctgtagttcttactgtgcgcacagctcacgagtgctaagtgcaaaataaatatcagttacatgaatgagccagaatgggccaatgggggattagagaagccagtgcctgtaaagtactaacaggtgccaggtccagggagccctcatccctggactgtttctcccatggcgtggctcagacctgagcctcttgttatttgttctcgaaacccagtgtctgtaagtgaacacggattttgagctggggtctgagagtgggggaaggtagcactcattgtagaaactcattctggaaactgctgtcgtgaacgtggcccaggcccaccgctgtctgcaccgtgcaatgtgttacatggggtgtcatctgcaagccctgggtgaggccccctttcctccatgggccttttgtgggccaaggtcaggattcctgtctgaccct

SEQ ID NO: 477680 - DNA, 779 bp, Homo sapiens
ccaggttgctcagagattcagtcttgaatgaagagcttcagccactgttgggcctggacacttgtgttcagactacatccagtaaggaggcagaatgaggaccagcgccctctgggcgacctctacacagctgtcagtcttcatgctgttatctctgggtttgctactggatggatggtccacgacataaaagaactgaagcttttcacaaacctgctgtcacagaactgctcaaatgggtccaaagaaaactggaacctgcagaatgcctttccatcatgttcttggacaaaatataaagcacagagagctttgacagttgctctgaaattgctctcagagtgcttggagatggtagaagacacaagaaaatcagcagaaagctttccggattgagcctttgatctcagcagggctcagatcaaggtccaccacgcgtacaacgccttggtttaaccagcgcctgaaggattaacacagaacaaaagctcaaagcacactacctgcgtaatttctaaatgaacacatttgctgctgtctctgtatgttgcagggtttacactgaggttcattacttctctgccttactatagacggaatatttatgcatttttcagcacaggctacttctcctcttgcataataattcagtagaaaaacggggcagaggaaaaaaaacgagaaaaaaaatctggttagtttttatgttttgttttgaatagatttttaagaattagcaaatttagcagctggacctagaggagaaggtgggccctttc

SEQ ID NO: 477681 - DNA, 1496 bp, Homo sapiens
aaatgcttcactcaactgatttaaccctccaacagctgcataaggagttggtggtgttgactgggagtgaattgacggaagggaccatgggaatttatatatcattttgaaacttatgaaaccttttgtcaaagtttcactttctgactcaggctcagtccaggacattgttcaattcccctggtgcatcaatcagtgcatgtgggtgtgcatggcttctgtttggaaaggacatcgtcatggctccacaatccaagatcccccgaagcagatgatctttctcctgacttgtggtcaaaaggtcaatagcagcctaacagtgactcacaatgcctacaccactcacctcacctcatctcatcacctgggggcttcatcgtctcacatcagcacaagaagaaggcagcaatattgccccaggggcattcagcaaggtctggacaaattttgggttgttgcaactgaggggaggaaggtaggtgtttctggcatctaggaggtaggggccagaggtgctgccacacatcgcaccatgcccagggcagatcccatacaaagcattatccttcccaaagtgtcaactgttgggaaaccgtgatgtgaagggatgttcatcacagcaatgtgacagtagagtgaaaaactgaaaatggcctaaatgcccaaccgtagatggtgtgagtgttaatacagggtgtcaacttgagtggattgaaggatacaaagtattgatactgggtctgtgggggtgttgctgaaggagattaacatttgagtcattgggatgggaaaggcacacccacccttaatctgggtgggtacaatctaatcagctgccagcgtagctagaatataagcagcatagctagaatataagcagcatagctagaatataatcatctgagatggtatctcagactcctttttcacatttttctgcctgcttatattctagctatgctggcagctgattagattgtacccacccagatgtaaatgacgagttaatgggtgcagcacaccaacatggcacatatatacatgtgtaacaaacctgcacattgtgcacatgtaccctagaatttaaagtataataaaaaaaaaacaaaaaaaaaaacagaaaaaggagtctggcctaacctcccagcctacatctttctcctgtgctggatgcttcctgccctcgaacatcagactctaagttcttcagttttggaactcagactggctctccttgctccgcagcctgcagatggcctattgtgagaccttgtgatggtgtgagttaatacttaataaactcatatatatatatatatatatatatatatatatatatatatatatatatatatgtgagtgtatatatatgagtatatatatgagtgtatatatatgagtatacatatatatattccatcagttctgtccctctacagaactctaactaatacagatggtttaatgtgttttgtttttgttttttaaagacaaga

SEQ ID NO: 477682 - DNA, 1949 bp, Homo sapiens
aacgagttccccaacccaggtgatcgggttttgagactggtgctctcatgtcctggctgttcctgaagctcacccgcttgacacgactttttcacccctctgacagcagatgccatccaggggctgtggaaggaactggtcattctaagcaactggaagaaaaacatttctacaacaaagaagcatttgagcgtgaaaaaccttttgagtcccagtttccgctctgccttggaagcaccgtgatttggagggggcccaacagctattgtgatcatatgggagcctttggaaggcaaggtgcaggtaggggtgggtgtgcacaggcacacatgccacagccacagccactgtatccggcgctgcagcgtcagttacccaagccatctagccctttctggcttctgcctcacgtttactgtgtatatcaatgtggtcattttgagaatgttacagaaactgaatcatctactgttacactgagtcaggccctcgtggcctctccatgcagcactacagcagggtcctggctggtcagcaactagaggtcccagatgcatggattttaaatgaatattgcagcattttctaggatatctctgagacatgataccgatcgtgggaatcttctgttaaaggatgtctctgagacatgataccgatcgtgggaatctgctgttaaacgatgtctctgagacatgataccgatcgtgggactcttctgttaaacgatgtctctgagacatgataccgatcgtgggactcttctgttaaacgatgtctctgagacatgataccgatcgtgggactcttctgttaaacgatgtctctgagacatgataccgatcgtgggactcttctgttaaacgatgtctctgagacatgataccgatcgtgggactcttctgttaaacgatgtctctgagacatgataccgatcgtgggactcttctgttaaacgatgtctctgagacatgataccgatcgtgggactcttctgttaaacgatgtctctgagacatgataccgatcgtgggactcttctgttaaacgatgtctctgagacatgataccgatcgtgggaatcttctgttaaacgatgtctctgagacatgataccgatcgtgggactcttctgttaaacgatgtctctgagacatgataccgatcgtgggactcttctgttaaacgatgtctctgagacatgataccgatcgtgggaatcttctgttaaacgatgtctctgagacatgataccgatcgtgggactcttctgttaaacgatgtctctgagacatgataccgatcgtgggactcttctgttaaacgatgtctctgagacatgataccgatcgtgggactcttctgttaaacgatgtctctgagacatgataccgatcgtgggactcttctgttaaacgatgtctctgagacatgataccgatcgtgggaatcttctgttaaacgatgtctctgagacatgataccgatcgtgggaatcttctgttaaacgatgtctctgagacatgataccgatcgtgggactcttctgttaaacgatgtctctgagacatgatactgatcgtgggaatcttctgttaaacgatgtctctgagacatgataccgatcgtgggaatcttctgttaaacgatgtctctgagacatgataccgatcgtgggaatcttctgttaaacgatgtctctgagacatgataccgatcgtgggactcttctgttaaaggatgtctctgagacatgatactgatcatgggactcttctgttaaacgatgtctctgagacatgataccgatcgtgggaatcttctgttaaacgatgtctctgagacatgatactgatcgtgggaatcttctgttaaaggatgtctctgatacatgatactgatcgtgggaatcttctgttaaaggatgtctctgagacatgatactgatc

SEQ ID NO: 477683 - DNA, 550 bp, Homo sapiens
ggcggtgatggaagagatgccaggatgatgcagggagcatctttgcatagtcccttttgcacacaggtggaggtaattgaaacacggcggcagtttccccaatgctgttctcgtgacaaaattactcagtttggggcagttctttatagcagtgtgagaatagacttatatggtgaggtagccacagatgccaacaacaactggctgcagatgtcagcctggtcttgcctcgggctggatgtgaaaacaaagaagcccattgcatttacaaatattatgaccagtaagatggtgcaatgtgaagactcttccctgtccctactaagcaccaaagtattgataacacacatatctcagctcaacttgtcaaagttgctggttttcccacagcttctcatctcagtaattgtttgcaaagagttgtttagaagtataaagcaatgctgatattcataatatttctactttttagggctttatctagttaatttcttcttaaaaatagaatcaaccttgaaacgttgattaattttttttttcagaaaatgtt

SEQ ID NO: 477684 - DNA, 683 bp, Homo sapiens
aatttgcagggatgcccacctggtcctattgcaatcccacagcatggcatcacaggttagaacatggcctaggccttgccagtgcagaaagcagccgccctttcttccgactcaccagattatgaggaagaggcaatgtaccctcatgaaaataatactgacccaagaatctgtggaagtcttgccccccttgtgggaccccatgttccacgtcagacagaactgggttcagatatcagccaagccaacaaagacgtacattgaatatctgctcagtgcccagcactacagggtgaggttaaaggggaccagaagctgtggctgttgcctgcagaatttcactctctttggagaagcagaagtgacaaatagactacagatgacgccaagcctttcgaggagcccttgggttctgaaccacggacttctttgtatcttttctgtttccaacatccccactgggcacactgagcagtgggacttgaggctgttctggaagatcagtggcctgcctttcgctcaatcataatgcaacatttggtttggaattcacaccaacgacaacccacaaacatcgtaattcctgcaagaagtgaacaggctctcctataaagttcagaatataagtatacaaaatcttatataaatgaaaatataaataactaaaaaacaatggtgtgatt

SEQ ID NO: 477685 - DNA, 704 bp, Homo sapiens
tggagaaaggttgagtctgtctctggagcccccaaacactgcagaagaagcctcttctcacagcaaccatagcatgggaacgtgtggatcacatttaacccagcatgtctctgagtcttacccaaggctcacagagaaaacattaaggttagtgaacaatgctcggacttccataaaaggcagagacaaaggttctgagggtacctctgctcctgaatttatgtcagagacgcctgtgagaacactgagaacaatgaagggctcatggaggtcaaaggtacttggagtttgtgaggttcccatgatcctgtgtaaagcaggatgcgagttcattcccagtaaaccaagcctgaaggcattctgtgccctgtgtctccctgccaagacaagagagctgaagccacgtggtggtatgggtgggctgctggccatggctgaaccagttgtcatcagtgccatggtcttcatcattgtcttcgaagcagtcgttcatgtaaccaactctacatcagatactctagtgttttgcaaaatgcttgggctcgaaagcccaactcctggttagagtcctgcctttgtcacctgctgactatgtgacctcaggcaagctacttaccctctctgtgcagcaatgcactcatctgcaaaatgggcaaagtaatagtaagtacttaattgggctgctatgatggaataaatgatac

SEQ ID NO: 477686 - DNA, 624 bp, Homo sapiens
acctacacagcagctctccttctgcaatccttcaacacaccgctgttttatcatcagtaacaaaatggcccctatgtggcctctcaccacaaacaacctccctctgagtgtctttctcaaaggcaaaggttggaagggcaagaacccacgtacttactacatcccctttttgcctctaaacattcatgaggacttttatttaaaagaatttggaattgaaggcaggtattcaacccaaaatgtgtgcatgaatgctcataataacactattcacaagacccaaaaggaaatcacttctcacaaaattggagaccgtgatcacattcacatggaaggggccttttggatctgcatccatctaggtcgtgctactcacggcctgtgcgatacattttcatccatggtgaatatttcaaccagaaccacacttcaaacctggacacacaacggcaagctggcctacatgcagaattccaagacagaagagaatggatttaactgtggcagcatggtggaaatcatccataaagcagtgccagctcccaaactcctggagattctggttgcctggatgaccatccccaaggaaaatgggaaatgcatagcccatggatcagggtgata

SEQ ID NO: 477687 - DNA, 577 bp, Homo sapiens
gcagtaagcagttctaaaccgtccagtcaggatgcaaacacagcatgttatgaggatgggccttgagtccggccaaggaacaagggtagctgaaaccagatttgaatcagaactggcccaagaacagccctgctggaggagcagccacactaaccacatccggccctggaccagtggggcactagacaccactacccactcatctccagaattgcaacccaaagatgcagagacagcattacctggtgatactgactctggccaggggaaaagagtcctgcaattgctcgtgtctggtcagaagacccgcttctgtggccaagcaagaagcagcatcctggttgacaaagtccaccaggactatgtggagtgggcaggggtcatttccgcaaacacaaaacaaggtgcagttaccataaaaaacaaacaaacaaacaacaacaacaacaacaacaaaaacagacagcaaagcaaactgaatagataaaaagcagagctatcatgggttatctaaactaagcctccttgtccatattatctggtggaccccaaatcatgcatcagatgtgcatcagac

SEQ ID NO: 477688 - DNA, 534 bp, Homo sapiens
tgagaactaagaaccggctcaacagagagagagctatctttccatatgaaagctctccgcctgcagaggctgtggctatggctgtccattgttctcgctccttggcttcagttcagagccatcaaatccctgcagctcgcacactggaacattcatattttggataagaaaatggaaaacccagagtgtgatctaccaggagctcctggtttcaaccagttccttgctgtacctgctgggcctgtgatacgaagaaacatcatggcttcaatggcagccttggaaatgaacttcattgaaagggaatttacactgaggtttatgattgctgctatgaaaagagtgcacatcctttccttcgaaacacaagaggttttggggttttttggattaagttgtagcagttccttatacaatttggatagcaactcctcatcagatagatggctcacaaatattttctcacaatctgtaacctgcctttaattttgttgattgtttcctttgttgtgaagaagcttttaagtttgatat

SEQ ID NO: 477689 - DNA, 673 bp, Homo sapiens
actcttattccacaaacagctgtaggatctgggtcctccaggatctgggtcctccaccatcatgcccacgttaatgataatgatttgaaaattacctgggctggaaatggccactgaagttttaacaactgttcaaaaaaaaccagaagtgaagaatgtcttcacgctcttgatagttattctggtttgtgatggccacaaaaggagaggaaacaggggccgtttcccgttctcccccttatccagacaattagtatcattgatgtgcacccaaaataatccctcttttgttcatttgttcactcctccatctgtcagtcttttatggaagtactatggtacacaaggaagtattccagattttttcaggcatacaaaggtgactcaggattgcactgaaaccctgttctcaggaagatcacactccagtgaagaagaagagaacatctgtctaaacaaacaccgtgcaaggggtgtgcccctggaggtctgccctcccacctaacttttatgactgacatcaaaatgaatttggtggaagccagtgtcaggccagtagtgctcttgattaggagagctttctacaagaagggaagaaaccccaacaccaaaaggaacagtttgagtgtccctgctctgatagcagttggaagtctggctgtgcacagtgatc

SEQ ID NO: 477690 - DNA, 555 bp, Homo sapiens
gagggtttgcctgaaaactgcggttatggatttgggggcgggaaaagagcccgtgggtgaaacgctgttctcaccacctcacatcagagtacaagatgtccagatggcaccctggacacactgttagttactgggttggtggggtctgtccagttgcttctcttttagaaagtttctatttatttatctctgaactcactgatgcctgccctggccatgctcaggctactgatgagcccaccaagggcattctttctctctgttacagtggttttgattccttgcatttacgtttttatagtgtctttgagtttttcgtggtttttatatctgtgggtgccagaggtgtcaagtttctgaaatgtcctcagttttgtctctactggtggcttggtcttccctttggacttgtgcttagaaagaatctgcatcttgcagctctttcagctgtaattctcttatatcggatgcctggtacttgtaggaagttgagaagcattctaaaatcttatgattaagcttttatgctgaaactagcttctgaagtccattgac

SEQ ID NO: 477691 - DNA, 1018 bp, Homo sapiens
gtgatgtgcacgggaggtgggctcctcttacttagccatttatttaaaaaaaatcatttttccctgtaatttctctgcataaaaacatcaggcacttgtgggtaacctggagccctctctgccaatccttgctttatgggctgcagtcaggagctcatttgctccagagaggagctgtgcctaagatgctgcgctagcaacctctgtattgtgaaggaactgcgtttcctggattccaaaacacaggagttggattcctgtccttgtgaagccatctcagggaacaggggacaaaacgacaccttcatagaccagtgctttggatttgccggtcaaaaaatcaccctctcctgtcctgcatccgcactgattgtagactctccctccaggctcagctcacagcccacccatctccctttcagccagggccctgcagtcagctacacactccatccatgccaggatgccctcacggctctattctctcacagtagccacccatcctcaggcctagggagccccctccaccatcatcctccaatcctggtcccacgtggtctgacgttgctgaagatagtgatgtagcagagccagctgccttcatggcatgttcatgctgcctgacccgagttcagaggccttgtcactgtcgtccacagctcttgcaaatatctccatttccactctgcagaagccacctctagcccaggcattctctgggtaggcccatgctgtcacctgcaaaagaaccacctgaaaatctcattggaaaactggttcctgggcctcaagctaaaaacaactctgttttggcatatctgaagtggagcccgagaatgtttatttctaacaagctcccgggaggagggtggtactgctgctagcctagactttgttgagaatagtatggatgcagaagggtctcgtgcctcctggactctaaagaccataagagccacctgaggactctatgaacatgcagactctgcttctgtgagcctggggtgagcacaagcat

SEQ ID NO: 477692 - DNA, 642 bp, Homo sapiens
acagcaggggctttcagacaggactgctcattagtttctggtcttccttgcttgattcagccagaaccaggaccatgccatatgcctatttcgggtctatgtcagcaaaagaacaaagcgatgtgtgctggggcactgcttcctgcaccgctgtatgacatgataattgctgacaagagaaatgatgatgctgctggtagtggtgatgatgtcaattgtgatgatgataaaaatggtgatgatgatggggatgataataatggtaatgaggatgatggtgatgatgaagttaatggtgatgatgatgaggaggctaataatgatgaggatggtgatgttactggtggtggtggtgatgatgataatggtgatgatgattctgtgatgatgatcatgagggtgatcacagtgatggtgatagtggatacatgtgcagaatgtgcaggtttgttacataggtatacatgtgccatggtggtttgctgcacctatcaacccgtcatctaggttttaagccccgcgtgcattaggtatttgtcctaatgccctccttccccttggcccccaccttcctacagaccctggtgtgtgatgttcccctccctgtgtccatgtgttctcattgttcacctcccacttctg

SEQ ID NO: 477693 - DNA, 736 bp, Homo sapiens
cattttacttttgttttattgtgactctagaaaagacaaatgcagaccccagggtcccatctcgccttagattcttctccccaaagaaagctctccctaggagtggcaggtgtttttgtttttgttcttagtaatttcttctagaagtctatgttagtccatgtctgtattcacctgtgcatatgtttcatttattccaaaggttcacactatacccacgatttggaacgtcagctgggagcttcccacaccagcatctcatttcattttcaagagtgtcattgagttcccgcgtgcccaccacagcaccgattcctctagccctttccagacaagctcttcagcactcttcagtgtcttcccaccatcaacagtgctgttgggagctcccctagtggactgttgcccatataaagcccttcaaggcgctgttatatcaaaggatttgtgtggacaagcttcagggatgcatctgggacaaggcttttgctggacctctcggtcctggggcctagagtcagtcacgacaaagaagaaagcctgcaacaattgggaaagtctttgcaggggagaaacaccatatgtgaagtccacctgcgacagcatagaagaagccctggccctgtcctgagacccttcagtctggtcaggcacacctcacagactggatgtgggacctgtggaagatgagaaggggttgccctttttccatgtctcctttggtcttcctctcttt

SEQ ID NO: 477694 - DNA, 759 bp, Homo sapiens
agtgagaagattttctccgcagcgcatatgatctgtaagagggagcccctgctgtctgacgactgtgagctaggacttgggtcattttctgactttgggactgaagtctccgtgcttctcgggtctagagcggacctgctcttggactggagcgaaaacatccactgccctgcgtctcagcttgcggactgtgggaagctggactttcaccctgctgctctgggaggcgggtgttggaagctgcacagacagtcccgccatggctggggtgagggcacctgcttgggtggcacacctggctctggtttccacatggaggagcccatcaggctttgtggaagcttgaaggtgccccaaggtcacctggaggccttgcccaagtacagactgctgggcctcacacccagtgtttctgatttagcagatctggggagaggcctgagagctggcccttctaacaagcccttaggtgacgctgatactgctggtctgcggatgctgatactgctggtctgtggatgctgttactgctggtctgaggatgctgatactgctggtctgaggatgctgacactgctggtctgaggaccacactttgagaagcactacattaattctgcctgtgctctgcggctgtgcaatttactaaaatactgggaatttatttctctcccagaggaatgagtggtttaaagtgtgtctccaggtgcaggctcctctgggggatacccttgattttcaaatgcaagacgtgcattt

SEQ ID NO: 477695 - DNA, 866 bp, Homo sapiens
cgggccttgccgcttggcagtggccatcggttacgtcgtcttcacagcccttcgtcactgctcatcacccacctaccttgtggcccaatatgcaacaacaggaggacctgctaataggagagaaggaggaaccaaaagctctggacttcggctaccacttcctggcccttcagcccagcaaatttgaaaacgtcttctctctcaatgaattagtttgccacctgtcctgccgagcatggaaactgttaaaggcaaatgagacaacgtatgtgaaacatctcgaacaactcacagaggctcctaatctcacattccacagctgtgctccccctgagcccaccgagaagagcccaaaagtgtcctgtgcccacttgacggggctctcaggggccctcagcagcaggtgcagagacatttattttcacagtagaagaaaccactttgtggctgatatttagacatagtagaaatggttgagcatttgtactcctcagcagtaggtcatagcattgaaacaaatgcttagatgtctcttttcaagtggaaaaaaaaaaccaaaacattcggagtatgtgtgtttttcttttctcatattagtgatatgggagcagaggctatcaaaatccctagtttacagattttaaaaactccaaaatcttaagctgagagttaaataactaacttgactagtgtattagtaaaggttctgaagagaaacagagccaatagaagatataaaaatgtagatgtatatgttttataaatataagctcctagatttacagtgaagttgtatcccaataaactcatttaagttggaaatattgtaagtccaaaatgcatttaatatacctaatctaccgaat

SEQ ID NO: 477696 - DNA, 1152 bp, Homo sapiens
gtctattgagaacagtgtgagggtagatgctcctctgtggcattcctgtctggtgattcccatctttggtctgaaaacaggatatgatggctggtgctccagcagccatcttagactatgagaaagatggaaacctttctctggtttcagttccagcaactttgaatgaaaaatccgtagttcacaacattctgagacatgtttattcctttattcatttgctcaccagctgtttcctggagatgtacttcgtggcagccatggttccagggctggagatacagacatgttcctgccctcctggagtagattccaatacactttttaatgatcacagtgtaagtgagaatgccagggaggcagattctagggtctctgtggatctctattctccaggctgtagggagaagtgtggccacaggtgtgtgaaaggcctttgtcaagcaaacctctatctcccagacagactctcagatccagggcccatgcggggctgcaagactggtgtgttcacctgtggagacatacctggagaccccagtgcagcagatccaggaggtggacacctgcagatgacaggtgtgttcccctgtggagacacacctggggaccccagtgcagcagatccaggaggtggacacctacagatgacaggtgtgttcccctgtggagacacacctggggaccccagtgcagcagatccaggaggtggacacctgcagatgacaggtgtgttcacctgtggagacatacctggggaccccagtgcagcagatccaggaggtggacacctgcagatgtgcatgtttccccaggtgctcctaagaaccgttgtttccctcactagaaaaggcatcccaaccacagttacaaagtgcagtagttttcactggagccccagtgacctagggtgcaattcatgtacgatttacacttcccatgcacttctaaaaggacttgagagaataatggagggcccaatgcaaggaaaactacaagggaacagaagccgtgggagggagacagaaggagcggatgcaggcggcacctgaactgaacagatgacagtgtttagggaacaaatgtgccccaagtttcctggcagctacagtacacatcgtttttgttttcagacacgagaaagcatttgtg

SEQ ID NO: 477697 - DNA, 718 bp, Homo sapiens
acacatgatgatatttccagatgtggaatttcaattaattagacagagggttctctggggaaaggcgctggcgatgacaggtctgggaaggtctgaaaagagcaggacatctaaggatggcaaggctgactgtcaaaaacatttcaacagtcaaggcttggcagctcgtgttaaaatacttctggaaagtggtttcttgatttgggaagagttcagggagcctggaataatccatattaggaagctggtatggtcaattattattcagtttaaggaaaagccccccaccagcaagcctgcagtaatgaaatacaacattttctcaacagaagagatgggtgtgccggccgatccatcctgtttcccttacatctgtggtagcatctggtggaccattctaaacacaccccaccttcaacatcgactgtagagaagggactgccgtccgtcattcccgagctttgccggggggggcaggggtggacttgtgtctcaggcttgccagaggtggaagtggatttgccacatgttccagggcccctgacccctgccctctgcccactgcccactgcccacagtggagtgtgtgtgctaaggacaaggcagataagccgatttgaaagtgggaaatcagatgggagtttttgtaattatccaattagcgtttcttcattcccagcaatgcgcatgtctaactccaaaattaaggcagggatgt

SEQ ID NO: 477698 - DNA, 881 bp, Homo sapiens
tgagaatccagtgcccaggacctctgcaaagcccaactacttcaccttcaagggcgggatgccagatctgctgtctgccttggcaagtcacatggatcgtgtttgttgttttgctttggcgttgtgtgcgtgtgaacgagaggacgtcctggccatgggtgagacaatggggagcactgatctgggactcagctgtaacccaaacatgggcagttaccagggctggaagcccagctgccgatgcaaaggccaagtatggccagcagaatcatgcacaacacagagatggcagcctcagaagagcccgcatctgtgtgatggggcagtggcagcagaccgcaggctggtgagcatctccatcggcccctgcctggctcctgctgccccagccactgtgtgcagcagtggagcagagctgggcctgtgctcaccagaagagggatctgcccccatggcagcatgccccaactatgcctctacccttaagatgccaggggcaaccaccctattatcgtatcagaaatagcggcgctgtcagccccattatcccgggaatgttgctgaggatgtggggatgggatctctcactcactgccgattagagagtatatccatggaacacttttagattattttttgtttgtttagattgattttttaaatttttgcagagcagttggcagtatcatttagaaatcagaatgcccattggcccaacaattccatttctaggaaatctatctacagaagtaataccaaaaacgagcagacacacgtatatggataatcatcatgaataatggaaaatgggaaaaaacctaaacatttatcaagaatgggctctgtcatttggggcatctctattatggcacattctgtac

SEQ ID NO: 477699 - DNA, 1174 bp, Homo sapiens
ggctgctctaggagggcttcgcctggactggtctcctccacgttgtctctcatcacccagcaagcctggaactgcccttgcacgcatggggtcctgttggagccctgactccttttggtggggaatggtttgtggaccccagcatcttgcccctttgtggaactctctcctcctggacttctatggctgggctctccccgtctccaccctgcacttgtctggtgtagatgcagatgtagatataggtgcagatgcaggtgcagatgtagatgcaggtgtaggtgcatgtacaggtgcaggtacaggggtaggtacaggaataggtgcaaatgtagatgtagatgtaaatgtagatggaggtgtaggtacaggtacaggtttagttgcaggtgcagatgcagatgtagatgtagatgcaggtgtaaatacaggtgcaggtgtaggtgtagatgcaggtgcaggtgtaggtgcaggtgtaggtgcagatgcaggtgcaggtgtaggtgcaggtgcaggtgtaggtgcaggtgtaggtgcaggtgcaggtgtaggtgcaggtgcaggtgtagatgcaggtgcaggtgtaggtgcaggtgtaggtgcaggtgtaggtgcaggtgtagatgcaggtgtaggtgcaggtgtaggtgcaggtgtagatgtagatgtagaggcaagtgcatgtgtaggtgcaggtgtagatgtagatgtaggtgcaggtgtagatgtagatgcaggtgcaggtgtagatgtagatgtaggtgcaggtctaggtacaagtgtatgcacaggtgtagatgcaggtacaggagtagacgtaggtgcgggtatagatgttggtacaggtgtaggtacaagcgtacacacaggtgtagatgcaggtgtaggtacaggtacaggtgtagattcaggtgtagatgtaggtgtaggtgcagggacaggtgtagattcaggtgtagatgtaggtgtaggtgcagggacaggtggagacgcagctgtagatgtagatttagatgcaggtgtaggtgcaggtacagatgtaggtgtgcagtttcaggtacaggtgcaggtgtggatgcagatacagtcatagcttagggaaaccatccctaaccatctcaggcagaatcagcactttgttcatatctctgaggtttgacatcttccttacata

SEQ ID NO: 477700 - DNA, 676 bp, Homo sapiens
gtgcaggagggcgaggccaagctctgacactgctccccaccctggctctgcctgcatgtggagaggcttcacacttatttttcagaggccaggaagctttataattattgaaattaagcagtgctttgaaagtgatgtcaaagttctggaggctgaaaaatccaagactgaggttccagccagcatggttccaggtcacagagccaccctcatgacctcatctaaccttgatttccttcccaagcccccatctctgaataccgtcatgctgggggcctggctaacaaggaggaaggaagaacacattcccaagggaaaagagacactgcgagaatcacagaccaaccggttgcgggaaaactgcggggagaaagaaatttacttgcaaaaaaatggtgaagggcaaataaagtattgagcttgtgcagcataaataaaaaggctttggttttatctctgggaagtaagaacaaaatagaaagttcccatctcaaaaagctcagacttgtgggaataaaacctctttcccttttgcattatagaacaacgccacaatttccagcatcgtccagagactgcaaaggactcacctgagattgcagggcccaaaatgatctcctcatctggggcctctttatagttcatgtatattcaatcagcagagctctggttctac

SEQ ID NO: 477701 - DNA, 1185 bp, Homo sapiens
gattggctgtcctctgtgggcacagggaagcatggggacctccagccaccccatagcctcaaacagctgcccagggcagcctctgagctccccggcatcaacggcatggtggaagcgagagtgggctttcttcccatgtctcacccaccagtggttaattggaagtgagagtgggctttcttcaaccaccagtggttaagtgagcaggctttggatacaagggtgatgtgaatggggctcatttggtggcactcagccaaggaatggtctggcctagaggctctggagaacttcaggctcatgcctgaccgcttatacagcagctcaggggcccagacaaaatggcccaagaggccccagtgtgagctgcatagcttctcggagcttgaaagcaagtggtacatcctgaacctggtgaatgggtatgtccttaaactggtgaatgggtatgtccttaaactggtgaatggagacgtccttaaactggtgaatggtgacatccttaaactggtgaatgggtacgtccttaaactggtgaatgggtacgtccttaaactggtgaatgggtacgtccttaaactggtgaatggggacgtccttaaactggtgaatggggacgtccttaaactggtgaatggggacgtccttaaactggtgaatggggacgtccttaaactggtgaatggggacgtccttaaactggtgaatggggacgtccttaaactggtgaatggggacgtccttaaactggtgaatggggacgtccttaaactggtgaatggggacgtccttaaactggtgaatggggacgtccttaaactggtgaatggggccgtccttaaactggtgaatggggccgtccttaaactggtgaatggggacgtccttaaactggtgaatggggacgtccttaaactggtgaatggggacgtccttaaactggtgaatgggtacgtccttaaactggtgaatgggtacgtccttaaactggtgaatgggtaaaaaaatcgtggggcatccatgcagtgggatattattcagtgataaaaatgagctgttgcaccagaaaaagacacagaggaaactcaaaatgcacgttgctaagtgaaagaagccagtctgaaaaggcttcatgctgtgtgattccaattccgtgacattctgaaaaaggcaaagctatggaga

SEQ ID NO: 477702 - DNA, 2115 bp, Homo sapiens
gaagcgggaacagtgtgtcatttagtgcctcgtcactgcaaactggctgctgtggttccagtcgttgcttctgagttcagagcagaagaaggtgcagatagtagcaccatctgcatttcttccctgtaccaggaagacaaacactttctcagaatccctgcagaagttttcattgactagtcctaggcacttagctcattcctatctccaaattaatgttaaagaagatggttttagagcaccactgtcacgtgcagacaggatcggacccagatgttcagggccacagccataagaccagcagtgaccaggcacacagtggttccttcattcagtcctacacatacctcagtggttccttcattcaatcttacacatatctcagtggctccttcattcaatcttacacatatctcagtggctccttcattcagtcctacacatacctcagtggctccttcattcagtcctacacataccccagtggctccttcattcagtcctacacataccccagtggctccttcattcagtcctacacatacctcagtggctccttcattcggtcctacacataccccagtggctccttcattcaatcttatacatacctcagtggttccttcattcaatcttacacatacagtggctccttcattcagtcctacacatatctcagtggttccttcattcaatcttacacatacctcagtggctccttcattcaatcttacacatatctcagtggctccttcattcagtcctacacataccccagtggctccttcattcatggctccttcattcagtcctacacataccccagtggctccttcattcagtcctacacataccccagtggcttcttcattcagtcctacacataccccagtggctccttcattcagtcctacacatacctcagtggctccttcattcagtcctacacataccccagtggctccttcattcagtcctacacatacctcagtggctccttcattcagtcctacacataccccagtggctccttcattcagtcctacacataccccagtggctccttcattcaatcttacacatgtctcagtggctccttcattcaatcttacacatacagtggctccttcattcatggctccttcattcaatcttacacataccccagtggctccttcattcagtcctacacgtacctcagtggttccttcattcaatcttacacataccccagtggctccttcattcagtcctacacatatctcagtggctccttcattcaatcttacacatatctcagtggttccttcattcaatcttacacatatctcattggctccttcattcagtcctacacggacttcagtggttccttcattcaatcttacacagacctcagtggctccttcattcagtcctacacatatctcagtggttccttcattcaatcttacacggacctcagtggctccttcactcaatcttacacggacctcagtggctccttcattcagtcttacatggaccttagtggttccttctttcagccttacatggacctcaatggttccttcattcagtcctacacatacctcgcaatcttacacagacctcagtatgaagtccccgacttccgcttccaggaaggtccaaggagaaacgcaggctgcagcccccgatagggtgcagagagatgctggtggggagtctggagagggatgaattgggtgagggcccttccttctctggacctcagtttccctgtgcaaagcagaggggtaagatgtccaactgtggtccaggaactccctgcctggggggtgcttgctaaactcgccagccccgtgggtcctatcccagacctactggagggtgccgacagtggcccacaaaggatccatccacgcagagcctccaaatgtaacattatttggagaaagggtctttgcagatgtaatcagtttcagaatctctagatgagatcatcctggattacctgggtgggccgtaaatccaaggacaactgtcttgacaagagacagagaagacacagacttggagggggaggccccgtgaagtcacaggcagagattggagcaatgcaaccacaagtcc

SEQ ID NO: 477703 - DNA, 772 bp, Homo sapiens
atctgctcctctctgccaggcagaaaattacattatttcctcattttgaaaggtgcttgttttgtcaggaagacatcccttcctttgggggagtactgtatgcaatttgggggagtaccgtgtgcagtttgggggaataccgtgtgcagtttgggggagcaccatgcgcagttggggggagcaccgtgcgcagtttgggggagcaccgtgcgcagtttgggagagtaccgtgcgcagtttggggggagtaccgtgaagcagtttgggggagtactgtgtgcagtttggggagtaccatgcacagtttgggggagtattgggggagtaccgtgtgcagtttgggggagtaccgtgcacagtttgggggagtatcatgtgcagtttggagtactgtgtgcagtttgggggagtaccatgcacagtttgggggagtaccctgcgcagtttgggggagtaccctgcgcagtttgggggagtaccatgcgcagtttgggagagtaccatgcgcagtttgggggagtaccatgcgcagtttgggagagtaccatgcgcagtttggggggagtaccgtgtgcagtttgggggagtaccgtgcgcagtttgggggcgtatcatgtgcagtttggagtactgtgtgcagttcgggacacctgactgtgcttttctgaaggatcctggattctgagtatcactgggggtggaagcaaacacttatctactgatttgctaacatattgcactgttaatctcaacttgccttctcccagtggaa

SEQ ID NO: 477704 - DNA, 1309 bp, Homo sapiens
ttcttgtgaggatgggcgagatggtgaatgtgtcaccagcctgggtcaaggagggcgatattagccatgagctgctgctggggtggccttcctgctgctggtccaggtgcctggcctggtgctggtcaaggccacgagtcctctgcaagagccagggcaggggtgggggacagcaaggggctcgaggcacagccgtatccacgccctgccccgtctggccctgctcttgccatttttttccagctcctctggctgcccctcttccccttctctgcctcatcctcaccctcctgcttctcctgggttcccagcaaggctgcagcagcaggacagggatccaggtgggcccccaactggtcatcttgtgatttggggggtgtctgctctctccggtgccagctctcctgaagtcctcttctctctgccttctcacctccagcgccattgcttaatttccctgtagctcttttcaggggagcagggaggaggaggtaggagctgggctgagatatgtggagcatcactgtgcatctgtgcccacccccaggcccgggacacggaggcaccagtgggaggagcccacggaagtccagtggggcaagctggaaagcgagccttcagcagcagcctggatcccaggaggtgccacaaccaaaaatgcctctagatgttgcccagtgtcccctgggagcagggaccccctttccaccatgcccgagacccccacggttctagacaaagggcacttctgggaagcgttttttccgtgtgaatttgtgggtgtccagccagccagcaagggtgaatttgcacgagtttcctcaagggacattgtgtttggaagacaccacgtggcctcatctcccttgggtacttgggtacctgatgtatgtgctgacaccttccatgtagacgtgcgtcaccagttcggcaatcagagcacattctggatgcttgggtttctaggttggggccacagggactgtggctatgcaggaacactgaagggggctctccctggagaggaggggcctctcatcttgccttctgggggccagaactctgatgtcaaagtgtcagagagccatgctccctccggaagcactcacagccatgcctgcaggggtcctggctcctaccccttgcagctgggggatgctgggcgagtcccgtaacctgccagtgcctcatgtccagagccaccagaggccctttccccatggggctatgtggatgtgagacaagatggaacacatcatgtacatctcacggtgcctgacgcacagccagccatctggaaagagtggac

SEQ ID NO: 477705 - DNA, 492 bp, Homo sapiens
gtgatagcgaataagtctcatgggatctgatgatttgataaaggggagtcccctgcacatgctcttttgcctgccaccatgtaagatgtgccttagctcctcctttgccttccaccatgaatgtaagaccttccaagccatgtggaactgcgagtccattaaacctctttcctttataaatgacccagtctcagctgaagttgaagagaccaatgtcccgtgccgaaccaggaaagcacaccccgccaaatgttatgagacaaagaaggcgagttggcgcttcgcaaacaccagcccccgccagcttattttgcctgataagcatatacatctcccgactaagctgaacaatggacttccagaggggaaagtaaacctgacaggcagtgaatcaacatttccttgtctaataagatgaaggcatcgtgaggagtgtcccaggtttctcattaggagcatgtgttgactcttggtagaatttgatcgtccatc

SEQ ID NO: 477706 - DNA, 1539 bp, Homo sapiens
ttaatattgaattcactataagagctcactgaagttggggataatggtaaccagctccttctcagccaggaactcgacctcggccacgtccatggcggcgcgagtggccagctcgggcctcacagtctccttgggcccttcagtgtcccggaggagctctggcccctcctcaggccgaatggatcagcttccccagaagaatctcctgcgactacaccctgctggctctgctggctgttccactggagtggagagctccagcatggatggcttttggatggaggtggaacagatccaacagagagatgagctgagggaagaggacagtggcgggaatgaaggccagcttccagaggaaggggaagctgaatcccagtggctgcaggacacaggcctgtcgggcctccttggtggcctgggcttggatggtgatcaccaggagctcctgtccaccctgacacagacccaggtggccgctgtgtgccgccggctggacatctatgctcgctcagtgcgaagacaacacaagacacctgtcagagatgtcagggatgtctttggggtcttcaattcagggaaaatgtcgtcagagaatggcgactccggtatgaagggggcccagctcagttccggggcctctaagtttcctccagcagcagagcctggggggctgcaggagcaggctgggagggaagaagccttcaacatggactctgcctactcagaacaagctgcggtgctcctgcagaggagcaggccatcccggggaggcacctctgcctggggcaagtgttccctgccgaagtttaccgtccccaaaggcagacttggcgtgacgaggataggagacttgtccctgcaggatatgaggaaggtaccttctctggccctcatagagctgaccgcgctctgtgacatcctcggcttggacctgaagaggagcaaggcggggaagtggaaagcggcagaaactcgcctctttggtgtgccccttgacagcctgctagaagctgaccacaaagtcctccccagcacacaggtcccgctggtccttcaagccctgctgtcctgtttggaaaagagaggactggacatggaaggcattctcagggtgcccggatcccaggccagggtcaaggggctggaacagaaactggagagagacttctatgctggcctttttagctgggacgaggttcatcacaatgacgcctctgatttgctcaaaaggttcatccggaagctgccgacacctttgctcacggctgagtacctcccggccttcgccgtggtgcctaacatccccaacctgaagcagcgcctgcaggttcttcacctgctcatcctcatcctcccagaacccaacagaaatgccttaaaggacttctcaaagcctttggtatattgaggctttagagaatctccaagtgggattagagtatgcagcactctccaaactcagttgatcacagacctcttttgttgtggaaagcattgcatggcactggtgttccatgcagaaccagtttgggaaacaga

SEQ ID NO: 477707 - DNA, 3095 bp, Homo sapiens
gacgctttcgttgtgtgcagacccctccctttgtacccatcttcaacggaggcagtgattggctggccagaactgtgggcggggcctttggggtccaatcctaggaggatctgggccattcattggcccctgtgggaggtgggcgaggtggagaaatgggacccccaaggagggaggtgagaagcaggacaagttgacaaattccgcaactacgaatgccctccacttccctagtgctggaggacagggctgagccctctggccattcattgatgctcccatgtcacactggtcatgcctcttggtggcccgaagtggcctgcccccaacaactgcaggtagccccaggacacagggagcaccagtctggcctagtgtcgcaaaggcctagtgccacaaagaccacagtgaggccaattggcacatgtggaccacacagaggggtgctctgcctgtagtggccaaggtagtagtggagcccaggccttggatgttccattaggaagtccctagagtgccctgcgggcatcccctggcttggcagcgtctcagtgtgggtccccagaagcaggcagtgagacaaggactccagtgaaagtcatttatgtgggaggcgaaggaaacagcagcaggggagtggagacatgagacaggcaagggaaggcgccaataagcagcgcatcatcaaaccagctaccgcatcacaccagctactgcatcacaccagctaccgcatcgcaccagctactgtgtgggtgactggagctgaatcccactggggaacccagggagaccatggagacacttctcagggcctaattcaagttgctcctctctgagaagctctctaagctgatttcagcttagagagcttctcccacctcccaagtcctccacctccgaagtcctccttagctcttggctctttggcatctgagagcactgggacaggggtgaatattccttagtctgccgcttggggcagggcagcccaggctcttgctccagggacggtggacgatgctgcctggtacctggctgtgggcagggctgctgagagggtgggagatgccttctattgagaactccccacccccatccccaaccactttgcattctggggcaggggagtgggagccacttgtcattgttcctgtacgttggctggcaggaggcccagggagggggctccccaatagaaaatctgcagctgcctgtctttaaggagtaccggtctagtgtagggatgaacacattaaatacggcccccggggtctcgcccactcaccccctgaatccccccaacaggctgccctcagcttttcagacactggacatgagtgttcttggtcttccaatgatgccaaagtcctgccgccctgcaaacagctcctctgcccaccaggacatcttgccttctccggacctgcttctccccggacctcgggggttgtgtggtcagtgctggctggtccctggtgaagctgtacttatgtgtctctgttgccccaggagttgccctcattctgcccatcttgtcctcactccaagcccgccccttcttaaagactccctctgagttcagtgccctaagtccggaaacattcaaagctggacccagggtagcgggatccggggcctctggggacccgagagggacgttaagttcagggcttcagggtgcagccctggggtcggtacccccagcctccaacccagagctggcagcgctcgcccccttctccgcgcgggccctcagctcagctccctcttcgctccccgtgtccccgcgagcgggagggaggggatgctaggacgccctgtcggcgtcgtcgccgctttccgccattgtttagtcgtgatgctctcattttctctgaatcaacaattttctgctcggctccgcgccgaccggcgaacgcggggcttttcctcgcccgcctgatgacagcagagcggcgcggagcagctggtccggaaggaagcgccaggcgcctgcccggtcccaggcgtccgctgccgcccacccacaccagaccccgcccccgcgcgtcaagccccgcccatccataccaagtcccgcccccacaccctcacccacacaccaggccgtccccaccccgcccccagagccccggggcgccccgcccgctagccgcgcacgcgcagtgagcacggcgacccccggtggtcgggtgtctccgcaggccgaacacgctgctcgcccagctgcggatcattaccgcccttttgttctccgtcgcgcgctcgccccacgctaggaatgcaaactgtaggcgccgccagcccccccttcctgtttccctgggtgggagtgggaagggagttttaaactgaattgtgctcagactcccagcccagtcttcccggagccatccgttccttcatccaatgcggacacccatatctaaggttcgggcaggatttccggggcaccctcaaacccagcccgtgggatccgggaaggcctcctggaggagagtccacgaggcacggagccgaggatggggttggggttaggtcttggagggcttcgaatttccggcaaagggtctgggatggttcttgaggacagcagggatttgcagggaggctgggggtggaggtgggcagaggtcttgctcacatttgtgttctacaaaggtccttttggcttttgggaggcggagactgagactggagtccagaggaccaaggaggacgaggtaactgccgtggtccaggtgggagaaaatgtcggagtattaaatggggttgtacaagtgcccctggtcctaggagaacctcttttaagttcctccacctgtcaagatgactactttgttacaagagctagaatctacaagaggccaggggtaacatccatcaggcaaggtgctggcagttttcatcctggctctaagtccttaggaaagtcatgtcacctctctgagccttacttttctcatgagatagaaaacctcacaagattgttaagaattacataaaaattaaatcctgtgtaaaatgagaaaataccttctgactagccacttcctgagggcatgggcatgtcaacttatcttcgtgtcctc

SEQ ID NO: 477708 - DNA, 947 bp, Homo sapiens
cagcctctctccagcactggattcttgagaaataaaaagaagccgtgggtcacagaagtgaaccgtggaacccagcgactagcgttcagctcaattaggacgaacccaggcacttagccatgcaggaacaatggcgagcctctagcccgatcaggagctctgttttcactctgctaaatcttgcaactgcacactctttctgtgacttcgcacgtggctatattacgctgtctggtgtacaaagaggggccaattctgacccagatcaaaaggtctggggaactccgcttccacccacgggaccagaatgtaagaaatgggattatttcaactgcgtgaattgttcccagacaccccagtgtcctcatcagaacaattctcagtggcagaattttcaggacatcagccttgtccaaaatgcaagttccaaggtgatggaggatgatacactcatcatcagaatccagggctcctgcgagccactgccaaatgattgggaaccctatttgcatttgagcaaatgttttggggcccagatgatagcaatggtgttggtaatggtggtgacagtaatgatggtgacagtgatgatgatcctatttgcagatgaactttgtggtttgaggcttgcaaagtcctgtcagctatatggctccacaactcattcctacaactgtcaaagacagcttgcgactgtgaggagcagggacagagagcttcaaagacagaagagcgtacattccaactcactcaacccccagatccaatcgcaggctttttcttgtgcactcccatttccacccccagccccacaacgagaactggctgttgagtatagtcactacaacaatcacaaaataattgctatcacgtattgggcatgcagcacctgttaagcatttcatatatgagatctcattgaattttctcaataattctatgaggcc

SEQ ID NO: 477709 - DNA, 644 bp, Homo sapiens
tgtcaggaatgatctggacagagggcatagggcatctttcctgagcatatttaggaggaatttgggtggccaagagaaaggatctgagcagaccacccaggaaattaagcttctcccaagaaaggagagggagcaatggtgcacaaatgtgaatatcatctatattgtggagaagatgttagagcaaaagagaaattgctaaagtattcaacagagaaatatcaaatgcccctaaataaaatgtatagattggaggaagaaattttcagtgtgtgcagaaacgatgatgatgatgatgaggatgaggatgatggaggtgatgatggtaaggacgatgatgatgaagatggggtggtgatgatgaaggtggacatggtgatgatgatggtgatgaagatggaaatggtggtggtaattatggcgatgaagatgttggtggctgtggtgatgatggtgctggagatggcgatggtgatggtgctgatggtgatgatcatggagatggtgatggtgttaatgatggtgctggagatgacagtggcaatgctgatgatggcaatggtgatggtgatgatgtctgacctttgttgagctcctactgggtaataggtactgtactccatggattatcttatttaagactt

SEQ ID NO: 477710 - DNA, 674 bp, Homo sapiens
tcctacaatttgcatttctaacgtgttcccaggtgatgtcaatgccactggtccagggaccacactttgtgaaccactgcccaccattggctgaggataaaagagatgctctctcctgggtccttaaatgcccccagaggcagagctatcttctggatttggctcctttcacattttgccaatgccaggagatggcctggctggaaccacctacttcaggaagtcttatcttttttgacccccaagatgtgctcggtgttgatgctagacgtgctcctcccattgatgatagtggcaacaacagtactgatccctttaacattattgaggtctattatgtgccaggatctgaactattgacaggttctaatttatttcgggcccacaaagcgggctcctcctctaaacaggcttccaatcagtcacgcttccctgggcctgccaagaagctccagtcgataaagaagcaggtagtatctcttcaaggacatcctaacctcagagaagttgaattaattgtttaagtgaccactatgattatacttcagactgttacgggctaaactgtgttccctcaaattcatgctttgaagctctagctctcagtaccttggaatgtgaccgtatttgaatatagggccattaaagaggtgattcagctacaacgaggtctt

SEQ ID NO: 477711 - DNA, 569 bp, Homo sapiens
gccacataccataagccctgtgaagaattttttggctttacccaacagaaagagttctaactttgccatgggtttagaaggtgaagagctagaaatatttgaaaaaaaaactcacaacatccacagtgatgaatacagtaacattctgcagtattgggcactggggacttcaacgtatgaattttgggggaatggaattcatcccatgcaggattcaagaccaacttcccggcatctgaagctctctgggaatagaggagaactgaaagggctttcgaaagagccatctgttagttttcataaagacattatgtgcttcccatcacagggtttttgctgtctctgtcatgtgtccgccctccctccgctgtctgagagagcaggagcgtggtgcctctccactttcctgtctgtgcatggctgctggaggtgggctgcagatgagtatttatctaaaagtgaagagatctgacttataagcaagcctgatattaaatgtataaataatgcatcctgtggcattatttataatgcaataacatccctataatgtaataaaagtatgcagg

SEQ ID NO: 477712 - DNA, 595 bp, Homo sapiens
agcagtagcttcctgcctcactctttctgctaaaaagtttcacccagactcgaaaattaatgtgtttctttcttgtccctattttcttctaaaaatctgatcgggcacttggaagaatatccaagctccccaccatgacctatgggcctgtgctgatctcggtctcttctccctgcccatcttcattttgttccatggcctctcatgttgcagatgtcaatctcaggtcctatttgaattattcccagttgcaaatcaggaaggtattaattggtgcatgttctgtaagtgctgttagaattagagctactgggctggctgacaggagtttagagggcagcccttttcctcctctgagcctgtctccccagccatcccttctaaaagttgctgggctgatgcttgtatcttggctggctctgatgccagctctgacggggccaccctggaacctgcttgcacaggctgtcgagggcgtgagaacccaagcagacaactcccagtcctacctcctttgctgtgccaggctgccagtgccagctgaggaggccccctcctgcctctgcttgtttcccttgattgttatgtaatgttc

SEQ ID NO: 477713 - DNA, 637 bp, Homo sapiens
ccttctccatgtgttcacaaacaaactcctttaataatccattccataacctccttttggatctacagcaaactactcacctagtggttcatggaagctatgttcctcctctgttgaaatttgggatgacatttttctcccatcttctaccactctcacctcttctccatcaattctgtcagttcgacaagtcaaacccaagagatgagaaaggagagctgctagatatgacaccccacacttggaaagtcccaggcccttctgcatgtaagactctccagctgcaggatgggaagtcctgtggcaaggatggacctggatcctgggtctgcggagatcggcttggtgccaaggtccacaggggtgaactgagtctactggacaggcctggagtctgcgtccacaaggcctagactgaagcttggctgcatccgaatgttttcatatttcatgattttatcgtccaaaatgctatctaatttttactgtaatttatttttgactcacaggttatttagaaatgaaatgtttaatatccaaatatttaagcatttctaattttatttttgttatttgtttctcagttccatggctgtcagagaatatatgctgaacagttttaatgctttaaatttgg

SEQ ID NO: 477714 - DNA, 568 bp, Homo sapiens
ggcaggacatcaaagttcctttccagagtgtctatacagaaaatcttattggaccacagccatgctcattagtttacatatcatctatggctgctttcacacaccaccaccagggttgagtagttgcagcagaaagtgtataccacctgtaaggcagaaagtaagatatttactctctggccctctacaggaagtttgccgactcttggcttgggggacagctgaagggctttggggttacagcagcggaagtgacttgagcagaggagggactctggacatcatggacaatggggcactgggaagtgaggagctggcggcagggtgggcacaggatgatgacgatgataacagagtcttgagagcccgtgcatctatcactgcaagctcttttcgttctaggatgctcagttctctctttaacttgacccccattggggctgcccccccatatcagaaatgtagacagagctaggtccctactaggctgtaagtaccatgaccaaaggagccatggctctagatctggccaaagatgatttgggaagtgtaattatctcttggcttt

SEQ ID NO: 477715 - DNA, 718 bp, Homo sapiens
gacagcgagcatcaactgcccctgtgtgacccagacgttctttctaaaatgttactgtggccctttcatggctcagatcaaggctgttctgtggatccctattggccacaagccagttgtccaccaacccaaagactcaagtagaaaaagtcccaagtatttaagggctcatcccaacctaagaggtccacatgagcttcagaatatagcagattgggtctcacattcattgttttgttgttgtttttcggttttacataaacgtgagtgccagtatctttgggttgagactgggcctctaacaaggcccctgaattccagtctgctcttacatctgccctcttggtatagttcaagatccactcaaagtggtcctcagaacagccttcaacagattttggaagaaaataaaaggaggcccatggacagaaaacttagggagatggtgcataccctcttctcttctgaggaacaaaaatggtaatcatatattagaggctctgagaagtcttacaatcaccataaggaaagaaaaacccactttgattaaacccacattttacaaatgtatttgctcatacatttctcctctcctttagggaaaatcacaatatgttggattgtcaaactttcaataaatgtgagtggctgttggcaattggaggtctgcggagaactctaaagtttccaggaattggaactctaaaggctaccttcc

SEQ ID NO: 477716 - DNA, 558 bp, Homo sapiens
ggggcagagccagttatgggaggactccaagtgcaaaggacagagctagccatgggaggactccaggcacagcagacagagtcagttatgggaggactccaggcacagcagacagagtcagttatgggaggactccaggaacagcggacagagccagttatgggaggactccaggcacagcagacagagtcagttatgggaggactctgggcacaggtggcagagccaattacgggaggactccaggcacagcgaacagagccagttatgggaggactccatgcacagcagacagagttagttatgggaggactccaggcacagggggcagtatgcacaaacacccagaggcagaaagaagttcacgtggtgaagcctgtgccccagcacattgcctgcacatggtaagtgcccaataaatatttgttgatttaatgaattgttaaccaactaatgaggaaaatgagcgtgtagaaagctccctgtaccaagctaaaatgggaacacagaagcatgcttataaaagaaggagctaaataagtggatatttagcaacac

SEQ ID NO: 477717 - DNA, 788 bp, Homo sapiens
agtgccgcagtagatttatgctgcacaaaagctgcaaaaatcaacagctgatttggataccaccaagacacctgaaaccttattatgagccagatgccaaggaagagattccgggaggatcccgagtactccccggttgcagccatgtcaagactgatgctgaggaggaccccaactgtcacaaacaacacatgtcaaacacagccactcatctggggacagatcaagaagctgccacagatggcggaagaaaacctgaggaaagtgggacaaccagtcacaacaagtaatttaatggtagctatgatagcagttatcaccgctgctgctaagctgaaagagatctgcattaatggcctaaattttattaacgagaactggaagcacctaattgctaaggaagaagacatgaagatgagagaaagtttggaacttcttagagactcgttaaatgattgtgaccaaaatgctgaaagtgatatggacagtggagtccaggctgatgaggtctcagatggaaatgaggaacttactggggactagagcaaatgtcacgtgttatgccatagcaaataacttggctataaagtgcccttgctctaggaatcttttcagcttttggtttaattaattttctttattgtttttggtttgcaattgcattagtttctgctcttatatagtcagtaaaaatttaataaaattttatttccactgatttatattcttttgcttttttcaacactgatttacattaaaaactccaagcacactataactgaggggaa

SEQ ID NO: 477718 - DNA, 2584 bp, Homo sapiens
caggggtgaaggatgattttgaatgagatatgggaccagaacacagatgtggaaacccatgggttcttatacctgaacacttggtgtcagcggtcaagctccagcaagtgggtgttatccctcagataccactctcttgtcctaactcaggctggcataatccgcaggaacctgaacgtgcatctctagcctatgcacttaggacagtgattcctgctgtcctggcaagttgctgcagctctgaccatggagaagaggcaccattaaaattaagcacattaagcaagtttgcacaagaagagagagaagaggaaaatgcaaaggtaaccaggggagtagaatgttctctggccttgctgggactgtccactccagtagaaacgaaagggagtcctacaggagatgatgcagctcaggtgccttctaagggaaatgagaaaaacagtcaaaataatgcagcccacgtgacactcatgccagcttcacccagggaaggagtggaacttaagctctccagcccctccaggtgtcaggatagagtgagtggggccatggtggacattgtgggaagggacagaatggatgtgctctgccatgagtggaccaccatcactaaaatggacagttgttgtaccaaaaaagaaccatagacagagaccatagacagaaaggacacatactcctttgggaaatatgtactgcagcaaagaagggtcacttattgctataaattttcctctacgtactgctttagtagtatctcacaaatgcaaattttaatgtattgttttccttttcatttagttcaaagtactttattttgatttcacctttgacccagaacttatctagagtctcaggtacgtctttgccagctgcgtaaaaacagactaatatagcatgtaaatgtttgggattgttatgtctcttatgaatttacatctttatcattataaaacaatttttttctatccttggtaaaatttcttgctctgaaatttagtctgatattaatataatcattacagaattttttaaaaatggactttattgttttagaacactttttatacttacagaaaatttgagaagataatacagaaagctcatatacttcaagctatgggatgaattgtgttcaacaaagaaggtatgttgaagttttaacctcctcaaaatatgacttcatttgaaaacagtgtaattgtaaacaactattctaagtttattttcaaatgacactaaaccacttcaaggataatgcagttttcctaaaaactcctttttaatagtctgtgccttgcagttcttttaactgtaattcactgttattatatgaaagctttgatgacagggtggtaaggtatacactttctataatgctatgattaagcctcagtcttttagtgggcttctgtctctgatctgtgaccatcctaagtgtatctcagtgttttttcccatattaggggatgataataagaaacacttgagaaacactggttcagatgcatattttcatcgtcttattttccttcagcctgaagtatttcctttattgtgtcttgtggtgtaactttaccatctgtaggtggtaaattatttcagtgtttctatgtctgaaaaaaactttagtttgctttcatatttgaaaaatactcttgctgggtatagaattctacattgacagttttttaccccttttattactttaaaagattgttgcactgtcttttgtttttctggtttctgacataaagttcactgttatccctaaacttgctcttctgtgtttaacatgtcctttttctttgtctattttgaaagtttgtactcatcacttgttttgagaaatttggttatgctctgctttgggttagttttctatgtttggtgtttatagggcttttcaaatctacatatttatagttttaatctaacttggaaacatttgggcaactgtttcctcaatttttgttttcttctcctcttttgggtattccaatttagtgtatattagatctcttaaaatcgtcctatagatcactaatgcttttctccatttcttttttacttttttaaagtatttgattttgcatcatttctattaccatgtcttcaagtttactaatgtttcttccagttatatctaagctacatacatcatagatctttctctcaaacattttacattttaccaataatattttggtttatatttatatttgtcctgtctctacttaatttttaaacatatgagaaaaattatacatccaatgtccttgcttactaattttaatatctgtgctgatactgggaagttttaatttattgatttttttcttattattttagtttttgtttgcatacttggtaattcttgattgtgtaccagatattgtgaagtttgcatttttggatgtttgatgcttgcatgtgtgtgtgtgtgcatgttcttaacctttgttctgaataaggttacttgaaaactggttctctagaattttgtgttttaagatttgttaggggagaccagaacattgtttattctacgactaatctttctctagtactgaggcaagaa

SEQ ID NO: 477719 - DNA, 990 bp, Homo sapiens
cagcaaaaaccattgaacagggataactcttttccgtggagccttttgtgtgtgtaggctatctgtctcatagcatgggaactgatggactctgctcccaggacatactggtgctgttatctggtgaagtcaaggtgttggacttcttaaatgattgttcaggtatccaagagtgtatatttccagaaataggaagtgacagctgctggtctcttgcagcttgggcctcgaacctagagtacatcacttctgctgcatcctgttggttacagccaccatcaaacctgcccagacttcaggagaaggaacatacattaggagtaagaacttggttggttctcagtctaatgcctacgaaaaaagcctgggaaacagggaaaccaagagtcacggatgtcatttacaccagaagagtcaagcccttggaagagcagctgccttccttcctttgctataccaggagctcctgggagttacaggaagctccagttaccactgcctccatcagacgggatccttcttcaggaatgcaagctttgacattgcatctccagtggcagtctcttctgtactcccagcacttagcatgtaggccctggaggaatccagaagcagataaaagataaggtagtacttgtaaagtacttagcacagtgtcttctgtatgataagatcctttccaaaatgaagattacaacaaagagcttattctgactagtttgggaagtcattacaaggtttgaggaaaactcacattatgagcatgctgccgattgccttgagtgttttcttgtgatttttatacatgtcaccattttaccaatgggttattttgatttcaaagaccatggtgagaaaaatacggacagttcagggcaaatctaactctactgctcaggtagagctcagagtgtaccggcatagaataagtctgaaacaccaacatcatgagctgatttagaataaggtcagcaaacattttctgtaaag

SEQ ID NO: 477720 - DNA, 1886 bp, Homo sapiens
cccggaagcacttgaatccttcaagtcatgccacatttctggaccaaactaatgtctttcttcaagtggggaggtggtgatgaatgtggtggccatgctgattgtgatggttggattgtggtgatcatggtgatcatggtggaggtgttggtgatggtgctggtggtggtcttggtggtggtagtcatagcactggtagtgatggtgtggtttattgatggcagtgtgattgtcttggtggtggtgatgatggtgtggtttgttgatggtagtgtgatggtcttggtggtggtgatgatggtggcgctggtggtggtcatagcactggtggtggtcatagcactggtggtgatgtttgttgatggtagtgtgatggtcttggtggtggtgatgatggtggtgctggtggtggtcatagcactggtggtgatgctatggtttgttgatggtagtgtgatggtcttggtggtggtgatggtgtggtttgttgatggtagtgtgatgctcttggtgctggtggtggtgatggtgtggtttgttgatggtagtgtgatggtcttggtgctggtgatgatggtggtgctggtggtggtcatagcactggtggtgatgtcaacgagtcgctttagctttcaaacaactgtagtgtctttaactttatctgaagaacgtgaaccagatccccagaaagaacatccctttcaaaaccagaagtcttaggctgttaatgtgccataaccactggctccaagcaattcttcagtgctgtgtaaagggtacattccatctgttccccatctggactccttagaaatactcagtgccagggagttagagcccaccctaagtccagaatgatctcatcccaggatccttaatgtcattacatctgcaaagacccatttttccaaataagctcacatttccaggtaactagggttaggatatagacatgtttttttgcagaggggaggacacaagtcaatcggtacacagacaaaaaaaaccaatcactgtgtatcatggtgggggagtgtattagtcacagttctctagagggacagaactaatggaatatatataattcatatatatataatatatatatgaatatatatatgaatatattatatatagaatatatatgaatatattatatatatgaatatatatgaatatattatatatatgaatatatttatgaatatatatgaatatatttatatatgaatatatatgaatatattatatatatgaatatatatgattatatatgaatatatgtgatatatatgaatatatgatatatatgaatatatgtgatatatatgaatatatgtgatatatatgaatatatgtgatatatatgaatatatatggatatatatgaatatatatggatatatatgaatatatgatatatatgaatatatatgatatatatgatatatatcatatatgaatatatattcatatatatgaagatatatatgaatatatatgatatatatgaaatatattatatatgatatatatgaatatgtatgaatatatatgaatatatatgaatatatatgatatatgatatatgatatatatgaatatatatgaatatatgatatatatgatatatatgaatatatgatatatatcatatatgaatatgtatgaatgtatatattatatatgatatatatgaatgtatatgatatatgatatatatgaatgtatatgatatatgatatataaatatatgatatatatgaagatatatgcatatatatgaagatatatatgcatatatatgaagatatatatgcatatatatgaagatatatatgcgtatatatgaagatatatatgcgtatatatgaagatatatatgc

SEQ ID NO: 477721 - DNA, 1612 bp, Homo sapiens
cccctaggtgcaccccttcttccttcctccacccccaggactagccagcgactagccagccacatgtggagcttcccatgtgccatgcagggtgcattcactgccccggcctgtgcccataagaagctaatggcatccctagacattggaaaaacccaaatgtacctctcacatttccaaactgccccatggggtggtgccacccccatgagagccactgtgcttgactctgagatcctcgaggacgctgtgtatggtccttacatgtcatctgcagcatgggaccaagcaagcatgaaggagccaaacatgcatgcagaaattcaactcccaaagcaggtgaaatttggtggtgactgtgatgtgagtgacagtggcagggatgatgacaatggtggtgatagtgatgggggacaggtgacagtgattggtggtggtggcaaagatggtgatagtagtgatgatggtgatgctgatggtcaccatggtgatggtacgatggtcatgatcatgatggtgctgacagtgctggcactggtggtggtgatgtcttatcatggtgatggccatgatgttgatgacagtgctgatgctggtggtggcggtgatggttatggtcatgatggtgacaacagtgttgacactggtggtggtggtgatggtgatggtatgactgacactagtggtggtgatggtcatggtcatgacggtgatggcagtgctgacactgtggtggtaatagtggtgatgtcatatcatggtgatggtcatgatgttgatgacagtgctgatggtggtggtggtggtgatggttatggtcatgatgttgatgacagtgctgatgctggtggtggcggtgatggttatggtcatgatgttgatgacagtgctgatggtggtggcagtgatggttatggtcatgatgttgatgacagtgctgatgctggtggtggtggtgatggtgatggtatgactgacactagtggtggtgatggtcatggtcatgagggtgagggcagtgctgacgctgtggtggtcatggtggtgatggtatgtgctgacactggtagtggtggtggtgctgatggtatggtgatggtcacgatggtgatgacagtgctgacactggtggtggtgatgataatggaggtgatgatagtgatgatggtgataatgatttggatagtcataatggtaatggtaatgactggtgacagtagtggtattggtggtggtgatgatggtgataatggtaatgatagtgatggtgatagtcatgatggtgatgggtgtagtgggggtgatgaagacggtgatgtggtagcagtggtgacaatggtgacagtggtgggcagacccctctccctgggctgccctgtcgacagtatcctgctcccatctaagccgcctgtttccagggccattaccagggagaatttgctgaagaccaggttcctaatacaggacttggttgcatttgtagaaacactgatctaaatttgaacctctaaaatgaatgttggaacctccccttcccccaattttacacaaattattttaaagagaatattgataatctaggaagccatttttttttaaaaaaaatgcaaaa

SEQ ID NO: 477722 - DNA, 2859 bp, Homo sapiens
ggcagcttcatttcgtgaaatgaattggcatgctgtgcttcattttgatgattttggcaaaggacttgggttcttcaaaattgaagtcagcacccctgttccattgcgagatgtaacattccctattgtgaaagcatccctgcggaggaggctgcagttagcacaccagggccctccttcctctgtggatccaagcatgcacagagcccattcactctgccagggtggtgttgggtcccggagatgcacagctgaagaagatccagcccaggctcctaagggcaaccccagccaaggagagagctccacggtgctctgccagacgaggcccagcaccatttgtgaaaaagataatgctttctccattgaattgcctttgtcttttgccaaagatcagttgaccgtagttatttgtgttgatgttgatgctggtggtattgatgttcttgctgctgatgtcagtagtgttgatgttgctgatgttggtgccattgctcttgatgttgatgctgatgtaatggtgttgattgttgatgttggtggtattgatgttgatggtattgatgttggtgttgtcaatattattgatgctggtggtactgatgttgctgatactgttagtggtgctgatgttggtggtgctgatgtaagtggtgtcagtattgttgatgttggtggtgttgatgttggtggtgtcaatattgtcgatggtggtgttgatgttggtggtattgatgttgctgatggtggtgtcaatattgttgatggtgttgatggtggtggtgttgatgttggtggtgtcgatattgttaatgttggtggtgtcgatattgctgatgttgttggtgtcgatattgttgatattggtggtgttgatattgttgatattggtggtgttgatattgttgatattggtggtgttgatgttgctgatgctgatggtggtgtcagtattgttgatgttggtggtgttgatgttggtgttgatgtaggtggtgttgatattgttgatgtttgtgatgttgatgttgatggtggtggtgttgatgtaagtggtgtcaatattgttgatgttagtggtgttgatggtggtggtattgatgttgctgatgctgatgttggtggtgtcaatattgttgatgttggtgatgttgatgttcttgatgctgatgttggtggtgtcattgttgatgttgatggcggtactgatgttcctgatgctgatgatagtgatgttggtgttggctggcctctctgcaagagacgcagaatacaggcctgtgtcagtgctgtagcccacactcgctgtgggcctttccggagttccattgtctgtgaaccagtcttcttggatggtaatgcaggtcagagtcatgataaactttcactcccaaccctctagggtgaccccctccagaaagagagcagacccagtgtggattccgctacaggtggcccccaccccagtcctgggagaacagtggcccgtacaaattgccatggaggcaggtggatgcccctcagagcctggcccatggtcctcagtgtcccccacaaacctccccctgaagcaagacctgaacactctggagcggactctccaggtctgtgttgttgtgacagctcagcagccacactgccagacaaagagcaggctggggagaaaatggccgtctgactgctgctcatcacacacaactccaggagcaggtggagacaggagcgctcagtggggccgagccgggctgggtgtgagcccctgcaagttctggaggctgggtcccaggttctgacttaaaatcacggctgctgttcatcctcaaactcgagagaagtttggtgtcaaatgttgccttcatcctcctttctctaaactcaataaggagacccccacctctgctcgtgcatactgtgcaaatcgctgaaatctatcaacttgaatagacttagaaaatcatatgctgctatgaaagaaacccataaatgaatctttatatttgaagttttttcatttaacaaatgcattgttatccattatcctttcagtacttaacaaacaactcataatgaaatacagaagggctcaattggaaggcttttctttttctctccaaaatagctatttccttgcagctttgacaaatgcttacatttgggtgaccaagactccaatcaagatgcagaacatcattctagaaagttctcatatccttgttcagtcagcccctcctctggccctagagcagccactgctgtgatttcttcactatggttttgcctgtgctgtgttctttggatgtgctgtaggcttggtttgatgttggctctgcttcttccaatgaaaatactgcatgcagcttgggctatgatgggtgaagctgctgagaacattcttgtgcaaatcttgttgtgggcaggtgtttttttttgtttgttttggggattgattttttttttttttttttgctttttgttttttcctggtgaaacatcttgccttaagtctctcttatccaatgttaatatcagccgtgaataagcctcttacgttcaccattggcatggtatttttcatattttgactctccacctgtctgtgtactcacagtgtgtgtcttgtgaacagcatgtctttgaaccttgatttttttccccatcctttctgacaacccttgccttgtaacaggattcctgatactttctggtatgttactggtgggggtggagtcgggtctaacacttgtatttgtgtttttgtttgctctgctctgtttgtgatgtctcttttcctgcttctctcctttcttgtgttaattaatttgttttagaattctatgttaatttagctataggattttt

SEQ ID NO: 477723 - DNA, 766 bp, Homo sapiens
caaccagcaaacaccaccatgaccaacaccgacctgcacggacccaaaggtggagaccttccttctcaaaaagcagcagatggggagctggtgcagtcttctcgcccacaagcccctacagagacctcagtgcaggagttgctcccagccacgctcatcagagctggtgcctgtgcttgccattggtatactaatgggcaagccaggggcaccagctcttctcagctctgtcccaccatccccacagaacaagaagctcagtacatcaggcacccccactgtccagcccttcacctgaaacaactgagagcccctaatagtaaaaaaagatcagatctatacccatctgtttatgggacagctggctgttacttgcaaatacttcaaagattttctcactttatcttcaaatgtgcctgctaaacaatcatttttctaatttccaaaagtttactacttctccttacatagcatgatattattgctttatggatggaatacactcttgaaactccagcccctaaataatagttattctaatgtgcctttcttcatttattttcagtcatgttaaagattttctcaaatagatagccagcctagattgtttattcatattttacatatatactgagccattttatgtgtgcaaacttgtccacagcttttgttttaaaatgcttgaactgtgaagatagaaaagacatgtttgctggaatgcataatactgaagtttacttctcatagtctttctttagaagttatc

SEQ ID NO: 477724 - DNA, 619 bp, Homo sapiens
tgcagttaccccatcacattccttctcatctttttactttgcatctccggttttgcctcacacaaggtctcttcttcctctgtggatcctctacctacatgtgtctacctgctaattggacaggcacatgcacactagttttccttactcccaaaattcaatttgcaaatgggaccgaagagctccctgttcccctcacgacactgacacgacaaaaaagagttattccactaattcccttgcttgtcggtttaggactttctgcctccactattgctctcagtactagaatagcaggcatttcaacctctgtcacgaccttccatagcctgtctaatgacttctctgctagcaccacagacatatcacaaactttatcagtcctccaggcccaagttgactctttagctgcagttgtcctccaaaaccaccgaggccttgacttactcactgctgaaaaaggaggactctgtatattcttaaatgaagagtgttgtttttatgtaaatcaatctggcctggtatatgacaacataaaaaaactcaagaatagagcccaaaaacttgccagccaagcaagtaattacactgaacccccttgggcactctctaattagac

SEQ ID NO: 477725 - DNA, 791 bp, Homo sapiens
atattgcctgtcagacagcaagctccctgagggcagggggctagattaatcaccctggtgtccctgaaagcttctagctcagacttaaggaagaagactttttcagtcccggatagaggtctaatgatctgatggaaccagagcaagtagtccagtgcactgatccgctagtcagacagagtcctccaaggttgaccaagtcatggactgaaggcaaaaaggaccgggggacctggaggggaggagagaagaatgctggtgtttatcacgcactaactatgctagatgctcgggtgccggacgtcacccctagggaattcacaaatttgggggcagacacgtcctacaaaaataactcaagtttctggcgaaagtgtgggtttttaaaatggatacactgtaagccagagttgctggcagctatctttgccaccaaaagagagaggttctctgaaaatgaagctgacaggaaagcagggatgacagatggagagacagctagagtcctaatgctactgtatggtcacctcctggacccagccgtgaaatcagtgaccctgaacacatacaggatccagttcaaagtcatgtatcgcatttacctgttcaggtctatacttgatatcacaactacacgaggcttcctgccattgacaaggccacagtccttttcctgtggctttgccagaggctggctgtacctgggagggtaggcgcagggggagcaatgtgctttcctaatcagctcccaaagggggaagcacagccacgctgggacacaggataagcac

SEQ ID NO: 477726 - DNA, 768 bp, Homo sapiens
atgtccgggtttctatgccaggcagggatgatgatccctgtcaccggatgatcttatccctgtaccctcagcgccgccgtctgcagtggaaaatgctgttactgctcggaggcgtaagccaccattcccagccctcaatatgtgtttctaaatcaactttgaggtataatttacatacaataaaatgcacctattttaagtgttatcgtgcaatgcattttgaaaaatgtacacagccatgtaactacgaccacaagcaaaacacagaacatttccatcaccccacaagtgctctcgtgccccttttcagtcgagccctcttccccaccctggtcctgatcacttcatcagaaagtgccaaacacttccaactcccactggccatgtccaaacaaaggaaaaatcaaaatcccttgtcacaaataaaagcatcatcggatagctctgggaacaaaggggcctaggaatcagaattccatgatatgaatccagggctgtgaattgttttctcagcactgggattgtgctgttattggaatgcagccttgatgtcattattcacccttccgtcaaatattcactcattgatctgtccaaccacatgtactgagcacccactgtcagccagacactggagctgtaaagtacagagagctgagttaatcccatttctcaagcatagctcattatcatcacacgcttcacttttattttttcctcaagccctactccttttccccttactcccaaccattgtgggcatccact

SEQ ID NO: 477727 - DNA, 2752 bp, Homo sapiens
ggacctgctttagcaagtgtgggatggccactttcttgtctgtcaaatgggaatgggacaagatggtccctgagctgctgtccagacccggtaatggaattctgtatgaattccaaggaggagagtagccacaaatgcatccgctccacgctgatggggctctctctccggcaggcccctggaagtcatgcttggcggtaccctggtcgtgggggggaaggggtgctggcgcttgctgccccatctgtctcagtggcattgagctgtgacttcagtggcctggggaagttcaaggtcacctctggggtggaggaggtggagacatctcaccagggctggcaaaggccaactgggaagctggggccgatacctgcccctcacggcagccaccacaaggggccttctgctccgaaggcccaagcacgccctgttcctttatttatgggccgtgtgagcaatttgctgcttgctggccggctggctgggtgtgcgatgcggggattactcacgccccagttgtggtccggcctctgcaggctgcggggtagagcaggggagtgagataatgtaggataatagcctagccaaaccctgcccaggcagcccggcctgtgctgagaggtgccccccaaacggccaagacaattcagccttttcagggaaaatgggggggcttgggcagggcctggctcccagggacagctgtatggaaatgacagctcctctccttcgtcctgtcctgtgttggctcagggtaggggcaagtaatgcccaataataggtgtggaaggaaggatgcaactagtatggtaataattgattcaaacaagaagcattactagatgctaaaactaaagccattgtgtgaaaatttgttgaggagtaggatatttacatagtcttaaagagtctttccacaagatacaatacctgcaaaaggaaggagagtgactttatagcgaagaaacatggcagagactatcttagtcgagtgatcaaaggctgcatcactgttactggacaaactgacatgaggctcctgatgggatgcacagggaagagtgaaaaatcacttctgtgatgttcctgccagagatgcaaaactgaaatctaatcacgaggagccgtcacataaacccaatttgaggaaccttctacaaaacaactggcctgtaacctggttgcagagaggaaaggaggaaatttttcgatagaaaaatcttggagatcctgttgctgtcacccatcgggctgttggaagctggggttagtccagaagtcttcagtacatcttggagatgtttcctattggctcatgtggagctgcccattcttttgtacagcagcagagcagtctgttatttggatgaactgtcatttattaactagacatgcccacaaccctgccacctcttttcctaacacactgggcagtcttggcctctcccaggctccctgggagggtcactactttcacaaagatgatgcccacttctgcccatggaatctggcttgcccagtgactacctgacagggttgagtgacaccacccagaagtgcaaagaaggcagtaaagaagaaagaagaatttattaggtgcccgaggaagggctcaatcctgccagtctaaacattgttgtacatacctcctgatatgtttttctagaatgtctccaggaagggattgctgggaataagtgcaaaataatgcccaattgttctccagagtggttgtacaactgactcccttatcaccagtgtcaaggagtccttgttccacataattgatcacatttggacttgtctagctttttaagttttgccaattgagtagacaggaaatgagcttttaatttggatttctctaattactcagaggttgagcatcttttcaaatgtttgttggctattcatgttttcgcttctctatgtctgtccaaatctttagtccatttttctttttgattgtttgtccttgtcttattgaattgtaggggttctttatatatttgggtgctaatctttgtcagttaaattgttacggacatcttctagcttgtgacttgtctttccacttttaaaaaatggtgaactttgatgaacgataaagtcatagaaatgaaattgcccatagaatttaaggcttcggatacatttgaccaaatttgccagaggatccacttttgattcctttccaagaagcaatatgccattgtgttcaattgcccttcccaagagtctggaatcagcaaagtaggggtcctggagatgatgttttgaactggagctgttagcaggcatgttctgttgtgtgcagaaatagttactgtagcagttaaagattttccctgtcctcttccttcctaccctctcctgactcctgacagtccctggagggcaggcgggtgagcatcttcaccattgagggatgccccctccttaattgtggcaaggggggccctttgcagcccagtgcaggccttatgggacagtgaagaggaaaagaagcaagctggccaggattccctggggtttttgtggagctgacaggctgaggagtggcaggggcctttaaggcactcagcaaagcttctgtcacagggtaccagggtctccacctgtgctatcaagccactcttttgacaatgttaaactttacctgagccctgtgctcctgaaaaacagcgatggtccagaaatccccccaactttttgttttctgaagtctccctaccttttctgttcagggaaa

SEQ ID NO: 477728 - DNA, 4540 bp, Homo sapiens
ctctaagtccctccgatccacatcaagctaaaaaacccaggggaagtagtaagaaggaagcaataccctattcccctagaaggatgggcttcttgagccctgtatgtctccttataacatcccaatcaagaatcaagaaatcaagactgctaccagccaggtggaaacaacaatatcgatggaccgtcttgccccaagggttcacagactcccctaaactttttggccaaattttagaagaagtactagaaaaagttgtcatcccagaacaaatatgccttcttcagtacctggatgacattcttatatctggtgaagatctagagaaggagaagcctaaccgtctcctgtggacttctgaggaagttgatcaaatcgagaggttggaggaaaggctcataactgcccctgttttaggcttaccctccctagaaaagccattccacctttttgctaatgtggacagtagggtaccttcgggagtgctgactcaagaacacagaggccgccagcagcccgtagccttcccatcaaaggtcttagacccagtcacttgtggatggcctcaacgcatccagtccatcgctgctatggcaatactaggtgaggaaagcagaaaattaaccttcggaggaaaattgacattaaacacgcctcaccaagttagaactatcttaaaccagagagcagtgagatggcttactgacttgagaatcttaaagtgtgaggccattctgttagaaaaggatgatttaacattgaccactgataattcactcaacccagcaggtttcctaacagggaatccacatctaaggagggaacacacatgtttagatttaattgattaccatacaaaggtttgaccagacctgggagaaacccccttctggactggacggcacttactcatagatggttcctcccaggtgattgagggaaaaagacacaatgggtattcagtgattgttggagaaactcttgtagaaataaagtcaggaaaattgcccaacagttgatctgctcaaacgtgtgagctgtttgcactcagccaagccttaaagtacttacagaaccacatctatacagattccaggtatgcctttggagtggcccatacatttgggaaaatttggactgaacgaggtctcattaatagtaaaggtcaagaccttgttcacaaggagctgttcacccaagcattgaataatcttcagttgccggaagaaatagctattgtccatgttcccggacaccagaaaagcctttcttttgaaagttgaggaaataacctagcagatcagactaggcattagtgaatcgggaccatttaatctggggagatttctataaagatcccagtggcaaccaggagtcttcccccagtgatgtagagcttttaagccatagttggtccaaagttctgtggaccattaaagagcaaggatggattgccccaaccagtttttgtaatttcctaaattcatacattcgttttactaaagggacagtgcccactaactctcagctaaaccagtgcaaccctatacaggttattattttgagcccacaaaattcttcctcttttctaagctggttcccttctttaagccagttttatggtatgggggctgaagtttcagggacagaccctattggattctttgaaatgcacttctttgatcccctgctgtctgcacctgcctctgagcctttttccaaaacctctcacaacggaaccattgttcctcctctatctaacgacaaggccaagatagcgatggtagaagttaaagacttaaaacaaactggcaattgagacaggataccaagatgtaaatgtttggttggaatggatcaaatatttcatccacacgttaaacaaaagcaattgttatgcttgtgcgcacagcaggccagaggcccagattgtcccctttccactagggtggtcctccagttgaccgggcatgggctgcatggtagctcttttccaggattctatagcctgggccacaggtactgaattggcttaaagttaaagaatattcataaattaataagcctaaatgcttttcaagttcatgtgacttaagtaaaatctttaataagctagctttaaaattattggtaaagtaatattagaaatgtcttaaaaattgttagcataaatttttgtttgcatttattgatcaagggacttcatatactgccaaatactgtaaggtgtcaaaatttggcatagggtttgtaaaactacaaaaccgttcaaaacagaatgatttttgcttttgtaatttttgataaataagacattgatattggtttaatgaaaacagctaaatcatgaattatttagtgaaataacaatatatttaatcttaaggtttttacttagcaaacacctgaaattcacaggctatcaaatgtttgacagggaaataactttaaatgatgactatcacagttttcataactaacctgggtaaactattaaaataaaatatttaggtaaatgtaatgggataaatacttgtagacaaagttgtcataatttaggatctaaagttatgttaaattaaacaatagatatttcattaactgggtttttttaattaaaaaagatattgcaggaaatcattttttttctaaaaaatgtgttcttgttaaaaggaggataatttttgtctaattcaaagcttatttaaaggttatatataaaataaggtaaaaagaaacaagaaaatatataaagaagttatagaaataaaaaagaatttttggtaagaaagcttaaagaaaaataattttacatgagaaagaaccttgtatggtacatttttgtcctagaataaaatgactggttgtttaagaaagaggaatgttcatacaaaccagaaagtccaagcatgtcgtgaatggtctgtttaagttataataagagcatttatggaaaaagacccacaaactttcatataatcaagttgtctataattaaagggaaattatttataatgatcttttgagagattgggttttgatattaaaaaacatttatacactaaagaattcattagaacaacattttcttaaggtattgatttacttttaataaattacaagactatatatataatatattttttcctgcaaagttcaacttttattgcatctcactgttttcagctttctctccccttttaaagtacctgaaataataactctatctttcaactcatttttagctcctgtaagtttttttattttctcctttgtgttctaactgttgtggcctgacgctaataaatgttttatctttgtggtctaaaggaaacattccttccaacataatatttcctgtagggaacagcggttgaaatgcagaaggtgttttgttttccctttgggaaattggcctaataaacagagtttatgctttattgaaataattcctatgtcattattactaagttttggtttgtttagaaaaaaacccgagattaaattttttttaattaagattattacatacatgtaaccctctgtatgtgcttttaaagtccttgtgccattaagttacagagctttgagtccttggtctaaaaagaacaccaagtcctgctaaatattaaacactgacagcagttaaaacctcattttctgacctggtagaagatgccaatcaaaataaactgtgttcatgagacagaaggccggaaattaaaacgattcaactcctcaaggtctggagactatcaaagaagagggcaagttctgtatttatagcttttaacaattgaggaaattatactcctataaacaaaatttggagcatatttctctctatctggtttctctaaaatttggaaactagttgggagtattcttaacttatagcaatatagttatctgcacaagtacaataagaatctgttttcttttgtaagaggacataattggggacagtggtgattttaccaaggttttgactggaacaacatgctatcagatgcagactcctttaaggaatcaaagttgacttacagagctaataaaagcatcttgggaaagctggcctcctatcttgtctacacagtccctgtacaggttcctgacctgtgaaatcaccaaacattaaactgtgctttcctaaagccctgtgaactaaagctagacaatctatttacatacataagctactttcatacctgcctactgaatagaatgaatgggaatggtcggctttacacagagacattccattcccagggatgagcagagaagccttcctcttatctcaactgcaaagaggcctccctctttcactcctcctcctcagcacagaccctttatgggtgtcgggctgggggatggctgaagctacctgctcaatcttctcttgtgtcttataggatcacaggatcccccttgccttacctcactgttactcccaaacagttctcacatgtttacaagggaatgtaacagagtggatcagagaattcattctggatccagaccgaccttagttttctcatct

SEQ ID NO: 477729 - DNA, 1709 bp, Homo sapiens
gaatccactttgcctctggagacacagaaaatccttccaagggccaggggaaagtggtatgccccaggatggccctggcttggttgcttgtaacagtaatgagaagttgtcatgtcctggggcagattgtcctggggctgctggagtggggatgtggagaggaggcagtggggagaggaggttggagtgccaggaggctaaccctagatctcgctccccgacagctggccacgagacctagggtgggcagctgtgcctctctgggcctccacaccctgatctgtaaactgggtaaaccttatctcttgcaggaggaatgcgtggtgggaaaacagggtcattccgggaggaccacttgccaatttggggtcctgaagtacctggatccaaaagaagaagactgtccccagtctgaatctcccactctggggagagggtcactcctgggttgttcccacaatccagcccttctgccagcccctcccttggcaactccttgcatttcaacaccctggatgatcattgagggttgcacgtggggcagctgaaacagaccccaggcctctggtcctgttcatatctaggtatataaataatgtataatatttttgtgttctcaaaacttaagtatatgctgttatactgaatgcgacgtcctgcttatattatattttccagattgatataaatgacacatatagatcttgtgaccaaggacattttcttttcactgctgtgcagcattgcattatgtaatttttaactctttatccagtttttggcagatggatatttaaattaattcagttatcttgttattcctgacaatactgctattaccatcttatatgggaatacttgtgcttacaagcaagggctcctctggggaactaatccaggcatgctcctcctgggtcgtggaatatatgtgctgccagcctgaggcagttgccaaattgtgctccaagtctctctgtcgagttaattccagtagggtgccggggtctccatcgctccgcacccctgccatcccttgagatggtcatgctttacctttgttccaatctgatggctgtgaaatcgtacatgtaattacatagcctgctttccctacttaatagtatattacggaactattttcctgtgcagaatattgttctatatatgtgacctgtgacctttcttattgcttcttggttctccctgctgcctctttctcaaaaatgtactcatccttccaagttttctggagagtatcaacatgagtcttatctaagtaaaagctaagttatgtctttgtgcagacagaccgacagtgtgacagaatccattaccgttgacttaaagaaagttatccttggcattttagtaagtacatcagatcacgacagtaattgttttgaaagcataaattgttatgtgatattggaacatctgggcattttgctgtcgtaagagtttactcttgcaggcattattgagcagcttccttagccataaacatcttatgactgtgggctgtgattagcaaggaatgtgtcttgctagttttaagatagagttgattttaaaatggtgtcaccctagctctcctatgctcctgtttcccaaacataatcccccctctacttaagagagaaccctaaatcttaaggggagatgaaaggtgaaggtcatttttctgtaacttattcctgctgacagtggac

SEQ ID NO: 477730 - DNA, 952 bp, Homo sapiens
ggaaaaagggtcttatcccatatcgcaagagtgggttcttggatctcacatgggaaagaattcaggaagacttggcttggccctaatcactcccagcccccttggctgagtggccacccgctgctggctgctgtcatcccacattggaagtgacggaggagcagaagaacgagtgggtcaccagccggtcttcaggctcccgggccagcattcagactgggcaggaggtttgtgggtggaagcttcctttgtctgctgcacaatgggctctggacggagccctgttggcgcaatgagtgagccctacatcaagcttcgtcatcgctgcatcgctttgcaccgtgtggctgggccgccatcagtacagccaactgcctctgatggacatctgggctgcagccagattcctcctaacagggcttcagggaaagtcctcctcagcgcctctttgtgcgcatggcacatttctctaaggcaggtttctggacatgagactgacgggcagcatgtgctccttacatttgggggtcctgtcaatcccctcctctcccgcaggctgtggccagagggtcgagactcatctcacagccgtgcaatagatgcgtgtctctcagtcggtcagctctggctgggatcagtgtttatcttcatgtcggtggacaccatcacaggcacccgcaagaatcagcgatcgacggggaagaggtttgggtgcatggaggagtgctttgcagtgagggctttggagccttgtgccctgattcaaatcctggctgtgtcccctgccggttgtgtgacttcggataaattacttgatgtctctgagcataagctgggtcatcagaaaagccaagctatcctgctaggagagaaccgcaacacgaccccgtttcagaaatgcgctccttgacaagcctggctgcgacctgttcctggttgactgccgtcatcc

SEQ ID NO: 477731 - DNA, 489 bp, Homo sapiens
tgacctcctggccgcggatgccgaagtacccagggggacagtcgtgcaggcacttgccgtactggcggatgccttcccggcggatgaacaggaagagcctctgctggcaggtggaacagccgttctcctctgagcagatgatacagcctgtgcagttgccccccaggccaaggaattccccattgtgcaaggtcctgatgaaacacatcctggcaccttccccctggaacagaaaccaaaagagttctggccctcctttaagttggcagcagctctcggatgagtactgctacttccccagtcctcaccttctgttccttagattcgacagcgaacagatcacggtggagcagcgctgctttggcgcggatgaggaacctggagcaccacctatccaacctgatcaccctggtgctccaggggacactgaggttccagggagcacactttgaaaccccctgggtccttctacacatcttggcctctgtc

SEQ ID NO: 477732 - DNA, 779 bp, Homo sapiens
ctggaggccggaagggcagtgagaggcttttgcaatttgcgggtgcttttcatcagccatggttaccttgtggtcctgtgctgtccccaagcgtcccaacgggccgcttttggacaagcagcctagggaaaaattctatgggaatcaccaccgttctcagcgggcccacgagagggcgaaagagagtcaacgggcctgggacatcttttctctggctcccaagagcagggaggaagtggaatccagggcaggtgtgaggccgattctggacttgggtgggtgggtaggggctgagataagggaggccccgggagcctggcagctgcttcccttgccctcgccttcacagcatggtaggagaggccgctgtcacccccactgctgggcagaaatgtatctagccttggctgaccccacaaggacactgggtcgcggcacctcagataagattcacttggttgcaaggcagcagggcttatatgtcagtcatccacaggctgcaggctgtgggagtgggcgtgactcccactgggcaaagggcaattccctagagaagagagaaggcccctgtgacccaacaggcacagcagccgcagatgcaccctatcctgcaaaggggtctgggcgaggcacccacagtgtccatttcagtcccctatcggtttactgctgaccccagccagcctctctcctcctctttcccgggtaagaacagacatggcccagggttttcacattggctgggacagtccatgaagttctaaggggtcctgaggccc

SEQ ID NO: 477733 - DNA, 1074 bp, Homo sapiens
gaagcggcaccgtgctcacgcatgcccctgtactgtctccctttcccacacccttccttccctactcaagatggagttgctgttgttgaaacgcctctgacagtccaaggtccctttgaccatcactgcaaggctacaggctgtggaatcagaagaactggggcctctcttgttggtgttacactcagctctggtgtccccatgtcatcatggcacttgctagatggcagacactgtgctaaccacacattcacccattacctcattaaatcccagaaggatcctgagaaggagcctcatgcatttcaaggaaatcacttctcttctaacaacaagcagccagaaagagcagacagtaaaacacagataagacagcttggacacagaaagaggtgggggaaaagtctcttgggtaactgccaaacttcaccctcatacaatgggccccagtaaaacattttcagaagtttgaatattatgcatcatgctgtggatttctttggatttgtcctgtttggtgttctcttatcttcttgaatctgtatgtttatgttgtttgccaaattcaggatattttcagccattatttctttgaacactttgtaaatcctacccactttctgcttgcctagtgggacactgatgacatcaatcctaaatcttttgttttagttccacacatccctgagagtctgttctttatttgtgtgtgtcttatctcaggaagtaattttgtctttctaggcttcatttcttcatctgcaaaatgggaaaattaatatctgctgttcaatatcatgatgcttaaatgacactgagtgctcaatgtttgttgaatgaatgaatgaacaaacaaatgagcaagctgatggatagaaatttgccagtttacttgtcagctttgtaatattaagtacagtcaagtctttaccaatcacacacaaaagtacatttgatagaggttgtaagtggttcagcaaattcagttccatttctggggacagagcttggatctcatgctgtgatgaattattatgatatcttctttaagtatgagaagagtatgcataaaac

SEQ ID NO: 477734 - DNA, 629 bp, Homo sapiens
ttcaggctctgcttttttgtgtaggtgggcaccgtctaatcaaccaccagcatggctagaataaagcaagcagaagaggtgggaaaaacggacttactgagtcttccagccttcatccctctcctgtgctggatgcttcctgccctcaaacatcagactccaacttcttcagcttttggactctgggacttatgccagtggttatgctacattgttacagcagcactagcaagcaaattcgccttccctgccaaatatgacccatcccccaaatacgacctgtcccccaaatacgacctgtcccccaaatacgacctgtcccccaaatatgacctgccccccaataactggcaaattcttccggaccctcagaaccctcactcactccttttgtctgttaatctcagcctggcgcaatggtgtctcatgggcaatgctaatcttctgctctgcataatttctggggactcagaatttcaggcatcccggagggatcctctgagacataacccttctcttaagaaatgatgttatcctcaagatgcgataaagcaacagcatattaacagttgacagaactactccttcctcagccccaggactctgggtggttggtcccgtggtggctg

SEQ ID NO: 477735 - DNA, 1098 bp, Homo sapiens
cgtgttgctccaaaccaccttgtggtgtttgtcggcgcgctctcgggtttggaaccaatacaagagccttgcacctgcaggctgtagcaggacagggaattggaagggagatggtgcgggaaggtgatctttccctgaagccacaccatctgaagttaactatgtctatccgtagtcgccgacgctcagccgcatgtatccctgatactcagcagcttgcagccctgaccacttgcatcagccgcttgtggttcttggatgtcactaacaaccctcacttcttttacatcattcaattgggctgcattcacagactgtttctcaatttctcctctaaacagaaagccagagattcatttcaagagggtgaatacaggatctggttaggagacactgaactcagtggaaagcaaggagtcacactgagaacaggagaactacatgagtgtgggcactgcggatgctggggcagccctatcccatcccccagcctcattcctcatgcggttcccagaacgccagccaccatcccaacaggaagcagagaggtttccagtcaaagggcccagacagttgaagctgccaagccccacctgtgcactcggagcatccaatcagctgtgaagggctcacccttccacacgagcagattgccagatggctgaggaagaaaggatcaaagtatacagacaacttaaaaaaaaacaagagtaaaagttatttgaccaacatcagccatgtgtggctaatgaacacttaaaatgtgacaggtgtgattgaggaattaaattttagttttatttaaatgttttaatgtaaatttaaagagcacatgtggcttatagctatggaacatgcagctgtgaacactatagttaaaactgacattttgatctgaggattccttttatttaatcagttctgaaactatagttttctacatttatatatttgttctattgtgaattttaggatttattttgatgatgtactttttctttgtgaagtttagaaatgaccatgggggtcatgtgggccaaattaactcaattcctggacaaaaactatttccccgaccaccccaagcttcttgccaat

SEQ ID NO: 477736 - DNA, 1157 bp, Homo sapiens
taaacagctgttacagtctgaatgcttgtgtccctcaacaactcatatgttgaaattctcacccccgaggaggaagttcaaagcactgtggagagagggatggattcagcagggaaaagtctttgccaagtcgcagagccaacccaagtggaaaatgcagggagaggtcacttcttggtggtggtggctgcaggacacagggttctcaagtgccagtttgccagggacagagggaatttccaggacacaggattttcagtgctaaactgggaaagtatgctgccacatggaaacattactgattttccaactggacatgaaccaatgcctctcttccatcttctctgctctcccgactccaactgcaagtgctacgcaggaaacagccatgcttggatgaccccaattggagactggaaaccctcctttgggacaagtctggtccacaataaatgccctactatctgtgtggcagaaatagcaaccccagcacctgtcattcctccactgaaaggcggtgtagagaaaggggttttcagattggctggtgagaaaaggcctcctccaggggttggggtaaaaggagattcagagtcattcagggaaaagaagaaaatcaaaattacaggcttctcattggattctgcagtctgtgagtctggacagtgggcagggctagtggtcacccatttggaaggacttgggcctttgagatcctctgatcctctctgtggtgcttcccctgaccttagacttgggggcctcaggaaggagctatatccagaatggaaacacggcgatttgctctgccatgggcgctatgaggtaggcacccttggtgatcctaaggacctctataccaaactcttaaatatcatcacaaatcaatggccatgtgtttccataatatacttttggggagcatactgtgtaccctgggtaagtgagagaataaacgtttctgaatgtgagcttcctaaaatggacagcgttgtgaagatcagagaggcccccctgaaggcagaccggccaggtttggtgcataccatttactgattaaaaataatagttaccaatctttttctcattgtaaaagcaatatttggtcaggaggttggcattatattgtaaatttttaaaaacttcatattttcctg

SEQ ID NO: 477737 - DNA, 2138 bp, Homo sapiens
cccggagccaaagcttccttcagctggcccgcaccatgccctggacagctctgagacatgcagagaacaatggagccctggagagcctggggccggcttcctctggacaatcttcatcctcacctgatgtttttgctgaagtcactttgctctcatggaaaggtgttggcagttgtgccttgggggagacagcctggaaagattgggtgccagctgcagagaggagagcaaggcgaccaaacgcaggctgtggctgcctgcagcccatcctgcccccagcacctagagtcatctttagaaatgcaagcctgatcgtggaatccaccttcctaacacccttcagtgccctcctcttcgttacacccttactatacaaacgatagtccatggaccagcagcatcaacataaccagggagcttgttagaaatgtagaatctggtccatcccaaacctgacgaagcagaagctgcattttgccaagatcccagggaatttgtgtgcccgttatggtttgcgaagtgcttcccaagagaacatacggcaagccagagggatctttgcagatcttgctcctttcattctctggcctcatcttgtcgctctcctccatccgtgcccacatccccactgtactggaccgcttgcagctccttgaatgcagcatagtcttgttttcttttttgcagtgattctacatctttcccatcttctccacctggatgcctccatccatcctttcagacttcccttctctagcaaacctttcttgctaattcccatgtctaacacaacacttccccatactgcatggccattatcctttctgcatcagactgtgagcaccttgaaggcagtggcagtgactcattcattgtggcatctgcagattccagtggactgccaggcatgcaatagaaaatcaaaaaagatttactgctaaataatcctcaactccagtggcagctccatgtgccatttctcttccgctctggcctcggctcttcctgtgcctacctggggcttggctttcacctaggtgtctgcatggaagggagagcgacctggaggaccatcgccaatccatcaatagcctcccggttgagatgacttcagctctgatttggaagagctatgatattgtttataggagtgaattaatatgtgtaaaggttacaaagtaaacagttaaattaaattaattgtgctggagcaggtcaaacaggcttctgagagatgaacatacacatctctattaactccacattcagtgagtgtgggtaacttgaaattggctgggtcaccatttacatcatagaaattggcaaatagtacaaattagggctccctcacccctactcgggcatagagctggtacactagcacacctctggttatacatgcatgcgtgtgccaccagaacaaaacacctaacagcaggcacgttgcctctgttgcccaccattacagctcccgcacggagcagacagactcatggcaggaattgaatgcatgtttgtcgagtggaagcatgaacaaatccacaaaatgcccaagatgaggcaaagaaggacattggctcaaatgttaaacataagttaggagctgagataatgcccagaggaaaaatgttctgtaattctaagtaaaacccatctctaaggcaggatgctgcttatgagggctccacagacagatgggggaggcctgggtcctgcccttggaaagagtctgacagctcgacttctggaaacagccatctgcacaggtcaacatcttcttagctgacagggagcagatttgcagaccacatcacatttgaaattccagaagaaacttcttggagtctgctcttgtgcaaatgagcctagaaagcccgttaactttgggtggaggcttccactgtttggctatcccaagtgggcccaaagctaaggaaaacccaccagccctttgcttcctgcttcctctatttgtttgccccaggaaatcagaggtgatgacatgatttggcttgggcacgacaggaataaacgatatttaagagacgtcataagcgcctccattttgttcttgattgctaagtagccccgaaccaaaacagccaattaaaaaaattagaatcttaattacagatttc

SEQ ID NO: 477738 - DNA, 736 bp, Homo sapiens
tagtattgctgggctaaatattcggggtacatgtgcatgatgtgcagatttgttacacaggtaaacatgtgccatggtgatttgctgcacaggtcatctgccatttgtcttttagaggtccgtggcagggtgtggggctggggaaaggaggacagatctcctgtggtgtcacaagttattgccacaagcaaatacttcacaaagcacttggtaggctttgacaagccaatgactattctaaacctttacctggaccttgtttccaagttccagaacttaggaccctctactcacctgaagccaccacgggatgcctctcaaactggaaacattgccgtccctctccaccaaagatgcttctcctccagccccatcagcctctctcaaagcctggctgtcagagtgattccttcttctctgtcattttccatactcaatctatcaccacatgttgtgggtttttcttgcaaccacctcctgagtctacccttgtctctccacatccactgttacccctgatagtagatcgcatcacttttctcagttcttcactcaccctgagtccatatcctttgccatgtgcctttgcagcccctcccactaaaggtgatgtttcttttagaacaaatatgtccacacaaaccaggaagtaagaggagttattgggcaacatttaagtatgtttgaaacaacttgggcatgtgaatctactttttcaactagaagttttacaaaa

SEQ ID NO: 477739 - DNA, 1296 bp, Homo sapiens
aagttccttattaatccgtttcagcgccatagtgtgtgcttgtcgtctggctcctcactctctcagtgtatgctcaaagctcatcagctgcccagtcggctctcccctaaacactctgaatctgatgtgcctcctgatacagtccacctcttctgtggtgggcaccccgttggttctgaggtcaaggtcagcactggacttgctcccccgctgggagggacgccagtgcagcagcatcatcttcttgaagtacttcatggtgttgttcttgaccgtcacgaagcacacggtgttgatcatgctgttgctcatggcgatgcactcgaccacgtagaaggcagtgaggtagtgcttttccttcacgaacacagtggggaagaagtcacgaacgatggtgaaaccgtagaagggtgcccagcacagcacataggccgtgagaatgcacatgagcaccaggaccgtcttcctgcggcagcgcagccgcttgcgaatctgctccgtctggaacccagggactgccttgaaccagagctcccgggagatcctggcatagcacagggtcatggtgaccacagggcccacgaactcgacaccaaagatgaagaggaagtaggacttgtagtagagctgctgatccacaggccagatctggccacagaagatcttctcctggctcttgacaataaagaggaccgtttctgttgcaaagtaagccgatgggatggcaatgagaatggacaccatccagaccaaggcgatcaggaaggaggccgtttgataattcatccgtggtttcaaggggtgaacgatggcgagatatctggtgagaacaagagcaggatgccgcctgctggtaaacaggccccccaaaacctggccataaactggcgtcagcgtaacaatgggacaagtgtgggctctgctcgtctaactcctgctcagttcttacaatttaaaacttggtgggcagatgaagcttccattcaggctgcttgcaatgcccaggcccatcctcaaattaatataactgcagaccaacttttgggggttggcgactgggctggtttagatgcacaagtggtcatgcaggatgatgccatagaacagcttagaggagtgtgcattagagcttggggaaaaatcacttcatgtggagaacaatacccttcctttagtgctataaaacagggaccaaaagaaccatacgtggattttatagctcagttacagtagtctcttaaaaagatgattgcagattcggctgttcaggatagagtgttgcagttattagctttc

SEQ ID NO: 477740 - DNA, 617 bp, Homo sapiens
ctggacgtgaggaaaatggatgagggtcagtgcccgccagccatgctccctgtctatggagaaagacccaagaaaaagaagcagattgattgccaaacttttatttttgttccatatcattgcccggatggtgtggccacctgctctgaatccatccattctgttggtgggacccctatgttcaaaagacttacagccaaagatgtacagccaattcacattccaggccatatgggaatagagtctccgcttgcatcctttgatattgtcccatccgccaaagcgagccatatggccaagttcagggtccatgttagaacgcactgccaaagaacgaggggtactggaggcctaaacaaattagattcgttattgcaaacagcctgccaaggggaggccatcgctttagctgaggggtcaaactttgcattcccaaggctgtggaacatggcatcatgtggcctctgatgtaatgcactgagaagggtacaattgcaggtcctgccaaaaacacatacactgaatcttgtcatgaggaaaaagccacacaaatacagttgagtacattatgcaaaaactggtttggacccttcaaaatgcccatatgatgaaagaca

SEQ ID NO: 477741 - DNA, 810 bp, Homo sapiens
ggattatgcaaacgggtcagccttaaagtatacattgagagtgagtgtgccatctcaggaagggccgcagcagtgaaccagacctggaagatctcctgctagtgaggggtgatggacaaaagcaagtccatttcaaatagtgagaagcaccctgggataataaagaatgacatggtagtgcctggggtggccactctggacagactgggaccaggaaaggagaactcagtgaggagagccacacccagtggcagtggtggacccaatctgctcacagcactagcaccagcagaaatgagcttccaaccactcccctactccacagccacagacagcagcaggccagtatccctgcagcagtggcaacagaagaatccaaacgggccaacccacttcacatcccatctccaccagcagcagggggctcaatctgcccgtattagtggtaacagtgaaacccatgcaggccaggtcatctactgctccacaccaggtgacagcagaagttacaaaaagaaccaaatggaaatcacagaattgaaacatgcagcaacaaaatttaaaaactcaccaggtgggctcagcggtagcgtggagatgacaaaagataaagtcactgaccttgaggacaattccactgaatttattcaatttgatcaacagagagaagacggatgaggacgagcataatgaactctgcctcatgggagtattttaaggattcacagaaatgatgtttaagatgcaggaagcacatcataggaatggaggaggcttatagaagccctcaatacatgggaacggctctta

SEQ ID NO: 477742 - DNA, 619 bp, Homo sapiens
acaaggggctataccttcatcatgctggcggccctcgcagctgcggaagcagaggacatgcaggttggggaagaactctggctgaaaggtgagcctcaaagccagtcagctggggcagatggccctcatgctgcagtcagttactgtgcagatcggcatggtgtatggtctgccggcctgtggggctcaggtcaacctccaggacgacaagggctccatggtcctcattgtgccagcaagcacgggcacatggagatcatcaagctgctgctggcccagctgggctgcaacgtccacctgcaggacaatgatggcagcaccatgctctcgatcgccctggaagtggggcacaagggcatcactgttcttctgtatgcccacatcagctttgcaaaagctcagtctccgggcacccctaggcttggaatgaagccacagaaggaattggctatgtatttgcctctagagaaatatagtgtagttctctgtatttatggattcctttatactgtgtcacatttactttggtcctacatgtatttaaatatttgaagtgccttagacttttgccatattttcaaaataaaatttcattaagcttttaaaaaaaaaaaaaaaa

SEQ ID NO: 477743 - DNA, 544 bp, Homo sapiens
cctcatctcaacctaattatatctgcaaagaccctatttccaaataaggtcttattcacaggtactgggggttaagatttcaacatatctttttgtggaacaaaattcaactaataacagacatgaatcctgaaaccatgcagagccccttcatccaaaaagagccccctggaggggattcccttgattttcaacttgccttagttcctgtgcttttcaaagaaccatccgcttcccagaacaatgatgccaaggaggtggccttgggagccacagggcaagactcaggcccaaactggactcagaaggaaaaacagacacttccttcactcacctctaacgtggatgtgcccagtggaggtggagcaaggcaacattctgtcttcttgttcctgctctcatacagagatgcccggaggatggagactgagagcagtgtagtgcgagaagctccagcacgggagccactagggcagggttcgaatcccaaatctggcatctgttagcggggtggcctcaagccagtcacttagcatttctaaac

SEQ ID NO: 477744 - DNA, 1364 bp, Homo sapiens
gaggagaaaagaagacggatgggctgccggccagggcctgactcgatattaatctataataggtgtagcaaatatttcatgaacgtggctggctacacagggcagcacagcacaacatatgctctaacagaagacatgtttactacttacagacgccagagaggagggcagcaggcctctccaggccaatgggaaggggagccagctgggaaccacaccctcaaccagagggatgctgaaaatagtctcaccaatctcttctgtgaagttgaccctccagaaagatggaccaaggatattctgctctttgcatcctccctgcacagaattgagtctgtgcctactcccgtttcagaagcatgtgatacaggagccagaaggccagagtgggaggaattttcttctctcatctgggatgaggctctggcaaagtcctttgttcctggagaggccgtccaagggatggacacatttcctggtcctgaagcagagaaattagaagcaaaaataggcatggaaagatgctctgcccaaaagaagtcccccctctcttccccaggagttgaataacagttctctttcatttgggtatattttacttttaaaagcttaatttagtcatttttaacaacaaagtagaatagttcagagatttataaaaacagcagcaataacaacaaaaaactttgctgcagtgtttgcttttcctgcaggccctcctggtgaggctgctctttgaagcacttacacaggttctcacaactctgcttgggccaccttcccaaaagcaatggccttttatgcccccaggtgacccatcgcccccaccttcttcattctcctgatctatgtcattgtcccacttacttctcctcaaggcaggaaaagggctgtgggatgagctcattgatatcattcaggtgagcagcagactcctttgtgtccaggtgagaacatgggatggctccttcacgtggtttgggaataagtgtagactccttttccacttttagggaacccttgctcagtttcctgggaagagttgggataagaacagatcctagggatgctgatagaatccatctgcagttggggtcttaccagctcagggcttgtcccagataaagcctccggggaaggaagtgtggttcttttgctccctctgctttaaagcacatgtcctgaaaattcccattggcatcttcttccttttcagtccctttgcctctcgtggacatgagttgcctgtgtgtatttgtttatgtgattatttgtttagggcttagggtttgccattcttttgtgctaggctctaacaggggtcttgatcactaatcattactgtgtctttggggtctagtata

SEQ ID NO: 477745 - DNA, 760 bp, Homo sapiens
gcagcaaggtgggctctgaaggcacacgctacctcacagtgctcaagtagcatgtggcaaacttgtgggatactttccattggaacccagccaccatgctttcaggaagcccaagcttcatggaaaggccatgtctaggtgttccggggccccactcaaggaccttcacagtcggctccctgtgtacagccccagctccatcactgaggtctttgcttggcccacagtgcctgcagttctcccagtggaccaggctttgcctcacctctgggagtcctgcctgctgcattcttctctcctttccttgcgggctgtctttcccaggctcttgtgcagctggtttcaagctgggttgaaccaatggaagcttcagcttccatcacacagacctgctatgttttcaggttccacaagatcaccccagccatgggcactggaaacaccacctcctctcgaggtccctgctgtcctaggggtagaagtagctttctgctgttctcagtgcctgggtgttcctctggccctgtttggcttcttaactcatttgtaaggtttcttttccctctggcttctttcagcatatttttaaaaaatcttcaattttctctacttgaatatagtatgcctagatgtagtttttattgtttacatatttatttatttatttggtatttatcttgcttggtgttctgagctgcccctctgggttttggtatctgacattaatttatggaattacatactgatatggtttggatcc

SEQ ID NO: 477746 - DNA, 1567 bp, Homo sapiens
tgcagcaggtgttgaaaataattgaagctatgaaacttggttgctggatcgttacactgaggctaataatgaaaggaaggcggaataaagggccttggttagctacaggatcctatcggacaggaaggattgctgtttggcagagggtgggcatttctgaagatcttcagggagtaaaggagcatgatgtctaccacttattctcaaatgggttgcaaaaaattccttttagagagaaaggagaaaacaaatgggaaacaatttcagttagccccaatttggacgtggataaaaagtaccttggaggtgttgacactcctgttgatgatgacttccagttagaagaacagcagccaagatgcctcctgactgcagagctggctggaatagatctggctgctatagaagcccttcctttttcattcaagaagagcacctagcatcttaactcctcatgctgaagaggaaatagttctgagcaattatttatttaaaatattaaataatatttaaaatattaaataatgtttaaaatatttaaaatattaaataatgtttaaaatatttaaaatattaaataatgtttaaaatatttaaaatattaaataatgtttaaaatatttaaaatattaatgtttaaaatatttaaaatattaaataatgtttaaaatatttaaaatattaaataatatttaaaatatttaaaacattagtggtggtaaggtgaagaaaaaagttaagttggttgttttctacaagttaaatagataagttttgtggttggtaattgaaatagggagcaagctttttgtgaaagctttaaataaacttttagagttttaaaatgggaaactcaaagtatattttgggaaaatgtacagtttagtacaagccgtgagctgtctcatatgtttagagcaaaatgctaattggggtccaccttaatgaccttatcttgattacatctgtaaagaccctatttctatagaaggtcatattctgaggtactggggttaggacttcaatgtataaatttggaagacacaaatcaactgatagcagaggataaattctcattccaaaagtgaattgaagaattaaggcaattctctaggtcaaggctctccagtagaaataaaaagtgagccacatatgtaatttaaaattttctagaatccacactaaaaagtacaaagaaatagataaaattaatctgaacaatatattttatttaacttatgttccaagtattattttaaaatataatagacgttaataattattaatattttacatattttttatagtactaaaattttgaaattgtgaattttccacttagagtacatttcaatttgggccctaaatttatatcagaagtatataatctgtagtttgcaattgtaaaatttatgattgaaaagtggatttcataccaggttgaaatatacttaagatttttccaacaattgagttaatgatgtttttaaattttaatttaaataaattaaagtgaaataaaactaaaaactcaatttctctgacacattagccatatttcaaggct

SEQ ID NO: 477747 - DNA, 884 bp, Homo sapiens
cagccaaactaaagagtaacaaccaaagtaaactttctgagagcagctgaagaaaggagggtcctggcagacagtgttttaagcacagtaaccccaccatggcccaagaaactttctgtctgagtgtacactgggaagggaagctcctcctctgcagagattggagctgtttctgaagaggaaaaggggcagagtcctcttttccatggaacatgaggatggcgactcagtttctcctcacactgagaagatggtttctctgctcagtgtttgaccagaaaatgaccaaaccgagatggaagctccaaatgggaggagtctttgcattgtgtctctgccagaggaacatcaagagctaccagaagctggaagacacaaggaagaatcctttccctacaggcttcatagggaatatggccctgtcaacaccttgttctgggacatctagcctccagagttatgagacaatacatatctattgtttaagccactcagtagtactttgttatggcagccctagcaaactactactttatgcaaaggctgctaactcttggataatgcctgctatagcattaatcaagcgtcacatttgttatgtgatggacaaagactgtggatggtggatccatgacttgcccttggaaactcattgtcagagcagctgtccacaactgttcaaaggttcattagtcatgcaaaggcacatggaatgcagtggatgctgctagtaccatggccaggttttctttactagactgaggacgtattccctggctgctgtgtatattgtctgcttttcctgaggattgctgtcagtcaaatagaagcccctttactatgtctttcccttcccattttagtgtgaagccataaaggagtct

SEQ ID NO: 477748 - DNA, 1472 bp, Homo sapiens
gacactagagcagccatagttacgaaaagccacttcaaagcattggaaatggcacgaactgacaaggttgaaacatatagttatatggttctgcttcattgccttatttctttcctcagagctattgtagacaaaaccaagcagaagaagctggaggctggacgaacagctgagcttcagctctctgctgggtccatagtgccagtgcctttgtttcctcatcagagaactgtggatcataatagctacatggagaggaagatgaagaagtccaagatcaaggtgctggcaaggtcggtgccgtcccagcgctgcaaaggagagcttattccatacctctttcctggcttctggttgtttgctggcaatctttggcattcctttgcttgtggatgccaagggcctctgccatcatcttcatatggcattctctttgggtgcatgtctttctttgtgtctaaataattgaacacaagtgcttattttataataatttggtagtatattaactattttttgatgtaatattttgttgattttgaactttcaaagccaggaaagcaaatatttcttggttttgccttctaaaagttccttctgctggcaggagcgagcacaacgctgtgtgtctgtgtgtgtgtgtgtgtacctgtgagcatgcacttctatgtagtttatcctgtcatctcttaagataaggggggaggttgaaatgtatttttggtcttctatactgaaaccaaaaaattgaatctctttttaaaagacatttctagatgcagagcctataggaatggtaacatgaattactctggctttgcgtaagtatcttaaaaaaataaatatatacactttgatagtaggttgactggactatacagtccatgtttacaaactaacttaaatcttaattccaagtgttctggaatataagaaccatgggaagagcattggttttaagttgtttcaagaggcaatttttctttcagtttaaggaaactgatttactaatctatgtcaagaaattatgaactattcaataagccttattgctgtaattttgcctacggtaatacagtagtaaattagacattaatggcaaaagtagactaaatgccccactagaagacactgttaggaatatcaaaactttacaaatgttgaaggacataaatcatggtgaaagtgtaacataaacagttacacggaggtttatagtaatatcctggcactagaaacttggaataataatattagtacaaatatatactaggatgcctttgacagtatagaataattttattttgctgtattcatgtgaatacagtaagtcttcacttaatatcatcaatagattcctgaaactgcaaatttaagcaaaatgctctataatgaaaccaattttttcctcatcaatgttatatgacaaaacaacattgaattaaacgatgtcatttgaaggcctgctgtac

SEQ ID NO: 477749 - DNA, 1628 bp, Homo sapiens
ttaatcttgctgtgtctagattgcgaacatgaagtccagttccctctggcaccccttactggcccagcccaacagagagctggctgcaacacagaaatatgagtacaagagaagggagagtgaggccccgcaaaacaggacaaagagcggggccgtgactctaaaagatctcagaagtatttgcgtagctgcaacatgcatctcatttcagggaatcccacagacagctttcccaaagtgggcatttcctcttgagcaacccacaagcctttcctggcccctggggcctgcagtcccctctctccctgaaaaaccaatgccacaatttcaaagtgattcaactggcatactctcacctggaaactatgcatcctttttgaccgtgatgccccaccagtgttccaacccgatctatggctcgagcagctgtttaccttcctcagaccttgacctcacattttctaatgaaggagaacagtatgatgtagtggaaagaacagtgagacccgggtttctcaacctcagcactactgacattttgggccaaatcattcttttgatgtggacgctgtcctatgcattgtaggctatttagcagcattcctgggcctgctacaagcacatccccttcctgctatgacaaccagactactgtgacaaccaaatacatctccagacattgccaaattcccagggagtagggtgaaataaatacaccccctggttgagaacctgctttaggcacattttaatagctcttctctggttgtctccattccagttcttggttttcttgagctataatgaccaaatgatacacatggctccaggctgaatagtattctattgtgtataaataccacattttcattatcctttcaaccactgatgaacacttaggttgatttcataccttggctattatgaaaaatgctgccatgaacatgagagtaaggttttcaatttattttgcacagatctatcaaaaaagtcattatctatggcagctgtaaccttaaaaatgtatttcctagatagtaagacttataaatcaaaattactccttgatccatgggctacagaacggatgctgtgttagcagacaggaaaacaacattcagctccttatatatgatttgcaaatattttatcccattctgtggattgttttttactcttttgataatgttttataatgcaaaataatttttaattttatgaagttcaatttatttttttttctgttgttgcttgtgcctttggtgtgatatctaagaaaccattgctagatccaagggcttaaagatttatctctatgtttttttgctaagtgttttatggttttagctcttatatttcagtctttgattcatttgaagttaatttgtgcatataatgtgaggtataaatttatagtagtgcctataattaacaatatcgtattatgcatttataaaagcaaatggtcacaagaaaacttttggaggtgatgaatatgtttattaccttgattgtagtgatattatcataagtgtattcatatgttcaaactcatcaaattgtttatgttaaatatgtgcaattttctatatatatcagttatgcctcaataaagctgggggaaaatc

SEQ ID NO: 477750 - DNA, 616 bp, Homo sapiens
ctacgagcagctgctgttttgacacgtctgctatgtttgtctctgtgatcaaccagcaatcctgtcccactggggaggggtgttcttggcattgccagaatgattagtttggagtatgctcctggtgtaccatacaatcagagagcctcattcccagggcttctgctagagattttagggaagaggtgctctgttctttctagattagatgtaccagcagtatgtaaacctaacattcctggagaccatctttgtcaccacataaagggatctcctctgagaacgacaacaatccagaggaaaatagaattgagagatgaaatgcagctggatcctatttataatccattttcacatttgtttgaattaaaatcccagattgttgtgctttcaaggttgaatgtgcatggcagccaacatttatccagccatttcaggagttactgggtaactgggctccaggaagggaaaccacaccatgcgtttgagccacagggaggagagagagaaaacagactcacacctaaaacctctgacatcactgttgtttggagagagattgttctgctctgaacatgtgctccctacttaagactctaattactctaaattactt

SEQ ID NO: 477751 - DNA, 533 bp, Homo sapiens
gaaggcttctctgttaactctggtgagttttgcagcctgaggaatggacagatgtgataagccagcacaagaaaaagaagttcaactctccactcacacacacattctctctttccagtttctcctttctttttgccacctggctattcctccaaagaaaaccagagtacaagagctctggttaaagcgtgatgaaggtgaagtgtcagcaataccggagcaattgagatacgctaggatctcattttgtgctatttcaaacaatgctgaaatgaacattgtgtgcatgtttttcatttctgcaaccattttaacggtttttacaaatcaaccaagcagccccaccatgggcttgatgatttggttgtgcaacatgaaagaggagggagctatgaaattgaaatgtatggacagaaagaattctcaccctatatatgcagtattgatctaagtgtttggtgcaacgaattcttaagtgaacttttctcgttccatatatcaagagtcctatattcacacaaccattaaatatc

SEQ ID NO: 477752 - DNA, 2014 bp, Homo sapiens
tcctccccagctatgttgagctgatttgctcatggtggcctggaggacactgttttgagaaaggttttctgggggcattccgactcaattgccaggatgaatcaacgatggttgccctgagcatgggactggggagtggcagctgcagtgttagccagcaggaggaactctcaggcaacaatgaatgtcaaagaacccagctccttagcagggtcccggtgtgtgatgtcccccttcctgtgtccaaatgttctcattgttcaattcccacctatgaagaggacttccaccccaatccaaaggtagctaaaatggggctgtgggatagtggtatctctggagctgccactagtgaggaaagccagccggtgtcctctgtgcccatgtcccatgtagtagccccaggcatgtcagggaccttcacagaagccacacccatcacagactttgaaggtctaggagggaaaaatgattttgtgggccaggcccagggctccctgactgtatgcagcttagggacttgatgcccttcatcccagctgttccagctatgactaaaaggggccaagattaaaaatatggatgatacgttattgaccacactttaaaaaatcacaagcaagtgttaaagacttttcagagacaaacactaaattgaagattaggattcaaattattgctttctcctaagaggaaacaatcttccagattttccatgtaatatgcttcttgacttagcttctagagagtgcttagaaggttaagaaacctagcattccaaatgggcattggaggactggagaagatagcacaatgactgaacaaaagatcctttaccttctcaccttccagaaacatgttaagtgcccttaaagcacagaccacttgacctcctttcctattcgtgtgtgtgtgtgtgtgtgtgtgtgtgtgtggtgtttactatgagctacagtgtttacgaattcagttttaatagggccagttgcaggactttcatttagctttattttcaatgacctaacctttgtagggggaaaaaaatttacttcagtggaaagctatacattgtccagtttctagatgacgcccctgcaagttatttgatccagattctatggaagttactttacaacttcatgaattgtagatgatatcaacgcaaatgattctatgtactgacacaaattctgtcctatcctgcagaggttcagtttacttcccccctacagtgaaaaatctttccccagctcttctgcagttattacaaaattttctatctctaaatgtatctgttctttgcattcttttttgaaatggttataattacttgtttctctaatgaatcaaataaactctttggcatatatttatcttcatatctgtatgagagacgatgaattgtggaagttaatattctatgtatgacatcctcctgtgtaccctatctccagctctcctatctctgaaactggtagaaagagcaacagatgaatccacactgttattccccttagactgataatggaaccacacaagagatactatacagttttattgtgggcaagaaggttttaggctaagaaaaacaggagaaaaaaactgatgttagtttgagaacgaaggttgagatttttgtaccagtctaagtgtagtatttctgccaaaatttttcaaccatttaacatgtggatggatctttacacaaaatcaaatcatgatggaaatgtgctgcatgtttattactatctcaactccctcattattaaggcagtataaaaatgactcttatttcacaagtgtctatagaaagcttgtggctaaaatgtaagtagactgaaaatgggaatatatcttaaagacaattcagagtcagttgaagctatactgcatgaaaaactgttaactctcctgttttcataaatgccaagtgcagcatattttaaattttaatttgtgtttgtattcttggtaatttttatcccccttcagccaagtcctcatttatttgttc

SEQ ID NO: 477753 - DNA, 592 bp, Homo sapiens
cctatacctcagctgtgagacttgggaacgtatcaacagaattgtcagcttctgcacaaatttaatcttcatcacctctatgctatgtttaacgtcagatggttgtgcttgccagggacttccaataatgtgcttccagaaggcaggcacttcataaacattaaacactggacaaagcaagcatcaaaaccacactcagatatcagacaagatctaaacataactgacggctatgctaagggatatgaaggaaaaagtggacaacatgcaataacaactagactcttagaaattccaaataattcaacaatcatttgtcctctcatttttgccttcaaagatgtaggttccaaaggtaaccaactgaggaaaaagaaaagaaaagaaaagaaaaagcaagtgaaaataactaccaaaagatgggagaaggggacggcccttaggctctgcacttatcaggtggtaaattcagccaggcctgtgtccttcacttcaaggcggtgagttccctaggacctgggtgggtacagagctgctgcccagaagccagggactagagtctgaaatcttagaagtctatttggtgttctat

SEQ ID NO: 477754 - DNA, 560 bp, Homo sapiens
acacagtacttaagacacacttctcttcacaaatacttaaagcatggcccgtgtaatagcttcctgggccacacggttcctcatcttgcctgaattcctccccctgcaccttttgagaactgctacctatgatgttagcagttgtcagacactacactctcattcactgcaccagccccttcacccagatccaagcattgcatcaccatctccagaagctgctgccttgtgtgtgccagatgataatttgggcataggcacaaatcaataccaggaatgggtgtgctgggagcgtgcactagaaactcttgtgaatgcctataaggaaagatttgtaagcactgtttgtaacaatagaattcaaaataatatagctgcttctccatcggttaatagacaagtaagttattttatttatacagtggaagctaaatagtacttaaaatgtttccagtatcctgtattattactatcgaatgtttgctgtcctatgtcccttacctagtggctgatagaagatttagccctataattttgtggtgtcctttctagtggggaga

SEQ ID NO: 477755 - DNA, 856 bp, Homo sapiens
aaaactgctgtgaagtatctctttttcttaggtacatatttgaaaagcatgcagggaacccatgccatgctgtaagaaccccaagacaggtggagggtttgcactggcactgctagcgatagtcccagctgaaatcctgacagtcagcaacaactaccagccatctgccagcagaaacgaagtcagtaaaggagcaagggaaaatgagtcaaatgagtcagcaaaaagagagagggcaacgggctccaaagaccagttgccagaactgaccttacatggagaagtagaagaagaagtaaagaagataggccaggtgtgcgtgtgtgtgtgtgtgtgtgcgcgcgtatgtaagtttctgcctggcagagacttgcaaatctctttgggtgcattgtcttctgatggctcctatattctctatgaaataatatttggtcactttctacatgtatgctgtgctttaattgtaattacataaaaatccttctcattcatagaaaaagtactgaagagaaatatatcaatatgttaataattatgttatctgtgttataagtttattggtgatttatattttctacattttgtttcatgtaaatttttaaattgaaaatacattaattttttaatgcagaaaaacaatgaagctctttgcttttccaacaagtgtgaactctggtttccggaataactacactaaaattatgaggttcatatttcatcttcagataaaaagacactacatcttcaaaaacttgtgaaaaactgaaaatgaaaattaatatctattcttattttagtgagttatcagcctttgaccttaaaattttaatttttttacatatttaaaaatttc

SEQ ID NO: 477756 - DNA, 1123 bp, Homo sapiens
agggctgaggagtgcaggcgcatggcacgggactggcgggcaactctgcccacggccctggcacgggatccactaggtgaagccagctggtttcctgagtctactggggactcggagaacttttatctaaaggattgtaaatgcaccaatcagcactctgtgtctagctcaaggtttggaaatgcaccaatcagcaccctgtgtctagctcaagatcatgaacccactgggaagaaagaacaactctggaggggaggaacgatgaactctagacgtgctgcgttaagagctgtaacactcaccacgaaggtctgcagcttcactcctgaagccagcaagaccatgaacccaccagaaggaagaaactcggaacacgtccgaacagcagaagaaacaaacttcggacacaccatctgtaagaactgtaacactcaccggacatggatgaaattggaaatcatcattctcagtaaactatcgcaagaacaaaaaaccaaacacagcatattctcactcataggtgggaattgaacaatgagaaaacatggacacaggaaggggaacatcacactctggggactgttgtggggtgggggaggggggagggatagcattgggagatatacctaatgctagatgacgagttagtgggtgcagcgcaccagcatggcacatgtatacatatgtaactaacctgcacattgtgcacatgtaccctaaaacttaaagtataataataaaagaaaaaaaatttagaatagttgtagatttacagaaaagtttcaaaaatatgaccaagctcccatgtaccctgcacccagtttcccctattttgacgttactattacaagtctgttactacaaatggagtcgtattaacacaatgtttagataacaagtgtttagataacacttgttatctaaagtccatacttcattaggatacttagtttttacctaatgtcccttgactgttcctggagcctattcagaataccaagggttggtatttagttcatttggcaatgtcatgtttttctggatagtgtagaatcttgtgcatatttatgggtgtctgagcattgaagagtcaggtatttattgtagcctttgcagtcaaggc

SEQ ID NO: 477757 - DNA, 566 bp, Homo sapiens
tgacactgtcattacatcagatcaagggtgccagcatgatttataacaatgatattaagcttgatcatacgaaagcgcctcatcccttggctgccataaccacaggcctatggggagtacatctacactacccctgctgtttgtttaatgcccaagggctcttcagtccgcttgtggtgaatgctgcttggcctaggactcacccttcagcacagtgggttcccctctggctgatggcaggtccagaaatgccatccaaaagccaagtcctggaattgaagaccccaagagcctgcttggtgctctaccctcctgtggccaagctggtatctaagacgcaagacaaaatccccatttgcttatctcaagttgaagaagtcttgcttatagccatcacagttggaaaagtgtcgcatctcactggaagccagcaagcctcagagtctctccaaaggcccttgatatggtacttcggtattgctgctggttattcagggcccaaggacacttcagttagcatgtgataaatcctgccagtacttcatccttcccttcaaggaatcggg

SEQ ID NO: 477758 - DNA, 1370 bp, Homo sapiens
agggctcctcaagcaccgccagagtggacactgaggccgagcaggcgctgagagcaagcgagggctgctagcacgtccaaacataggtaatgacacaggttttacctggctgccccagaggaaggctgccctccccacagcagacccagagcagggcccatgtgtggggctgcaccaaggcctccttatgggaagaggagggggcaagcctggagacacatcccccctctgcctcagtgcccaggactttccaacccctagccgttcctcctcaccctctctgcaacctcagggtccctaatactgcagtgagacgatccccaggagccccaggagacccacctgacccttcaccggtgcactgccccatggagcaaaagggaacaggggaaattaccatagagaagaagtctgagtcctgctttttgggctgtttcacatatgacaaagtctttactttggtaatgagggaagacactggtaagcagaggtctgcagccagacaaagttgggtagaaattcatttccagtagacctcagttgtgtgacttcagcaatgatttctaatagtttccacattccaaagacaatgagggcaagaagccaatattccatgcacaagctctgtgacatgaaataatgtacggaaattactaccattgctgattaacactcattaagcgccaaaagcatttgactttaatttgcagttaatttttttttctggtttacattttattcactcgacattgtgaaacacatttcaaacaagtccactttatattcataatttgcatgttactgaaaaatctccagtgtagtggctacattgctatgtgtatatatagtacattatgcaccatctaaaagaaacggtaaataataatataggtgcaaattatggatttttgtttaatctgtcctgtattaactcattcgaattgtcatttcatattaagattcctaaatactagtgtaacatacttatggctgaatgaacctagtaaaagtattttcaggggaactaccacaggtcaaatttgtggatttctatttcaagaaaactttactaagagtaggagagataaatgaggcacagtctcttgaggacttgaagctgtagcacagcattttagttcattacaggaacattagcctagcaaattgacaattcttacctctctatttttttaatatagttggccatgtcagggcatgtttcttaatttccaagggctaccgtaacaaattactacaaactcagtggcttaaaattcaatagaaatttattttctcacaattctgggggccaaaagtccaaaatcagggtgtcaagagagttgtgttccctccagaggcttcagggagga

SEQ ID NO: 477759 - DNA, 540 bp, Homo sapiens
cgaggcgccgagagggagcgacggccatcccacaaataagtgagaacatgcgatgttcgtctttctgtgcctggcttatttcacttaccactgctctctactcagggggtcaacaatgttaattacctacaaattgtgtttgttccaagcctttgtcattaaatctatactaaataaaggtgaacatcgctggcttaaggggactgctgactgtcttcggcccctaccaaatattaatgtgctgaatttattacagttgagctctgaaattaaaaatgaccatctgtggcacatgtgtgtggtacgtagaacagtaatatattgtaggccagcccaacaagacacaaaggatatcgtgattgtgacaaggtgggaaaactcactcaaacaccaagacagttcagtgaatctagtggacactggtattggtcctctctgcaggtatctgctttctgaaacaatgcacgacatatatgagatatttattaataattccttcaacatacctctataacagatggtgcgctctaaatctggaaa

SEQ ID NO: 477760 - DNA, 1219 bp, Homo sapiens
tctaagacaataagaattaaaccaatacgtagatattaatcaacacttcgaacttccttctgagataagatttctcctccttctcgccagctctgtgctgcatttggtggggtccccggccattagagagggggatgtggacagcctaggacagaactgtttgaattatagagtagatgccatcggtaccctgtctacaaccttcagatcttatcgcttctgtgtccactggcctactttcagctgcagataatgaaattgagaagttacgaaactctcccgaagcttgtatttctggatctagaaacgatgtcattaaccatcatatgatagctaaaaagaaacaggtccaggaagaatggaggtcccaatttacacttggctccgggggtgaggggccacaagctaaaaatgtgaatcatcaggacagtgccgccttctggaaaggtggaaatgtctttagcatatctaaaggcaggttaacccaaacacattcttatggtgatgccaggggtccgagaaagaaagtagaaatacccaagtgctttttcaaagcttgcttgagtcaagccactggttcaaggaaagaatcagtacagggtagcactattacagtatatagttgccaggaggtgtgaaaaaatggggacattaacatagccaatctaccgtaatacttaaaaactgtcggttttccttgtagctcttgtaataagatttactaagttggtcaactttggaaaccaccacattgtttttaaatcggcaactttatattatttgtgggcaaataacactccaggcagtccccaaattaacatattttatttcctgatgtgaataatggaagtcctgcagtgtttcctgagatcacttctaataactagcaatgttccgaatatcactcaaagtatttggactcaaatccatgtctccacttcggttgctagggaaacccaacctaagacaacttatttggcagttgcgcatttaaaccagcctagcaattttctattggatagctggcattgattgcaaattttatcctttcgtgtgttaatatttatatattactataaatgtgtcctgtagctttattatagaagagagttaagttacttacaaacagtttaatcctttcaggtcttgcttttataacttgttaagtgaatccataggatacttagtcgaaggttaattattctttactactgaggca

SEQ ID NO: 477761 - DNA, 721 bp, Homo sapiens
acctacgtagcaaatcctgcacgtgtatcccgtgcagcccgaggtaatgatcactggctataccgtcttaaacttctgctgggcggcccgcttcctaacaggccacagaccagaggacctataccacaattttgtgcaaaataaaaaagtgtactacgtctttggggccaattcagcccagtgccaagcaaaaggctttgcaagaggagcatctcagcgaacacttggcccattgactgagtatcctcatgcagtgcgcaacctgacctactttgttcagtgcacaggggaacaagacacaaagttagggaaaggataccctgaggtccagacagctcgtatcaggcctgtctgtgtgctgcccacttttcaaagatatatgtctctaattaaggtaaactgggcaaatgcgccagtggtgatctctgtcttccaaagcacagcatgcaaaaagctaggtgaaaactgatttagagaaaaaaattatttaatgtttatacctgagttgagattccttaataaacatattattagattgaagacttaacagtaacaacaaagattactgtgacttggtttaccaatatataaaatgaaagataggcttaatctatacaactttgaactctaaggcaggagggctagttttatggactctgatgtgtgtggtagattttaaaaacaaaatactactctattttgtgtctccttttattaaaat

SEQ ID NO: 477762 - DNA, 647 bp, Homo sapiens
tccttctcataaggtttgccagaatggatgctactcaccttcttccctactccctgctgtgtatacctgtacacaacatccaaagcaggacacatcagggaattcaatccaaaccctatcacgacatgagaaatcagtacactgtctaccatataggcattcacttattctacaaatatttattgagcaccacctgcttacatagcactgtccaaggtgctagggagggtacaaaggaagacagcagacaagccctcaagaagcttcagatacatgtggagaaacgtgcaagcccacaacgcagcccatttctactgtcaaagaaatggacccttgctacagaactgaagctggacccacttatcagccaacttagtctctcaattattaccaaaaatgtgttttcaacttggtgcacactgggggtgtgcctgagcaggatggcgagaaggggcaggcacacactgagaagcgtagacatactcccctttatctaagggctctgctatttaggaaagggcttttgtgtgaggaggttcgagcctcaaaggctcatcttgtcatttttcctgtgcctttcagagatggagcatattgtgctgtgtttttgaaatgatgaaatgaaagtgtgaggaatctgaaagcca

SEQ ID NO: 477763 - DNA, 767 bp, Homo sapiens
gatttagaaagagggggcatagataagccgtcttgatactcaggtggagatcagacccgagtcactgtgatcttcttgccatgaggacaacactttccaagttcttcaagtggtcccacaagttgctgagggagcctctagctgacagccagcaagaaactgaggctcacagtctggcagctggcaaggaactgaatgctgccaacaaccatgtgaacttggaggaggatcttgcagatactgacggtaaagaagtcctcagtaaggttttctttttaatgaaaagcagcccccaaatcttcttcttttctaacaaagagcagtttgtaaaactgagctgcagacacaaaaacgcaagctggaagcttgtatgggtgaatgctggcagctgtgccaataaggaaaggctacctggggctaggcgtattcaaaatggcggctccaccttcccctttccttgcaaaccacacaacatggccccaggccacgcaaagactccatttgcataataagattccagtagggcaaccagtttcctcatgcgctatggatgcgttattaatctattgctgttcttttctgttcttttaatttttcaatactctttcaatattgaatacatctctaagactgtgcttatatccatactcaactgtctttcaaaagtatatatgtatatatcacttttattaaatatatagtaagaagttattgtatgtttcctattgcaagccactggactgaaatttaaattatgtatataacat

SEQ ID NO: 477764 - DNA, 1269 bp, Homo sapiens
agcctaattctgagagtgcttttctgagcttcagcggaagcatgggagaacactgcccaccttcccgcatttttgtctcctgcatctttcaccttccgatgactgcatccccagaaaggaccttgactgcagcatcttacagactccaagccagaggcaccctgctaagctgcacctggattcctgatcctgaggacggtctaagatattcgccttattcctttagtttgttcctggcttctaaagtggcatccacgtgcataaaaatgcaacttatttcatcatttgtcagcatttccaaaacagagaaataccactttccttgttgggtagacaggtaccaagtggtaaaagtgtttaagaagaagttcatgtgtgaaaatacgaacactgagggctcggactcagacaagtgggagaaacgacctacctgcactgaagatgtaaatttaatgatggagtgaaggatgactattttgcttattcatctaattttacctaacctggactgatgttaactcaatttttttttatattctgtatttcatgttatttaaataaaaatatcatgttttccattgtctgcaatctattgaaactggaaaatatttttttatcattcctaccaggactagaatattattctatcttagagtcaaatgctagatggcttcaggactaaagatatctatcaacttggtaaatttcttgtgcttatcctgaattaattttctgattcacgtgaattggtttcagatttctcttgcgtctccttgatgttccttacaatcaatatttttaattatctggcattttaaagatttctttttggttagggcctattggtagagaattattatgatcatttgaagatgatgttaccttttattcatcttttctatacctttacgctgctttattcacatcttgagtaatagtcactttttctcattttttaatttgcttttataaatgtgaagggggatcttttttcacttgaagatataactatgatgtatgctagagtactgtgctattgtgtcagcagttataacgggctgtgtggactgatatccaggacaggacagtaggtggcactttcagtgttgaaaaacaggatgtaattgtttgccaaatcctcttgatttacccgattctgattaagaccttgagattagatgcaaacagaatgtcattcaatgaaatcagactctttagagtttgttggttgttttagtctctgctacattgactgtaaaactggtccca

SEQ ID NO: 477765 - DNA, 487 bp, Homo sapiens
tcctatgattgcaactaaagaaagtggatttccatggctgtgaagatagctgaactatttaacttgttccctggaagaaactttctccgtaattttgttgtggtcctacaggaagattctgtctccatgcacataggtgaacattattttattcctgaactttcggtcaaaagatggtgtcttctggacaaggtggaaatgaccattgccggaggaagcaacagaccccctcccgccttgctgtgtccgcctgacagggatttagcaggtcctcccctaacatcttctgcagaacactattggtcctctgcctggagcaacccaaaccctggagctactgcctacttcatattcaaagtgcagcaaagtcttaccttctgctgtgttccccattttgtttttctattctgttcctcaactgtggaaatgatcatcttttattgattccagccatgtctctttttatgtatatttttccctcttgcta

SEQ ID NO: 477766 - DNA, 628 bp, Homo sapiens
cagacatcgatggagggagtagactttggcagagcccctttgaaaaacaagttggcattggaactcaagttgtacatccacaacatttgtgtccaaaacattctacaagaaagtggctcagcagtcaggcctctcttctgtagcaccgctgaagtttgctgggagtcaactccagaccttatttgcctgagtcccttcttaacatggaggtatcaccagtggaggctagagaacagcaaagatggcagccttcttcttcttctgggagctctgtcccagaggcacactgacctattgccagccagaacacccctgtatgagaatgctaaattcaatgtgtcctgttgccttggagttagacggtgttgctacacattgacagaggacaaggatgacagccagggagctatcaccacatctcactcttatcacttcagttctaactgagaatttgtcaattttgttgatctttaattaaaagcaactattagttttattgattttttctattgcttttttattctccattttatttgtttctgctttaatctttattattttcttccttataataactttgtgttttatttttttttctgtttccagtcacttgaagtataaagaagct

SEQ ID NO: 477767 - DNA, 843 bp, Homo sapiens
cttcaggaaaacaaatatagtacctgaaggctctctcctctggctagaaagacaagccttctgccatggttttaggtttttcttcactgccagacatctatgcagctcagttactgagctgctctgggcagggtctggagctaatcgtcaagaatcattttggaatgcttcttggcaaatctgtatgggatgatggccataaaatgagatctaaaactgagctgcatttgaataagaacttagcctctgtattaatcctctcctcaccccctaagcatctcttacttgggtatgacaatcactttaaattccacaaagcaaggaaacttagaagcaaacaggcccttctccaggatttggttcttggcgttttgaacaaagaattggaaaaatgcgcaacaaagcacagaaagaatgaagcaacgaaagaacgaaagcaaggatttattgaaaatgaaagtacactccacagtgtgggaacgagcctgagcagcggctcaaaggcccggatacagaatcttctcgggtccaaatacccactggccacttcatgctcacctcatgtaaatgaagtggtggcctgcaatcagaggagttgcgaagagtagttacaaagtggactgaagtggagttaatgaagttcacactcctgtgcaaatatctgattggttgctttttgtaatcaatcacaggctaaggtggagttacaaagttgcacttctaggcaaaggaagactggaccggccatcagtctgattggttgcggacagccaatttcccatctgcttggcagaaaaggtcgggggtttgcaaagggagtagcctctggtccttttttccctt

SEQ ID NO: 477768 - DNA, 671 bp, Homo sapiens
agtccagtgacatcaagttggataaatgctttcattaggactatggaaacgtctgtggaaacctgtggcagcagtttaccctgtgacctaaattctctgatagaactaattgattttagtttaacttgttatgtattgttaggacagagtgatgacttccaagttccttacattcagttgactgagccagactttgctggtcctgtctgggctcctcacatgactgcattatggtataagctggcaggggctggaaagcccaagataatctctaccatatatgggatctttggtgctcactgtgagctgggatgctattattcccctctttgtgacctgtctctctatgtgatgacccatacctctggcctctacctggcctctttctccagcagcctgaagttggccttgactgtctgctggcctgtccgatgtactattttcaattggtgtttggcccctgaaaagtccgcacttacttattaagtcagcatgcatctaaaaatatgttattcatattttagctagcattttacattgttttcagtatgagggtcagtctgattttgtaattttcaatagtcccagtaagagaactgggcatttgtttttaaaggcatttaaatttataataagtttatgtatttttcgtaacttctataaattaattc

SEQ ID NO: 477769 - DNA, 703 bp, Homo sapiens
ggagccgcagccacacgcagatggaagcctttgactaattagttgagaatggtgacaactttgaagacatgctttcgaacagctttagcgttgacaatgctctgcaaatatggggacacagtgttactttctcaggagttgggaggggaggaggtaccaggcttgagtctggtatcttggctttggaggaggaacaactgaggctgtgcaaggtcacttgggcagctcaggtgacagtgctgcctgcagagctctcaggagcctttccaggttttttggcctcttccgtttcttctttctggatctgtggatgggagactttttccctgtcagtccagaccctgtctcagatgccctgtgccttacacagctggtcctttttgcttctggaccatctacatagatgtaagaatcacctgaagagcttgtcaaacccagacacctgggtcaccctcccagccattcaggtcctgcatgtctagccagctcccaggtgatgttgatgttgatgttggtatcttgagggaccacacttggtgtatctctgctctaaagagcgatacattgatgtaagcacagggttgcaaactggcctcctgcaggccaattccagccctagaatctatttctttccttgtaatattttaaaggaaaattacccacaaaaatctaaatgttttgtcttcttttgcaaaatgaaaac

SEQ ID NO: 477770 - DNA, 554 bp, Homo sapiens
gcagtggctgctccagttgtgtgtgggagtcgggggcgggccggggaatgggagatggagtccagggcaaggttctgaagttcaagggctctagcagtgagagccttatccacaagaccaagactcttcggaggccagcccatggcatcttctctcctgtgccctgtctgaatggtcctgcagacacctgctcttctatacccgagggctttctcttggcccaagaagtgagaagtttgaaagtgctgagaagtcaacatctccaggagcagccttcagccaacaatggatggaagctggaggataaatacaccagctttattcctgcaaaacctgtgccagtgagaagccttgagcttcagcttcattggcttcttgataaatccatctctgtggatttacatctaagaacaacttctcgtcatttgctgaaaatcactgaagttcgaatcttacaaataagatgaaaaagggaagagctactttgtaaatacttctggggaccaacatgctgctgaggttttaagatttcagcctgtctcctggtgatgttt

SEQ ID NO: 477771 - DNA, 1429 bp, Homo sapiens
aggggaggaaataacaaccagcacccaggagctgcggctggaggagaaacgaggctgcagtggtggtagtaggaagatgttgggcaaggtccagcagcaggagcaaactatcgccaaggacctggtcgtgaccaagtataagatgtgtggggggaccacatcgccaaccgggtacttcggtcgttggtggaagcatctagctcagaaaggagatgccatgattatggaagaaacagggaaaatcttcaagaaagaaaaggaaatgaagaaacgtattgcttttcccaccagcatttcagtaaataactgtggatgtcacttctcccctttgaagagaggccaggattatattctcaaggaaggtgacttggtaaaaattgaccttggggtccatgtggatggcttcatcgctaatgtaactcatacttttgtggttgatgtagctcaggggacccaagtaacagggaggaaaggagatgttattaaggcagctcaactttgtgttgaagctgccttatgcctggtcaaacctggaaatcagaacatacaagtgagagaagcctggagcaaagttgccctctcatttaactgcatgccaatagaaggtatgctgtcacaccagttgaagcagcatgtcatcgatggtgaaaaaaacattatccagaatcctacagaccagcagaagaaggaccatgaaaaagctgaatttgagaaacgagactcctctaaacagtatggactgaagaggaaaacttcacgtgccttcttcagtgaggtggaaaggcattttgatgccatgccgtttactttaagagcatttgaagatgagaagaaggctccgatggatgtggtggagtgcaccaaacatagactgctgcaaccgtttaatgttctctatgagaaggagggcgaatttgttgcccagtttaaatttacaattctgctcatgcccaatggccccatgcagaaaaccagtggtcccttcaagcctgacctctacaggacccgcagcagagcaggggtctccctttctcccccatcccagttccccaacccactcccttccaacaacaaccagctccagctgactctggtcttgggagagcagtttggagaacctggtgatttattgaagtcctctaaataccaactgaatggtgtatgtgggtgtgttgcgatgttctgccaggtggttttgaaaagagctttccaaggtttaaatcaaccctatcatcagaatcagagcaaatgccagctatttttttcataccctaattctggacctgattgggaacacctgttaggaatattgttcatttgatgcatattgagtcaagcaacatggtcacaaagagtttggtaacagcaaaggtagagccttgtgttggtgggtgaggcaaaaactttctgtgaagccttgtttgccaaa

SEQ ID NO: 477772 - DNA, 628 bp, Homo sapiens
cagctatcctattagttgtgtccctctagagaactctgactaatacagaagcagggtctgagatggggatttaaatgcatatgattagttgggagagtgctcttaggagaaaggcggaaagtaggataggacaggagaagaaactcagccaagatgtggttcagctgaggttttatctcagcctgatcctacaggaagctatagagaatgaagggcaccggagaccaagtccttccccctttgccttctgccatgattgtaagcttcctgaggccctcaccagaagtccagcagatgttgggactgtgcttgtacagccttcagaacacaacagcagtcagaataatgggtaccttgtggaggtattgagtgtgaggcagtatgaggaaagcttttatgctgctggcaatatccttcatcttgatctgtgtgatgattgcgggaagaagaaagaagaaagagtaaagggactggtttatgccataaaagatccagaaacatttatcctttgagagctggtctagaaaaagaaaaaatgatggtgaagaaataaacttagatatggcacaaaaggagcaactagtacttattgttatggacagtagtctttaaagcaaccactggctct

SEQ ID NO: 477773 - DNA, 1548 bp, Homo sapiens
caccatttcttaaagaaactgtgccttcgccattgaggcagtggattctcctctggtccaggtcaggtccagaatgccatccaagagtcaagtccacagggatgatctggagcctgggattgtggttgctggccagatgacgaggacttcagtaggcagctttactctggggtgggcctggagctttagtctgtggggactcacatggcactggagcaggctcaaagtctcaggtcactggggccagctgggcactgcgactagtccagggcctggagccagtgggatggcttggtggatcttgctaggtgttggaacaggcttggaagctcagtcttcagggactggcctggagtctgggtccatgaaggtctgcacagtgctgggttttactggggtgggctcagtgattgggcctcagacgaagtctaatgttcacttccctcttttcttccacatgaagatttatctctccgtgatgtgatgcctgaggttggaggaggagtgatacaggaaggcaaagtgtgattatgcagctctcatagataaagggattgagatccacagaaattaagtggtttatttaagagccctcctcttattagagataacgtcatgggttgtaagtcttttgacatggaaggataggaaatgttgaataaaggtgtttgatatatattcaattttgtgtatgtgtgtgatttttttcacagtcatttcccccaaattatgcatttaaaaataaacacaaaaatatgtcttccctgcagtaagttaaagtaaaactctgatgacttggaaatagccattggaaggtagcaaattcaatttaattcacgtttaataaaagaaaattattcaattatctctgttttcacagctcaaatttctatatacatgaggtaaaggcagattcctaacaatatgggtgagacaaaataattatgagagtaaatattataattatgtaaataacctttggaattttgggactttaactttataacacttacataaaatgtaaaggtcacaaaggataggtttttctgaaagtagttcaagttgaaacaaaaaatgcaatagcataaaatgcaccaaataagctttcataagatttatgtcttgtttctgtttaaccatttactacaagctccaaggtaacgaggggtaaaactacttaactatcaatattctcattcatactcatttaatcctcattattaagtatggatggtactaactgcttcactctttttgaggagttgtaagcatcaacaaagtgatggatgcaatagtaatttgtgaaatgataaagtcccgtacgaagggactaagggattcattcaggactaataaagtcccttgccagatgcctaattgcacatactttcttgagctacttctttcagtaaattgtttagctaaaatgagttttcaattaagtggaatatttcttttgggaaattccttgagaatatcacaatacattgtccatatttttacaacctataaaattttatcataaatatttgaattaatcaggcctct

SEQ ID NO: 477774 - DNA, 897 bp, Homo sapiens
cattactttcaatgttttgcttcaaccatctgagactgtagctaagatgagtgtcctggaagctctccatccaaggatctgtaggtacatggcgggctctgcttcccctggcattgcagcttttctgacacggactgctcatcagtttgagccactatataattggaaacatgggtatgatacatcaggatgcccacagcctgagttcatagttattcctcagcagaagtcagacatcaatggtacatggcaatggatccagaggaacattcccactcccaataccaatgtcattccagataaaatgctctttcaaacaagtataattccctttgtcacatcctctcagttcctctcggattttaaccacagctgtgctgggcaggtccattcaagtctcaagctgccagaggccaccttcatctgggaatttctctgctcttctgtcttggagccaccttcaaagaggcagaagccactcaacacacagcccagaagtatagaggaggtaaagtccatgagggatgggaatgtgccccagcctcttgtttgtcatgaagacaattctgagatgtttactccacaaaatctttattggtagcatgtaaagatatcttagagctattacttgtctccataaatgcaaatgctgacactgcaattgcaggacaagacttacttatacgggcttatctgggggacccaaagtagcctttaaaatgttactcttttattcacttatcaaatgaaaaccacaaatgcaaaatttccgctaaagaattcataaatcccagtttgattgaaactgttctaacatcaattttaaaatatcccatttcctgacactgcattcctggcaaataaatatctccagtttctgaaaatgagtagccttca

SEQ ID NO: 477775 - DNA, 581 bp, Homo sapiens
ctgctctcctacgggagctgaacagaatcaataccattatggacaaaagaataaccaaagatttcatgatgaagactccaaaagcaattgcaatggaagcaaaaattgacaaatgggatctaattaaaacaaagagcttctgcacagcaaatgaaaccatcaacagagtacatagacaacctacagaatgggagaaaatttttgcaaactatgcatctaacgaaggtctgacatacagcatctttaagaaacaaacaaatttacaagaaaaaaacattatgaagtgggcaaatgacattaacagacacttctcaaaagaagacatacatgcaaccaagaagcatatgaaaaaaggctcaatatcacttatcattagaggaatgcaaattgaaactacagtgagataccatctcacaccagtcagaaagactacgattaaaaagtcaaaaaataacaggtgctagcaaggtggcagagaaaaaagaatgcttatacgctgttggtgggagtgtaaattagttcaaccattatggaaaaagatgtggtgattcttcaaagacctgaagacagaactaccattc

SEQ ID NO: 477776 - DNA, 728 bp, Homo sapiens
ggtcaggaaaggctttgcagagaaaacaaggtaagcagcctttggcccaaggatacaagagacacttggatcatgctcaaacccaagccatgtcaagtctacctgatgtttagcttaaagcagaactgcctgctgagcccagccaaagccaccccagatacagacctgcagacttgggaaatgctagttgttgtaagacacccagttttgagatggttgattatacagcattattatggcaatagccaattaatgcatggcattgacaagacatcatttattaagtctgcatgttcggtggacctgaacagcatgtggtggcggtgtgtctggaattggtgggtccttggtcttgctgacttcaagaatgaagctgcggaccctcgcggaatgaagctgcagaccttcccggtcagtattacagctcttaaaggcagtacgtccagagttgttcgttccactcgttcctcccagtggagtcgtggtcttgctgacttcaggagtgaagctgcagacctttgcggttacatctgtgaactaccaccacatcaagaatcagaatgctatcagcaaaccagaaacttattaaaaagtttaaaaatatatgaaacactttaataggcactttacaaaagggatacacaaatggccaataaatatgtgtaaaatgtgctcaacttcattcatcatttggaaaatgccaaataaaaccataacgaggtacaatt

SEQ ID NO: 477777 - DNA, 1146 bp, Homo sapiens
cctgaatgtgagtacacgcactctccacctgtcttacgttctgtgagcttcccaatgaaccacgttctcttaagttacccaaagttaattcctgtaaccaactttgtgatcaaaaaaccttatcagacagagaattatggaaggagtgaagggagaaggtacacttttggaaaaacagaatgggaactgtgccccaagagtagaagacacataatcagacttaataccgagcagactggaataaacatcggctttcagtgtttctcaaatggaagactccaaggcatccattctgccctttctctgccagtgtcagcccctccctcaggaaggacaatatctaggagatctatgaaactcggtaccaagctgtcctccacaacctaccaaagccagagggtggaagaagggacaaatgtcagctgcagcaggtgtcctggtgaagcccctgatacctgggcatggggcaccttcatctgcactgccctgaggaactgtgagctgttggagatgccagcaagcttggctgtgtgctgtggtgaacatgaatgtgtaccggaccctgagcaaggcaggcatggccctgatttcacagtactagggaatcagtctgtgacaatggtcactgtttccttctgggagtttccagaagaaggcattatcatcataagaaatgacaactccgtgagtattattgcccctgaagaccttccagcaggacaaaatgaggaggtaaaagacagtgatattggtgattctgatcctgtcaaaatagctaagatatcaggctttggaaccaggcctctggggtatggattccagctctatccattacaattcgtgtgcccttgggcaaggtactttagacctgtgggccacactttccgtgtctgtgaaataggaaccaccctagttcacaagtgatttgtaaagtgagttaacatatataatgttttttaaaaaatattaccaaattgttttcctggcttcttacaaaaatgtatattcccatcaggaatatatacaacttcctgttgctctacattctcacaaaaacttagtattggcagacttaaaatttgtcttcaaatgtgtacgtagagatagatgtaaagagatatagtcactgagtgtttgaaacacaga

SEQ ID NO: 477778 - DNA, 1423 bp, Homo sapiens
actcctcctcctcctcctcctcctcctcctcctcctcctcctccttctccttctcctcctcctcctccccgcgcttctctggcggccgctcccgctccagctgcggcgccgcggccacatctggggcgcccatgtgcgctcgggggctcggctgcgcccgccccgccgccgaccccgcagccccctgccagcagggtggcctccggcccggcccgggtcccgggctgtcccgggacccagtctccgtctccgccgccgccgccgccaggcagcgccggggcttgctccgcagccggcttggacacccccggcctcgcggtggctccgccgtggtgcggcggcggcggcggcggcggcgccggcagctcctgctcccccggccccgcacaccccgccgcgcccagcgccagccccgcgggcccgggaagcggagccctggcgggagccgaggcgggagccgcgctgccgggctcccgggctcctactcctcctcccccggcgtcaccgccgccgccgccggccgccgcgccgggtcctaaagccgcgcgtctcaaaaggatggtgcgcctggcggccgagctgctgctgctgctggggctgctgctgctcacgctgcacatcaccgtgctgcgcggctcgggagccgccgacgggcccgacgcggccgcgggcaacgccagccaagcccagctgcaggtgagtgcgccgccggagagggccgtgcgcggctgcggggacggtttgtggggcgggggtgctgagctagtgccgggtggatgcagggaggcaggtcccctgccccacctaagagcaactgttttggcagtagttttgcccgggccacttgacttaggcagaggcggagcgggggcacgtgcctggaggctgcacccggcttccaggtctgcgggctgcgctccttcagttctgtctgtcacgggtcaggtgcggggttggtggggaggtgggaaggagcgaggtttgggatgagcagaggaagtgtggagaatgtgcttgcttgggggtgctaccagtctttcatactcagattagttctttcacatatatttaattaatgttaatgataaaacatacatagatatggatatagatatagatatataataaaagtcatctggaagacaaaatatagaatccataggcaataatagtactaataaaggtatctcctttgtctgaaattcaaatgattgcctttccactaaatctcagtcagttttagaatcatgaatttctatatatttttagtattttttaaaactacatataaattacatgcaataaaatggatgaatcttaagggttcagtttcatttttgacagttgtatatgcctatatagttaccaccaaaattaggatatagaacattccccatcaccccagaaagtcttctagtgcaca

SEQ ID NO: 477779 - DNA, 561 bp, Homo sapiens
caccacttgcacccagcgtgagttgaatccttacatatgttatcaaaccgaaatggggtctgcttgcctggcacggtaaggccaaacatctacattgaggtttgcagtgggagaaaggagggtgtttatttgcagggcaccaagcaaggagaatctaggcagctcgtgcttaagacccaatctcctcgatggttttcagcagaaaaagaatgccagccctggcttgtggatgtgaccttctccagaatcatacaaaatgaaactctacagatgggatcaaagaaggctgaagatgacaaagaaaaaagggagataacaaaaggaatagaagaggaaattttagggaatttgttgttagaaggtagaaaaagtggtggaattgcagagaagtgtatatatggggcaggagattctgtgcccatgtgttccaatggatgctcaatgctaagatggactcagcaggaaggtcagaaagaacacagtctggaagaaattaggcatgaaaactgggagaaggtggtctgtattgctttagtataacactgtctttggtgggcattt

SEQ ID NO: 477780 - DNA, 1375 bp, Homo sapiens
ctctataccagagttccccagtgggactgagctctggtgactcacagtggtaccttttttttcatctcggagatgtccagaggctgcaagatgcccaaccatgcacagaggtggagaagaagaagaagaagaagaagaagaagaagaagaagtcaaatatctggagaagaagaagaagaggaagaagaagaaaaggaagaagaagaagaagaggaagaggaagaaagaagaagaacaagaagaagaagaagtcaaatatctggagaagaagaagaagaagaggaagaagaagaagaagaggaggaggaagaaggagaaggagaaggagaaggagaaggagaaggagaaggagaagaagaagaagaagaagaagaagaagaagaagaagaagaagaagaagaagaagaagaagaaaatacaaatatctggagccgggatttgagcctggcccttgacatatggagctttgagagaggcctctcagtgaagagcccgggtcaacccccattccctcgttcaggaaagccagtccacaagagactccctgatgggccttgtcactttgtccctaagagttgctcactggagactttcagagattcaggacctgttcaagacaaacttacattaaaaaacaggatatcccggagcaaatgcgtagtttccagtttcatgacggcaaagagcacagatcaatcctgtccgccattcaaacacgctctggcatcttctatgaacaaaaataaaccctctctttatcctgtggtgtctccttctagctcatgccccatttctctgttcccctttacactgaaccttttcaaaagtgtgttctatactcactgtctccaaagcttcacctcccatggactcttcaacccactccaaactggcttctgcccccttgcccgtgaagctgctattttgaaggtggtagatgacctccatgcagccaaatccattgccacatctctggcctcatcttacccgacgtctgagcagcactggagtgatgggccccatctgcccaagcactgtcctactccttacgacctacaagttatgcctcacctgccctctgcacaagatccctgcattcgattcctcaaggccctctacctggcaggtttggaacactctgactcttcccgtggctggcttctcgtcattctcagaagcgccaatgccacttctctcctagaggccatgcttccaaatgtacaggtcagtaactgggagcaagaacttataagaatggtgcccagaaaagaggcccaagggagtctgaagaagcaggaggtccaatggagctctaaagagaaacctattccatctctaattttgcccaaagctgccttcctttgaccctaagatt

SEQ ID NO: 477781 - DNA, 1701 bp, Homo sapiens
aggacccgaagcgccaccatgatttatctcgccatctttgtgatccttccatatcaggacacccatatagcttctcccagccatgactatggcgtatgcagcagatcccaagccaaggacttggaatgaactagaagaacaaggccatcttaggcaacctcaaccccccaagatagtacaaaacaggtgctcctgctgggccaccgtggaaaatgccagtgaccccttgaccggatgtgacctccttgatgatgtggtctgctgctgccctggctcctcctctgacatgaaggacttggtggggatactcaggctgcttttggtgccccagataaaggctgctgttatatggggcttcttcccaaactgtcacctcaagaatatcaccctcgggttgcagccagatgtcccacttagccgcttccgtgaaagaggcctgctgccctatcctaataatgccaaagatgtgtgcttagacattattctgattacatttagactaatggttgcttgaattgttctcatatgtggtgacagatacctccaatgtataccttacattcattcctttaggaatttttggcagtcatcccatattctgaatgttatatttagggaaactgcttaatatttatcggtgctacattcaaattctcagtaaggaaagaacatcacaaaggcaagtaaaacagaattgtttggggatacatattaacaaaaataaaaaatgagtataatcttttaaaaccatttggaaagtaactattaaggaaacagaaactgtattatgttaaaagaattgtattataacatattaaaaacgtacacttttgatattttcataagtttatatcaattgaactgttattgatttatttttctaattccttggcaactgtttattttaaaataaattatgtggattacttactataatctgccactttcttgtaataacttagggcaacttcacaattctgtagaacattgattcccgacaaatatctgtacccctaaaacacagacagatgcattcttaatattcaagacaatgctgtatttatggcatacaaatttggttccaagaatattttgtttacaaaccaaaatcatctgggacatcatgtttcctccagcacttccaaaggtgtaatatatcagtgcctaaagtaaaaacaaacaaacaaaaaaccccccaaaccaggttggccatttaaatttgaaactcaaaccaagtattccatttttattcctagctccataatgacccattgagttactccaaaataaatttcaaatttcactctcctttgtaaagatgtttgccatttattaggggttaactaatctctggagtctgtgataagggcattgtataagatatttcatttaatcatcataatttccttatgaagcagatattatctatcttcaatgaagaggctgactcatgaggctttaagaaacttatggcataagaacactaaatttctttgactattaagttggtgttttcaactactacactagagctgcaggaatttgggaaagctcacaatagtgggaggtttgtgtaatatacatgaatataggctaattcttactgtgctttagtataaattatagcaataaaaccaagggcccttatatactttcctttcttggaaacgaaatatttttccttcaatatttaaaacattt

SEQ ID NO: 477782 - DNA, 850 bp, Homo sapiens
tcctccttacttgtttcaaagatagtagatgtcttcattctctcttctctcagtctcgctctctctctctcattttctctctctctttctccagcttctttacccacatttctgttgctatgttgtcctcacagttcccaatacttccagcagtgcgggcaggatttctgtaccaagctggcacaaacggcccaagaagaaaggtggtcactgggccagcctcattagagaactgtggtttcattttccttcaaaactcacgttttgggctttacatgatccttctttagccaaggactcatataattggatagctgctgttatattttgcacgccaaaatttccaaatagcaaagcgtcagccattttctccatagctttcaagtttcccatgtcagctgctttggcaaaaaggttgctgtggagattaaatgagataatccatgggaagtgcttggcattgtgcgtggtatagagtaagcactcagtaaatttagctgttattattgggacagttgcattgattctaaagttttatagcatggtaattgttctcctataattaggtggtgtcttgcattccaagggcagtgtgggcatatgggttccatagcagaaaacccaaggcactaaaagggatactagaagcagtatccagggctggagaaagttgctgataggaattgaagatatagtgacacataagacagaagcattttctgatcatatggagcttccatttgtctgtaagaaatacagcaaccagtaaacaaataaatgaacaagttagtatcagatatccatacatgctatgaagagaataaagcaagaaaatgtaaaaagtcaaata

SEQ ID NO: 477783 - DNA, 728 bp, Homo sapiens
ctcccacctggccaactcggaatgggtcatggctccctcctgttcccagcttccactggctctgcggagcacacagccctaagcgtgcttcccctgctgcagctggcatttctgcaagcaattctatatccacccatcatcaactctatcaacctaccagcagctgtaacctgcactgcctcaaccccagacacaaactacttcaggcacatgtttactgggatgtgtaaaatggatctgagacttgacatgttgactactgaactcttgatttttctgaactccaaacctgttcctttcctgacatctcctaggccagtaaatggctccttcatccaccagatgcttagaacaaaaatcttaagctcaccctctgcttctttctctcatacacaatatcccagttatcttgagctttatcagcagaatttaatgtattacacagtgccaaggaacagtgactattttgggggatatgaaccaggaaagaaaaaagggacatagattgttaaggaaaacaagaaatgtctttgattgttgagccctaggaaaaatcagggatttttaagagtaatgaggggaagtgatatcaaaacattcttgtgaaatgtgcacagtctcaggcaggcagttactcattgctttctaggtcaatgccggtgaccttctgcaggggccatcaacctgttcttacgaggccggtcagctcattcccagagttgttggtc

SEQ ID NO: 477784 - DNA, 1021 bp, Homo sapiens
ttctcctattccggggttggtaacctggatttaatttttcaaaatgggtcgtaaagcagcaaagacaacctgccacatcaacaacacatttggcccaggaactgctaacgaacgcacagtgcagtggtggttcaagaagttctgcataggagaagacaagagccttgaagatgaggagcatagtgggcggccatcggaaattgacaacgaccagttgagagcagtcattaaagctgatcctgttaaaactacatgggaagttgccaaagaacttaacgtcgaccattctatggttgttcggcatttgaagcaaattggaaagatgaaaaagcttgataagtgggtgcctcatgagctgaacgaagatttgaaaaatcatcattttaatgaagaagctccaaagcacttcccaaagccaaacttgcacccaaaaatggtcatggtcactgtttggtggtctgctgccggtctcatccactacagctttctgaatcccagtgaaaccatgacatctgagaagtatgctcagcaaattgaagagatgcaccgaaaactgcaacgcctgagccagcattggtcaacagaaagggcccaattcttctccaggacaaggcctgaccgctcgtcgtacaaccaaagcttcaaaaggaattgaacctgggctgtggcagtgagagtgctgaattctaaccactagacaagcagggaccaaatacatatttcttaaattgaatttatcatgagcacattatatgaggattgggtaaaaagtaactaaaaaaatggccaaagaaacaagatggaaaataacttccattttcagatagtaactatttaggaaacattgaaactttggaagtgaaattgttattgtgtaaatattttaaaaaagcatgtttatacatctttcacactctttgagtcttatatttttcctttaaagtcttggaactagacctttatgatattctaaatttaataacacttaacaacttgccctaaatatccctactttataaca

SEQ ID NO: 477785 - DNA, 631 bp, Homo sapiens
gacttaccctccactgtgagagttacctaaagctcggcgtccacgatggtctacagggcttccgaggcgatcaggcagtgtcagtcttcagctgctaagccgagaagatctgggaaggagtcagtcagagagccttgggccagagttccagggggctctgggagtggctgccaggtgagttggacagtccaattttcagtggggtcccacagagatgggacgcggcttacgaggaatcccaggctgcaggcattccttggcccgatggccagatttccagcacttgtagcaagctcctgggggaggaggttctggaggaatgcctggctgctgcggttcaggcgtttggaagttcttgtgtgctggagatgtggctggggtttgtctcacagtggaggcaaggaattgcaactcagaaatatattgctacttggctgtctctactctattattgtacaccttgaagggtctagggctgtaaagcatctcagagttgctgccaaatgagccatgaactgggctggatttttatatttgatgaaaaagagcctaaacactctctgatttgggataaaggaaaaggagcattaaccttgactatgtctttagctctagccacctttttaagagt

SEQ ID NO: 477786 - DNA, 791 bp, Homo sapiens
ctacagccttgctacttaaagtgtggtccctacacaagcaatatgggcatctctggggaacttgttaagaatggagatatcagtgcttgcattttcacaagatctccaggcaaatcccaaagctccccccagcccctcttgcagttgggcagcaggtcctctggtacctggcccctggacagtgcccaatgcaaggcccttagtcagattcctgtgaggcctggctgtggggagtaccaagaggccccctccccccagcagttcccccagtgccagggaacatcagacacacgtctcctggcagtgcgggcaccagcaggcatctgctcatgcccagtgctccaagctgcatgtggagaagtgcatgactcccctgtctggtgcatgactgcccctggttctcaaaaaccatgtacctctggggaggccagctgtgctccagcaaatgacaaacactccctgaaggtggaagagatgaatgaatttgaagagacactctcccagctgcccccgtctcagctctgctgccatgggctgtcccgcctgaatctccacacgtggaggcagctgccatgcaaggacacagctccaggtggaggactggcttcatcccacagcgggtgccattcagcgctgtccctgcactccctggatcccatcaccgggcaaattagtgtggaagctggaacaactatacgtcagtttgccaccgtctggcagaggccccctcaggactgttgattgtggtgaggtactgttctaagcactttccatatatttatgcctttcaa

SEQ ID NO: 477787 - DNA, 743 bp, Homo sapiens
agagctggagtcaccgcgtgtggatggtggagcccaggtcgctgagggtatttgcgttaaaaatagtgacagcacacatcatatttctgagtgaagaaatggcactgcatccctccatgttcataccaatggctgaactcatctctctgggatcgggacttgagccaccttgcgctgtcctcctacctctgggttcctcttctccggttatctgcaccctggctgcctgtctcctgttcacgtctaaaaatcgcctcagggttactctagccctggggaggaattggagagcagtctgcctcctcgtgtcactctttgtgattgtccaggacctttatttgcacgtggcctttatttacagacaagcgccctgccctccaagtgaaaacggcacagaaagcctttattctgcaagtgaaaccaagtacctggggccagtggaggtgacttgccttggcatgtgaaatgtaataaagccttatttacaaacacaggcagctgggccaagggctgtagttttccaatttttaaaattttatttctagctttattgaggtgacccgagccattttacactattggctacaaggttcttgtgaggcttagatgcagaaaaggtgctccctgttcacatggctacagccactgtggcctctttgctgttcttcaaataaatcaggcatacccctaccccaggacctttgcactgactgtgtcttgagcctaggacactttttccccag

SEQ ID NO: 477788 - DNA, 816 bp, Homo sapiens
tgtcttctcgcgctgagtcagttcctggagtgaccctgagaaaggcattcatttggaagcttttctccccgcactctattctaagtgacccattgctcagtgcctattgcccagtggacattatgaagtcctggaggctgccagtctcctcactgtgactggagtcatggctccaggctctgccggcttcatgcacctggggagagtgaccagcagcactgcccagagtcccgtgctggccctgcaggaacaaaggccttgcaggatacgcagtttggtgcctgaggactgtaaattgaatggacaaagatacattaataggagaagaagtacaacttttattgatgctaagattttacgtgcatgggagcttctcagaaaagaaatgaaaacacgaacaagaggaaccaatgtggtctgtctggaacccagcatccaggaactcttgggacccaaaccaggtttgctgcagaatttggagacatgtccatccttcagccagcttcagactctcaattccccagccttccccttgggctgtgcagacttggagattgatgaatgcactgggccacaggaagctgcacagagttctggcctcctggaggacatcaatttggctcccccttttccctttagtggtaattgaatgtcaggataacagatgaagggtggggagaataaaccacattctcactttccacaagtggggggaaaggctttgtggagaaaggaagggttaaaatgttaagacctcaagacttaaatttcagttaagtttggtgtttgttgttgttattagtttggagagaattt

SEQ ID NO: 477789 - DNA, 843 bp, Homo sapiens
caccactgtttgagtgacactttcaagtctctgctcaatgcaacctcccctgagaggcttccctgaccatctgataaaacagcacaactttggcttgtcagaccatgtccctgaaaaggcaaaactattcagggaacctggtgagtgtcagcccgagaaatatgggcagctcatctacatatcttttagtgaccttctggaatgacagccaagccaccaacgcttccctgtttgcaaatgatagagatctcatttctggggacgacaggattgatgtggcagccgcagtgccattagacctggaagatgctcttttctcattactgtctcctggcaacatagcaccagatgccgccgtgaatattaatgatcctcattcatcctgtggtcataatctggactcattcagagaaatgagtggagacaaagctaacttttcatctaaccttgcccacaagatttcagaaaagctcctgtttcaggggctgtgtggagcagacaccattggtatatcctgcctatatcccgtcacacttaccattccaatgccagctgagggtatcctcctacaacatcgctactccacctgatggctttctctcagcctatgactgaaccaagtcagaaataccaaagaggatgctggcttattaaaatattaacaacagtatcttttgggtcttcaagtcatcaaggcaagtatgttcttcttaaatcatatctattgcttatttatatttcattgattttgcaaatgcttcatgaatggatctttttttgcaaactttaatgtcttcctctttaaacagaatagcaacattcaaaaggatattaaaatgagaa

SEQ ID NO: 477790 - DNA, 1395 bp, Homo sapiens
tttgttttgttttgttttccatctaataagggcatagtgataactcattgtggttatgaactcaaatggttttggctcgtattatgttcaggagcttattgtggctagaagatggaagctaaatgatcatctcaatgaaatacataacaaacccactgaaattgtaaatatggaagatttgcaggctttaagagggtatgaactgtttgactttgtgtccaggcaaaactcaaaagaataccttccttacatcctgggagtaatcatggccatagattggtaccacatacccaagacatttcatttggagcaagccaataaagtattcctgaaatacagccagaacagcagaaggaagaaaaggaggagggaagttaacaagaagagttggagagcctattacatctttatatgcagacctggtttatctttgcaatgctggtgcaatcttttatcatgcagataaattctcatttattggatgtatctttactgataaacatttatgttgttttacaatcacaagtaatgctgcaattcatagccttgcacacatgtcattttgcatatctataaaatatttaaagatgcattttatcatttatttctgagtcaatggcatgtacctttttagttttaacagacagagctgacacaccctcactaggtactgtactcctttgcatgcccattagcagacctgtttctacatacttcctgcaaacttgttatcaaacttactgactttaccaatctgataaatgaaaaaaaatgaatttcattatttatcttcatgttcagcaactttttttctccctatttattcttgcatttcatttctttcttctgatccacttctctttttcctggagtttatcctttagtaattatttcaatgaccatccactagagaagcatgaagcatgtaaaactacacagtttcctgagtcactttccagagtcttacccatgctgtcttttcaaactttattccttgtccctaggagttcatgagatttccttttcttctacttaataaaactcaagttgaattgagttagtgcctgttctgtgaagccagtgtcctttctagagaaaatggcatatatatatcacaacttttttactgcatgtgacaacaaaacctgtcaaatatgctaataccaaataggaatgtgtggttccagaggactcatttgatccaagtcaagtaatgctcttcacttagttgtctattgtttcttatgtcaatttgctaagtgctggctttgttgatgggcaactatcaaatatagtgtttcaagataacttccaggtttaatgctaggagaaaaatgaagacaattttccagcaatcttcataaagtctccctgcatttcattagctatgatttc

SEQ ID NO: 477791 - DNA, 680 bp, Homo sapiens
ctcccacctgctccatggagcatggcagcgtcagggacccagctttgccttccaccctgcaccttccccacagcagcagcgggtgacagtggtgacagggagccagggtctggagcggcagaggctccaggtctggtggcagatccaacctggctgtgtgagggtgatggcggtgtagtcagctgccttggggatgcaaggcacaggggacccatcgcttccactgctgctcccgcagccgctcctgccgccactgctcacacctccctgctgcagccaccagaacagaacacagatacagattttcagggccacaggaaggaggccacaggactggctagtgagtggcacctcagatcagaccgctgtagttcaacatggaaaaggaggaatttatctgagaaggatgctgttcccatgaacattgcagagttgcaatttcaaatgggtcatgaactataaaaccaggacttgaagaagaggccaaaataaagagaagcttcaccaggaatttacgtatgacaaacacaataacagaaactcagatgcagcttttatttaaattcagggatacatgtgaagatttgttatataggtatacttgtgtcaagggggtttgttatgcagattatttcatcaaccaggtattaagcctagtacccattagttatgtttcctga

SEQ ID NO: 477792 - DNA, 769 bp, Homo sapiens
gaaactggtccctggtaccaaaaagaaaaaatggttcctttcaaactattactgctcattgacaatgcatgtggtcacccaagagctctgccgaagatgtacaaggagataaatactgttttcatgcctgctaacacaacatccattctgcagcccatggatcaagaactaattttgactttcaagccttacttaagaaatacatttaataaggctatagctgccatagacagcaattcctctgatggatctgggcaaaccaccccaggcttcaacaaccacagcccttatcagcctgtggttatcaacactgaggcaagaccctttataagcaaagagataatggagataatgaaggctcagatgatttttttaagcagtaaactatttttaattgagagtgaaaatatgaggagcaaacctgaaactgacacaagcctagagtccagcccagcccagccgattgacctacggctgatccatggacctataaacaaatgaacatgtatttcagatcactgtgttatagtgtttgccggtgagtgtgtgtaggagtgtatatacttatgcatgagtgtttccatattgtatgtatatgtatgtagaattaaagctgattagactttaggaactgggagaaaagtgggggatatttgttcacttgttcatttagtaaatattaatggagcaactgccaaatgagatgtactgttttaaacactacaactatagttgtaaataagattcacctttctgagacttacatttt

SEQ ID NO: 477793 - DNA, 502 bp, Homo sapiens
ggccatgccctacagtgtagatggcgtttctgctcctctcccatctgcttctttcctcctacactcagtacacatggctggcaaagaagggaagatggagctgccatgtttgatatggctagccccagggccctgccctttgactaagtttgtgactgtattgccttcaaaaaataaaacatcccctggtaaggccatcctaccagatctcgtgcgacttattcactaccaagagaacagtatgaggaaaaccacccccatgattcagttatctccgaccaggtccctcctacaacacgtgggaattatgggaactacaattcaagatgagaattgggaggtagctggagacactggttgtgaggcactacctggtactgaggagcagggttggggacccactttaaaaagcagtctggccacattttcacaaaggagctgtgctcgggggtccactttagcctatgattgccttggactctccaaagtctgaaggctggaa

SEQ ID NO: 477794 - DNA, 600 bp, Homo sapiens
agaaaaagaatgaaagccttgacaaccgtggaaaaaaggctcaattctttgagagaggatgtggtgaaaatacccctgaaaggcactaagaccagcatgggcaaggcccaggaccttggcatgcattctcctaacctgatgaggttgtcagtagtgcatttcggatcatcagctctgttttcaggattggcaattgccttgaggattgttcccgggatttctgaaccaaattccaatatgtccactactcaccttacacattttagacatcatccaaaacgaatatttgaaaaaaaatacttcgacatagagctcctcaatatacaaatattcctgtgtctccaaaagcaatggaaccacagtcagatcatgcagccccttacaaatggccctttaaagtttacagaggctgcaggtggtgtcaaaaatatggaacgcttcacgaatttgcatgtcatccttgcgcaggggccatgctaatcttctctattccttggattgggtttcaactttctcctgaatgttaatgatctttattcctatccataatctgaattctgtttctaacatttcagcttggttaaggaccattgctgggaa

SEQ ID NO: 477795 - DNA, 870 bp, Homo sapiens
cagatatcctgtccttggagccagtctgcaccaaatatgcgttcttgtgtccacaaaattggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagcaatgaacgagagttcctgtggctccccattcttgctaatatttggtgttgtaattgttttggattttggccattctaataggtatgtagaggtacctcattttaatttgcatttacctgatgacatatgatatggaacattttttcatatgcttatttactatctgtatatcatctttggtgaggtatctgttaaggtctttggcccattttaaaaaattggattgttttcttactgtgttttaagagttctttttatattttggatactagtcctttatcagatatgtcttttgcaaatattcaacttgcaaatatttatcctttatcagatatgtcttctgtgaatattcaatttacaaatatttatccttataggatatttcttttgtaaatattttttctcaatctgtggcttgtcttttcattctcttgacagtgcctttcatggagaggaaaattttaattttaataaagcttagctt

SEQ ID NO: 477796 - DNA, 798 bp, Homo sapiens
aaaatcagacaaggtgagctgcctgcaaccagcagcacttacctaggcttgaaggattaaaacctagcccacaggaacacgatgtctgctttgacctggttctttgtggcgcaaacacctgcacaggggcttctcgtaactgccacaggtccaggacagcacaccctgtttccattcttgctggacaatgccagaagtgggacatctcttgaactgaaatcccacgagtctgtgacctttggcttctccctgtttcttcctgctacttacaggcctggtggcagaggctccccaccacagacactgccagagcccactgtgtcccccagcccagaggtcacctgcagcctccatggacaactgacctgcaaatccacagcctcctacctgagcacctgcccctttctgcttaaggacaccctgtggccacaggcgggcacaaggcctgagtatagggcaggccagaagtgtccagaagttaaggattctagaagtggtcctcagtcactgagaaatgagacatggggtgctaagaaccccaccctccttctgcccactgagccaactgagatatgtcccacacagtccccctgaggacacctgggatggttaacgtgcccttttaggctttcctcccttggcctcccttcctagtcctcacttccttcatggaaggacctcctaaacaaaccacctgtatacctaaatcctttcacttggggacctaaaccacaagcattttaaatgctttgaaaaaaaccacatgttaacatgagaattcgttatgtgtaactcatt

SEQ ID NO: 477797 - DNA, 1127 bp, Homo sapiens
tccttcgggctctctcaccttgctgggaggagttgaggttttctaggtggagtctacagaggcaggcaggcctccttgagctgcggtgggctccacccagttcgagcttcccggccgctttgtttgcctactcaagcctcggcaatggtgggcgcccctcccccagccttgctgccaccttgcaatttgatctcagactgctgtgctagcaatgagcgaggctctgtgggcgtaggaccctcagagccatgcgcgggatataatctcctggaaagggaattccctggccccttgcgcttcccgggcgaggcgatgcctcgccctgctcggagggtatagaggagtgtgaaacaaccggcggagctgccacaggtgtgagaggaggggagtttcgacgtctgctggcaggtcggtaggactggacttggggagagagggagcacgtagaggaagagggacgtaaacaagacttcgtaagtgagcagggcctggaccgcagaggtcttttcttcagcagtttcttatgtgatatgactgtcaagcgaccctagagaacaggatgcagctctgccagtgtggtgtgatgaaggcccacgatgtggacagtggtgttgtggtctcgacaggccatggggttgcacagacttggggtcgaatcctggccttgctattgacctgctgcatggcctcaggacagtttattcaattattcagccttctatgcttctgttccctcatctgtccgaagaaggaagtgcttgccacttggagcatggtcatcaataggtgcattacttcaattcccatcgaaccctcattcctccttcccatgttgcccattcttgctgaaatcaggccatactgttttcacagtattctgattaattcaacgatcctgtcaaaaaatattagttccgcacagtgcgttatttgtgaattcattctcagttccaatgatcactgattctttctttacccttgacctttggaagtctgattattaaatgtctttgggtagtcttttttgggttaaatcggcttggtgttctataaccttcttgtacttgaatactagcatctttctctaggtttggaaaattctctattattattcatttgaagaaaca

SEQ ID NO: 477798 - DNA, 686 bp, Homo sapiens
cgggtgataaaggcaactcaagactgtctttcctaccctcttcagtgcctctttccttaatatgatgtttaaaccagttctaagttgctagccaatcgggacaaatacagactgtgaggtcccgttccagccaatgaaaaccagacacagcagtagggtggatgcatcagattataaataacgctatctcctttgttcggtgtactctcgtggcaaaactgctggagagtggcaagcatcacatgtctgagtctaccagtggtctcaatctaagctacatattacagccacctggggaagttttgaaaatcctggtgcccaggctgcatccaaagccagtgaaatttcgttattcagttacattggagcagtatctgagggcaaagccagcactccagaccctgcaccatttttggtggtattccagagaaaatgggatttggtctaggggtcttgtcttccttttctgggccaagcacagggataggctttgccttctctgtggtataataaatggggtagaacccaaggaaattgttggtgggggttgctcggtatgtgaagtgggaaactttatgccccagagctcagcattaccagaaccaggtctggcttccgtcctgtgcaagttattagaggcctgaccctttcaagccatttgacctctgcatctctcatatttgtac

SEQ ID NO: 477799 - DNA, 844 bp, Homo sapiens
ttaagacctgagttgatatgacttctacatccaatttggggaatgaaggagggaactttccacagaggatgtatgggaaagccctgggtgccaaggcagaagcctgatgcaggggcagagcccttgcagagaacttctactaggtcagggctgagggtaaatgtagggctggagaccccacacagagttcccaccagggaactgcataatggagctatgggaaggggcccaccatcctctagactcaagaatggtagagccactggcaacttgcacccggtgcctggaaaagacacaggtgctcaactccaatccatgagagcagtcatgggggctgcaccctgcaaaaccacaggggtggagctgcccaatgccttgggagcccaccacttgcacagtgtgacctggatgtgggacattgagtcaaggattatgctggagctttaagatttaatgtctgtcttgctgggtgttgaatttgtttaatataattctattttctctcttttattagcatattagttatgcttcttttttcttcttaccttttttagtgctcaccctaaagttttcaatatgcatttataattaatccaagtccactttcaaataacactatactcttcacttgtagtctttattgaaggacacttggcaaataaaaatggtgtatatttaaggaatacaaggagcagtggttcagtagtcaccaatttgatgttcactgtgactttatagaacatatactactgcgaataataatagactgtatgttcaactttaatgcctaatagtttactaacatgatcgtatgatctagggagctttaaaaactgcccttggt

SEQ ID NO: 477800 - DNA, 582 bp, Homo sapiens
tatctgagctgcagagcatacacagttgtggggaggatcaggccttggcttgctgctatattggaccctggatagaggttgggaagtccatggatgaattttaccaaggtccacgggtcccctgagatttcaggcccctctgctgcaggtctgctggagcttgctggaggtccactacagaccctgtttgcctgggtttcaccagtggaggatgaagaacaacaaagattgctgcctattccttcctctggaagctttgtcccagaggggcccctgccagcagagcttaagcgtcctgctgggagatttgctgctctcttcagagctggcaggcaggaacatttaagtctgctgaagctgcccctacagctgttccttcccccatgttttctgtcccagagagatgggggttttatgtataagcccctgactggggctgctgcctttctttcagagatgccctgcccagagagaaagaatctagggaagcagtctggcttcagcggcttcgccgcactgtggtgggttccacacccagtttgaacttcccagcgtcttagtttacactatgaggggaaaacc

SEQ ID NO: 477801 - DNA, 689 bp, Homo sapiens
ctcttctctgtaaggggaagtccctggatcctggcaatcagagggctgtttctagtgtgctgtgatggacgtgcttatcttccgctgcagttcatcctgcaacagtaaaactgcaggcagcacacagacaagtttctgccgacaggccagataccagaagtataaacaagagtgatgcctgaaaacaacaacaacaaaaacaaagacaaaaccaaaaccagacaacaacaacaacaacaaagacaaaaccaaaaccagacaacaacaacaacaacaaagacaaaaccaaaaccagacaacaacaacaacaacaaagacaaaaccaaaaccagacagcataaccacctaccccccaaccaaccaaccaaaataaaaaaccaagaaaacagaaacaacaacaactacaacaaaaaaccagccaccatccccccattccttccctcctccctcctgcaatgtaagcagctaactttgttgctgatttctcttacccggaaggtttttgggggcagagggactgttgatagaaatatggatgttaaagtttcaccctgtgtgggggttgtcaaacaccctatacaggagtgttcctactggcatcaggttggtgcccctcgaggtcagagatcccagaggatggagcaggcacccatctttgctattctccagccttcttgagtgacatctct

SEQ ID NO: 477802 - DNA, 610 bp, Homo sapiens
tgcaaaagcaataactggtccctgtgagggcagtcttcattctgcctcttccctctccccagacagcttaaagctgttgcttcatctgaacgtagggtctgggaagagggcacgatgtgtacctgtattttagtggcatcacctgcacacctgctccactctggggatgttgttccagtctcttttctcatgagttcctgtttaagcaagtctcctgaaccctgggtcacagttttcttgcctgtaaaattagaggttggactaaattatcttggaatggatggccctcagaccgtggacaagcggagacttcacatagcttatttcttgggcttcccctcaaatgtctgtttgaagaaaaggttttgtgaaaaaaaaatccactcagaaatcaggtcagtggttgcctgggagcagggagtagaagcacgggcttcaaggagaggcaatagtataaaaatatcatgtacattcattcttccagtctatttgttgacatcttttcatacacacacacgtgcgcgcacacacacagacacacacactcctgaaaacaaagtcttattttgaacttttgtttgtaaatttatgcaatcagtttcagagtata

SEQ ID NO: 477803 - DNA, 1980 bp, Homo sapiens
tgccctagacagcttttggtgcaagaagcatgagagacatgtgaagcagacctgcaccccacttgttgtctggagccaagcccacccaagcccagcccaggtcagccatacttaagcccaaatgcaggtcctgaaagtatccgcactgtacagatgaggaaaactttcgcccaaggactcagtttctcttgaacttcttcttggaaagcagctgcacgtgggttacttacctcttccttgcctggtactgtgaatgcacagcctttcccaaacccaggctggtcatgctagggtgaactctgagcaggatccttgcactatgcgagggcggaagtggacaggactccagctctctttgagctcagccctcatttcacagccagaaaatgccttctgcaaggtcacagagcttggcctagcagccccctctgtggactccaaggtggaaggaactcaaattcagttttgctacatgctgaccaggcccggtcttgtgtccgagtggcatgtggctgtaagctgctgtccctggtgggctcagctgtatggtgactctttcacagactgtaagaaaggccagtggtcctggaatgagggtccacatcactccacgcagacccccccattttcatcccggctgtcccaacctccagtccacacggggctggtggtgtcaccccaccaccctggggctgcacctccaaaagggctcagcttcacatgacactccttcagaggagatgctctgggcttcatctgtggggcagtggatttcccctcagcctccctcccaggggcctagcagaaggggaggctaatccacccctgccagagcgtcccagattgtaactggatctgtgcattggggcccatattgcacaaggacagtgtctgctcaacttgcctcccccagcatccttggctttaatgtcaacagccagtgcctgaagccaaaggggtgctgattctccattggagactgggcgatttcccaggccaagtgtctgcatgagttatacatatgccttgctgatgctgttgttgaagagagaggaagatttttggtagtaaacaaggaaagatgaaatgaagggagggatggcaaggggtggttccctgcccagcctctgagactgcttaaaattcccagggggagagccagagacaaaaggcaatagaacttgtttacacaaggtgttttgagatgctgagcacaagcatccatacttcaaggtccaggcaaagaggtgcagcacagaataggggagcaaggcatcctgttctgctccggcaccttgggaatcagggtttgggcagctctgggaggagggatttacaagagtgtgctcacggagggcactgatattgatggccaaggaccatgacaagggcctgcaatagaacatgggaatatttgtgcctttacatctgtaaaacaccagctgggaacattccaaaatagtgggaggagatgagggaggacctgtgtccctgcatcgccaggtgcagccttggagctgggacaggtatatgatgtgagtatgtcctcatcgtgttcatagtcacgggtgtttggggagggtaatagaaggttaaagatacagtcacaatcatagccatttttggtaaattgcagtggcagtcatgtctgtgtgtatgtggctaaaaagtgaaagacaaaagttgagtgggtgagtgtgtaagactgacatttataccaagtacctgagtcattctgaagcaggtggcctaccacatggccttgttgattaaaaaaaaaagaccactcttccatgacatgtctgctacactgagaatcctgtcatttctgtggctgggatttgaatctcagcaggagaagaggagttgggaatttttaactgaaaagaggccatatggcttcagtgtttcaatatggaagatgtctcctagagacatcctggggacattgtagcagtcctggacctctccagaaggtgg

SEQ ID NO: 477804 - DNA, 829 bp, Homo sapiens
tttgccatcctatggtcacccagaagagaccaagcaaatcatgtcacccctctcagtttggactctcccaaaactaaggacttttcagataaggacttggatacaggacatctccttaaaaatcatatgcttattatcaaaaaccacacagaaaatggaggtgagactcttccaggactttcttcatgcagaaacacccatcccctgtggatgtactttgaaatccaaggaggagttccttatattcacatccacatatctgtgcttctgcctgaacttcggcatgggaggctaccctccagctcctccaggctccaagaacaggggttggaggatccaggctgaccctgcccaccctaactgcagaaagcgctcccttgatgggcgtctgctggctgcatctttggctctggctgtcctcacagttgctatggaaacgatgaagccccagtgtgatggttatagcttaatggctgcagaaagttattttgtacaatgattggatattatataaatatatacatatataaattataaataatatatacatatatgtgtacagcatatatagtatatacatatatagcatatgtgcacgtatgtatatgttacatatattatatataatatatacatatatgtatatctaatatatgtatatattatatatttatatgtatacaatatataatatatgtatatattatatacttatatgtatacaatatataatatatgtatatattatatacttatatgtatacaatatataatatatgtatatattatatacttattcatgtacacacataatatatatgtatatact

SEQ ID NO: 477805 - DNA, 545 bp, Homo sapiens
cggttcagggatatgtctggagatctgctgatggccccatagaatggagggtcatggcggtttgccatcctatggtcacccagaagagaccaagcaaatcatgtcacccctctcagtttggactctcccaaaactaaggacttttcagataaggacttggatacaggagtccatgatgtgggaggaaggagaaagcaagtgctgcaacaataaaataccagggagaataaccatatgggcaacccagacaaaagtaaggggttgtaggaagatgagtactagaagcatgcacagcaaagaaaaaacaggggaagggggaaacaaaagtgaaaaagaaaggcgatcaaagaataaaataatcaaaacaaagcagggaaaagaagaaagaagttgtgattgggccagaagcccagctccttaaagcccttagtggttcactagctcatttatctgctagtctggccagctttctaacaagcaccaggcatgtgggcaggtgctaatttgcaaggctgatttagcaatacattagttgctatggaaac

SEQ ID NO: 477806 - DNA, 617 bp, Homo sapiens
ggtccaggatttctcctttgcaatgcctggaaggatttttttattttattctttactctttctattgagacctttcaaaagagctagagcattagtacccaaccgcaaaggaccccaaactgggaaggaatggatccgtgacccatttgtgaataagccaggggaattgactttgtccgtgacggaagagggtgaactgcttgtgattgcaaatgatggtggccttaaaagtatgtttgagaaaacttcaaatctccatacgttcttgattaaagtcaaggcaaaatatcccgagatggccacaaaagcactgaaaaccttgcttccatttccaacatcctatctttgggaatcaggattttcttcagtgaatgcagacactttgggggtcactgtctccatcacccccagatgggactgtctagttgcaggaaaacaagctcagggctcccgctgattttacattatggtgagttgtataattacttcattatatattacaatgtaataataatagaaataaagtgcacaataaatgtaatgcacttgaatcatcccgaaacctgaaatcatcccctaccccactagtccatggagagattgtcttcctcaaaacc

SEQ ID NO: 477807 - DNA, 626 bp, Homo sapiens
tcacgagaagagtcagcgaccacgccatgtggcaaacctcagcagctgggcctgtgtgctctgtgaatgctttaacttgtcctgacttattaagaccctacacactgccctggcctctttttgacccctcctactgcttctggatcttccaaataagctcccacagtctaagattttatattgctggctacgaatatgcaaacgaacttcccttcatcttttttgccttactaagaaaagaaacacaagtttcaggttacctggggcctgatagtaaggagtttgaatggaacacaatagagggagtaaaatatagcgttgtttcattaacggtggagttggattgcagaagagcaacagatgggaaggagagggcgcggttctctcctatactgcctgctgtggtccgaaaaggacttgatatgggaattcaccaggatcttccctcagacttgccaggcttactccccgatcttccatcatcttcctctcaccactatcatccgaatctcacacatcttctaaggcctggacacttcttgcttcctctgagaatattcctctgacgattttgccttataccaagccctcttatttatacatttctgtagcctttacatttctat

SEQ ID NO: 477808 - DNA, 733 bp, Homo sapiens
aataccatcaccttggggaggcaaactgccaccccaaaatctggagagatgggtaggtacagagaatctgctcacctggagcagaagctgctggagccacaaatggggagaccccacactttcatggatttacatctaagagcccaatcaggttctatacagaagaatgaaggaagatctcctgatggctttagcaggaggaagggaaagaagctcaaaggcaatggggaagcccaaaggcaacaggaaaaacaaaaactaaaatatcagacaaatttgaagcctctgacacctgcagagtggattaaaaaacaaaatccaaataacaatgtctatcagaaaccatctttcaatataaagatccagcacccctgtcaaaaattaattcatcataaaagtatcaatttatttctggactttcaattatattgcattgatctatgtgtctactgttacatccataccacacagtattgattcctggagctttgtaaatagtttcagcaggattggtaccatctcttctttgtacatctgatagaattaagctgtgaatccatctgttgaaggtcttttttggttgactactttaaatgcttaaacgttgggaatttggttcttgtggttttccatatttaagaggtgtttaaaagcaaatgaaacgtggaaagttgaaaaaatgaaaaggtatgtgtaatcgtgagtgctgtaacatatagttagctatgaatac

SEQ ID NO: 477809 - DNA, 3285 bp, Homo sapiens
gccgccctgggcctgctggcggtcgaagtctccgttcctagaaaatcacctctgccctgaagggtgaatcccaaagtctccagggagtgtacttgctgcgaacctaactccctaattgctatattcttgaattgtgggctgacctaagccaggtggaacaatttagctttaatgggaagatgtcaatttgtaactaagtgtttcataacgaaaaatctcctagtatcagtcctggtaaactcacagcaagagcacggactcagcccactaggggacttgaaccagctcaccagatgtctaattaatgcccgctgtcagctgctcagatgtcacttacggagcttctctctttgcagccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtaaggccgggcacagggggcgcaagccacgtgtctggagagctccatgaaagccattcatatgtttactggggcacacacactctgggtaaagagcatccctctgcctggacagctgctgctctaaattcataaaagcacccttcagggcccgcacacataaccagaattatgtccgcaaaccctcccagaaacccattccaagaaaaacattctgctcgaggataaaaatcacagcaagttggagaaatgtcattctttaagctgttgtccaaaagtctaacacatactgctcgccctagcagaatccagacgcaaccaggcatgcatttgtggtaaattaatttatgcctcaagaggctaacatttggctgtggcaatgggctctcgcaaaagtattgcaaacacgtgcaccttctgtcgacccttattttattttgtctctcagttatgaaaataggaaatctgattgattggtttcccagtgtccatgctttccttttagttaaactctccatccacatttgagtaaagcattgctggataacactgaagctgttcaatgtcttagggcagcagattttaatattccactttgtaatatgcatgagtgtttcatgtagtttacagcagtaaggtatttctccagtgacaagaggcttactctaactcaaggatgaagtcttagaccaagtttgtgaaacccatggcccatgggcccaaggtggctttgaatgtggctcaacacaaatttgtaaactttcttaaaacattatgacttttttttttgcagttttttttcttcagcttatcagctatctttagtgtttgtatattttatgtgtggtccaagatgattcttcttgtttcagtgtggctcagggaagccaaaagattagacaccccacttagaccatcttgtgaatagttgtgggattcgatgcgagcctgtgtatgacagttttccttcacgtcgccaagcgcagaggaggcagcgcatgaaggagacagggtctccacctgggtgttgccacagaatgtgctcagcagctctaagcatcacttaccctatattttctgccttggccgcacattgagatgacctgggtgctttgaaaacacatccatgcctaggctccgcccccagaggttgttttaattattctagggtgggacccagtcatcagtatttttcaggtgccccacatgcttctaagctaaagctgagaaccacaagcttgcactttcttgactaagaattcctcatctataccttagaatagcacctctcaaactgctgtgcacatgaatcccctgagcttcttgttaaaatgcagattaggagcaggaggccatgggatggggagcctgagatgctacattttcttttcttttcttttctttccttttcttccttccttcttttttccttccttccttccgtcctttcttccttccttctttctgtccttccttccttccttctttctttccttccttccttcctgtacttttaattccatttattgttggatgagtctattcctgtgccgtaagtttccatttcttcagtttcttctgggctatctttttcttctgcgcagcctcttctggtttaggaacaatttgttccttttcaataaggctcatctcactgtggcaggcagagctcacacatgggttaacctgaccctgagctctgtgagtctggccacacatcttgggtactttgttcacctggctatgctcaatgaccagagaatctacatgtaaacccttacgttcagcatgactctgcatttttaagcatgtgcagcaaacattcagcactctttttgggccactgaccctgtgtccagtcccactgtttggcctggacgcacctaccaactccacctttgtaacgtcagaatggtacacactgtctctgtcaagtgacatctttcagatactgggtggctcttgatatatgcataccctgacggcctgagcagtttcacaggtgttcttcaatgaacacgaagatttgaacctctcgatttgcctgagttcacatttccacagattgtcaggccacttaggggaacaggaagatgttacatttctaacaagctcccgggtgaggccagtgctgccagtgaatgaacaaccctttcagtagcttggatcaacctctgaagaatctctctcctcccctcccctcccctcccctcccctcccctcctctcctctccattcctctccccttccctcctctcccctttcctcccctccactcccctcccctcctctcccctttcctcccctccactcccctcccctcctctcccctttcctcccctccactcccctcccctcccctcttctatcccctcccctcctctccattcttctcccctcccctcccctcccctcccctcctctcctctcctctcctctcctctcaattctcaaagggtataaaaggatatttttatggttaaaggataaatatttactgcagggatacttcgttttgatatttaagtattcctctgacttgttaaaacattaaacccgacagaaatgccatatgcacccccttagcttgtcttcctgtcacctgcctgccaggttccagctgctgccacgactgcgtactttggaaactgagtggaagacccagccagctgcccagagcctcgggcatctgcccatgtgtgcccagctgcccctgcagctttactctgtggcacattaagctcttgccctttttacaac

SEQ ID NO: 477810 - DNA, 1211 bp, Homo sapiens
gtgtgtccttttgtttagacaaaatccccaggaatgtttctaatgttgtttttcttgtccacatccctcctccagggtttagaactagtaaccggcagtgcgaaaaatgggacttacttccgaattcatattaacaagtataaaatggtggaaaccatcacgtgcctttctagggagcccttccccgcctccaactacatccgcttgtttggccagcacgagcaactcctcaacaacctgtgtgctcggtacgatgaaaacctgatcacagatctctataggatgatgtctgtagctgtggttcgtttgttctccctgctgtgtggtattccatcatataatggtcatgattcagtcatggcttttcctgttgactgtatttacactggttccagttcagggccattacaatcggacgttgtgaacactgtggacttttataatcaacttgtcaagatccatgaaaaccccattggatttgataggaaatgcattaaatcttagatcaattaggcaagaattgacatatttgatattgagtccaatatcataacatagtatagctctcaatttaggtattctttaatgtctttcaataaaggtttatcattttatccatgaatggcttgcacaacttttgtttgatatgatccaagatgctttatattattttttctgttttaaatgtcattttttatgaattgatgcttgtgtatacagatgaactaattttaattaagaaagttccttttgattactggttttctaagcattcttaccatgaatggatttttatttttatttttcggaaagagtacttagtccctgaaaccttttatgtgtaaggatgtcttcctaatgctttcaaatataaactacgttttggtaagtgtcaaaatttaaaatcatgagctttccctcctcaaatctttgtaggcttggctccaatacttattttaaataatgaaaactgcaagtatttaaaaaatgaattcatttgctccttcacttatatataggattttcttggtcaaccttacccaaaatatttgagttaagggagaattagctgtttgttacagaaagattttggttggtggggaatgatatgctaagactttccggaaaaaaaatgttttcacatttgaccatattcagggccctacctggtttgtttctccctaaatagaaggtgattctgaaacagactc

SEQ ID NO: 477811 - DNA, 850 bp, Homo sapiens
gccctcacgcctgtgtcaaacatgtgaagggcactgagggtaccatgggtacaattttgtatgtggcttctgttatatttctactggacatcactggtctagatagaaaggtgaagaaagtgagtctgttgaccgcctcctgtgagcatcatttcaaatgcaaggatgaatgtgcagtgggcccagcatccagaggtgctctgacagcaagagatgacggacatgtaaagagaaccacaatacggcgctgcgtacagaggcacggggaggatctactgaagcactggagaaggagtcggtgtttgcaagggaaaccaggcccgggaaagcgtggaggcacaaagcaggcagggcctgctgggaatgacaggtggtttgactgctctaacgtccagtcggatgcaagttacttatcaaagcgaagcagcactgaaaccagcctgcacaaccacagctggcgcttccgcatggattctgactggagagaagagcagtgcctgaaagcaaggggtgaaatcaccttctctaggattgggtagatagctccacttcctcttggggaagatcttgattatgtcataacataaacataactaaaataatgtttctcttacctaaagctgaagtttctctttaaaaaattacttgttcattgtctctttcccataaaaggcaagaagaggacaagggtgggcactatctccactaccatttaatattgtacatgtaattccaggcaattcaataaaataagaaaaataaatagaaagtagaagtattggagaggaaagaaaaaaggtgctgttattgtaactgataatcatctgtcaaagaaattccaagataatct

SEQ ID NO: 477812 - DNA, 2368 bp, Homo sapiens
gcaaacatggtgaaacctcgtctgtactaaaaatacaaaaattagccaggcagtagtgtgtgaggggaggtggtcacactgaggggaggtggtcatagtgtgaggggaggtggtcacactggggaggtggtcacactgtgaggggaggtggtcacactgagaggaggtggtcacactgaggggaagtggtcacactgaggggaggtggtcatagtgtgaggggaggtggtcacactggggaggtggtcacactgtgaggggaggtggtcacactgagaggaggtggtcacactgaggggaagtggtcacactgaggggaggtggtcacactgaggggaggtggtcatagtgtgaggggaggtggtcacactggggaggtggtcacactgtgaggggaggtggtcacactgagaggaggtggtcacactgaggggaagtggtcacactgaggggaggtggtcacactgaggggaggtggtcatagtgtgaggggaggtggtcacactggggaggtggtcacactgtgaggggaggtggtcacactgtgaggggaggtggtcacactgagaggaggtggtcacactgaggggaagtggtcacactgagaggaggtggtcacactgaggggaggtggtcatactgtgagtgaggaggtagtcacactgaggggaagtggtcacactgaggggaggtggtcacactgaggggaggtggtcatactgtgagtgaggaggtagtcacactgaggggagggggtcatactgcgagtggaggtagtcacactgtgaagggtggtagtcacactgagaggaggtggtcacactgaggggaagtggtcacactgaggggaggtggtcatactgtgaggggaagtggtcacactgaggggaggtggtcatagtgtgaggggaggtggtcacactgaggggaggtggtcacagtgtgaggggaggtggtcacactgaggggaggtggtcacagtgtgcggggaggtggtcatactgaggggaggtggtcacactgaggggaggtggtcacactgaggggaggtggtcatactgtgagtgaggaggtagtcacactgaggggagggggtcatactgcgagtggaggtagtcacactgtgaagggtggtagtcacactgagaggaggtggtcacactgaggggaagtggtcacactgaggggaggtggtcatactgtgaggggaagtggtcacactgaggggaggtggtcatagtgtgaggggaggtggtcacactgaggggaggtggtcacagtgtgaggggaggtggtcacactgaggggaggtggtcacagtgtgcggggaggtggtcatactgaggggaggtggtcacagtgtgaggggaggtggtcacagtgtgaggggaggtggtcacactgaggggaggtggtcatagtgtgaggggaggtggtcacactgaggggaggtggtcacactgagggaaggtggtcacactgaggggaggtggtcatagtgtgaggggaggtggtcatagtgtgaggggaggtggtcacagtgtgaggggaggtggtcacactgaggagaggtggtcatagtgtgaggggaggtggtcacactgaggggaggtggtcacactgtgaggggaggtgggcacactgtgaggggtggtagtcacactgagaggaggtggtcacactgaggggaggtggtcacactgaggggaagtggtcacactgaggggaatggtcatactgtgaggggaggtggtcacactgaggggaagtggtcacactgaggggaatggtcatactgtgaggggaggtggtcacactgtgaaagaagatgatcacatgtcagaacagcagcatacaatatgagctcaaaatcttgtataattttagtaaggtaattgtttttgggcctggaggatgggagggtacggagctggtgtttaatggagacagcgtttcagctgacgaagatgagaaagtcctggagatggacagtgagcagttagcccatcaaatagaagatgaggaaatcaacccgactgagaagcccaggcaatacctcaaaagagtttttgaggaatccatctacaaaaccctggtggagagaagcactcttgactacctgcactataaccgctaccacctgcccatgaaagcttacatgacctttggaaaggaggaggctgtatttctgtttcaaattgcagatgaggagcataaagtcacagaaaagttgggtgctcaaggggttcacacataggttttagattagaacgtggtaacgtggtaatgggaagttcatcaaagttcattttctttgatccttagcactgttgctttgcattgaggggggcggggtgaaggggtccct

SEQ ID NO: 477813 - DNA, 537 bp, Homo sapiens
agctaaaggtttgtaaatacaccaatcagcactatgggtctagctcaaggtgttgtaaacgcaccaatcagcaccctgtcaaaatggaccaatcagttctctgtgaaacggaccaatcagctctctgtaaaatggatcaatcagctctctgtaaaacggaccaatcaacaggatgtggaagaaatgactcaggccagtttaccagaggatagaaagcaactccctggctctgtcctcagccatgtcatagaaaccaggattcctcttttcctgaagtgggtcatagaaactagaactcctttcccccaaggcaagccacaaaagctagaaaggacactctctgatacgcctcctctgaaggtaggccataagaccctcttccaagagggatcctgcttggatctaggaggaagaaatgctgtatacacagaggccaataatatgaacaaacattttaaaaatcttaaataactgtaaaaaattaaaagataaaaaataaatgataaatctaagaaaaaaattaaaggccagttgcat

SEQ ID NO: 477814 - DNA, 732 bp, Homo sapiens
agcagacaccaagatggagttaggagtgcagaggatttactgtgtagtagcaccttcgaatgaaaaaggccccggtgaaggtcacacccttgaccactcagggctggccagctgcagtctataacccacctgccctgcgagtcacaggtcagggctgcccccgaagggtagtgaattcccaggcactacttgttcctgtgcctgcaggcaaatactgctccccttcaaatctgagttatccgtgtggacagtttagggcaggtgaaccagaagtcatcaaacttccatgtggtgacaccaagaatggcggggaggaaggctttggtttggttaatcctgaaagcagagcctgcgacaaggacttggatgcaggacgttcatttggaaggagatcccagggagctggagtgagggatagaaagatggaaggcaaaaagccaataaaagatgtgtcatcactgtggacaactaggctcagtctcacctggggccctcaggggaactgtgtggaacatgcctcagagatgcccctctgaaagatgggagactaggatgcttaccgaccagctcccactcccttggcagaagatgtccctggagcattaactctccttcctccctgcctttcctgccctcacttcaggcagtatgggcttccctggcttgggagaaagccccatggcagaaaagtgaagagctgctgtggtggcagaagtgggacactcttggtgt

SEQ ID NO: 477815 - DNA, 802 bp, Homo sapiens
gtaagcattaggagaaagaagagacaatgaagaaaactgagaatgagtgtccacagaagcagaagaagcaggaaaataggggctgtgttcagctggccgcagggctgggccggaaggtccaggcagtttccattcactcctggcccttcaatgctgctgcatgtggctctctttcccatgctgtttcattgtctgtggtcatcctgatcttccttcccatgcggcgggaaacaatagtaacatctgctgaagagttttgcataagggtgaaaatgaggccatctggaagaagcagcagggaactggctaaagcccaggccactgcccaggtcacagcaggcagtttgggtcagaagttcagcaggcctttggaagatgtggatgttccattaccaccagcagttggtgcctgggactgccaagtcagctgctcctgtttatgccttagcatttcacaccagtccatctcacccagaagggcacatcagaagctgctgtctgaggctctcccccctctaattccaatgtcctctggacatgaaggtggattccagaacatgaactgtgctaccactaagctgagaagtggaggatgggactagagtaagttaaaatgccacaatctgttcttatcaagattcagtcatatttttaaatcctcacagggatgctacaagcttttggttagtttccaagttctgaaaaagtcaattctgccaaattttgccaattttttcattgctttcatagaagcctgaactttcagagatccttacctagccattttctctgatgtcaccct

SEQ ID NO: 477816 - DNA, 667 bp, Homo sapiens
gggcagcgcctggcgtttgtttgcttgaaagccctgactgatgggggcgactgcatcgagttttcatcctgtccgccttgttagactacacgcgcggtgggggcatcggatgatgcagcgtggctgctgtcgttttggcaatgctgttgccggggggcaggcccctggcccccagcttggattcgcagaccccacggggccgccttggatgtgcagacacagcagcgcgtgcgcgctcagcgggcagagctttgtgccccgggcctcctgggacgaggctgcaaaccttcagatcccagcacagaccccccggcttccctctgcccgcaaacttctcctaattaagccagtccatctaattacggggtgttccatcaaatatttctccagatgcttccgatgcagcctgcgggcgctggtcaaagctggcgaggcttgtgatcagggctgccggccctgcgagggccgcgcgcgttcccctctctcctggacgtgcctgtctccaatactgcacaatccgccctcactcatttgctccgttgcctgtcgaaagcacagagcgtaattactaaagttaagaaaacatccctgtaattagccaggcaactctaagcacaagaaatggaaattagtcacagtaccataaattagtttgtgcatacattac

SEQ ID NO: 477817 - DNA, 466 bp, Homo sapiens
aatttacccccagccccaagatgatgatccatttcatcaaatgtgtcaggttaactttcctgcgcattacacttgatcaagacatgagcattccagtcttcgtgctgctcttcatttttccagggcaagatcagctgccattgatgctgctaaaatctggggccaatgcaggtgattcctgccatcctggctccatgaggatgtttgaggacaaaatggagctgtgcataagaaagtccacagtcactatgtgccaagccctgtgctgtgatcttcattcaccctcatgggataaggattgccacgtccaggctgcagacaaagctcagatgcccacagctcatacaaggattcaaaccaacctctgtttctccaaaggctttgggcttaaacactactcagtgctattgaggagcaaaaagaggaaggaccatgactgagaccaaaaaactggaatttgggctgt

SEQ ID NO: 477818 - DNA, 1272 bp, Homo sapiens
ctttacccataaaacttcttgagtgaatttgagtcagtcatgatggcagggcaggcaagacccaaattggggcttagcccaggaaggttcttgtctttgctcaggaaagaattcaagagcgagccagtggtagaagaaaacagctgtattgagatggcaattttcatgcgtgtccgtgtgaagagaccaccaaacaggctttgtgtgagcaacatggctgtttatttcacctgggtgcagattacaacatgccccttgatagatcctgataaatctacaggatcaaaatgctataaattagtatcatacaattttcagacgattaacacccatgaaagcaggaggaaaattacttcagagaaaagcacagaaatgaaggaagaaatgaaagttctatatacgttctatgacctcgagcaggagctatttccaaatacagtcacactccgaggtactgggacttgggctttgacctatgaattttgggagaacacaaatcagcctacaacagcagaatgtttacaaactacaaatattctaacccaagacgttcttgctggaagactgacaacgggcttgactacatgaacatcttaagggtgtcctttggtggggacctacactgtccaaaatggtagccaacagctatgtgtggctaccatgttcaatagccaatgtgactgttgaacactgacatgtggtgagaaaccgaattttaactaatttaaacttaaaaactaaagaagggtaaaactatttttctgctgaagacagctttattgggttggtagaaacacatttaattgcaatcattacaaatttagtgtctggatagagatgtgataaaaatgtaaaatacacactggaattcaaagacttagaatgaaaaaagtgaaatatttaataatttgtatattgattatatgttgaaatgaaaatacttttaatgtgttgagctaaattaaatatattaataaactcaatttcaccagtttcttttctttttttaataatgtggctactggataattttaaatgacaggtctggtttgcactatattcctcttgaacaacattgggttagagctttagctcattgctcaccaaaagtgggtcagcaaataccctaaaatatgcattccttttgccaaaaagattaaagttccaggttcttttgtgtcctctgtacaaagattaagataactgaaaccaaccatttattcttggatactaatatattattaaatctcccattacttgccatatttgtaa

SEQ ID NO: 477819 - DNA, 542 bp, Homo sapiens
ctgagccatacatgacagtgcttccagggctgcaaatggacttaggctggcccggtgctgctttttgcctggctttccatcgcctgcttggaaagtttcctcatcctctggattctaatggtcctggttacacattagttgaccaatggccttggactctggtatcactcaaagacctggtttccaatctaagccaaagatcttggatgggaccaaaagaaagaaatcctgaattaaaacagagcttacactcaaggctagaaagattcaaggtggaaggagcacaaacagtgccctgggggaaggcaaagaaattgctttgccgtctgaataaaatagtttgcgcattgattttatctgggagtgaggagatactgacggtgacctctgagcacaagaggtggaagaagcttgagattctcccagaagctcagcagatgctgatgccatgcttcttctacagccagcagaacagagtcaaataaaccttttttctttataaatgacccagccttgaaaccaattcaaagctcaactactgc

SEQ ID NO: 477820 - DNA, 1441 bp, Homo sapiens
gaaaccgcacacttcgaatcacagaagtgtttacatagggcaggctggaggggacgagagagaccttggttgatggtgactcagttcataaacacagcatcaatattgatagactccaaaagatgcatatgcaggacatctctcgggatttgcagggaccgactgttcaggtgaacatcccgtactgttcgttcgagcaggacacggcagatgcttctttcttgttttatggagggtggtggtggattactcttcccatcttgtgcttttgaggatgctccaaaaactttaaaaatttatccatgttccctttcacacagtgggtgtttctttcctcaggcagaaggaaaacttaccaatggtttttgaatatgataggaaagaccacctgcagggagagagtgggacccctgctctctgcctctggggcctgttttccagaatccaaagaagggtataagtacagcatcttgcaagtcatgcagcaaaacagcagtcatgggagatggaattctaagggggcccctgaggttccagccctcttgtgtacacaccgctatgaacccttcccttctgcaaatatgacaggatatcacttttgtgactgggttacttaccagttaactttgaggcctaatggccgggaaccagagcaccgctttgaaggtgagatgagtccctggccagagacctgtgtcctacaaccacagggaaatggattccatcaacaactcgtgagcttggttcttagaacttaggtcagctaactaaaaggcctttcttagtgacttttgtaactttagcagttttaaattatttaattgactttaccttttctcaagagataaataactaattaatactgaaactgagttttagatgcagggatcctcttgatcttaaatggcgtcctctagggaaaatgtggtggttctcagctgcttcagcgcaagctctccaagcccgtctactcagcatgaaaatctaggaggggtgagctgaagaactgtcctcatctccagcaaagtccttatagtggaaggacgcatccttgaatggatgacatctccttaccaaacacagtgccccagtgcatatacatggatgtagcatcaaagtacagacagcaagcaaaaaacacgaagagaaatgtgcacaacacaagtctgccaaatctctctcaatcatacaggttaaggggaacaaaaaaataagtatcctggattggaatatggattgaaaaaatattgctttggaggagaatattgggaaaactggtgaaatgtgaataaagataatattaaatatatttgatattatataatggcattgtatcagtattcaatttcctgaattaaatatttgctctttggtttacagagatggttcttgttcttaggagacacatggtagagaatctgggggtgaagggtcattatat

SEQ ID NO: 477821 - DNA, 727 bp, Homo sapiens
tgtgctgtggtttagaccaatagttgagatgataatggtttccttactgatctttggatcaaagagaaggtggtgtgttcccagagcctctcgattctgtttctctgatggtcccatggttggtggagacatttgggaatgtctggagacttgggtcatcaaaactgagaaaggtgcttttggcattgagtgggtagaggatggggacactgctcagcatcctacggtgcacaggacagcaccgacagcaacgagttacccagcccaaactgtcaatggtgctggtgcttgctgcacagaaagccaattactgagacaacaagtattgccaaggaagaaggctttaattgggtgctgcagccaaggaaatcttagtctcaaatctgtctcgctgaccaactacaattggggcatttatatcataggctcaatcccaaactttaatgtgagtgataacaaacagctcatctcttcggaccactattattttgtgtctctgactagaagtccaatgtcaacctaactgatacagatgggtactagctgaaattatcagaatggtggtcactctaagagttctactgaatgttaagtaatactaagtacatgagatttaatatttccaaatatttaagatcacctattaggctatgcatcactcttcacttttgttatctcatctaatcatgaaacagacttagagagttattaacaaggagctattctt

SEQ ID NO: 477822 - DNA, 784 bp, Homo sapiens
caaccacaggccggctcgctgctgccagtctgagcagcagagaaaatgcccctgggcctgcttccccccagcgatcagttcatggaattgatcatggttattgatagtgatgctgatgggcttgcatgggaagtaatggatggcactggcaaggttgcccttccaggaagacagccccatgctccttggagatgcagaggacgcagtccatccaccacacttcgtgctgcttgtgggctgcaatctgctactggcatgttgcccctgcagcagcagcagcttgacctgctggatctgagccacggccatttgggaatcattgcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacactctggactatttctgtgtttatttgtggccgagtggaccaagccaacagaaatcaccagtgtgggatgaagtttgacctgaattggagccacatggagaatgctgcctcagggttgggtgtggatggggaggcactgagtacgatgagggagaagccaatttgatactttgtggaagaggaaaaatcataagattactgcttggtggctccagaggactgggatgacatggtcttgattgtttctctcattt

SEQ ID NO: 477823 - DNA, 785 bp, Homo sapiens
gggtgtccctcggagaggccgcacccgggagaaagcgctgacgcctccgacccagctccgcgcacagcggcgcccccttctggccctcgtcccgccggagctgcgcttgcgtgaacagccctcaaatgcgtgtttgccctgctgcacctttgtcccagacatttgatgtgggcagcgctgtgctggaccctcagttcccccagctcccatccacttcttccttcagcttttccaagtcctgggctgcatgggtgcagctctatggcatatgcacccgttatcttctcagtgttaactgcgtcatcaagttcgatggtggcttgtggctgcaaattctttgcatggccgtttatttcactgaagcgaatgatagcccaaaagtccttgagatatgtgagctgcaaaattctacagctctgcctaaccatttctttgtgttcattcctcctcgtgtctttgactacttcaggctggcattcaaatgccaggtcctgaccatgtttctaaagaatacatttgaatgcaattactaagcctcctttagaagtccagcagccctgtccattataataattgatagtctagaaacttgttagagagaaaggaatttaatcaaaggtagaagtaatttataggggagagtcacgcggagacagctgaagatgctgtcatgattagagtcaggtcagtatttcttctctgtgggagcatcccattggccaggtcatcattccagaatctcagatgcatatctttcaatttcccttccatccctgctgcagtcc

SEQ ID NO: 477824 - DNA, 601 bp, Homo sapiens
tcccacactatctcccagggtttccagctggatgaagctccaatggccccaagaggacgcttgttccttggagatgctgaagcagtagcttcccaacactcccaaagccacatggatgacccatggcagctggaccccaggtcacatgcctcaccatcaggtgtggcatccatggctgcttcatcaagtcaatggctgattaataactgccagaagcagggttcatcaataactgtcatctacttctctttatcagtgtgttctgggaggaaattgctggccagagagaaatctggaaatggtcctgatgcctcctgccccttccgctctgctgtggactcaagtgtggtttctggaaagctgttctctcacatgtgcctcaaatgcctctttggtcagagcaggaagcacaaggaaagcttttgggattcggatggacagacagatagcttggtatgttgtttctttggggttgcccttagcaacccgattaaggaaattgcttgcaggcagttttctggaagaacatggcccggggcaatagaggagaaagattttgaaaagaccatctttggagcttgagggggtttggcaagaccac

SEQ ID NO: 477825 - DNA, 1123 bp, Homo sapiens
gaaagtccagacccttgacatccatctctccctactgctcagaattgtctacaacctaacctctttggtccagaactatctcaaggttctgctaccaacatgttagaagcaaaaggcccaggaaacaacccagtcacttcatgggaattggcagctttaaatagcctcagcttcctcattgtgcgtccactgcaggctgaaaaaagccagacctgcttgtcagtcccgcaaacagatgaaagacctacttgggttcggtggaattccattgtcgtggtatttactcacaacgacaagagaccagagaagagagaagcaggcccctgtgcccctcctgacatgtccctactgtgtgaaagggctgggctgggggacagaatcaccagggaatttcaggttctctctctctttcttacttacagaaaccatagcatcccttttggcaatgctaaatgtgaatcttgttatacagctttccagaaatgggtcagctggataaaagtgtaccaggtcaaaagtttaccaatttgtcatcctcataaaaatgcatagaagcgcctatttcttccaaatggtatgcttgattgaatctacctttgccagtctgacaggtccatatgtatcacttttatttttctttgtatttccttggtagcttcattatagtgaaaatatatctaagctcattggctctttctggttatttgtgaaaggtctatgtttcttgcccatgtcttttgttgggtgttctttttctcttagtaacttaagagttatttgtgtattaggacgattaaatctttgttacatgcattgtaaatatttctctagttttgtagttcatcttaactttatttatggtgttgtcatatagtgtgaaagtttttggctgttagtagaaaaccatacagtttcctccctatatatcttaactcattttctaagagtgttagattttagtttgagtgttttccagcttttggaattaagatatgagaaagtttatgtcaagcatttttgactaatttatctaatattttaatgcccttaaacagtattgagaggtacaacatttaagaggtgattaagtcatgagggttagttatcagaggaggaagttccc

SEQ ID NO: 477826 - DNA, 606 bp, Homo sapiens
actgttttctccttctctgcctctctcctgactcccggactcacttcttagacccgagaggtcctgcaggacgcctaccagagccatgcatcagacagtggcttctgcccagtcacggctgggagggagatggttaaaaggctacccagaaaactcgcggaaacagccagacctggagaaagcagggacagaggagccatcagaaaccaaggctgatactgactttatgagtgttaaccaagataatgcatgtaaacaccttcgtacagtgcctggaacacagtcaggtctcagtggatgccaaatcattaggttcagagaggcagctgttcattttcacatgccccaaagaaaaattccactgcctgcaatcaccacttccactgtgggctgctgcagcatgagcaaaagcatgagcaaacctcatgtcaccagctgcctgcctatggctgctcctaaagaaagcaaatctgccctcccagtagcagggccacagcacagccactgccccactcacctgagcattctacggcaactgggggatttccccaaccatgcctatcacagatagtgcctgcatgtaccactggggagcctgaaagcagg

SEQ ID NO: 477827 - DNA, 1048 bp, Homo sapiens
tccgagcaaaagcatccatgggccacaccagagaacaggaagcagcgttcctccttttccacatcatagcacactgaaaatgattgcatatgtacaatacagcatccaggacattcagggacatttatataacacttggttttttgtgtgctatggtttcacggaattccgtataaaaggcagacccaggtttcgtgggtctaaatcttacatgatttggaggagaggggagactaaatctgaagctgacaatctacaatacccttcagggtcgttccttttgccaaaggggaagcagaagtgccgggactccacatttcacgaagcctttcatcgtaaatacagttctcctccttccttgtcaaggtttcgaggatctaccattcacgttgctgggaacccgtgggatgacacagcccgagtatcagaagtgaaagctgaacgtcattactcctggtatcaaaaatattttgcagactacctgaatgatctattgtaaaagggcttgagttcttgatttgattgcttggtcactgttggtgtatagaagagctactaatctgtgtacattaatattgtatccagaaactttgctgaattcatttatcagttctaggagctttctggaggagtctttaggattttccagatcccccttctcacttttggtgtccatttgcatgagatcccttcttccacacccttactttaagtttatgtgagtccttatgtgttagaacaccaattattcttagctttggtcacttaacataatcccagacttcttaggggctttgttcatattttcttatttttttactttgtctttgttggtttgagttaattcaaagaccttgtcttcaagctctgaatttctttcttctacttattcaattctattgctgagactttccagagcattttgcatttctataagtgtgttcaatgttttctgaagttttgactggtttttctttgtgctatctatttctttgaatattttccccttcacgtgtatcattttttgaatttccttgcactgggcttc

SEQ ID NO: 477828 - DNA, 487 bp, Homo sapiens
ctctggtttgtgaggtaaaggacaaccactgtctttgcccactgtgaggatggactgttttgaaaacaaaagagctgccatatttgcaaaaacatttaagagattgctacgttctaggaaaaggtctgctcaaggaacagatcatctactccacgatgcaaacaggttggtcacggtgagaacgcaggtgcgccagtcagaacgcggccagtggggaatgtcggactgtgcgaggaatcggctgcagaagagcatattcaatcctacacgaatgttggggaattcagaggaccggcttgaagtcagtcccctgcctgccctggagaatcagctgggggccaggggaccaccaccttgcttcctctggaagaagcacactgttagagtgcatcggtcaccaggcatttcatgccacactagggctgtcaggagtccaatatctaaaccaagtgatgcctgatctgaaataagagaacactctgagtgg

SEQ ID NO: 477829 - DNA, 581 bp, Homo sapiens
tcatggagagggaggagttcagagagtggcccacacagttgacatggttttggaaaactacaaacatgattcagctgcaacagtgggaaggaactgccactgctgggtggaagcggccttgctggagagatgctgggaggaggaggaagtcctcaggaggaacggtcgggcccctctccctccagatttgcggcctcactctagcgtccccttgccaggagcatctggccaagcccaactgcagtttgcagagtcccagtgctggcatcacaaggcaggatatagaaaggtgggtttggagccaagagaaaatcatttaataatggcattactcccagcccccgctgggataagtccctatcttattaaagcgataacacaaagcagtagtgaaattaacagcactagacatgccactttctctctggacatcggcatttctgtagggcagtaatttctacgatctaagattgcctccctgctggactcagaaaagaggtaacaaaagtgggttaataaagtccattaatattcctactgtttataagagcttgagagataagccaaatgattgatagtct

SEQ ID NO: 477830 - DNA, 1134 bp, Homo sapiens
tctgagaaatgcattgttaggctattttgctgttgtgtgaacatcatggagtgtacttgcacaaatctagatggtagaacctgctacacccccaggctatgtggcattagcctattgctcctggactacacactggggcagcacgttgctgtaccaaatactgtaggcagttgtaacacaacggtgttctttgaaaaagagtttagcagtcaagtgaatttgagagagggtggtttaattgaagttaaacattactttactgcagggcttttcagagcctttaatctgctaaatgcttgtgacattccaagtggggctgtgagtgaggactgccttcgaaaatttcacacaaggcactgcaagaaatgttggggtttggggggcaaaacaagcttaggcttaagaggcattgcatgctgttactcatttggaacccagccagggccatgggcagttgcctgggctagcctgctggaggatgagaggccctggggagcagagatgagtcaatccagtggccctcccagaaatgtctgtttgggagatggtacagatgaggaaatgaaagcctccggatgtaggttctctggaccagaccgccgcagcagagacctgtgttttctcctggggattcggaaaccccactccccttgccttcagaggcgctgccgctctccattgtggggcagaggtgaagaagcaaagaaagtgtccttttcatcctcgccatagaatgaaaaacaattcatcaccacaattactcaccaaacctgagaggaggacaaaagaaaacatgtttacgttactttttctttcattaaaaagcaacacgtgtttttgcccatcagatagaaaacacagatgcagaaaaagccaggcgttggaagctgttcgcgaaggttcaggttcaggtcacattattgacttttgagctcttgactcagatgtcaaatcctgggaaataaagcatggggttataaacaacattacgataatactggttattatatttgtccatgtatttactttagtggagatatttatattttcatatgcttttctgttactacctactgttttttcatttcaacctgaaagactctctttagcatttgttgtgcaatgggtctagtc

SEQ ID NO: 477831 - DNA, 1686 bp, Homo sapiens
tcagtcactgactgacaatggctgctcaggtcacgaccccccaacacggcagctctacaacggcaaggacgggcatgggtttgggatgcggggttttgacactgtgtgttgtcttcttcacctcctccatggtggtggaagaaacttgtaatcatgagagctgctgggatccatttgcaaccctgcatgatgctgaccacacagaaagaagacgagaaaaacagaatccagaggccttgacattcttactgggccccagactcgtacaaagctgggaatctgacagcaaggaagaggcatggggacattgcccgatgtgtagaaaaccaccatgtctgccacaacatgcaacaccagaagagagaagaagaacccatgtggagagaaacctcatccaaggaactgaagaaaatccccataagaatcagtccttcccagaatcttcccagcagagctcagaatttgccttaagtcactttggccaggactgtgtcacaaatcactacagcccactggtctggcacatcttatctgagatcaaggatctcccctcaaggcctgaataaggttggggttctaaacgtgggtttgggaagttgctatgtcctggaaatcacaaagtatatatttatcttgtaacactgccttcttggtgttgcataaatgctagaagcaccatccctctcatgaagactttcacctttgatgcctactgcctagaatgcttctgactgggtcttcacttggctcattcccaccctccaggtatcggctcaccggccgcccttgcagacttctccaactgtccaatgcgtccctccgtttttcagtaccttatcaccatgtgtattttactttgagcattcatctctaatatatggtttgcaatcactttaattacttatttgtatccatgtttgttgtctgttttcacagagtagaatgtcaactcatgagatgagagatcttgtttcagtgcctggcctacagcattagctcaataaatatttattgaatcattgaatgcatccagactttcagaaatgattcctggttataactcaggattacaaatgactttgcttcttgtaaatgactattaattttgacatttatacctagaatatggtggaattgtggggtctctattataagtctacgtgtacattttaagtacccttttctttatatatttcctgattgtagatattacatgttctagttgtaaaaacaaaacaaggctgcagaaatttataatgtgtaaaataaagaactgtttattgccaactctcccagattaaaatgagattcttttgataaactaattgtaccttgttttcttcaaacttaaaatatgcaatggaactcttttcattttgacattttgtgataaactttattctttttaagaacattgtactgtgtggaatatactatatatttagccatctgtggtgaggctaaattgtaaactgctgctagactataatacgaaattgaggatgtttgtgttatttaaattcatttaaacaatttcatattagtgggcattcatcttgttgccagtgggtttttgggtcagtgtaaaaagttgcagtaaatttacttctacatctgtgtatttttctgtaggaaaaattcagaaaagtacacttttgtgtactgtattagtctgttttcatgctg

SEQ ID NO: 477832 - DNA, 693 bp, Homo sapiens
gaggccacctggggagctgcagatagattctccttgttgctccagggcctttttttaagcaccggcattatgggtccatctgtgatcagtagagtgtgtggtaatatcccaactcagagcccacaaattcagaccaggagtgctctgttcccctggccgatgcttcccttttttgtcctccccacaggagtagtatggacggcccacaagtgtggaggccagttctggagtttatacccatccactgggatgagaaatgagggcttggagctgttttttcagagtatattctcagatccattatcagattttaatctcacaagtctgaccagaaaattcatgggagacctctatgactattcacatgtgggacggacattcagaaaatgcgttgcaaagagcatggaggcaaaggccaccaagaagtcgctggaatcaatggcagcctttgcaaaaactgttgccttgctgagctttggccatcctcaggcagccctgcagcacagcccagaagcactgaggtccccagagtatcacctcatcagctccctggggtctcagacaaacacagccttcctagtcaaggaaataatgtcccccttgtgatgcaaagccccctggagggactgagaggagcttcctggcttcactttgagcgcagctgtcctcagttcctcctgtgaagcagtgggt

SEQ ID NO: 477833 - DNA, 731 bp, Homo sapiens
cacataattcaacccatgataatgattatcgacaaggtggatcaaactgcgcccttgtgtgagtactccctggacagaatgtctggttatcttcggtctgaagcaggctcagaagaccggggcccatttgctcatttgttccttgcacagagtttaggaagcttttatcaacagtgggatgaggagcaggccacctgcactgtgggtgatgcagaattgataggggctggtgtctgcacctcacccttcagcttcaggatgtcatacaaactttatttggtgaagccctggggacctgctctgcccacagcgctggtggatgcagtaaaccaggtccccgctgtccagattacttacgtgtttgtgaccagaacattggtcaaaatatggaaggtaaaggccattctgatgaggactcagatggaactgaggaacaaagtattggaaactgaagtaaaagaaaatccttgttgcaaagtagcaaaagccctggctgaattgtatactggcccgagggttttgtgcaatgcaaaacttaaagagtactaaactaggatatctggcaaaaaaaaaaaaaaaaaaaaaaaaaaaaaatctaagaagtaaagcattcaagcagctgtgtggctacttttaactgcatattgtaagagggaagtgaagaaaacttatttaaaaacagaatttataattaaaaggcaagtaaaatgagaaatatagaaaattttcag

SEQ ID NO: 477834 - DNA, 958 bp, Homo sapiens
gaaacaaataaacaggacaacatgatagaaagtaaagtaaattgcagtgagggtggggccaggggggcaaaaggagaatgcatgtggggctctctgagcccaaggtctctgtgccctcccagccaggcacaatgggagcacagagagagactgccttgtgctggagctaaaatcatggatgaagccatgagaaacaggaagaagaggctggcacatccaggcttctctcctcctcccagcagccaatctccggccagtgcctcccattggctgaatctaccaggaagcgagagcgcaaggcctcccgggaaatgtggggccagcctcctgttgtgtagactcatcaactataccagtcctctgttcctggtctctggagcttcaatttgggaaagtgacccattagcttctgaggaccagggtgagagagggcaaacttgaatgcccttcacaatggagagatgtgtgcagaccggacagacatcagttcctttatcagtgcacaggtagctgcaatgcctgcatgtggagagataaaacccagacaaagaggcagacatgagcagatgagctcccccgaacaggagacaagtgggctgagaggtgaaggaagaggatgagggcagccacgaacgctcaatgagacatgacaagtcaagtgtggagcccaggcccttcacccagaggagctcaaaaaatattagcagccgttaccattggagcctctgcctcctaaacctgcctcaatatctatggagggtgggagcagagtcacttttcctcactggacctcagtttactcctcagaaagacagcagtgatgatgccctctcaagatatcctctaactccagaatccctgtctctattgatcgtgtaggatgaggcagtccaagttaaaacaaacactttgttcttagtatctcatttcattttcataaaagccttagaggacacac

SEQ ID NO: 477835 - DNA, 1267 bp, Homo sapiens
tctgagacatcaagtttcttacccaagattgcctatcaagttcccctgcttctgctggctttatgtctcagaactttggtgtcattggtctcagacaccactttgccatccactatttggtgggtggtggtcttttggatggtttacatggagctgctgctgtccagggcatcaccaatattgaagtcctcgccatcttccagcaggcggcagtaggtggagatctcagcctccagcttgaccttgatgttcagcagggcctcctactcctgggcctggcgctgtccctctgcccggagttggtaatctgggcttgtaggccttttatttcctctttgtggttcttcttcatgaagagcagctcctccttgagagccttgatctgtctccagctgcagccgagtgacattcgtgtcatcaatgaccttgcagagcccatggaggtagctctctacagattggagcatggccagctctgtctcatacttgactctaaagtcatcagcagcaagatgggcattgtcaatctgcagaacgatgtgggcattgtccacagtatttgcaaagatctgagccctcaggtcctctatggtcttgaagtaatgcccccagtctctgacctggggtcccttcttctccaattgctcacagattttgctctccagcctctggttcttggtctccaggctcctcactctgtccaggtaggagatcaggtggtcattcaggctttgcctggtctccttcttgttctggatgccttccattcctgccagactctcagccatccccacagccagagctctggacaccatgccgcccccgaagctggtggagtgggacatggagatcagggaaccagaggccccagcaccttcatagacgctggccttgctgctgaccagccgggcaccatagcttggcatctggacagagcccagggaccagtagttggtggagaaggtggagcgagtggtgaagctcatgctgtccgaggaggagagcgagaggacaggactcaggctttgctgaccatcttgattttacgtttatatggaaaagcaaaagaccgagaatagccaactcaacattgaaagagaagaaagtcagaatacttacactaaccaacttcagggcttactgaaagctacagtaatcaagatggtgaggtattgatgaaagaataaacaaatagttcaaagtaatagaacagagagctaaggtatagacccacattaatatagtcaattactctttgatataggat

SEQ ID NO: 477836 - DNA, 635 bp, Homo sapiens
gtcaaccttaaagaatttagactgtagctcggggtcaatgaaggtccctcagaagcagagcttcaggaggatttctggaaatgtgtttggctagatggcgttgccaggaaaagtcagcaggacaaaagcaagtgggactgcagagggaaggaggataagcaggggaaaatccctgcagggaagcagcagctccaacagcagggagcttgcaagtcgcaccttagaactgctctccagcagcctgaggatggcctctgaccgggatacacaagtgctggccactgcatgtgcgaacacccgagagccgatgtgtatgaaggtgactaggtcctttatgtttttgtcaaatggggatccatcttcaagtgatgttggggcagggttctccaaagaagggcagcgagggaaggaagagggacaggaaggagctgaacaggagcaggttcgagctgcagtctggctttaccctgatccctgggggagctttggaacaaactgcaccacagtctcaccttgcgaggggctggcctttgtaccctgagccagtcactgtttattgggggtgggtggatgggctgtaatctcctaagatgcttccatgatccaatgacaattttccaaaatgggggtagctc

SEQ ID NO: 477837 - DNA, 696 bp, Homo sapiens
tcgatggagacgccatgaggcgtcttactgagcatgtactaggtgcttcaacatcctttcacagcagttgtgattttatcccacactcagagacagaacaagaaagcttggagaactcatgcaacttgcctgaggcagagctggcaagagaagccatcatagaggaggcagaactttctactatggaaagtccccagcagcaaacactaccccagtgctgtgggaggttcagttgtgacggatgccagagcacctgctccctgcctccagcagtgacaccagaaacatctccagatgctgcccagggtcctctagaaggcaaaaccaccctgagggagaactgctttagattatggctgtcgaaagaatgcacatcaggtgaaaatcctaattgcaaaacacattcagtgatttcattaaaataatacaaaaatatactttcatgaataagtgtaggaagatttatgtaaattgtattactggcctatacctcactaacacaatgcctagactcgtgcagtcactcagtcatctttgagatttcaccagccttcagtcatgcaaaggctaagggtttgcaagcatccttgactttgcctttatgaaggtgtataattaaggtaggtgatggaccatactctatgtaatgattagttaccttgatttaatcttttaaacagagagctcacaggatgc

SEQ ID NO: 477838 - DNA, 557 bp, Homo sapiens
tcacttaagtgtggtggtgacttgcatttggtttgaccaaggagaatactgactggttcttgagtcgggtgcactccccctcttgttgtaatggaagactgtgcttgtgggaagcccagagagagtggttcctggaacgggtgtagctttgtggttaagagtttgaactgtggatttaggtttcaacataaacacaggcacgggcagttggaggacagtgaggaagcagctggaggagatgggaaggtgcagggactgtggggcactgatgacaatgtggcccttcatcaccaaggagctggctgggcctcgtcctatggaaaacctggccagcctctggatgaggaactcactggggaaaatgaaagagttttaacgtgtattccaactactgacagtcgaattgtgtacacttggaccatgtctactctgctaaatgtaacaagggaggaaacagtcctgcgggttgaaatgagattccttggtccactgctcatgaacaaagtctccatggatttggaaatgatgccattgtctctggattaccgctgagtcct

SEQ ID NO: 477839 - DNA, 518 bp, Homo sapiens
ctgctgtgacctgtgaccagattctttatgagcaggctcaaagccattcttcaatcacgaggaatgaatgacctccagcccacggttgaaatttctgacaggatggagtcattttatggtttccttctgggcctgtcctggcaagtgggaggcacaaaaaagggcttgaccgaggaaagagatgcaagcaaagtaggctgcaggcacattgagctctctgaagacatgagcctgttcctccaagtgaaccttggtgggtgtggccccggatcccatggaggtgtcagagctaccatccactcccacattggacagggacggctggagccagggctcctgggctcagtaaacaagtcctcctttcttacaggacacttggaggcagcttttaacaactcagaccagatgagtgagcacattctcacacatgtcccatatttcccaagtcagtaaccagccccttgcagaaggctggtgatgctttacaccttggggtccttcagagaaatgggtttgtc

SEQ ID NO: 477840 - DNA, 539 bp, Homo sapiens
ctgtcaggatttccttgctctgcttactcaaatgggaaaagcatgagatggcagcgagctcattggcaaagtgacatcttgaaagtgattatgcaagaatacctggacatccggcctgtcacatcctcatcaccacagcaacaagagctgaactttctcaggcgcctaacatgtgcctcacacgtgccatctcatgcttgctcccccagtccaggtgggcagtggaatccacagtgggacattcacagggacatagcaagagcagctgctctggaggaagtgaagaggccagcgtccctggtccaaggcaagtcaggaatcaaggaaacagaaggaagagggtttctcaggtgtgcaggggaggagctgtccgtgcagctctatgcctgtgaacttgggacagtggtgagcactgggagcagcctcatgggaacgaagatgctacagaaggcagcctcgggtgcatctttctgtggcaagcacagcctgagatggaactgcccgggtacagtgcagggcttggggacctcttgagggga

SEQ ID NO: 477841 - DNA, 906 bp, Homo sapiens
caggtgttggagagcagtgtgggaaccaggttaaagatctggcagggctgggaggggcaataagcatgacttgcttgagcgaaactaaaagaatttcctggaaggtgatttcctagaattttgctgcaacagaagggttggctcatctgagagtcacagcgtggagatggctctgatcctggagagtgagttggatgaaaagagaggctctgatctaagaagctgccattcaagttgggaaggacgtgcacccaagtgtgctcatcgaagtacaaatctggcccctggagagcagaaacagaagctggttttacagcattacttttatgaaacaacattgaatactctaccgcccacaaaagtagtggggtactccatactactagctgcccagcctgcatcaccccagacatcaggagtggctgctcacagaagaccaaggcagattggaataatggaaccccttcatcaagacccctctgcaccgtctcttagtcctagtaccttgagagagtcgtttacgctcttggagtgtccctgcatttttaaaggtgttagcatgaagaacaaggcaatagacatagacaaggaagctgttatgagcacagatctcatgggaaaagcaaaactttctgctgtttttgttcagaaatacagaaattttcaggaagatcttttatgaaggtgataacactagggtccctactcaggacaccagctgaacagacaagatttccctgttacttgtggtttggtctgttaagcacaatcccacctcgatgctgccattaggcagatagtttatgcgtctctccaaacttcccagtggagacctttattttcagacttggaggactgggagtgtggagcacagaggaaaaagaacgtgaagttctgactaattac

SEQ ID NO: 477842 - DNA, 566 bp, Homo sapiens
agaagtcaaaccctgcagctatgaaggacaaagttagactttctactggagcacgtttagggtatggacctaaaaattcctgttgaatacctgctccgctctcccgacaagtccaaaaccaattgtctcacctttcactttcaggctggtgccctgtccagacaggtattgcctgttgggtttcctctgaaactttacacagtaataggtgcctgcatcctcactggagacgttttgcagaagaatgctgaagtcattgttggaggcctgcaccgctgtctccttggggtgggagatgcctccaaagttgtaaatggcctcccggctcagaccagctccctggaaccacctgatgggtccagggggaccgtctccaagcactgtgcagttcagaaagacagtgtctccagtggtccccaacaccaattcctggggctggatgatccacaggtctggttcagggtccccagctcctgaagccaaagaggaggtccttgttgaattccctctcctcttccatcgttcactcatttcctacctggtgttttccctcccttccttctttc

SEQ ID NO: 477843 - DNA, 544 bp, Homo sapiens
caagatttcaaagtcacttcccatttctgagccttttgtttcttcatctgcagcgtaggaacaacggcagttccctcctcagaacagttttggatggcaagttcccctcaggctctgggcatgtccagaggtgccatctgggagccaagaactagaggagtattgccagactaccgccaatgttcctttaaggcccaagggctcttcagtcagcttgtggtgaatgctgcctggcccggaactcacccttcagggcagtgggcttccctctggcccaggataggtctagaaatgctattcaccagcaaagtcctggaactggggaccccaaaaaaccacttaatgctccaccccactgtggctgtgctggtacctaacgtgcaagacaaagacttagaaattggagctagatccctccgtcttgctccttggatctatcttccaccccaggtcctatgtagcccggctccacttggagtgggatttctttcaatcaccctggttgtataccctggtcaaggtcagccttagtcttaggtctttt

SEQ ID NO: 477844 - DNA, 683 bp, Homo sapiens
tattttgggattattgcctctggaagctatgcctttagttttgtctctgcagccctggaggcacagagctctacgaggtgccgtggaggactctctgagaaaggagggctgcctgacaccaagagagaagagaggaaattacaaatggtccctgacttacaatggctcgatttctaagtttttactttctgatggtgtgcaagtgatacattcagcaaaaaccatgcttccagtacccatacaaccattcttttactttcagtggttcaaaggaactgaaacagggcaggaactaatctacagttcaaaaggaggccactttcccaagatagcttgcatttcagacatcacaaagagaaacaatacagacttttccatgtgcatcactagcatcacaagagccaacactggcacctacaactgtgtgaagttctggaaagggggccctgacatggagcttaaatctggaccaggcactgagttgtctgtgcatagtgagtacagtgtgggcctccttcgtcccccagtgtgtgacaataagtcaatagtaacaccttccattcattgagcaacaatcgggtgtggtggtggcacgtggtcttccctctgtgtgcgtctgtaccctcagctcctcctgtagtgaaaacatgggtcacagggtcacattgtgttaaggcctgtcc

SEQ ID NO: 477845 - DNA, 1626 bp, Homo sapiens
cccagagatacatccagacatacacatagacacacaaaggaccttgtgaggacagggaggaataacgaggaaaatggctgcgtgtgctcagacaccttcattcatccagccagacaatattattgagcatctactatgtgccatgtgcctcctccgagctgagaacaggaagctaacaaggacctaccctcaggaagctcacagtctccttcggaagacaataaatacaggaacaaagcaacagctaagagtgactcggaagacaataaatataggaacaaagcaacagctaagagtgactcggaagacagtaaatacaggaacaaagcaacagcgaagagtgactcggaagacagtaaatacaggaacaaagcaacagcgaagagtgactcggaagacaataaatataggaacaaagcaacagctaagagtgactcggaagatagtaaatacaggaacaaagcaacagcgaagagtgactcggaagacaataaatataggaacaaagcaacagctaagagtgactcggaagacaataaatataggaacaaagcaacagctaagagtgactcggaagacaataaatataggaacaaagcaacagctaagagtgactcggaagacaataaatacaggaacaaagcaacagctaagagtgactcggaagacaataaatataggaacaaagcaacagctaagagtgactcggtggaggaaccggttagggtagtcagggaacacttctctgaggagccatcgtgggaccaagaggcaaaaactgcaagaataaatgccacagtcccagagactgcagaacagaaaaatagagcccaaaggctagacaacattgttgggcagctgtgcatagtctggaatgctatctcttgacatcttattatgaaaaattggattggaaatacatatttgtttgagccaaagacattcattactaactgaccaaagccaagtcattttttgtaaaataggacttgtgagagccttgagacacagccttgaagacacagcttgagtatccttgaattccagatactttcataaacaagttctgcccaaagatgttataagaaagcagattgtccaagctttgcatccaccccagcaaagagttgagtgttccctgtgtgagaggggcaccaggagtcatggagcgtcaggctgggagcccaacaaatcccatggcagagtgtcccatgttgctttgaggtttatagaggaagctatgacaatgccaactcaaaagtacattcttgaattcagatactgattgagatgcagcgaaatctatccacagtcttaagctcatctcactcttcttatatcctagtaatcttacttctgagctctcttctgataaaataacccataataagcagagaaaaagccaggaacataattttcatgacagttacatttacaatatcctcctcatcctgccccagccccaccaaaaaaactggacaaatctaaatgtcctataacagaggaaggattttaaaactatctgttcagtggaatattacatgatcataaaaaatgatgtttgcaagtttataatattatagcacaggggaaaagccggctgtagcattatatatattatgtata

SEQ ID NO: 477846 - DNA, 788 bp, Homo sapiens
atacaataaacttgtcctctattgtgatagatgaagcagaaggcttcagtctgtacgattcactgtgtgaccatgggtaagtcactttacctctctgggcctatttccttatccatgaaaatcccacaggatcgaaaacctttttcacaaactggtgaatgtcaactcatctcttgtgctgaaaccaaccacaggtcagagggtgatggtgcttgggtgatagactgcataaagttcagtctcctggaacatagagcagggcagagagaggcacatatggatacaggagaaggaaaagccctgtttcacaggtactcttattcttattttacggatgtggaaataggcgccgagaaattggagaacttgctcaaaattacacaagttcctctaagactcgttgctccagataatcggagggtgtcagctgcagagagtattcttgcccaaggttttaatcttcccatggtggctcgtatccgaagactgactgatataggagcataagggcctggtcatcatggcccaatttgggacaagattgaaggcccattctagcttcagagctgtccatgggtttggccagtgctgttattagacctgcattgtagcttgacttcttcttctgcccaattctattttggtcactctctgccatcaagtgttgatccaagggcctttttaaaataaaagcacttcatgaaggctgaataatctcatctgcacaggtacccagatttggatactctaggagccctggagaggaaggttagcagtgacagcttgga

SEQ ID NO: 477847 - DNA, 1126 bp, Homo sapiens
tacctgtgcaggtttgttacatgcatatattgtgtgatgctaaggtttgggatacagttgagcccatcgtccaggagaacatgcaacagaaacaccctttccatctttgatgaagcccgtagaacatctctagccctgcaacactgtaaaggaagacagaaactgtgttggggaatggtaaacaatttggcagagtggaagaaggttaaccctgccgccttcgaaggggcatctattgaggaacatccaattcaccccagaatgccagaaagcctcaggaattggcagaaccagacattgaggaggtggagggaaagcaggatgctgaaaacacgaggattgactgaaagtctttgtgggggcattttgaccttatgcagccatgcacgtctgtccccagaggccaccggggatttgatctctgggaaatttgaatcaggttccagatttagcagccacaaagagagcattgactctggctgcgatataggggagaggtgggagggggctgaacaacataggggttaactaaaaagctgcctcccgaatgatgacacctccaacctgttcctagcccagcattagaacattacatctaggctcattgggcaatgtcccccatcccctaacaggcaatggactggagcttctttctatgaagaaattgaactgccccagagaatggacctgcaatcgtgacctttggaacttttcagtgaaaaatctggctggacactcaattgcctataaggaaatacatcagttgtgaaaccctctccgtgcttactaagctttccatcagcttttactcgcctccctttgagataaagatcatcagtcccttgaggtggagttaattcctactcttccttccagacttatcttaaatatcagcttttccaggaagtctttcctggcccccaacttctcttctcagtttagttttaattgagcactttatattattctattgtgtctccaatatcatttgaatatttgctaccatcaaatctcattttgaaatgtaatccccaatgttgaaggtggggcctagcgggaggtgattggattatgggggtggatttctcatgaatggtttagcaccattcgccttggtgctgttctc

SEQ ID NO: 477848 - DNA, 548 bp, Homo sapiens
ggcagccagttcaggacaccctgttatcatggcaaagtcacaaccagatcttagggcctcaggccgtctctgtgacacctggacactatgggacacatctgggaagatgacaatccaggaggcagttagctgtcgggagatcgccaaccggccaggccaccacctgtaccctctgccgtcctctggaggagacgtggtgagactgtgggtcccgaggaatcgacctggaagacagaaggcggaagagaagagtgaagctcaggcctctgagaatccgaaccaggctacctgctcaggtcttaacatgggccagaatcccacacccaggggcagggctggactgggcctgcactgtctgctgcagtgcactgtgggggttaagaacgagggctctggagccagaacgggcaactgagtaaacaggagctgcccctcgactgtgggggaatttaagtcctctgttccctggtctcatcacctgtacctgcgtcacaggctattatgaagattaaatgaacgtaaaaccaagaagagtgcctgatcctatt

SEQ ID NO: 477849 - DNA, 2213 bp, Homo sapiens
actgcattcaggagcttgcaaacagcagatagcgggacttgtccgcctccataatcacgtgagccaatccctcgtaataaatcattttctatctatgtctatgtgtagatatccctttgcttctgtttctctggagaacattgatgactacacggctggcgactcacctgcggagcgaggggaatggtggtatatgggtggaggagttattgccatttttcggaagagaactgcgacccagagaggagaagtattgatcaagccctcacagcgaacaaaatctctacaccactgcttcagagctaggggtaaagacagcagcctcttcctcttgcagcaatatccagactttacaagtagtgtgcttgtggtggtggttgtctctggtctgctcagtttgcctctctcagtgcagaacttctcccttatgagcaacatgaaacgagggcaatcagggtcccagtattctcagactgacaagtctcggagctatttgccttttggtctgtccccacaaatgtccttgattcattttggtgcttcggaccgggaactgacctacccaaccggtcctatttatctctgctaccgagaagtctgataatgtagggcttagggtttgaattttgtctctgttactttgcctaaaaaggttgggcacatgctttaacttctctgtacttcagtttttcatctgctcaatagcataacaatactagtcaacattaaatgttataataatagtaacaaacattattgaatgtatactatcaagtcctttcattagagggattcagggcagcagttacctttccttgccccacattcacgatccttccattagagggattcggggcagcagttacctttccttgccccaagttcataatttgtttgtgtgcttgtttggtagcatttggactgtaagctccaggagcattgcttgtttttgataatcattatatctctaatgcctagttagagccttgtacctgacttaaaggcttttaaagggtgagaccctgaatttggcaaactctcttatttctttgcttttcggaggtatatttttctctagtttcttagttgatgctctatttgaaaaattccaacctggtcttaggataccgtacgaaaaggaacctcctccacatttcagggagatcttctccctggaagccatttaggtacaaggttcttgtgttttcttacagagatgttatacacatacaaaatcaaacgtgcacacacatgcatcctccctttttcttttacaaatggtagcataatattcacactctgtttttttgaattcttgtcttggagagcatttgtggcggtattggtagagtgtttgcatggtcatttgtttgtcttgactgcatggtattgcattgcataaggtactgttatttatttacccagttccctattgggaaccatttaggttatttcacttgaaggttttaaggtaacattctgatttatattttagaaaaatctctctggctgctgccaggaggctgctgtgtaggagactgagcatggaagccccagcccagccctgcccagttaggaagcaactattgtattcagcaaaccctgctggctctaacgagaagtatcatcccgagtgcatcaccatcacttctcacctccatggcctctcattatgcactctctgcctctactcttgccttcctggagccgttctccagccgttagccaaatgggtcttttcaaaggtgagtcagctcatgccacttccctgttgaaaacgtcaatgttttcccatcacagctcaggtaatattaaaattatttcctgtggcttccgactaccgcccgacctcactggcgcctctctcccaggttccctgtgctccagcccctcatcacctgggatggggttgtctgcaccgctgtccttgtgcctgatgtccccacacgctcgctcctcctccaccttccggtagtcccagcttgaaagttctgacctcatccccttccccaacacacccctactccctgtcacatcactcgaatctgctgcctacaattggtgggagtgaaaccacttagtttgccaactttgaaggaatcctgtgaaatgctcaggtaactggcaccaatttcccatttgttcccttgacatttcagtgctgcttatggattagtgctttgggcagctgcacagataacccaccttttgat

SEQ ID NO: 477850 - DNA, 596 bp, Homo sapiens
attaccattggcaccaactagcactcattgaggataacagatgccttattctgcctctggtggggagtccctgtccgaggaggaactggcccagatcctggagcaggtggaagaaaaaaagaagctcattgccaccatgcggagcaagccctggcccatggcgaagaagctgacagagctcagggggctgctccagcgaggacagcactcagggagccccatgagagccaaggcggccgtgctgttcgccagcaccacagggcctagagggggagccatggaagactcggaggactcccgacctccaaataccacagacaaaacaacagcccccattgccaaccctggcagcaaaggcaagtggggaagcctggatacccacctttgccaggccaaagcaaggtgccccaatacccctaaccagggtgtgccagaggaggctgagtgggaagcaggaattttcatccccagcaggtagtaatgatccctccttttccccatggtttcggtgaggaccatgtggggagtctagactctcaccatgacttggaagtaaccaggcttgagtggaggcctgaaccccatccctgctcagc

SEQ ID NO: 477851 - DNA, 789 bp, Homo sapiens
attatgatccatcatgtggactctgcagtggtatcttaactggactgtttgctttctttttgccttcccagaatcccctagaatgaaagctccatccactgagagcttgcaccttgcacctggaaaagccagaggcactcaacagaagcccatgagagaagcctcagggcctaaaccctgcaaagccacaggggtggcactgcccaaggctttgagagcccacccctcataccagtgtgccctagatgtgggacatggggtcaaaggagattattttggagctttaagatttaatgactgcccttctgggtttcagacttgcatggggactgtggcccatttcttttgtccaatttctcccttttggaaggggattatttacccaatgcctgtacccccacagtatcttggaaataacacaatcgattttcaacaagggtaccaagacaattcaatggggaaaaaaatagtctgttcaacaaatggtgctgagacaagtgaatagccacatggaaaagaatcaagttggatccctgcctcacatcatatagaaaaattaatttggaattaatcaaagatctaaaatgtaagagccaaaattattaaactcttagaagaaaatgtaagaggtacgtcttcatgactttggattaggcaatagtttcctagttatgacacatagagcacaagcaacaaaagaaaaaaattgataaactggatatcattaaaattttaaagttttgtgtttcaaacaacaatatcaagaatgtgaaaagacaacccacagaa

SEQ ID NO: 477852 - DNA, 640 bp, Homo sapiens
tggtttgctttatgttctgatttgacacatcagatcataaatcatgatcactgagtgcagaggaaggaggcattctgtcaaagcatattctgagacaaggaatccattgcaaggagtttatttgggagctatcattagtgttagcatattttatggttggcccaagacaattcttcttccaatgtggcccaggaaagccaaaaaatcagacacccctgatctacatgttctgcttctaagatgcccagccaaagacagcccttcagtaggacacaatgatggcttgacccagaggaagacacatgaccccaacatagctacagccttctggagcattgatatggactctgggaagaagcagagcatcaaggatgagaagaacctagggccgctggaaggtagcatgagggactgttctgagaatgaagccaacaaacacagcagcaggcaggctcctaatggagggagtgaaataagcccaagtggttgacattgctggagctcttagcttaagctcccctacaagccaaccctatcctagattacacctctttgattatacaggctaatatggaagtcttattttttgattttttattcttaaatattatctgactccttaccatataaacttaatttg

SEQ ID NO: 477853 - DNA, 855 bp, Homo sapiens
gtttaccagttttcagactgcgtcagagggagcacttgacagttaacggaggcaggaaaatggttgtgaaagctgtgtccagcgagggctttacaagctcagatgtgggcccaagagcagaactgggcctgagcgaggactccccccagcccaggacagggcccagcaggattgcaaaaacaccgcagagcagcaattgctgcatctgcacccgctccttcctggctggtcatcattttgacaaattctgtcaacaacagcagtgtcattcctggcatctgtatgggtcacgtctgaacagacacacgccctgcagccctgcaggatggacattcatgagccgtgaagtttccagtaataaatccacagatgcttccagcacctgccttttcgcatcacctccactcccagccacctgccaggcaacaggtaacagagacccagtcacaggagggcagtgtgggggcaggactgcagtctcccaaagcccatgcacaaaaccgacagcgccctggcaggacaaggaggctgacattcagatgtggaggaacaacgcatgacccattcctggtcatgggggccacagctggactcagccttgaggcttggccagacttaacaccgtgtataaaccaggacctttttagaaatgcaactactgtgttcatcaagggaaaactgaacttcgttttccttaaaacttatcaccagctggtcatcattttgacaaattctgtcaacaacagccatgtcattcctggcatctgtattggtcacatctgaacgacacacgccctgcatgcagccctgcaggacagctccaggcctgagttttggtgtggtctgtacctaacc

SEQ ID NO: 477854 - DNA, 3172 bp, Homo sapiens
aacatcggggattaaatttcaacatgaggttcggggacaaacgtccaaactatagcagggatgacaccttcactcaaatcacagcccctctggctgttcgttcctggagccccttgtgctgcgttggcccctgcttggtcctggaagaacaagaggtcgagtggaagactatgctggatgttaaaggtggaattttggtgcatttgtcctggaccactgacgctttcttgttcagcacaagggcgatggcaatggccactggcaatcctgggctccagaggcactggagtattgacacgctaggggtggacatgcccagtgtggatgccctgcagtgctaccctgggaagcagatgatctgggccatctggtggccacactggtactgtgctgctctgtgtttagctgggcatgtgctctgggctgggcatgagacaaaatgaggatagctgctgggctgtggatagttgttcacaggggtgcaggctgttgtaggtgggccaggaggggctgggcagcccatgagggtgaggctgagactccacactgagcccaggtttaggggacctggtgggggtcacagcctcccctgtcccagacttctcctggcctctctcatgtcctatgagaccccctcactgtccaccctcatgtcctgtagagaccccctcactgtccactctcatggcctatagagaccccctcactgtccaccctcatggcctgtagagaccccctcactgtccaccctcatgtcctatagagaccccctcactgtccaccctcatgtcctatagagaccccctcactgtccaccctcatggcctgtagagaccccctcactgtccaccctcatgtcctatgagaccccctcactgtccaccctcgtgtcctatagagaccccctcactgtccaccctcatgtcctatagagaccccctcactgtccaccctcatgtcctatagagaccccctcactgtccaccctcatgtcctgtagagaccccctcactgtccaccctcatgtcctatgagaccccctcactgtccaccctcgtgtcctatagagaccccctcactgtccaccctcatgtcctatagagaccccctcactgtccaccctcatgtcctatgagaccccctcactgtccaccctcatgtcctatagagaccccctcactgtccactctcatgtcctatagagaccccctcactgtccaccctcatggcctatgagaccccctcactgtccactctcatggcctatagagaccccctcactgtccaccctcatggcctatagagaccccctcactgtccaccctcatggcctgtagagaccccctcactgtccaccctcatgtcctatagagaccccctcactgtccaccctcatggcctgtagagaccccctcactgtccaccctcatggcctatgagaccccctcactgtccaccctcatgtcctatgagaccccctcactgtccaccctcatgtcctatagagaccccctcactgtccaccctcgtgtcctatagagaccccctcactgtccaccctcatgtcctatagagaccccctcactgtccgccctcatgtcctatgagaccccctcactgtccaccctcatgtcctatagagaccccctcactgtccaccctcatggcctgtagagaccccctcactgtccgccctcatgtcctatgagaccccctcactgtccaccctcatgtcctgtagagaccccctcactgtccaccctcatgtcctatagagaccccctcactgtccaccctcatgtcctatgagaccccctcactgtccaccctcatgtcctatgagaccccctcactgtccaccctcatgtcctatgagacccctcactgtccaccctcatgtcctatgagaccccctcactgtccaccctcatgtcctatgagaccccctcactgtccactctcatgtcctatgagacccctcactgtccaccctcatgtcctatagagaccccctcactgtccaccctcatggcctgtagagaccccctcactgtcaactctcatgtcctatgagaccccctcactgtccaccctcatgtcctatagagaccccctcactgtccaccctcatgtccaaagagaccccctcactgtccaccctcatggcctgtagagaccccctcactgtccaccctcatggcctgtagagaccccctcactgtccaccctcatggcctatagagaccccctcactgtccaccctcatgtccaaagagaccccctcactgtccaccctcatggcctgtagagaccccctcactgtccaccctcatggcctgtagagaccccctcactgtccaccctcatgtcctatagagaccccctcactgtccaccctcatgtccaaagagaccccctcactgtccaccctcatggcctgtagagaccccctcactgtccacccatatggcctgtagagaccccctcactgtccaccctcatgtcctatagagaccccctcactgtccaccctcatggcctgtagagaccccctcactgtccaccctcatggcctgtagagaccccctcactgtccaccctcatggcctgtagagaccccctcactgtccaccctcatggcctgtagagaccccctcactgtccacccatatggcctgtagagaccccctcactgtccaccctcaggaccctctgcatttgctccttgggttcccggaacttgagcttgggtcttggtccacagcagctttgggaagggccctcggctgctttttgcttcagcagctggggagcagttaactttcagacccggccctcccccaaggcagctcagggaggggctggacactcggttatttatgtatttacttatttttaaatcaaagcacagcaaacatgaccatgtgggggtggcccagtggaccctcacagtgagccctgggccacacagaacatggccctggagcacccctatgaggttttaacagggttttgggggaccttggtgcttcctaaagtttcgggatgagtccccggggtctccagactgcgtctgcctcctcgtgcaccagagggtggcagtaactgttcatgtttgccccatccaggggtttttaccaggggtacctcatcctttctggggagtggggag

SEQ ID NO: 477855 - DNA, 1509 bp, Homo sapiens
gcatcgttagggcccccttgcccatggtgtggcgtcccctgaccgatttagccgttattgagggacatcgaggttgcttggtgtggcggcccctgaccgatttagccgttattgagagacagccaggttgctttcaacgttttctttttcacagacagtggtgccaaaggcgtccttggacatgagtcgtctcccagtgggagcagagacctgggtgtggggagactcgagtgcaggaccctacagggagggctggggaagcaaacacccactcccagttggctccctgcaggccagtcccacccagcagcccggagtcaggcagccgcaggtggccctgcaggtcacagaggtggaaagtggggtgggccagatgctggacagggctgtccatggggagctctatggacctctcaatgtcagcgttttggggcccaggccagggtccgggatccataggaacccctcgaccaccaacagggccttgagcaccctggccagggcggaggtagtccaggacagaggacagttttgccagtggaagcctccggcagctgtgggccccagggctgacctgctgctcgtcctgctgctcgtcctgccccgtgctccaccgtcctggtttgcccagagacccccaggcacccttggctggtgggagagacagcacaaacatgaacggctcacgggccgcacataagatgcccccgctggggaggagggcacaggacaagcattcttcattgtctgtctgacagtgtgttttgaatgcgtgtttgaatattttcatgcttaaaaagtaaacaacaaaagatgatgggagataggatgaggaggcagcgtgctgaaaagggtccatttctaggtggcgaagagagcaattgctgtttactcatttgccaatcagctcattatccagctacctctccttgttcctgccttcccacttcccaaatcctactgcttctagggcgtccctctgcaactgtacccccacccaactgcctggcctgactcctggcaggtgagtgggcatgtacatctacgtgtgaatggtgtctgcatgtacacacatgcacaaaagtatgtatgtgtaaacgtgtgcatatgtgaatgacatgtatatgctcatgcagatacgctaatgtgtatgtacatgcgtgcatgtgtgtatgtgtaagtggtatatgcatgtgtgtacatgtaggtttttgtgaatatacaagtgtatatgtgcacataagcagtgtgtatgtgtgcatgtgtttgcacatgtgaggggtgtgcatatatatatgcatgtatatgcatgtgggcagtgtgttcacatgtgtatatgtgcatgtgtgcatgtgtgtgcacatgtgaggggtgcgtgtatatatgcatgtatatgcatgtgggcagtgtgttcacatgtgtatatgtgcatgcgtgtgcacatgcgaggggtgcatgtatatatgtgcatgtactcacgtgtgtatatgcatgtgggcagtgtgttca

SEQ ID NO: 477856 - DNA, 615 bp, Homo sapiens
gttaagtcgcatcaagactgtcggagatgccagatgatgccggttcggaagcatccagggtaaagaccgggctgtgcgcgggaaacacggaggctggacccaagcaggaaattcccacccgctttgcggagaacaataccagggagggggctgctggctctgctctcctcttcctcacctctccctctccatggagatctctctctgcctgctggctccatcttgtcctgcatcatggacaactatgggcagaggagaacaaacatacaaaacgggccacgggcagagagcagggtaggatgaaacatgtcattagcaatggtgattccgtcctgagctctgtggggaaattggtgttgaagttgggccactgtggggaaagaaatgagtggtccagaagatattcaaccagccaagattaccatgttttcacatctaaggaaagagagctgcagggatgaggggaggcgggcacatctatggtctctatgtttctgggtgtgcaggcttggggagcaggagaaaaaactggagaatctggagaaagtaagacattactgttaagtgcctggggcaactttctaagtgaaagattccaataacttccactctgct

SEQ ID NO: 477857 - DNA, 963 bp, Homo sapiens
gcaggcggcggcgggcggcatggagagcctgctggagaatccggtgcgcgccgtgctctgcctcaaggagctcacggccatcgtgcagaagcagcagagcctcatccacacccagcgagagcgtatcgacgagctggagcggcggctggacgagctgagcactgagaaccgcagcctgtgggagcaccagcagctgctgcaagcccagcctccgcccgggctcgtccccccgtcatcggccccgctgccggccgctccggccaccgctcctgccgccgccgccagggcccaggaacctctccaggaccagggacagcgctcagcagccgcgccgcatcccgcgcccgatcggccgccgcgtcagcaccacggacagctcctggagcagccccagcggggccctggcagcagggctcacacaccccagtcgccccagaagcatctggggacacaaggggccgtgactgacaaggagaaggagcgtcccccgagttgctgcgctgctgccggagccctccttcagcacaaatccccctccgccctcggcaagggcagccgaagaggtgcaagggaacatcccatcaaaccaatggaggactcaggcatggcttgaggactcagtctggttacagctttttcctccaactcaaggagggtttttcatacagggtgtttggccgttgttgaaagggagcaatgacatgggggacagttggcagatggagttggtattcagatgccatgcctgtttaaatctccccgttaaggccagcaactgcaaacccttttttcccggttatctggtgatcactgaaatcttgccttgggtcctgagagaaatgttaacctctcagttcctagaacttcaagctctttcttcactcaggaggtccatgaactaggaatatgggaagaagatatgaaagtgtctgggatgttctctcctctgtactggaaaggctg

SEQ ID NO: 477858 - DNA, 867 bp, Homo sapiens
cccaaggccaagtgaccctctcacccactgtgaatccagcacccctagaaaagctgtgcaccccagcagatacagtaggaggcccagggatggtgtttactgctgggtgagggaaggaaggccctcaaacagggcagcgcatgatgcctcctagttagacaagaaagactgggagctccacagataagagaaagaggggtcagcccctggccaggtacttccaagcacaatggtcatctcccaagtgtgggggttggttcttctctgtggcccccagcttcttgaagccactggggctccaatctcaggaagatgtgttgtacagaggttccagaccagcctggacaacatagggaaactgtgcagcatagaccccatcttaaaaaaaataaaacatgacacagctgtgtatgccttgattcctgtaacctacagcttcaaggacaagaaatttgctcacaatcctgagtgcacctggtcctgcacctgtttaagattttttgaaaggctcaccctccgggggcagcttgatgggtttgatagttctagtgctatagaaagaggatgcaagccggtgagaaggcagatggagagcatgaaatgtaggctggattcagaaggaaagggctgccctccagccgccccatggcagttgcagacaccagcagaaaccacagtctatgggggaggggattttccccctctctaccccacatggggtggactgtgggtctttgctgggagagctgttcagagcatcctgtatgcattacctgctgctgcatcagcagccaccctgaattttcctagctgaaagtcacgtaatgtatggattctcacgactctggagctgtcctcggctcttgc

SEQ ID NO: 477859 - DNA, 697 bp, Homo sapiens
ggtccaggactgcagagccatggttggcctggtccttctggggctggggctggcgctggctgtcattgtgctggctgtggtcctctctcgacaccaggccccatttgacccccaggcctttgcccacgccgctgttgctgctgactccaaggtctgctcaaatattgtaggaagctgggagtggaagagagcctggggctggccccagctgctgctgcgaaacaggggtcactggatgctgggtccctggccgggctggctggaggcctcaggaagaggcctgctacagcatcatcctggccaagattcctccctgcagaggaccctggccacgctgccacagggtctgctggggccaccagaagcccatgttcctgcctccatctctcccctttcaccaggttttactcttgggattctgctacagctggagcccctgggtgcgagttcctaagctttcttgtccctgcccctgccccagcacaggtgacttcatttctgtcctctcagctcagtggacttgctcaacttttgcataagtctccacttggtggtagcagcttgctgatgacttgttttaaaactttcatcctaaataacctttcgatgcttgaatatttttaagttttatacatagtttctaattttttttccccaacagatccagatacctggatccagggaatgaagttcattt

SEQ ID NO: 477860 - DNA, 4701 bp, Homo sapiens
ggactcggaggaccccttcacgcaagatgaagggtgttattaatctggcatcttcttcgtgtggccctggtggtctctggcttggggcatggatggctgtaagcctgagctgccattctgggggctctgctgggagggctagctctcaggagatgagtcttgagtatggtggggacagtgggagcgggagcttaaaaagtcagacagaaaagcactcgggctgcctgagtgaggaaaaatcataccagtgccaaaattccacaggatttcttacttttctaaagctttataacaacacttctattaatttatttgctgttcagggtgtgagaaaatctattgctgggagtatattggagagggttgaggagggtgcagcagcaggtattgggcactacactgtggtcatagaaaggaagaccaaggccctgtgcacagacagccatacaggctccacccgccctctgaaaaatggatctggaaagtttacttgggctgcagtttggaaggagaaacagattcctgtgcactgaggcttggtacaccctggggataaaaaccgaagaatagccatgtaaccatcccatccagtaaggtcatctgctcccttcaatgtgtggacaaatgctgttatttcaaagcattcttatcttactcttcactttgtatgccacatgaaggccacgtgtttgtgagctgaggttttgggttggcctttaggctacttataaatcctggaatcttttttctaatttcccaaggtttgaaaattgttttgtgtgttacgttttatattgatgtaattcaaactttcagaaaaattgcaagaataagaaaaacaacttccattatacactttatccatatttgccaattatttacattttcttccatcggctttatcattctctcttgataaatatataaatataatatataaacattgttttccatttatatattttgtataatatacaaatatgtattttatgtagagatgtaaaaaatgtatttataaatttgcgtacttcatgtatatgatgtgaatatatatttatatttcataaagttttagatgtttattatgtaactatatatgtatttgatctcttatatgtacagccattatatagatgcgtgtgtgtatatgcgtgtgcgtgtgtgcgtgtgcatacatatgtatgcatcttttccctaaatcattggaaagtgatttggaggctttgtatgtatttaccattagtgacttcagaatgtaccttctaaaaataagggaattttctaacataaatgcagtataatgaacaaaatcagaaaatttaatactgtacagttatctcacccacagcccatatgcacatttgccaattgccaggaatagctgtactagtttcctgtggctgctataataaattaccacaaacttagtggcttaaaacaacacttgcttattcagttacagttctgaagatcagaagtctaaaatcaaggtgttggccagactggattccttctgcagctttcaggggagagtccattcctcccggccttccctggctcctggaggctgcccgcattccctggctcctgtcttcacgctcagctcactccagcctcaggcttctgttgtcacactaccttctccacctgtgactctgccacctctctctcataaggaaacctgtgataacatttagacccctccagccccagataatccaggataatatcccattttaagattgacttcatcacatctgcaaaatcccttttgccatgtaaaggaatgtattcacgtattctgggattaggacgctggcatgtttgcacggccattattcagcctccacatcatgttttatagctatttttccttccaggtccagatcacattctagggtcctgtaccacatgtagttggcatgcctctttagtgtcttttcatctggaagtttcttagtctttctttccatcttctgaccttgacattttttaggagtacagaccggttgcttcacaacatgtttctcaatttgttaagcagcatttgagaaaaaaaccatgctaatatgcatatacacctttaaaagagaagacgtagagagttcatgagattttcagatgagttctatatctcccaacctgttaaaatccactggaactgagatagttggattgactcaatattgaatcttaatctgcatatgtgtacatatacataatatgtatatcactggtgtgtgtggcagattataaaatagctacagatgctcctgtgtgccttcctctccttacaaagtgacttagctcctgccatcaaggcacgaaggagtcctttctctctctcttaaatctaggttggccctgtgacctgcattggccaatgggacactagcaaaagtgatgcaagcagggctctgaaaggtgctgcgcactgagacttattatcctgcagcttctggagcccttcgactgctgctgtttgaagaagcccaggctagcttattggatggtgagagggatacggcctggtcacccctatgccctggccctcagcgtgccaggtatgtgagtaagcccaccctgggttattcagccatgagccagccctgccactgaccacaaagatcagccatgccagcttagactggaagaactacctactaattcacagaatcccaagctaaaaaatgattgttctcttaagctgctaaattttggggagatttgttacatagcaaaagctgattgatagaacatatatactttaatattccacgtaatttagattattaccttttttggttagagtgtacataatcttctctctgaggctcctaaagatagaggtacagtctttgaattgtttttagcagctgaagcagtgtttgagtaggccaacaatagcatggtttcttactaaaataaaagcactatgtaatttggttcctttgtatataagaagagtgtatacatctacaagttaatatgtattaaaattacaagttaagggttaaataggagttattgttcctaggtgtccacccataggtgaatgtcagcttctgcaatgctgctaatcagacattatgggtagatgaaggttcatctaattccctttccatttcccaatgcccctccccttcctgtttccccaacactaacttgtcaggatgaggggcttgcttcatgggagctggaggttgagccaagagttcacccttctctctcctggcttggtcatttcttctcagaccctaaatccttatcttcgctttaataatgtttcaatatgcttttggcatccgcagctcattcttgtgaactagagcagggttcaccaacccctgggtcatggactagtaccagtccttggcctgttaggaattgggccacacagcagaaggtaagtggtgggccagtgcgcaaagcttcatctgtatttacagctgctcctcattgcttacattaccacctgagcttcgcctcctgtcagatcagcagcagcattagattctcatgagagcatgaaccctattgtgaactgcacaggggagggatctagattgcatgttccttatgagaatctaatgtctaatgatctgccactctcttccatcacctgcagatgggaccatctagttgcagggaaacaagctgggggctccccttgttctacattatggtgagttgtataattatttcattatatattacaatgtcatgataatagaaataaagtgcacaataaatgtgatgtgcttgaattatgcgctgacctagtgcatgggttgctaaagaatgtgggtattaatatatctagggcttaattagtggtggaatctgggatagcaattcttttggttggcatcttcctcttttccacctcctctttcttcttaaaaatgcatattaaggcccttatttggtggcttcaaaatcattgagactgaattaagaaaaatagtgcctaaatttgtaaatgcttagtattgttacttgctgcaaatatgtagagttttctgttatttgttgcagtatcctgtgttttcatacactgaagtcaaaaaacacccaataaataaatatttaaccccaaaattgatctttccatttatctgtctattcatccatcacctcctccctcaatgctgccacctacccactcatccataaatttctccctcccctttctcctctattttcaccctttctctgcctacttatatattcctccatctcctttcctgattccttctatcccttgctccctgcatccatccctatttccttccttcttccctcacttcttccttcctccttccctctcttgttccattcatgcatatgtattcatccattcatccatccactcatatatccatccatccttttttcccttcatccttccctctttttcttcatccatacatccattcatacatacatacatactttctatctatacatcttgataattatctacctgtactgtctatgaacatataaatacatgaagcatttttatgtgaacatggaaaggaagcacacattagtaaagagcagggcaccagagctgggttgtctggatttaagtcctggcattgctcctcactaccttggtggttttggaaatttctcacccaccttttgcttcagtttccacaattttggatatggagataatattacctactccat

SEQ ID NO: 477861 - DNA, 520 bp, Homo sapiens
tcaagatcagtccaacagatgtgcgagtccatacacacctcaagactttcaacttaagaatgttagcatttccaaactttctgatcatggccttgctctctcatccaggctggagtgcagtgaagacccgtgaaagattccacctgggtcccagcagcagggatggtcccgctgccatgaggcctttcataatcggctctgtcatgaggaggaacaacgctctgcgtgcatttcataaattattcttcagggttgtagctgccgaggtgatttcacaaggcaccctgaatcctgactcctcaaatgtatttgccagcagggaagactgcagagacagccacaccggctcgctctgggagagcggtgggttgcaggtcaccctcacacctgaacaaacatggaattcagtggaatgctcacgtcgctgtttccacttcttggttttccacttgaatcggtgctttatttaccctctgcttctaacttagcctgaggatttcaagtgttattttgagagaga

SEQ ID NO: 477862 - DNA, 828 bp, Homo sapiens
ttattaatctggcatcttcttcgagatgagtcttgagtatggtggggacagtgggagcgggagcttaaaaagtcagacagaaaagcactcgggctgcctgagtgaggaaaaatcataccagtgccaaaattccacaggatttcttacttttctaaagctttataacaacacttctattaatttatttgctgttcagggtgtgagaaaatctattgctgggagtatattggagagggttgaggagggtgcagcagcaggtattgggcactacactgtggtcatagaaaggaagaccaaggccctgtgcacagacagccatacagaacaaaacatacgaagaaactgtcatgatattagatttggcagttatttcttggatatgacacctaaaccaaggcaacaaagaaaaatagataaattggacttattcaaaattaaagacttttgtgcatctaagtacactaccaagaaagcaatataatggcctacagaaggggaaaaaacatttgcaaattacacatgtgataaggagttaatacccagaacacataaaagactcctaaaatccaacaaatgcaaaacaactcaattaaaattgacaaaggccttgaatagacatttcttcaaggaagatgtacagacagccaataagcacatgacaagatgctcagtcaatatctttactcatagagaaatgtgaatcataaccacagtgagataccaatagtacagttactactgaaaaattagaaagtagcaagcattggtgaagatgcggagaaactggaatccttgcaggaatgcttatgggaatgtgaaatggtgctc

SEQ ID NO: 477863 - DNA, 806 bp, Homo sapiens
gcagggatgttagtggacatctgccatgtgccctgtgtgccactgggaggcatgggtggagatcaggttccaggcacacctctgggacataccacagggccaagcttttgcagcctgggctccttcaacgactccattcatggatgtagagaaatgctccctttcatggcagctgcaggtggtatctttgcccctcttcatcccactgcctcacagccctgccctggcctcactgattccagcactgaactttccatcacagttctgtctccggtcagtcttttccctggggcactgtgggctgaccatgtttcaggatcaggctcaggatgaaatcgagtctcccctcaccagtgcccatgagcacatctacacatacatgtctcaggacaagaagaagtctctttcccaacccctgaacctgggcattcccgtggctgcctttgatgaatggacagtgggggacaatgaactgggcaggctcctgagccccagtataggttacagcccccaccttcactcccttgcaacactgagaccacagtgttgtggagagtcctggatcagcgtcctggaagatgagaggctacttgggcacacggagcctgtgtggccatgggcaggatgggctggggaggaggcccttgctgaagtccaggtgatcactgataaaggcctgaactgggatggcggtgggaatggaagaaggggaccacgaaggggatgtgtagagcaagactgctgaggactcggtgactggaaggggaagttgaggagctgccctctgctggcctggcatggctacc

SEQ ID NO: 477864 - DNA, 645 bp, Homo sapiens
catgtacttcccacatggttatatcacaaactggggctcaggacccaggaactggcagcttccattctctgttccttggaccactggctcttggagccctcaactgtcatgtaagaagtctggctacccttctaataagaccacacagagagaccccgagacaacctgaggagggagaggaggccagctgtgtctaccttcctacttccccaccaaagtgccagataaactgggaactctgggacacaaatggcatccaagggttacttcacctgaagcaggaagctgagcccttgtgtcccaggatcagtcaatcttggagccaggaagactctgggggtgtgaggaacagcagggggcatttccaggctcagggtaatgcccaagggcagattcagaagacaccatcctgtgtttggacgttagcatctgctgaatgtgtgaggctcctggggaagctctgctgctttcaggccgtgtaacccaacttctctctgccttgcagggttttgtgcagacttacaggtatcattttgtatgaagccagtacacccacaaaaattaggagatttaagatctcaccaggaacctagctgctattccatgattgacaatacgtttataaagtagattgacattgtttct

SEQ ID NO: 477865 - DNA, 1751 bp, Homo sapiens
gcagccaagctcacagtggaaaaatgcggggtgtcctgactttcctcttcacaaactgctgctctggacacactgcctgtggggtatccctgctctgcaacgagcagtacctctgctgctgccatgcactgctgcttcaataaaagttggtattcctggactggactgaccagctggcatagaccaagctctggtgaccgtttatgtcatcaacaactatttgggcataggctccgcaaggcaaaactgtcatttatggaattacagaatgccttatccaccatcatgatattccacacaacattgcttctaatcaaggaactcacttcacaaccaatgaagtgtggccaaggacccacgctcatggaaattgccatcctgaagcagctatgttatagaaccttgaaatcgtcttttgaagattggttaccatgccagttaggcgggaatacctttcagggctggaacaaggttcttcaagaggctgtatatgctctgaattggcattcaataaaaggtgctgtatcttccatagccaagattcacaggtccaggaattcaggggtgggggtagaagaggtgccattcactattatccctagtgacccaccagcaaaatgtttgcttcctgttcctacgaccttattctctgcaggcccaggtggcttagtgccaaggagaagaatatttccactgggagacacaatggtatttcccctgaactgaaagttaggactacttaactttggggacctcaggcccctgtatcaataggaaatatgatagttactgtactaactgaagtgattgatccttactaccaagaagaaattggtagtagagatcaatcactcctaccaaggagggctgtttaagttatatttttctgttggtattctgttgttcatagttttccattataatcttttttatttctgtaaggtcagtaatgatatcctctctttcattcttgaattaattaatatgtgacttgtctagttaaaacttggtcaaatgtgttgattttgtcaaagcaccaactgttgctttgtttattttctatatttttaattttattgattcatgctctaatccctattgtttccttccttttgtttgctttgtgtttagtttgctcttctttttacagtatcttaaggtgttctttgatttgaattttttcttctttttaatataggaattatacataaatttctctctaagcatggctttagctttttcttgtgaggtctggtatactacatcttcattttcattcatctctaagtattttctaatttaccttttgatatcttctttgacccatttgttgcttagaagtgtgttctttaatttccacatttctaaaaatttacctaattgatttctaatttcattctattgttgttggagactatatgttataatatttcaatcatttaaaactttttggtgttcttttaatgacctagcatgtggtttatccttggaaatgttctttgtgcacttgagaagtataggtattttgctgccatttggtcaaatgtactatatgtgtctatcagttccagttgatttatagtgtttgagtcttccatttccttatcgatcttctaccaggttattctacccattatagaaagaggggtattgacatttacaactattttttattatgcatctatcccttcaattcagaattgttgctttgtgtgtttgggggctctgtttttaggcttatgtgtattcca

SEQ ID NO: 477866 - DNA, 689 bp, Homo sapiens
aaccaatcaaggtgtattgagccagcctgagacttcacccatgtcctgcaaaggacatgaactcattcttttttatggctgcatagtattccgtggtgcatatgtgacccgagatttttatttccctttgcagtgccttcttgctgcatcctctggagagaaggagccctgcgtcctcagggaaggcagaagggcaggcaagccggatactgtgatggtgcctcttccattcacaagggaggagccctcacagccttgtcatcacctcctaaaggccttgccttttaatttgatcacatgggccatgaagtttcaacacctgaattttggcagaaatgcattcaaaccacagcagacccattatcctatttctaaggaacctgggataagacaagtccataggacaggcatggacaagcgtcctgagccctggggccaggggaaatccaagctgtgtgatcttgagcagcttccttgcagctcatccttcatgtcctaaaacagatgatacagcaacatcagcaaggtggcagactaaggaacttcagacactacttactacccccagaaacatttttttaaaaacaattagaggacctttggaaaatagtgaaaaggtacaggagccaagcaactgcccattcaagaaaaagcaacattcaaaatgcaggagattttgtggatttgta

SEQ ID NO: 477867 - DNA, 558 bp, Homo sapiens
agtatctcaaagttagagctaacacaatgcaaagcagaacagagctttacatttttgagagagatccatccactttcaattcctggggtttcttgaggaaagcacgtttttcccagtacagatctatggtgcttcctctgtttttcccaaggagtgccaagctgttagaagttctcttaagtcctctcctatgtgcatcaagagtggcaagacaaaaacagagaaaaataattcaatcaactgagaaaaaagagaaaaaatcctttttccagaaaaacaagattcaagaagagaaaaaaacaaaccataaaagggcttttaaatatagacggcagagaccaagagaaaatactgttacatggttacaagatcaagttcacaaggacataaacaagatggagacctcatcccgtttcttcgtttgtttcagggatctgtaacaaagtttattactgaccagcttgctgggctatcttgaacagcaagcttatggggtcctaagctcatgttctattttaaggtacctctcttcatggcagaatgacacagaaagacaaa

SEQ ID NO: 477868 - DNA, 520 bp, Homo sapiens
aggaaatgctaacatgttcactaaacaaggtgattatggaattccaaaggcccaagtgtgtgtgctgcagaaacagcgagtgggtagggctttcctaagcccggtagcagggctcttgcatcctggaggccatgagaactgtgaggtccacaaagaggctgctgtggccaaatgcattatcatgcgagggaatgggctggataaagggatcattgagagcagtgccagcccaagaccaaggctgggggagtgggatggtgtagactgtcgtcccgagcctctccatgatgccaacattgctaaagttgctcgagggcagggaggacaagtggctcatggtgcaggaggtgttgctgagtctggtggcagctctgctctcattcctgactcccacgacaaacacagacttcacagaagtggcaaacacgctgaccctgcggctccaccattcaagggagcccagcttctctaaggcactgacagctctagtagtctccgctgctcattaccgttgcatgcc

SEQ ID NO: 477869 - DNA, 1432 bp, Homo sapiens
agaccttggccatgtcgttcttcactctcaggtactactatgctgcttcctggaaacatggcccaaatccagaagtccttatggagtgtgcagtaggagatccaggggcctgggcacatgctggctccttgtcctctgtgctcatgaaatggggatgggaggtcccgcaacgtcttcaggaaatggaagagaaggtggctagagcaggcccaacagcagagctggggctcctggtgggtgtggagggaggttttatgtggctgaggctcagagcaggatggacctctacggagagaagccacagcaaggggctcctctccatggggtctgctgctcgccctggggctgacctgctggtctctgcacccactgtctccacaaagaactgccctgctgaaactatgggggtagttctcagcaacaccaacagggataggcagggccgagcctattccatcaccaggtggcagatccacacagaagtgaatctttctggcttgcgtcactacagagggactgcagcagagccagcccagatgtgtggtgtctgcagcagcagctgtggatgtggccagggcatgtgggggtgtgacctagcagtcccagtgtgcatgctcggggccatggactatactgcaggtgatggagaagctcaggccatcaccaggcctggttctgactctctggcatctgtggcctgctttctggctgtgcccctgttgcttgggtggaaagccacctcagagaatctggacccaggagtggttccagctagcaccatgggaacaaagttcagtgttttccaacccggtctgctgatcactcccatcacagcccgtggggacccacccccaaacctactgaattcagaatggctgtggtcgggccatgaggtgagggacggggaccacagcagtagctcagtcttcgagaaaccagctcagagagctccatcccacctgagcgtctcctctcagcacaagctggtggctgtggagcaaggctgtgctctctacacccaggagacctgggcacctgtcgaagtttcctagagggctagtggcaggaagagaatgggccagttcctagccaaggcataaggtggggcttggttacttggaaacctcagggaggtagaagacagagatggcctggagcaagcagcagcccacacctgctggaaaagtttagcttgtgaaaatggattttccacaaacacggaaattggcaatttccccttaggattatatatgagggaagtaatctatttgaataatgctgtgaaataaaagacattcccgtttctcgttgtacccctttcctcctttctaatggaacaaggcaatcttggaaagtgcagagggatgagacgcaggcaacaaaaatgccttcatccatttgccttgatagggaagggctctatgtatgtata

SEQ ID NO: 477870 - DNA, 1916 bp, Homo sapiens
aatacaaatggtggagccgtggtttctgctggtgccctggtgactccccaggctcatggctcgaggcactgcgcaggccctctgcagcccctggagaatctgcctgagggctttcccagcattgtggggtcggcctcacaagcatcccttagctgattacaagtgggaattggagggcgttcagcaaacaccccctggggagagtactactggtggccaggccctgtgtaggacaaacattggtggacgaggcaacaccaccctccttgtggaggcaccaaggcctctgtcctgccccctgacttccctggagcccctcatcactccctggacacaggcggcatggactgagggtgctctgcaacagggcccctgggtttgctgcaccagcatcctcagcaggtgcctctcacctgcctccagctcagatccccaggataacacggttggtcctgaggagactcccaccaagaacctggggaagcagaaagaagaacgttaaaaaggaaagtaaaactgcacatggctcaaaacttcaaagagttctgaacattttcaaataaaaagtgaaagcctttctcttattttctaggctggttcatcacttcttagatgtccttttgagagaggcttctgtgcatatgccaacacaggtattttatagggttagttatttatttgttattctgtttttacactgttctgccttttgttattcccttaaacatatgtcttcgaaatgtttctgtattggtagagagagggtcatttcattctttgtgtatgttaataacttgttactgaagtgtatacataaacacaagtgaacaaattgtagtttttccatctgtagaattgtcataatctaaataatctgtttcttaatgatagattatttgatttttttgttctggtttcattcttgcaacaatatttgtaagtgtttctttttcctggctaacttatgagtacagccaccaggtcaattcctggcaggggtactgctaagtcaaagggtagctgcattttttaactttgatggatatggcccattaactttccagagcagccctctgcaacttacactcctgttgacaatttacaattgcacccttttccctatgctcacagcagccacgagtgccattgcatttttaattttgctactttgaaattatatttctttgttctttttatatgtttctttaattttgagagaaattgagcaagccttttaaaaactgtatttattaaccaatttcatttatatttctgtgggcttgtttttcagtggggtttgtaaatgtttttcttactgactgatgagcactctttgtaaaacgtgttgctcaatgaagcctacaagccttttcccatttgggtttcaaatattttcttcagttaattgttcactttttctttaattgtgggtttttgtgtcctcgatgatgatttttatttctagtcaaatatctcaacatttcccattaaagttttcaaatatatatcttgcttagaaaggcatttcacattcacaactataaataaactcaccttttaaatttcagaatgttttcatttcactcttgtacactcacatctctgatacctctggaacttattttggaacaataaggcagtgggtcagaattctgtgtggttttccaaataccacattgtctctaagccatttattcaatatttcctctcttgccctctgatttaaaatgcttcctatcatacacactcgatttgagtatacatttgtatatatcctggggcctctttctgctccacacaaaccttcgtgtccatctgctttcattcttgaaccttcacggtgcatttgacatttcacaggactactccccaattcccttcttccacctgactcttcctgtttattttcccacatc

SEQ ID NO: 477871 - DNA, 683 bp, Homo sapiens
attttatttcatttggtgctaattgtgggctctgtcctggctgggagcccagacaggccagtttgaaggatccacggcccagcaggctcacacttgtacttgctgaagcattagacaaatgctaggcttcaactgctgtttccaaatcacccccatgccctctgccttttggaggctctgtttccaggtgcgagggttgtctcctgtttccttctgctgctcccacactatctggttgggggctcctgtggctacgttgggagttgagtccgagagcttggacccggagttcaacggagccctgaacaaaaggaacctgggaggctggggcgtggcacgggctggcatgggaaaagcgctgagtcagactgtggaatacgccttagccaacgcccccggtgaggaggcctggagggaggtgcctggagatgctgacttcctgagtccagggaggggtctgacatcctgcatttccaacaagttttcagacaatgtcaatgtttctgggggtcttcgggcaatgcgttaacactggtcaaatgaccaagataaagcaacttcagagaaaatcagtgagaaaacagaaaagaaacaaaggtgaaggctaccctctcttattgatgtcattccccaaatgttgtcctttctctgctcttttcagaaatggagaggctggggttgcc

SEQ ID NO: 477872 - DNA, 1464 bp, Homo sapiens
tttggcaggagaccagaataattgaaaatgccctttaagaagacaaagccagtaaaacactacgtcaaattacatatggcaggtgtttctggctggcgccagtcccgaggtgctctgctgattccgagaagccggcaggcggcagccactgtggtcagggcagcactgccgtcttcatctgggcgtcctcatgcacctgctgtcagcaggccctcctaccctgaccctggaggacaatctgggagcctcggagcctttctgaaagtccagcctgacctcctcgctgtcccttcagcacccaggcacagccatgcctcagggcctttggatgtgcggtttgcctggagcactcttcacccagtcatctgcttggccaatgtccttggcaccttctctttggcacacccaacactgcagagcctcccctctccagcccacactcaggacccatgtatctgactctgctttctttccttcccataacacttacagtcgtgtaacatacaagttgtttactcttctgttctgttgttgtttgtgagttgttgccggttttgctccccaatatcctgagcactcagcagtgtctgcccggctttggctcagatggagcatgatgtgtggatttgggtttgttgcatcttctcagttcaaataaaactgacaaatggcagcattcttcagcagacatccagcatagctttatcaatttcatgtatttctgcttctgtctttattatcttgtgcattctattttcctaaggtttattctgttttaaaagaatatgttttcttaagttcattcattctcagacttcctgcttttctaaaacagccctaatatcatgtaaccactcttagaacctttttgttgtattctacaggttgtgacaggtactcttaatgattattcaatattaggtactgttatttataaattatttagaaatacttggtgagtcattgttacctcctttttcctgttttagaggtcatgacttctgtattctttgatacagcctagcatttacagcctgcattcctcacttatcaaagtctgatgttaactggtgattttatatgtgggcactctcttttccaaatatattttaaaaatcttttaatcattgatttttcacttaattgtattgcgtttagaaaatatggtgtacagtactaagttttgcaatcttttgagacttgctatttagtccaatgcataagcaatatttgtaaatgttgtctgtgatcgtataagaaataaatcccaccaattaatgggtgcgtgttctgcacatacctgtcagttcacatttgttagttgtgtcatttatgtccttgctaaccatttttgtcttcttgacctatcagtgatggtggctttatcaacctcttattgcaatcctgcaaatctttgctttacatatttagaagttattagttgcgcacaagtttagaaacact

SEQ ID NO: 477873 - DNA, 891 bp, Homo sapiens
tcccatttcttgttgggtcaaggtttttcttgattggcggggttgggttttagacacaggaagaaaatgcctgctgccaccttggaacttaatgaggcttctagcagcgagttctctcctgccctccacctatgcctgccacacgtcagggtccctgcaggacttggtgtccacagaggacatggaaggccagggggccttggagaaggtgctcagggaaccagttagccacctgacactcagcagcactgtcttcccatccctggagccttctctgaccaccgaggcctccttgacagccccaaaacctccctccgaagccctggagcccctgcctgtgcatcacgtcacccttcccagctctgcgggtcactaccctgttccctgctgtacccctacaccccacacagtgctgctgcagggcagaggaatggagggcaaatacccttgtgaatgtggcgagtggattttcaatggaatcctttcatcttgtgaactcccacacaggcgtccactacagaaactggggaaaggcatcccaggtttctacaaggaagagcctggaattctctgcctgccctccctgcaggaggcctccagcaacaccagtgagagccactggcctgcagaggcctctgcccttcgacacaggggcgtgcggctcggctgcctctcaggctacctggcaccagaccaggacactttcgagagcagaaacactgccattagtcacagcgctggggcagcaggcacgaacaaggactgtcctgagaagttggtgttgtccgagcctggggctttggaaaagccctctacagcccgaaagctctcccctccttttctgtaggacctttatcatggtgcagaggtgttaatgccataatcagaaac

SEQ ID NO: 477874 - DNA, 800 bp, Homo sapiens
agagatagatttgcaaaggttatttggttgctccctgatcacggcaccatcttgattctaggatctcttgaagggaagtggggacgccatcaaaggatcagagactctatgctgcatcttgaaaagctgacaaattccattatatatacattttatgcacctaaactcaacaatttaaaattcatgttggtcaacattttaaagagaaaggcccagaaaaatagccatgtaaaaagggcagccagtgggacccaaaaacccacccaacaggttcatgtggccagagagcttgagacacacactctgcggttctctgggtcgcgctcagcagccccgtgctttccatggttgtggagaggttttgttgagccgtgtctctcgtgtttgcagattggtaacccatgggccccacggtactggcatcatgcagggcatggcacagggaataaagcagggaaccctgaacagcaggccttcatgagtgactggggatgtctgcatgggtttcagcctccaccctgtaagccaacaggagatcccagctgtaatccggaccaactctgctctgcatgagagcaatgcattcctcagcattgttcacacagctccttgctaaggttccactgccatacttgctgtctcttcatagccctggttgcccttctcagggagagagcttgcactgacctgggggtagtggtcgagagatgatgtacccacagcttgggtgggacaggggatcaccatcttcctccaatccccactcttccagagatgcagctcacaatcacctcagccct

SEQ ID NO: 477875 - DNA, 612 bp, Homo sapiens
gtaccaatcagcactctgtaaaatggaccagtcagcaggatgtgggcagagccaaataagggaataaaagcaggccacccgagccagcagtgtgagaccacgaacccaccggaaggaacaaacaactttggatgctccacttttaagagctataacactcactgcgaaggacgagagtgtggaggaacgggaaagtcccccctctttgtggggcactgtggaaacccaaatcgcaaggtcatctctttgttatttgtgaaagaatggacaattgtcacctctgcagcatccctcatctcatcctgctttgtgccctggaatatggacaagggattcagcgcccagggctgcagggcctccctcgccccttgtggtgggagcgtgtcttttatcctccgtctgaaggtacagagcaaagacaaagcatgagattaagctcatcattccttcacccctccccaagatctctgcttgctccattccctttttcttcaaatgttcaccttatcttatgtaaaatttagatttacttggcattaactcaaatctcacaattatgtaatcatttctctcattgctgtccccctcctttttaaggaaaatgtctatata

SEQ ID NO: 477876 - DNA, 1000 bp, Homo sapiens
ctgtggggctgtgatgacccatgctcagcctgtccctgcatggtcagcggtgcatgacttcagcacagctgtgcaaggaccacaaggggtgactgcactgcccttggaccagccctgttcagggcaatcgccaccgcagctgcagtactgtcactgtgtgaaggctgaccctacagcagggggcccagggtggccattttgttgtgctcatagtttctggcccttggccactgctgctgggaatgagagtggtgcagccactttggaaaagagtttggcagttccccaagaagttaagcccatccagcagtccactcctacatatacatctaagagaattgaaaatgtgcatttgcacaaaaccttgtacatgaacgttcatagcagcattgttcataatatctaagaggtggggacagctcagactcagatgttcatctgatgaataggtcaacagcatgtggaatagccataggaggaaatatccagccataaaatggaacaaagtactaacttatgcaccagcatgaataattcttgatgctaagagaaataagcctgacgcaaaaggctgcgtattgtagaattcctctgatatgcaaatccatggatacagacagtggattgctggtcaccagggctggggacagagaggtggagagtgactgctaatgaggatgggatttctttgatgaaagtgttctcgaattagatagttgtacaaccttgtaaatatactaagaagacccactgaattttatattttgaaagggtgaattccatagtatgtgaattatgtcttaataaaaattgtttcagaaaaaaagtacagacataaattgctcaatgacagatacgttctgagaaatgtgtccttatgtgattttgttatcgtatgaacatggaagtgtacttacacaaacccggatggcagaccctactgcacacctaggctgtatggatatgggactgctatggtttgaatatgttccccaaactt

SEQ ID NO: 477877 - DNA, 901 bp, Homo sapiens
ctggcactttaagtctggacatctgaaacttggtatggcacatggtaactggtaagtcaggacactcagaccagttcccgtacatagacacttggttacagctggtgctagaccccccacagtggctaaaagggcaggcagcagcagtgctagtagcaaagggacagatagccaaggaaggatcccgctccacctgccaagggaaatcaactcccgaagttctgttcaacccaacatcagaagatccattgcaggagatggcaccagtgatcccagtggtgccctccccttaccagagaaagaggctccccactcttgagcccacagtgcttgcacctccacaaaacaaacatatccttaggccacccagagtaaacaagagaggagttgaagcctccggagaaactcctcccttggcagctcatttaagacccaaaactgggatacaaatgctcctgagagagcagcagtatactgggatagatgaggatggtcatgttgtggagaggcatgtttttgcataccagcccttcacctctgccgaccttctcaactggaaaaacaataccccgtcctatactgaaaagccacaagctctaactgatttgctccaaactattatccagacccataaccccacttgggctgattgccaccagctgctcatgttcctctttaacacagatgtaaggtggagagtgctccaagcagcaactaagtggctagaggaacgtgcactggctgattaccaaaatccccaagagtatgtaaggacccagttaccaggaaccgaaccccagtgggacccaaatgaaagagaggatatgcaaaggctaaactgatacagggaagctctcttggaaggattaaagaggggatcccagaaggccacaaatgttaa

SEQ ID NO: 477878 - DNA, 647 bp, Homo sapiens
taggctctgagtctacagcagggaaacaaggagcctgctctcatggagctcacaggctcaaaggatgcagccacatcattggacctttcaaccgggaagaaaaagaggtttaattggacttacagatccacatggctgcggaggcctgagaatcatggcaggaggcgcaaggcacttcttacatggcagcagcaagaaaaaataaggaagatgcaaaagcagaaacccctgataaaaccatcagatctcatgagacttattcactatcacgagaacagtataggggaaaccacccctgtgattcaaattatctcccaccaggtccctcccacaacacatgggaattatggtaatacaattcaagattatgaggtagaaaatttccaaactatagaaagggggatgagaaaggagacaactgaaaagaatatcaaacatgactatagacccctacaaaaagacaggagatataggaagcaggtgagccaggaaagtggttaatctaaataagctgttcttaatgttttaaaagtagatgcaggcactggtgtttttaatttttaagtagtcaaagtggagaactcctagtcttcccacttctctctgatgaagaaccactacattaactcatttaaattcggtatgct

SEQ ID NO: 477879 - DNA, 1092 bp, Homo sapiens
caaccctgaggaggctgtgagagtctctggggtccttgccggcctgcagaaaatcaagctttgagcgggaagcttcgaggagacacagtgtcacaattacaaggttccagcatttggaggcaaacatgaagctccatcctctccaattctggggcaaccgtgtggagatgatcaaaatgcttcaccttcaaaactttcaaaggaagagttaatacagagtatggatcgtgtagatcgagaaattgcaaaagtagaacagcagatccttaaactgaaaaagaaacaacttcaatatatgggtcttctggctctcagtacattcctcctgagccatgatgggccccagttcaatgaaaccttctgtggcagcatcatggtgtccaggggtataatctggagcatgtaccagcgctacccaaagtacctgtattttaatatgctacctcctctccttttcctccaagattttcataattgtggttgtgatgatgatgatgatggtgatggtgaaagtggtgataatgatagtgatagtcatgttgaggatgatggtgaggatagtgatagtgataatgttggtgatggtgaggaaagtgatagtgaaggtggtggtgatgatagtgatagttatgctgaggatgatgatgatgatggggagaatgttgaaggtgagcatggtgatggtgatgataaggatggtgatggtgatgatgaggtgataatgatggtgatgaggatggtgatggtgaaggtggtgatcatgatagtgatagttatgctgaggatgatgatgataatggtgagaatggtgaaggtgagcatggtgatggtgatggtaaggatggtgatggtgaaaatggtggtggtgataatgaagatgatggtgatggtgaggatggtgatggtgaaggtggtgatagatactgatagttatggtgaggatgctgctgctgatgctggtgagaatggtgagggtgagactgatgataatgaggatggtgatggtgagtatggggatggtgatggtgcaccccttgatttggcaattcgacatctaagaattgttcatttcttctaggatgtttgtttttt

SEQ ID NO: 477880 - DNA, 981 bp, Homo sapiens
aatggtagattcactgacagcttgcaccatgagcctggaaaagctgcgggcactcaacatcagcccatgtaaacagccacgagggcaccttgtaagaattatgccaaatctactctacccgtgctctataaatggattcactattgtagatgccactaagaacattcatgattcaccagaggaggtaaaaataacagcattaataggagtttggaagaagttcattccaaccctcataaatgactttgaggggttcaagactttagcagaggaagtaaccacagttgtggtgaagatagcaagagaagtagtattacaagtggagcctgaagatgactttccgagaggctctggaaagttatccaggactgtccacctgaaacatgagcctcgagcatttgcccacctgtcccacactgccatcgatcttggcaagaggaccaccgccctgaatcctgcgcttgagaaggtgcctctctgtctgggcactcaggcccctggccaaatgtgcctgaccctgcatggcctctttcctgggtccatttcaaagtgcaaactgtgtttgtccaaatggtgcccaaggctctgctgtctgaaggggtgagaattgtgtatggagcttgcatgaggcctagggagttccccacacaggggtatgcaaggcttctcaagtaaggaaagggatagctatgacgaaagaaaaaagtttagcctggggttgaggatcagctctccctttactaccacattcccatgcagagcaccaagaaatcagagaattctacactcgactttgaccttgtgggttattatggcagtatatttattgaagtagaagaatagaatgtatttagctattttttagcttcatttataattcatcattatttagacataatgcaaatgtgggctggaattcatgttctgatttttgtggccttgagctaaggaaaagggacccaggaaatgggctttatgtgt

SEQ ID NO: 477881 - DNA, 662 bp, Homo sapiens
tctctgcatccaagatggtatcttgtgcactgtgtcttcaggaggagatgcactgtgtcctcacatggcagaaggtggaagggcaaaacaggggaagcccactccatccagtccttgtagacttgctgaatgactttgacaaaaatgctgatagtgttttgaacaataaggtccaggctgaggtggtctcagatggagatgaggaacttgttgtgaactggagcaaagagcctctctacagagtccttactggggaacttcctagtggagctgtgaggagagggccactctcctccagaccccagaatggtagattcactgacagcttgcaccatgagcctggaaaagctatggacactcaacatcagtccatgaaaacagccacgaggtggactataccctacaaagccacaggggcagaactacacaaggctgtgggagcccacctcttgtatcagcatgaccatgatgtgaaacagggagtcaaaggagatcattttggagctttaaaatttgattaccttgctggattttggacttgcatggggccttcaaaatgtctaatcttttttaatggttaaatggctttttgtgtcccattcacttacattttctactaaaagttttaaagttttgtttctgacattaatttcctccatccc

SEQ ID NO: 477882 - DNA, 488 bp, Homo sapiens
ttctcatctacttccttgggaagaaatgaacaattcttagatgtcgaattgccaaatcaaggggtgcaccatcaccatccccatattcaccatcaccatactcattatcatcatcagtctcaccctcaccattctcaccagcatcagcagcagcatcctcaccttaactatcagtatctatcaccaccttcactatcaccatcctcaccatcaccatcatcttcattatcaccatcaccatcctgaccatcaccatcattaccacctcatcatcaccatccttaccatcactatcaccacgctcaccttcacctttctcaccattctcatcatcatcctcagcataactatcactatcattatcaccaccttcaccatcaccttcctcatcatcaccatcattatcaccttagcatcaccatccttatcatcaccatcaccatgctcaccttcaccattctcaccatcatcatcctcagcataactat

SEQ ID NO: 477883 - DNA, 669 bp, Homo sapiens
cggggagggaaccagggggagagtttcaatttcttcatctgtacaatggaggttaatgcctacgggctatggctgatgtagggataaaagaaccaacaaggatgcatgggcagggcctggtccatagagcagctggcatcaacaaatggaagcccccttcccatcttatatgtgttgctcctggggctctcctgccccacattcagtcagcactgagccagcaggagggatttcacaggtcatatcctgagatcaaccctccaccccttcagccctgtccttacttgagaaaccttgcctacccctgtgtgggggactccctaggccccatgcaagctccatccacaattctcaccccttcagacagcagagccttgggcaccatttggacaagcacagttttcactttgaaatggacccagggaagaggccatgcgggctcagagctctgtgtgggccggggtacagtcagtggagggccagagaggcaccttctcaagctcaggattcagggcgggggtcctcttgccaagatcgatggctacgattccttcgtgcaatgacgactgcgtcaagtcttctcagagcacctttctttcagtctcagccaccgtggggagttccatggaagcacaggcttcccttgtgctgccagcaaactcaagctac

SEQ ID NO: 477884 - DNA, 1135 bp, Homo sapiens
ctatatttattttcaagcaaggttttgtgacctgtatcttgtgctgacctcctatctcatcctgtgactaagaatgcataactgcctgggaatgcagcccaaaaaccaggcttgctacaaacagcagccctcaggaactgagttaacatgttatgatttgctgcaggaacctagaagctcccagatctgtgagcttccttggctcaagttggtcaggggagtcttgaagggtgtccagttctactctcaaaggcctctggggtgggtggtgccctctcctgccagcagagggcagcataagccagttaacagacagtccccgctacgtggccgggttctggccgggccggaacactgggatgagggccaccacttggacctggctcatggggaggcagcaggccactctgaggctcaaatgcagtctttgactttaaggccaattccagccacagaaatttggggctgttcatatctaaggctgctggccaatccaagccagcccatctctcctgggctcttcagcagcttcctaatttgtctcctggagtcccctgcacattgcatctctttgcttgaaacccttcgatgactccccggtgcccctgccctcaagataacttcacgctcttcagcatggcctagttgtccagctcattcattgcacatcttcttttgcgatccaagctcttttctgcctcagaccctttgtataggggaggtttggttctagggcccaaagcaaaagctgcttccaagactcttccctttctggactccactttctataagcttaaacactgtagagcagatattgtaaattgtcagttttataggcccagtcctgctcacagatgtgttttgtatgacttttgccaaggtttaaaaactggctttggttgggcatggtggtgagttgggtagaccctgaagtggactggatttggaatggtcacactcactctggactgttttgtaagactggaaaagctaagagcatgcacccttgactgcctgactagagcacttggggtgttaacccagctctagcttttcttcttggtgtggtcatgttgtactttatgcaaaccctgattaacctaagccactgattagtttgaaggtggccatgtaa

SEQ ID NO: 477885 - DNA, 790 bp, Homo sapiens
tttgattttggctgtagaaaatgaatacatttccacgaggaaatattgtagataattggagtttcctatttgagctaaaacatgagtgggaggaaggaaccagtcacaagaaaatcaggaagaatattgcacgcaaaggaaatagcaagcacaaatgtcctgaagatttgatattgacaaacaacttccaaaaagtctggatttggatttggatttctatgatcaagtatattaagtcttgggccctggaccttgttggctgtcctctccctgctgacctaaatgacaaagggaggggtgtccagtcagagtgtgagggctgtacccgtgggcagctgagggagtgcgagccacaggccaggcactctccttctcccattagctcagccgtggcatcggacttgcagcttcattttgggctgccttagccatgaagctccttttgctgactttgactgtgctgctgctcttatcccagctgactccagacctttcaaatccggagcctacttgttaggactgatactgtctcccttctttctgctttgtgtcaggtggcacccaaagatgctggaatctttatggcaaatgccgttacagatgctccaagaaggaaagagtctatgtttactgcataaataataaaatgtgctgcgtgaagcccaagtaccagccaaaagaaaggtggtggccattttaactgctttgaagcctgaagccatgaaaatgcagatgaagctcccagtggattcccacactctatcaataaacacctctggctgatccctgc

SEQ ID NO: 477886 - DNA, 597 bp, Homo sapiens
tcaacctatagtgttgtcaccctcatagaggcagagcgtacaatggtggttgccacggtgggggaaggggaaaatggggagatatttgtcacagggtaccaagtttcagttatgcaaagaaaggaagaagaaggagaaggagaaggaagaaggaagaagaagaaggagcaagaggggaagggcagggggagggggagaaggagagaagaaggagaagaaggacaggaaggagaggaagaaggagagaaggagaagaaggagagaagaaggagagaagaaggagagaagaaggagagcagaaggagagcagaaggagaagaagaaggagagaaggagagaaggagaagaagaagagagagaagaagaagaagagagagaagaaggagagaagaagaaggagagaagaaggagagaagaaggagaggaggaggagcaggatgaggaggagcaggaggaggaggagcaggaggaggaggagcaggagaaggaggagcaggagaaggaggagggggagaagaagaaggagaagaagaaggaggagaaggaggagaagaagaagaagaagcttcgaacttttcacagaaatgtgctcaaggc

SEQ ID NO: 477887 - DNA, 2150 bp, Homo sapiens
agtgggcaacacctaaagccttttctggtctcagcttcttttattcctttgctcaagagacatttgttctcatgctcagtaaagctcagttctcatttctaatggtggtagaaaacacaagtggcaagtctcagaggcccacccaaggccctcaacatagtacttgggtatctctgctggttattcagcacccaagggctcttcagttagcaggcagtgaatcgttccaggactgggttttttccttcaaagcagtgggttcccttgtggcccagggtgtgtcaagaaatgtcatcctggagctagggccagaaaaaggggcctcacggctctcactggcaccctatcctgctgtggctgagctgatatccaagatgcaagacaaagttctccccacttttccctcatctctcctcaaggagaaagaatgtgtctctttcagagccacaagctgtgcagcttggggttcaggggtacatgtgcagatttgtcatctaggtgagtttcgtgtcatgggagtttggtgtacagattgtttcattacccagatctctggcctgaagtggaagtggaggaaagatggaggaccatcagcacatgcccatcgacatccagaccagcaagctgctcgattggcttgtggacagaagtggatgaaggaatggcaggagattatagccctgtatgagaaggacaacacctacttagtggaactctctagcctcctggtttggaatgtcaactatgagatcccctcactgaagaagcagattgccaagtgccagcagctgcagcaagaatacagctgcaaggaggaggagtgccaggcaggggctgctgagatgggggagcagttctaccactcctgcaagcagtatggcatcatgggcgaaaatacccgaggagaactgctggccctggtgaaggacctgccaagtcagctggctgagactggggcagcggcgcagcagtccctgggggaagccatcgaagtgtaccaggcctctgtggggtttgtgtgtgatagccccacagagcaggtgttgccaatgctgtggttcgtgcagaagcggggaaactcaacggtgtacgagtggaggacagggacagagccctctgtcgtggagcgaccccacctcgaggagcttcctgagcaggtggcagaagacgcgattgactggggcgactttggggtagaggcaggagacgatgctgttgctttgcagatcacagtggtggaagcaggaatccaggctccagaaggtgttgccaggggcccagatgctctgacacttcttgaatacactgagacccagaatcagttccttgatgagctcatggaacttgagatcttcttagcccagagagcagtggagttgagtgagaaggcagatgtcctgtctgtgagccagttccagctggctccagtcatcctgcagggccagaccaaagagaagatggttatcatggtgtcagtgttggaagatctgattggcaaacttaccagtcttcaactgcaacacctgtttatgaacctggcctcaccaaggtatgtggaccgagtgactgaattcctccagcaaaacctgaagcagtcccagctgctggctttgaagaaagagctgatggtgcagaagcagcaggaggcacttgaggagcaggaggctctggagcctaagctggacctgctgctggagaagaccaaggagctgcagaagctgattgaagctgacatctccaagaggaggatgggtgtcccttgtcatgctccattacagatactcctgcaccaaaccctctgggctccacaccggctgaagttctgcctctaccacttctctaagcagctctccttgccagcacaagtgtctgtggtggttgaggggtctcctgctgggattccagaggcctgtggcgagaggctccttgcctatcggtccctgtggatacaggctcaaggcctacccagtgacaggtcagctcctgcagccccagactccaggactgtcccaggtttcagaccaaccctgagcaagattggcccacacactcccaggctttgggcccatcctggtgctggactggaaaccctggcctcaggcaccagaccagtaaacatggacactgtcctcaggcctgccgagtgacag

SEQ ID NO: 477888 - DNA, 700 bp, Homo sapiens
ctctggccgcccacggactgtttggcacagtctcagctcactggaacccccaccacccgggctctggggagctcacactttggttctctatgtccttgagccagtataccggttgtgttggaccatctgttccctggggtgtgggatgttgtgtggtctcagatgctggcagtgtggttgtgccactgggcttagccagcactatgatgctgcagccctttgagtgggtgtgggtggatattgggaaattgtggctgcatgaatccctcttgacactgaacctgtcttgtggcttgcttgtagtgctggtggcactggtgtttgatgagtggcacccatggagtggccatgttgctgaggcctgcagcacagtgatggtggcttctttcccaaagcagttcagcagtagtgcttcttggaggaaggagggttgtgcagctgcatctctcaaaggttccccagtgggaatgactattgttaacctttgtggcaaatgatgctgttgtcttcttcagagtaggccactgggaccatagtggtttacactgcataactgacactctgcctttcttctttgtttctaactgtctcctatagtctcagatatgctgacctcactagcaatcctttctttgtggatgttctccattttgtttgtttgtttttggtccactgtgttgctacagatttttaaatgttt

SEQ ID NO: 477889 - DNA, 706 bp, Homo sapiens
agcagtaaacagctggagagagtcataattgctgtcttcaagtatctgaaaggcatgttctctgtaggcccacagggcagaactaataggcctgagtggaaactgcaagggcacaagttttgaaactcatcagaaagacctctgaagatgggaaccatctggaaaatggcagctttgctgggtagtattcttggagtgaagtggtgccttacccccagggacccagagctcaaggagctggccctaaggatggcacactaccaggtgggcatggtgcagtggcggctgaacctcagggatggagggatgcaaatgctactcactcccagagtaggaagcactctagcagtggttctagcttcaagatggcacaaggagtttgttcctttcaagtccattccattacagtccattccattcgattccatcccatttgaatccatacccctcggttgtattcctttcaagtccattccattcgaatctattctgttcgagtccattccactcgaatacattccatttcaggccattctactcgagtccatttcattccagtgtatagcattcaattccattccattcgagtccattccattccattccatttaattgaattccattccattcgtttcaattccattccacaaggttcaattccattcgattcaattctattcgattccattccattcgagtcttttca

SEQ ID NO: 477890 - DNA, 597 bp, Homo sapiens
tgtgggtgtttacaggggacagcgatgctgcttaatggaggaatttcaggcacagagaggagtgtgtggagtaatgataggaactgcccccggggctatggtgaggatgaagagggggtggaatcactatgcgatgcctgccctccatggaagctggatattgctgtcattaccgtagttacaagaaatgaccctcattttacagatgagaaaactgaggcctgcagtcacagagacttccccatagtcattcaccaaatgttgcctgacttccctgagcagcagatgaatgagtcctcacagctaacaaacggctgtcggaaaggtgggagaatgaagctgcattctgggaagcttgcctttgcatgtgccgtgaccatccggtctgtggaccaggttgcagcattgttagcagaactgcctggtgattggctctgccaaaggagaattgttctcgaacaggccaaatgggaaaacgagactttgtgaaaatgtcaacatgacatttttcctgggtcacaggccaagtctcccccactcccccaccacaatgtagacctctgctgtgcagaatttgtgtgtttggagaaagcccct

SEQ ID NO: 477891 - DNA, 2034 bp, Homo sapiens
agagaatcctgatgatcagagaatggtccccgaggtcaccggggatgcacggtctgcatttcggcccctgcgggacaatggaggcctctctctccctttgtgcccgggcccgggcctctgcagacagacctccatacccagagacctcctggacgagctcctgcaccaaacgaaatgccatctccagctcctgcagctccacgggaggcttgccggggctaaagcggaggaggggaccagcctcatcccacagccagctgaccctcagttcctcaaagacagtgggtgaggacaggcttcaggctgtctcttcgggtcacacccagtgtgaaaaggcagcagatatagcaccagggcagacactcaccctcaggaatgactcctccatatccgaggcctctaggcccagtatacacaagtttcccctgctgccatgcaggcgaggggagcctttgatgctgccacctcccttagagctggggtaccgggtcactgttgaagacctggaccgggagaaggaggcagcattccagcgcatcaatagtgcactgcaggttgaggacaaggccatctcggactgcagactctcacggccttcccacactttgtcctcacttgcaacagggacttctggtctgcctgccgtttctaaagcacccagtatggatgcacagcaggagagacacaagtcccaagactgcctgggcctactggcccccctagcacctgctgcagaggtcccctctacagctcccatgtctgggaagaagcacagaccaccaggccccctgttctcctcctcagatccccttcctgccacctcttcccactcccaggactcagcccaggtcacctcgctgattcctgcccccttcccagctgcaagcatggatgcgggcatgagaagaacaagccctggcacttctgctcctgcagccgcagcagcccctcccccctccacattgaaccccacgttggggtcactactagagtggatagaggcccttcacatttctgggcctcagccacagctgcagcaggtgcccagaggtcagaaccagagatcccagacctcccggaccagctcgtgccccaaacgaaaggccatctccagctcctacagctctacgggaggcctcccggaacgaaagcggaggagggggccagcctcatcccactgccagctgaccctcagttcctcaaacacactgggtgagctactgaagccaaggcgggaggcagctgacaacacccacggcccatgtggaggtggtggaaaggctggactcagcagcaacaccaaatcccggaccaggcagaaaccacccaagactgaggggctcatgccagagcggtggccacaggccttcgcctgcattgcagaaggagagccgggtccccctcctggagaacgctgcgttccccagccccacaccggctttgccaccacacaggcttttgaggcaggaggtggagacttcagaacccactcctgagaacagcggagccaggcgcttagaggaagacaaaatgttattaattattaataacaaaatgttattaattattaatattaatatttaacattaaacagtaatatttaatgttaaatattaatattgatatttaatattaactattaatgttgatatttaatattaatattaaatatcgatatttaatattaatattaatatttaacattaatatttaatattaatatttaatattaatatttaatatttaacattaatatttaatattaatatttaatattaattattaatattaaaggagaaattaatgtaattaaaaataatcactatgcattgttctgaaatggcactcgtgaattatttacacgggaaatgctgccccctgctggccaccttaggacactaacaccgtgctttacctttttccattttctctctttggttggcatttttcttctttaaaaaatttacgttgatagacatttgctcatctctagcaggtaccgttgggaatgaattctgtgctgttgttgccaat

SEQ ID NO: 477892 - DNA, 1306 bp, Homo sapiens
tagagctcaggccatggcttcagaaggtgcaagccttcaaccttgccagcttccatgtggtgttgagcctacccgtgcacagaagtcaataactgggtttgggaacctccacctagatttcagaggatgtatggaaatgcctggatgcccaagcagaaggttgctgcagggtcagcatctcatggtgaatgcagtgcagaagggaaatatggtgtcagaacccccacacagagtccttactggtgcaccacctagtgaggctgtgagaagagggccaccatcttccagaccccagaatgatagatccacttacagtttgcaccatgtgcttggaaaagccacagacactcaacaccagcccgtgaatgcagctgggagggaggctgtaccctgcaaagccacaggcatggagctgcccaatatgatgggaacccacctcttgtgtcagcatgacctggatgtcagacatggagtcaaaggatatcattttggagctttaagatttgactgccttgctggattttggacttgcatggggcctgaagcacaagaggagaggaagggtagcaggagaggaagggcggcagaagaggaaagtgaagcattgccctggcttccttcatgcctgctaaggcttaacaatggctgcacttccctaaagccacaactgctgagaagcagcctgcttccagaactacaaccagctcttctgttcctggcttttccaggcccagggctgacagtggccccccacagtgtagcctggaagtgctttatcactcttggttctccttgacctctacatggcccctccattaagctttctttcatttatttcctgtatgatgacataacaaggttagctggggaataagcaaatatcctatagtgtcaagtgtacaatgagggcaagaaaggattaatcagtcctaactggggggtggggggggtcaggaagacttcctgcgctttttcttcttctaaacatgctttggaaattttcatttttactattatgtttttaattttcatgaactattttctattccctaaatcttctcttatttttaattataagataataatattcttatatacatataatctcatatttaactataagaaaagcacaatttttcctcatctttcttaagatattaattttgtgtttttttcacattatcttttccatgcataaatctctctttcatatagattattttcttcttgtggtttctttattttggcctttgtctttcatattggagggtttgctcaaaatgtggtgactttcggctgtcatctc

SEQ ID NO: 477893 - DNA, 665 bp, Homo sapiens
gatttagcctttctgccagaaccgccatcttccagtaattcaccaaaatgacgaacacaaagggaaagaggagaggcacccgatatatgttctccaggccttttagaaaacatggagttgttcctttggccacgtatatgcaaatctataagaaaggtgatattgtagacatcaagggaatgggtactgttcgaaaaggaatgccccgcaagtgttaccatggcaaaactggaggagtctacagtgttacccagcatgctgttggcattgttagccgagatagcttcctgaaacgcatgaaggaaaatgatcagaaaaagaaggaagccaaagagaaaggtacctgggttcaactaaagcaccagcctgctccacccagagaagcacactttgtgagaaccaatgggaaggagcctgagctgctggaacctactccctatgaattcatgccataataggtgtttaaaaaaaataataataaaggacctctgggctgtaaaaaaaaaagatgtaagttaaaagtataattaatataaattatagatatgtggaaatttaaacattaaagggacatttgatggtatttaaaaattactactttaatttgtaaaattttaggtgagataatggttttgtggttattttcaaatgtttttatgtttcag

SEQ ID NO: 477894 - DNA, 1351 bp, Homo sapiens
tcaaagaccaattaagattttccagacctacactatgaacaagggaggatcactcgatattgagtgtggcagtgaaaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagagcatgcaaagtgcacgtatgtggctaagtctgtctgctgagctgcgtaaatttcttcattttgggctgactgccctgcttctggttgatacaaccttcagagatatgttaacattatcaattaagactttgtcttttgctttggctgacaaaaccaaggccagaattgttttagctaacgacccggatgctgatagacttgctgtggcagaaaagcaagacaggtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactgtgccgaaatccattcttagggttcctgtttttgctttcagtttttgaataatttctaaatacttcttttattctttcaatttgttctataacctaaagttcttgaaatgttatttctgcagtttggtgtgcgtattgactgcccctcagagtcagttattttctagtgtttgtgagcgttcttgtttttaatctttggcaagtttttttatttgtttgtttaacttgtgagagcttttcgtgccctacattgcaggaatgatattacaaagcaattttgtgtttgcttctgcaaggtcccaggcgtttttctagtttgtttctcttgtcactgttattgttttgtttgcttttttaaaactttttgttttgttttgtggtctttttaaaactgttaaaattgctttatacacctacaataacaattattaattataagatactatttacatgtggttgtaaagaacacacttaaataacttacatatgtgaatttaaattataaatttatatttagcaacat

SEQ ID NO: 477895 - DNA, 2199 bp, Homo sapiens
accagggcaggcaagcgcagaaggaagcaggtcggtggagactagggtagaggagtgtaggagaggagcaaactgaggagggcggctcttcgagtcaatctggtccttctcaccactcttgaggctccgtccaggcttggaggagggttctcaagcctaggaaatcccgcgtgctcccctgtgtgatcgggaactgtgagatgggggagtaggcctgagctgggagctcccaccagcatggttgattccccggagttctgaaagagtttttatggagactgggggaaggggcgcttgaagggtgggccaagtctttggcagaaagcagccccactgggctgacccactgtgtggaggaggaggccccgtagggccctcccgggttggaggttgcagaggagggcggaggaggattgctgccccgggcgggagcgcttcctggcggccgaacccgccctcagtctcggcatcctggcgggcctcgagtgtgggctcctgtaggtctttcgctagcagccgcctgatcccgctcttgggacgctagggacgaggccggtcgggagagaatagggggccgccgattgtaaaagatcctcgacaggcccagcccggatcacctcgagggctccggaccgagcgctgggggtggggcgccgtcgccgctacggcccctggtgtcggtggagcgagcagggaggtagagggcgggggatcgaggaggagctgagctcggacacgcagcagctgctgtctatccgtctggcttgctggcagttggcagggcccgaggctaggtcttcccgccccctttccctaggcgggaagggcggttgtcatgggtgggcggattcccgtctgaatagcaggggaagatgcatttccgtggcgcggctcccgggttattacccctcccaaatggggaaatggatggagacccgcggcgggggaggagccaaccccactctccgcgtccccgcccaaggtggccggaggccagcggcaggaccaggagcgaccgccagggccaaatccacccccaggcagtcccagagtgtggagtgggcatggggacctggcgggaaatagtgtcgattagcacccccaggcccggatgccagggcccagtcgtggcgaggtgggctcggcgcggtctctgcggtgacgagagttggggaaagatgctcccaagtgtagtccccggtctccgcgggggggccacaggctctggcaggagtgagggaacgaggaggcccacgacaggtgctgtctgtccgctgctctgacaggcccgggcgggaatgcggcccggcccagtactgctctccccacccactcagctggacgcggactctgacacttgttagtgtgagcaatcgactaattttatccggctggggctcagcaggaaaccaatgccgaggcgcgggtagttcttccgggcgactctcgcccccgggaggatagtcgtggggagaggaagaggggttgggggtgggattcctgccgcctccatttcactgggggcgtggtggctcctgatctgcctcagagaggaccgaattttggcgctaagtatgtggccatttggagatggattttttttgtacctcttgagttgctgggggtggagggacagtaggtgaaaccaggtctccaagccaagattgcatggtctggagtgactgggagacagaataccaaaagtatgtgtcagttgcgggtgagagtaatcatgaagacatgggtgcccttctgggaaaatggagggagaaaaccaggagtgctgaaagatggcaagtcaacacttttcctgctgaagctcaaatgcaatgggggccatgatggtgatgaagaagccatcgcaaaggcccaggaaaagacagacgacgataaggcccccgaagtcccggcacaggggaatcatcatggacatcaggcccaggagcaggaaggaaaggacctggagaaacaagggcctgaggcccaaggattttccagtagttcacacaagcaagccaacttagccaagaacacatggaaggagtgggggtcaaggttatttggtgccctaaagattttctatgttgttgctggcagtgagttttttaggttgatcagttgatttttggagaggataatgccatctgaggacatctttttgttgggagactttgaactttgcccaggcagttttgaggt

SEQ ID NO: 477896 - DNA, 1278 bp, Homo sapiens
ggatgctgccgggacccaggaggccacaggtcttttgaagagctgtcccctctttagcaggcctgaggaaggtgctgctggccaagactgactgtccgtgctggctgagctctggggcggattggccagtcctgctggtgtttccaggcctgatggatgaacagggcctccagagtcatgggtgactacagcaccggctccttgtcaggcccaaacgaaaaccactgctgctgtggcctagcgaccttagagaggagacacaccttgcctttgccacttgtttctggcctgggctctgcactcctctccatcggctactctgactcatcgggagtagacaaagggacagaagtttccaggaaaagggaaagagactgcaggcaggtcctgtggctgtggaagtgggtctggggagccttgacaaggccccccgctccagaggcccacatggccagcagcagccaggccataagcagtcagcagctgccatcattgcctatcagactatctgtttccaaggaagaggctccaggaagccacaacacagacgcctttattctccctgctgagatgccagccagggactaaagggcaggagagaggcctccgaggtatgggtttgcctcccagaatgtgcagccggaaatgaccttgaccttctcccatccccattgtgcacatgggaaaggaaggcccagggaagcggccgatccaaaatgtgtcgttgccagggcaacccggccgcagcgcttgcaagcctgggaaaaagttgttgttcatcacgggggtggacgtttgtcttgttttgatttttcaaaagcctgaaccaactcagctttttaacatgctgctccaggacacggtgctacttgcagacagcctgaggagcagatgcaggcagagctgatggtgttcagacaccctcgccgattccaaaacatccctgctcggctcctgcctcacttctcggcagacagccctgtcctgtctatacccaagacccaagggtcaggccgattcctgtccatttccctcaatcagcaactttggtgtaggaatgaagttaaaagatccgagttcactgtccgcaatatgatgcagttgccctattttctcttccctgaaaagttaggaaactttgacattaaggaagtcgtttgtcatgatttctcattgtcacacaagtttaaccactgtcacatcagaccaaaaggcagcgctgatccagctgtgtgtggcatgactccagacttcttggtgaggaatggagatccttac

SEQ ID NO: 477897 - DNA, 698 bp, Homo sapiens
acagagcccatttgtgggtgtctgtttcaaagcttttggttcataggccatgctgcccgctttgctggaggaaagttccgagacccacaccaggctactccttgacaggaagcttttgttcctagcaacggttttgtggttccggcaccgacaccgtccctttcacacggtactgagccgcgggctgcttcggggcggccctccccgccccctgccttgccgggatggcagagcggatcagaagctgcgcgcgctctgcctgcgcgctttgcctgcgcgctttgccgccgcaacccgcgcagcagccaatccgctggagcgaggcgggccggggcgctccgcgggccggggcggggctggggcgggcggcgcgcagctcctgggccgaggcatccgcgagccgcgggtagatcgctcgcgtctgatcgccgcccgggagctcccgcggagccggctgccaggactcgttccagctccagtgcggggctgcccgggcgtccagaggcggcggacggcgtgccggcaagtttccccggcacctgccagtgcccgcgaacccacctcggaagccagacccggggaggcagaggcagaggccggctggctccagccgtggtaccgcacggctgccaccctcggacttccgtcttgagtctcctgaggctgagaagcagcagatgccgaacctgccccctgac

SEQ ID NO: 477898 - DNA, 643 bp, Homo sapiens
ccaacatcaaagaccaaaggtagataaatccataaagatgtggataagccagcaaaaaaagtttgaaaattccaaaaatcagaatgccgcttatcctacaaaggatcgcaactcctcaccagcaagggaacaaaactggacagagaataagtttgatgaattgacagaagtaggcttcagaaggcgggtaataacaaactcctctgagctaaaggagcatgttctaacccaatgcaaggaagctaagaaccttgaaaaaaggttagatgaattgctgactagaataaccagtgtagagaagaacataaatgacctgatggagctgaaaaatacagtacgagaacttcctgaagcattcacaagtttcaatagccaaattgatcaagtggaagaaaggatatccgtgattaaagatcaacttaatgaaataaagagagcaggcaagattagagaaaaaaagaataaaaaggaacaaacaaagcctccaagaaatatgggactatgtgaaaagaccaaatctatgtttgatgggagacccatctaacatgcaaagacacacataggctcaaaataaagggatggaggaatatttaccaaacaaatggaaagcaaaaaaaaaaaaaaaaaaaaaaaaaaaaaaaaa

SEQ ID NO: 477899 - DNA, 792 bp, Homo sapiens
tcatcagttaaggcaggaaccggccatctggatgtgtatatgcaggtcacagaattccttctccccaccagccattccccatccatgcctggggcttatcatccttcaaaacttttctcaaagtcctttcaactggcatctttcattactactctagcagtggtttctatctatgtcctgatgtactctggaccttttctagagccctcatcagaatcaataggcccatacaatcagtcagtcttcctggtggtcagccatgaattccaaatgctggctcgttcactcaacagttacttcctcgacaccaaccctgtgccacaaaacattggtgaaaacaaccattctaggtctattcttacttccaaaaatcttatttgcacccctgaccccatgaaaagtcttgaagtcttcaagctttgttttgtgtttctcttcatgacaccaatcttaagacctgacctagaaatttcagctgcagacttcgtaactcacaagagcatgaacatagcaggcaaaggagctcagaaagctttcttgggacaagttctgctctgctgtgaggtgggagagagaaccgctagttaaaaacagtagttagtaaaggcaagcagatttctcccaagaaagcctggccaaaaatataaaaaaataaaaaagaggaaagcaaaagaagtatgtgtggatgtatatataaaaggtgagtgaaaccatatttttaagttcctgttacgtgtggaggactttatctcatttattgattttatctttaaagcaaccacacaaggtcgg

SEQ ID NO: 477900 - DNA, 1322 bp, Homo sapiens
agccagacctggtcacctgtctggagcaaaggaaaaagccatggagtatgaagcacccaggtcttactatacctgagagaattcatactaaagagagaccctacaagtgtgaagaatgtgacaaatcctttaaacaatcttcaagactgaataaacataagaaaatttatactggagatacaacctacaagtgtgaagaaaagaaaccctataaatgtgaagaatgtggcaaagctttttactattcctcaggccttactcaacataacatagttcatactggagacaaaccctacaaatgtaaagattgtggcaaaatttttaagtggtcttcgaaccttactatacatcagagaattcatagtggagagaaaccctacaaatgtgaagaatgtggcaaagcctttaagcaatcttcaaaactgaatgaacatatgagagctcatactggagagaaattctacaaatgtgaagaatgtggcaaagcttttaagcacccttcaggccttactctacataagagaattcatactggagagaacccttacaaattcgaagaatgtgataaagccttttattgggttttaagctttactaaacatatgataattcataggggagagaaaccctacaaatatcaagaatgtggcaaagcttttaagtggtcttcaaaccttactatacacaagagaattcatacgggagagaaaccctgcaaatgtgaagaatgtggcaaagcttgtaagcagtctttggggcttactattcaaaagagaattcatactgaagagaaaccctacaaatgtgaagaatgtggtaaagccttttactggtccttaagctttactaaacatgatagttcatactggagagaagcactacaggacatggatgaaattggaaatcatcattctcggtaaactatcgcaagaacaaaaaaccaaacaccgcatattctcactcataggtgggaattgaacaatgagatcacatggacacaggaaggggaacatcacactctggggactgttgtggggtggggggaggggggagggatatcattgggagatatacctaatgctagatgacaagttagtgggtgcagcgcaccagcatggcacatgtatacatatgtaactaacctgcacaatgtgcacatgtaccctaaaacttaaagtataataataaaagaaaaaaaaagaaaaatatacctgctttcatgacaaatcattttatgatcacattaattttcaatttagccatgttttatagtagacttcagtaaaagtcagctgtggtccaaatgtaaatactgacatatt

SEQ ID NO: 477901 - DNA, 5124 bp, Homo sapiens
cctgcaggactcctggaaacaccatgagacacttttgggtgtcccttctgaagacagacaccgaaagcattgaagagaaaaacagctctcaggataaacattcagaccctcgtagcagtgttccggaatcctatgtgagggacaaaaactcagaacccagcagcagtgttctggaattctgtgtgagcgacaaacattcagaacttcgtagcagtgttctggaattctatgtgagggacaaacactcaaaacccagcagcagtgttctggaatccaatgtgaggtacaaacactcagaacccagcagcagtgttctggaatcctatgtgagggaaaaacagtctgaactcagcagcagaagcagtgttctggaaccttatgtgagggacaaacactcagaacccagcagcagtgttctggaatcctatgtgatggacaaacacccagaacccatccactgtcttctggaatcctatctgagggacaaacattcagacactcgtagaagtgttctggaatcctatgtgaggaacaaacactcagcaaccaggagcagtgctctgaaatcctttcagtgttctggaatcctatgtgtgggacattcagaccctcatagcagtgttctggaaaccaatgtgagtgccaaacactcagaacccagcagcagtgttctggaatacttggtaaggaacaaacattcagacaatctaccgagcggcagtgttctggaatcctatgtgagggacaaacactcagaacaaagcagcagtgttctggaatcctctgtgaaagacaaacactcagatcccagcagcagtgttctgataccctatgtgagggacaaacactcagaacccagccactgtgctctgaaatcctatctgaaggacaaacattcggagcctcgtagaattgttctggaatcctatgtgagggacaaacactcagaaacttatagcagtgttctgggatcctttgtgatggacaaacaaacagagcccagcagcagtgttctggaatcctatttgacagacaaacactcagaactcagaagcagtgttctggaatcctttgtgagggacaaacattcagaacctagtagcagtgttctggaattgtatgtgagggacaaacactcagaacccagcagcagtgttctggaatcctatggacaaacattcagaccatcgaagcagtgttctggaatcctgtgtgagggacaaacactcagatccagcagcagtgttctaaaatcctttgtgatggacaaaaattcagaccgtcgtagccgttttctggaatccaaagtgagggacaaacactcagaacccagcagcagtgttctggaatcctatgtgagggacaaacattcagaacccagcagcagtgttctggaatactctgtgagggaaaaacattcagaccctcgtagcaatgttctggaatcctatatgaggggcacacactcagaaccccgcaacagtgttctggagtcctttgtgagggaaaaacattcagaccctcgaagcagtgttctggaatcctatgtgagggacaaacactcagaacccagcagcagtgttctggaatcctgtgtgagtgtcaaacattcagaacccagcagcattgttctggaatcctatttgagcgacaaacattcagaacttcgtacctgtgttctggaatgctatgtgagagacaaacacagaaccgagcagcagtgttctggaatcctatgtgagggagaaacactcggaacccagcagcagtgttctggaatcctatggacaaacattcagacactcagcagtgttctggaatcctatgtgaggggaaaacattcagatcgtcgtagcattgttgtggaattctatatatgggacaaacactcagaacccagcagcagtgctctggaatcctatgtgagggaaaaacacccagaacccagcaggattgttctggaatgctatgtgtgggacaaacactcagaacccagcagcagaggtctggaatcctatgtgagctacactcagaacacagcagctgtgttctggaatccttatgagaaacactcagaaccctgcagcagttttgtagattccactgtgagatacaaacattcagaccctcgtagaagtgttctggaatcctatgtgagggaaaaactctcagaaacctgcagcagtgcactggagtcccttgtgagggacaaacaaacacaactgagcagcagtgttctggaatcctttgagaggcaaaaatattcagaccctcgtagcagtgttctggaatcctatgtgagggacaaacactcagaacccagcagcagtattctggaatcctatgtgggggacaaacacaacccagccgcagacagcagtgttctggaatcctatgtgtgggacaaacactcagaacccagcagcagtgttctggaatcctttgtgagggtcaaacactcagactctcagagcagtgttctggaatcctatgtgagggacaagcattcagaccctcatagcaccattctggaatgctctgtgaggaacaaatattcagaccctcatagcagtgttctggaatcatatgtgagggacaaacattcagacaatcacagcagtgttctggaaaccaatgtgaggaccaaacactcagaacccagcagcagtgttctggaatatttggtaagggacgaacattcagacaatcttagcagtgttctggaatccaaagtgacggagaaacactcagaaacgagctgcagtgttctagaattctatgtgagggacaaacactcagaacccagcagcagtgttctggaatccttagtgaatgacaaacgctcagaacccagaagtagtgttttagactggtttgtgagatacaaacattcagaccctcaaagcagtgttgtggaatcctatttgagggacaaacactcatcacacagccactgtgttctggaatcctatctaaaggacaaatattcggagcctcttagaagtgttctggaatcctatgtcagggacaaacattcagaaaccagcagcagtgctctggaatcctttgtgagggacaaacaaacagagcccagcagctgtgttctggaatccgatttgatggacaaacactcagaacccagcagcagtgttctggaatcctttcattcagatcccgatagccctgttctgcaatgctctgtgagggtcaaacattcagaacctcatagcagtgttctgaaatactatgtgaggtacaaagcctcagaactcagcagtagtgttctggaatcctatgtgagtgacaaacactcagaaaccagcagcaatgttctagaatcctttgtgagggacaaacatttagactctcgaagcagtgttctgttatcctatgtgagggacactcagatccagcagcattgttctagaatcttttgtgatggacaaacattaaggtcctccagcagtgctctggaatcctttgtgagggacaaacaaacagaaaccagcagcagtgttctggaagtctttgtgagggaagaacattcagaccctcgtagcagtgttctggaatcctacgtgcgggacaatcactcagaagccagcagcactgttctggaatcctatgtgaaggacaaatattcagaacccagaatcaatggattcctaaagtctcatagcagtactctggaatcctatatgaggtacaaacacgaaaaacccagcagcagtgttctggaatcctatgtgagggacaaacactcagaacctagcaacagtgatctggaatcctatatgagggacaaacattcagaccctcgtagcagtgttttggaatcctttgtgagggacaaacaatcaggaaccagcagctttgttctggaatcctatgggatagatgaacactcagaacccagcatcagtgttctggaatcctttgtgagggacaagcaatcaggacacagcagctctgttctggaatcctatgtgagggacaaacgttcagaccctcgtattagtgttctggaatcctatgggagggacttacaaacagaacccagtgacagtgttctacaatcctttgttagggaaaaacattcagaccctcaacccagcagcagtgttctggaatcctttgggagggataaacattcagacccccttagcagtgttctggaatcctatgtgagggacaaacactcagaacccagcagcagtgttctggaatcctatctgaaggaaaacattcggaacctcttagaagttttctggaatcctatggacaaacactcagaccctcatagcagtgttccggaatcgtatgtgagggacaaactttcagaacccagcagcagtgttctggaatccttggtgaggaagaaactttcagaccctctgagcagtgttttggaatcctatgtttgggacaaacactcagaacctagcagctgtgttctgcaatcctatgtgagggacaaacactcagaacccacaagcggtgctctggactctttggacaatccctcagatcccagcagcagttttctggaaacctatgtgaggaacaaacactcagaacccagcagcagtgttctggaatccaatgtgagggacaaacactcagaaaccagcagcagtgttctggaatcctatctgtgttctggaatcctatatgtggaacaaacactcagagcccagaagcagtggtctggaatcctgtgtgagggacaaacactcagaccctcgaagcagtgttctggaatcctgtgtgagggacaaacattcagatccagcagcattgttctggaatcctttgttatggacaaaccttcagatgctcatagcagttttctggaatcccttgtgagggacaaacactcagaacccagcagcagtgttctggaatcctctgtgagtgacaaacactcagaaaccagcagcagtgttccagcatcctttgtgagggacaaacactcagaccctcgaagcagtgttctggaatcctatgtgagggaccaacactcagaacccagccactgtgtactggaatcctatctgagggacaaatattcaaaccaccgcagaagtgttctggaatcctatgtgcagaacaaacactaagaaa

SEQ ID NO: 477902 - DNA, 785 bp, Homo sapiens
agaagatagcagctgagcctgaagatctgagtaaaataaatcataatggtaaatactctctacggccatatcatcctgaacatgcacaatctcattaacgatggcaaatactttcttccagatgctgatgtggaaaacctaatgataatgctgacatcattgcttaaagttctgaatgtgactgagaataatcatttcacagaaaatatccccaacggagctgcaggagaggtgggctgtgtgggaaaggggcacatcctacctcacttgtacattgacactggagcagtcaaatgtcactgctcttggggcatcaccgttctgcagttttctgaggcattccctccacagcaaacatcctgccactcagcctctgctccatgtgcatatcaacatgcagcccccgacttggacttgcttagtcctacctggtggccacctttagttgggttcatagtgaaggatctgccttttcttctatgtactcccgagcctatatcctgccagaattgtaagttctattcagacacctgaatagattgacactggtttctatctcctggaccccagggacccacactcagttctccaaagcatcctctcactgtggtccccaaagcattctctgacatcatccttctaccaggggtgggttaggaggtagaaagcatccacttctttccacctcctgttaggcagacaactatcttcacggaaaacagtacttacaaattcagcaaatctagcagacgatattctagtacttctgtataaaatatatgcat

SEQ ID NO: 477903 - DNA, 710 bp, Homo sapiens
agaagatagcagctgagcctgaagatctgagtaaaataaatcaagtaaaagccaggtctaacaatgacacctcataattgtccatcttatctcctgacctcatttcttacctctctccttctctatctcttttccttataccctggaatccttgaacttgatccagactcaggacctctgcctggaacattctactctctgatagctctagaactagaatataaggaatcaatttgtgtagccatgatggtgacttcagctgatgccactattgagcactggctgtactgtttaaatgatatactaaaatggacaaatgggcagaagcttcttcacacagagcaaatctatctctggaggagcccaaagtgtccaagtggcattcttaacttacaatttaatgaaatcattgttgtgtctcctggtagcagcattcctccctctgaaattaagagatctaggccagcagaatgtaatgtcatggtaacaggaagcaaaaaatttgctagtggaccactaggggtgatggcaagtgatgccacttccacatccaccccttgattcctggacccatgaattctggctatgagagaaatagtaccatatgttggatgctgattcagagcatacacagccttctggagaactttgcctcagccctgcaaagtatggtcatctagttggcattgtaattgtgacttcaaaaggcc

SEQ ID NO: 477904 - DNA, 1480 bp, Homo sapiens
agtacgagaggagtcagagaaagtgatgttgcaaatttcttttaaatatgagaatttcagcagtaagattataactgaaaagtcaattggatttaacttacaagttcttcagtgtctttttggcaaaccgactactgaaaattcacagtctacaaaagttgaggaagactttaatcgtactaccaaggaggcagcaacaaagacagtaactggacaacgagaacgtgatattggcattattgaacgagctccacaagatcaaacaagtaatgacaattttattttttataccaaaataatagaagtggctacatatcaaaaagaaataaagacaacaaatggcaaaatagaagattcaactaccctatcaaaaatcttggatgcagttccttcttgtgaaagaggaagggaacttaaaaaagatcactgtgaacaaattacagcaaaaatggaacaaacaaaaaataagttttgtgtactacaaaaggaactgtcagaagcaaaagaaataaaatcacagttagagaaccaaaaagctaaatgggaacaagagctctgcagtgtttctcacactcatgaaagtgaaaatgatctctttcatgaaaattgcatgttgaaaaaggaaattgccatgctaaaactggaagtagccacactgaaacgtcaacaccaggtgaaggaaaataaatactttgaggacattaagattttacaagaaaagaatgctgaacttcaaatgaccctaaaactgaaacagaaaacattaacaaaaagggcatctcagtatagagagcagcttaaagttctgacagcagagaacacgatgctgacttctaaattgaaggaaaaacaagacaaagaaatactggagacagaaattgaatcacaccatcctagactggcttctgctttacaagaccatgatcaaagtgtcacatcaagaaaaaaccaagaacttgctttccacagtgcaggagatgctcatttgcaaggaataatgaatgttgatgtgagtaatacaatatataacaatgaggtgctccatcaaccactttatgaagctcaaaggaaatccaaaagcccaaaaattaatctcaattatgcaggagatgatctaagagaaaatgcattggtttcggaacatgcacaaagagaccgatgtgaaacacagtgtcaaatgaagaaagctgaacacatgtatcaaaatgaacaagataatgtggacaaacacactgaacagcaggagtctctggagcagaaattatttaaactagaaagcaaaaataggtggcttcgacagcaattagtttatgcacataagaaagttaacaaaagcaaggtaacaattaatattcagtttcctgagacgaaaatgcaacgtcatctaaaagagaaaaatgaggagaatgtatagatcaatatgaaaaagagaaagcagaaagagaaacttcagtaagttgtgaagaactacagattcatt

SEQ ID NO: 477905 - DNA, 885 bp, Homo sapiens
gccaggtggctcccaccagcagcgatggaaaccccgctgaccttgcccgcagccaacagcagtgaggattccactgctggatcccttgccagggcgggaacctgccgctcagcctattctgggcagctgcacagggcccagcgcctgaaaccccgagctctgggctcgggccaaggaagagaccaaccctgccggcccctactgagaactcagctacagctgccacctgtacaacggcgccgcagcagcagagcaaccgggcactttgcctgcaccaccaagagccaggacaccagggacaacgccgcctcagcgcctaattcaggcagtcagccccgcagctgcagcagggcagaaacctttgccctcggcccagtccccttggcggcacagttcccagtgcccgcgacccggaactctgggagcaggcaaaggaagagcggactccaggctgggacagtggtccactccatgaccctgaggctgtctgggaaacccttgcctgcacatggcgcacgcagcagccttggaggcaaccccagaccgtgctcctacaccagccaggcggatcccagggccagacctcgcccagcggctaattcaggtggtcaggccccagctgcaggagggcgggaacaggccgctcagccatttcctggctgctgccctgtacccagcgcctgcacaccccgctatggatattataggctacttgttactgacaagtatggcaggaactgcaggtcaagctgtgataggcaaatagatcttgctgaagaggaagaatgattggctaagataatgccccaggacagctggcatacctttagacacagctaaattgaatgctttctgaggaggagtgtattagtctgtctcacactg

SEQ ID NO: 477906 - DNA, 493 bp, Homo sapiens
cgggttactatttgagtagcccagacaggagagcagcggtctgcttcagccatgagaccacctcaggcgaaaatagacttgtgtagcacaaagaaggaccccaggacatggggtgcagaagggagcacagagagggtgggtgctactggggtgcacaggcagcttgaggaggatgcagatggcaaacttccctttgtcacgccaggtgcatgtttagggccggaggaccaccagatccccaaagcctccggtgcttctgaggcagaggagaggcaaggccagtggctaccggtgtccagggacctggcagccaccactgaggcctatctgcttgtccctcagcccactggcggccacactccaggtctctgggctctgcctaggacgtgtgtttgggcttctctcccgagcagaaatcatctgcgtaccctctgcatcccatggatttgctttgtttctgagggaataattaaggaatgttagtatgacatcc

SEQ ID NO: 477907 - DNA, 694 bp, Homo sapiens
cctggagtttgataatctcactttggatagaagatggccgaataggaacagctccgatctgcagctcccagtgagaccaacacagaaaacaggtgatttctgcatttccaaatgaggtacctggttcatcatcattggcactggttggacagtgggtgcagcccacagagggatcgcagctcctcaccagcaacagaacaaaactggacagagaatgactttgatgaattgacagaagtaggcttcagaaggtcggtaataacaaacttctctgagctaaaggagcatgttctaacccactggaaggaagctaaaactcttgaaaacagaccaaatctacatttgattggtgtacctgaaagtgacagggagaatggaaccaagttagaaaatattcttcaggatattatccaggagaatttccccaacctggcaaggcaggccaacatgcaaattcaggaaatacagagaatacaacaaagatactccacgagaagagcaactccaagacacataattgtcagattcaccaaggttgaaatgaaggaaaaaatgttaagggcagccagagagaaaggtcgggttacccacaaagagaaaaccatcagactaacagcggatgtctcagcagaaaccctacaggccagaagagtgggggccaatatccaacattcttaaagaaaagaattttcaa

SEQ ID NO: 477908 - DNA, 1187 bp, Homo sapiens
gggctccgtgctgcatcttctcccctgagctgctgtcccaccagccgggaagctgccatggaagccttggaattgctgggatctacctatgtggataagaaacgagatctgcttggggcccttaaacactggaggcgggccatggagctgcgtcaccaggggggtgagtacctgcccaaactggagcccccacagctggtcctggcctatgactattccagggaggtcaacaccaccgaggagctggaggcgctgatcaccgacgccgatgagatgcgtatgcaggccttgttgatccgggagcgcatcctcagtccctcgcaccccgacacttcctattgtatccgttacaggggcgcagtgtacgccgactcggggaatatcgagtgctacatccgcttgtggaagtacgccctggacatgcaacagagcaacctggagcctctgagccccatgagcgccagcagcttcctctccttcgccgaactcttctcctacgtgctgcaggacccggctgccaaaggcagcctgggcacccagatcggctttgcagacctcatgggggtcctcaccaaaggggtccgggaagtggaatgggccctgcagctgctcagggagcctagagactcggcccagttcaacaaggcgctggccatcatcctccacctgctctacctgctggagaaagtggagtgcacccccagccaggagcacctgaagcaccagaccatctatcgcctgctcaagtgcgcacccaggggcaagaacggcttcacgcctctgcacatggctgtggacaaggacaccacaaacgtgggccgctaccccgtgggcagattcccctcgttgcacgtggtcaaagtgctgttcgactgcggggccgaccgggacagcagggattttgacaacaacaccccgctacacatagcagcccagaacaactgcccggccatcgtgaatgccctgactgaagcaggggcccacatggacgccaccaacgccttcaagaagacggcctacgagctgctggaagagaagctgctggccaggggtaccatgcagcccttcaactacgtgacgctgcagtgccttgcagcccaggccctggataagaacaagatcccttacaagggcttcatcccggaagatctggaggcattcatcgaactgcactgacctgcccagaa

SEQ ID NO: 477909 - DNA, 818 bp, Homo sapiens
ttccactttctccagcatcctaatcccacgagtctcctgcagtcacaagaaagaactatggaacgatgtgtttgcagcagggcaggaagccccgttaagtaaaatcccacggggctccagggtccctcagcatccacagggggcactcgagtccatgacaaagatgccttcagttctgtccacactacgcaagaacaggctgcttcaccctcttgcactggagggctgccctcttcctggtgcgtgtgcctcatattcaaggtaccagacaaatatgccgatcaaggcctgtgttctttctcctcgccaaactggcttcagacctgtgtggaatttaggcaatggtgcccttccaatggcaacaataggaaatttggtgttagcaggtgcacttcccttcattgataaaaatcctttggaattaggctttccaatggatgaaaacaacttgcaatgtggtcttattcttgcttgttttggatatcactccaggtctcttgcccttctcagctcctcctttccactgcactttcctgccagtgccaccacactttctcctgttgtgtagggagaacacaggtcacctccctaacatgaaaaggtgctcaataaagatgtgttgaatatatgaatgagtgttcttagaggacacccttgtacctggactggtccttacatgggtgagttttttttctaggctttgattgttttaaataaaatcagaatttgttaaagttcagttaacactcagctgtgaaccctaaggtactggggtctttttcaatgggagatctttaagcattattccaaactattct

SEQ ID NO: 477910 - DNA, 613 bp, Homo sapiens
attgccctgctgccttcagggatcctgatgtcttcttttatatgattgacctgaaggaacttataaaatgtatgtattacctgttactaatttattgcttattaattcaccagttggcccaacattcccaagctgagcttccagcagcaattataccttccttgcggggcctagaggcaatagaactgctctacctaactctcctcctactttctcaggcaggagaacttagacatctacagtctttaccactagggtcccttaaagtccttccaggcactaagcctagtggagtcacccctgtaccgccttatgcacccagggcccaaactgtagccaagcttgccatttcttggatacttgttgctacacctggcttcacagtctgggatactgctgaaccccgcaatgccaagatctggagtgactactacacagtactccttgttcataagacactcagactaagaccctgtctccactgctgctccaagtacctgcatctagaatccagttgctgtggcagctgcttataggaaatgtcagaactgacatcaagaggggtcgtcttgtcaaagtctccctcttgtggtgaatatgagaatagaaggat

SEQ ID NO: 477911 - DNA, 856 bp, Homo sapiens
ttctccctgatgtgcgtattctaaaggctgcctgcgtttcctggtttgtggcccccttgcatcttcatagccatcaatgcctagctgacacattctcatgatgccatacggattatttgtcttacttttatttttctggcatgcttgggagaagccaggagtagaagtctcctatgatcacatggggctgaacaagagacagaacaaagataattcagtaccacaaattttcctgctacctttgatgctgctggttttgaatcacctggggaaaaaactgaagcgggatagagaagagaaaaataagaacaaagatattttgatccacagggaaaagaccctggagaatgcattactcccagaagatggttccttttttaggccagaggaatttcatctgggatatcacattacatggttctcgttgcatcaccgtaagctcctcttggatgtgacagctttgggagagctcccaagatggtggtgggctgcttccaagatggtggcaagcctcgtgttctctgacctggggttcttggcctcacggattccaaggaatagaatcttgggccatgcggacgaaccggggcacttagccgtgcaggaacaatggcaagcctttagcctgatcaggagcggcaatgggttcctcgctggttcaatttccatgtagttgtgtggttttgattaaattggttaatccctttattaagccctctcttgcttatatatcttttattaatatttggaccctgtatactcaatactataatttgaattgctttttctcacctagaagtaatcaaactccaaatggtgctgcaaactgaactacgcatggacacgccattcttcc

SEQ ID NO: 477912 - DNA, 652 bp, Homo sapiens
tatatccaagcttcagggtccaacagtgttgcccaatgcctgcagtgcaaggtgcttgtggtcgaataacttctacgaaacacatcatgttagacttaaggtccagactaacggaccaaacactttacttctgccgtagagtccagcataaaagcaggaatggaaagagcagactggctgagtcttctgacctccatctttctcccgtgctggatgcttcctgccctcaaacactggactccaagttcttcagcttttggactcttggatctacaccagtggttcgcccggggcgctcaggctttcagccacagactgaagcctgcactgtgggttttcctacttttgaggttttggaactcagactgacttccttgctcctcagtttgcagatggcctactgtgggacttcacgttctgatatagaagaggcagagaaacggagaaacaagtgtatggagagggatggaaatcaaatagtgagcatctcatattacgtgcatgtgaaaaatctatgaaataggtaagaatcttcacttcaaagaaatggtaactaaagttcatgaagattaacccattcatctaatattcaaatgtaacattagaaatagtatttaacttcatatttgaccccattgacactaatcaacta

SEQ ID NO: 477913 - DNA, 1574 bp, Homo sapiens
gaaatgtggtgctggtttctcccactggctccctgcagcacgcagcaccggctgcacctcctccactgctgccagcgtcatggcagcagctactcaaggtgggtcgtcactgccatcagaactagaatctatgcaatcagctctctgggtcccaggtcttctaactgcaccacaggctttcctgggtcttcaggacttgatgccctgtgtcccagccactccagctgtgactaaaaggggccaaggtacagttttggctgctggttcagaggatggaagccacaagccttggcagcttccacatgatgttgagcctacagagaagcaaatgctgagaaaattaattgccaccagacctgccttacaagagctcctgaaagaagcactaaatatggagaggaaagaccattaccagccactacaaaaaacacacttaagtacacagaccagtgacactataaagcaagcacacaaacaagttggcatgacaaacacctaacaaaacaatgacagaatgaaatttacacatatcaatactaaccttaaatgtgataagtgatttgactatttctttaccttctgctttagcctaatttgtattttagtgagccctctttactacctgattggttgggagcgagcagacttacaagccctgtgtttaaagaagggactggttgatttaatagaagctactataccaggacccagaaaatgaatttttaattgtagggcaataattttttttttctgaaacattcaataatcgttgatatccttgtgtttcttccctattcttaatctataattctgtgacacgcttggaaagttatcctatttctccaagtattctattttgaggttgacactatttattgaaaaccttagtaataattggccaaaatatcctgaacttgcagtgttttaatctcattttgtttgaaccctataggcataacataatacagatatgacagcattttttttatttctccattaacttatgttgttaagtccaacggcttcaaggtgaagcagttgctataatatttatgaaagtcatattgttgcagagtccattacaagaaaggaagcagctggatcacaggttttagatataacttttactgcccaaggctgttatttaaactccaggactgactaaagtggtgtgatcaccatttttcaaaacatacttaccattttcacttgattttagccaaaaggctgagaagcaataacttaccattttctattagtattttctatgaagccagaaccaaaacatatgaggacaactgcatttatacatatatccatattatatttagcattccatttttttggtcataaacaacactgagaggtcttaatagtgttcattttgtgatttgataagaaacatattcaaaattctgatgagcagatgttttctgcgttttttttttagctatcatcaacaatagagctcctttaagagaatatcatgaaaatcatttagctcttatgtgtagtataaaatgtgatagtttagatagcattgcaaatgaatgctgactatagaaaaaaatgtt

SEQ ID NO: 477914 - DNA, 1488 bp, Homo sapiens
gtttcttgataggattgtgacgtgcgacaaaaagtggattttatataacaaccggcaatgactagctcagtggttgggccgagaagaagttccaaagcacttcccaaagccgaacttgcaccagaaaaaggtcatggtcactgttgggtgggaaaatgcttccacaaccagcaggatgcagaaaatgctttccaagagttcatcaaatcccaaagcacggatttttacgctacaggaataaacaaacttatttctcattggcaaaaatgggtcgattgcaaggagtttagtgactctctacacaataattttgaccaagtatggaaaaacaaggaacataatgaagctggttggttactcctaagttcaggagacaaagtgatgaaagaaaatgatcaactcagggattctgtctccgggcttcagaagcagatactgagcctcaaatctcctaagattgccctgagtgagagtcttatcttctgtagagaaatagctgaaattgtggaaaaagagacacaagcgcttaccacgcgagtggctgacctgcaacaaaaggtgcacacacagcctcgccaagtgtctactgttaaagtgaggacattgattgaaaaagaacgggaccctgcaacttggaatgggaacacgtgggaggaccctgatgaaactagggacactgagtttgtaaactctgatgaaccttttttgccagaaggaacagcttccccatccccagtagtggcaacatcccctccccaacccatggtaccatcaccctttccacctttgtctgaggaggagtcagccccaatgcccctgtttgcttctagacctataactagactaaagtccctatgggcccctagaggagacttttgggcttttaccagggtaactgtgcactggagaaagggaaatgatcagacatttccaggactattggacactggctgtaagctgacattgattccaagggatccaaaacatcactgtggccctccaactaaactaggagcttatggaggtcaagtaattaatggagttttagctcagggccacttacagtgggtccagtgggtccccagactcatcctgtggtcatttccccagtgctagaatggataattggcataggcatacttagcagctggcagggcccccacattggctccttgactgataggaattctgttttttaactactgaaactataaaagcctgaacacgaaaaacaattgtgttgtcaaatatacatctttgaggtctttccacttctttctattgtaatatcctaaatggtagcctggaagaccgagagtccacacatattacaaattcaaaaatggttaaacaagtttaacacctccagagtagtcattaaaaaatcgaatataatttatatgaaatagtgtgaagtgccaagtaagtagtaaacgatttaatcttatgacaaaatactacatattaatggaccaagtcatcaaagtg

SEQ ID NO: 477915 - DNA, 581 bp, Homo sapiens
tataatttcaaccattttccgttttggaaaagttaaacctgtggagacagtgaaaagattagtgactgtcagggcttgagatggtacgtactgttaaatgcaaaccattttggatgtcagtaaaaagaaaccttactcaaaatgattgtttcaataaaggattgaggactatggtaatagagcagaaggacttctgcaataggaacaggggattgttgcaatatgaagacccttcagtaggagataatctacaactgtatcacatggcgttgaaaaggggcttcctttttcagggagtggtaaataaggctagaaataacctggtgtcaaagagttggatacgtggtagtacgaaagggccgttgattaggagatattttttcctgaggatgggaaagcagataaatagaaaaaggataaagaaaataaatgcaatggtagaattccttacctgatatcagtaaaccatgaaacttaatcccttcaccaaaatcgtgttttaattcatatttcagttattcctgcaaactcagaaatgggcttatttgaagtaccatattagcctgaatataaaatgctat

SEQ ID NO: 477916 - DNA, 627 bp, Homo sapiens
atcaatccgaggaaagcatgccacacgggagtacacgttttcaatccagtctgaggagatcatcctgggccattctaatggcaaggactgtgtccggaatttattccttctggtgggttcttggtctcactgactttaagaatgaagccccagaccctcgcgaatttgttaagaggctccaaactgccgttaggaatcagagttggagagacagtgatttctatgtgtatctgaatgttactgtgttctggctgttatgcaaaaaagaaaagggcataaatagtcaagcagcaataggaagcttactggagcaacagttaatgttacaacttggtgacaggaacccaaatgagactgaggaaaacacagggccgcccgtgcactgtggggctttaagaaagaaccagagaacttctcctctagtgtcatctcagcagaaggcgaaagagacatcttacatcatagcaggcaagagagagaatgacagccgagtaaaagagaaaaccccttgtaaaaccattggatctctttagacttattcactaccacatgaacagtgtggaggaagctgccccaatgattcaattatctcccactgggtccctctgacaacatgtgagaattatg

SEQ ID NO: 477917 - DNA, 1150 bp, Homo sapiens
gtcgcaccaccctgcttttcctcactctgtggttcgcaccaactgcctggtcaatcccaacagcatgagcttcaccactcgctccaccttctccaccatctacgcaggcaccgagtctctggttcccggatcttggtgtcctgctccaccagcttccgggtcggtttggggtccggggtcctggctgcctgaatggccggggttctggctggaatgggaggcatccagaatgcggagacgatgcaaagcctgaacaactggctggcctcctacctggacagagtgaggagcctggagacggagaactggaagctggagagcaaaatccgggagcccctggagaagaagggaccccaggtcagagactgggaccattacttcaagaccatcgaggacctgagtgctcatatcttcgcaaatactgtggatagttcctgcatcgttctgcagatcgacaatgcccgtattgctgctaatgactttagagtcacgtatgagtcagagctggccatgcaccagtctgtggagagcaacatccatgggctccacaagatcgctgatgacaccaatgtcactcaactgcagctggagacagagatggaagctctcaaggaggagctgctcttcatgaagaagaaccacgaagtggaagtaaaaggcctacaagcccagattgccagctctgggttgacccttggagaacagcctgaaggaggtggaggcccgctatgccctgcaaatggagcagcccaaggggaccctgatgcacctggagtccgagttgccacagacctgggcagaggggcagcaccaggcccaggagtaggaggcgctgctgaacataaggtcaagctggaggctgagatcgccacctaccaccccctgctggaagatggtgaggacttcaatcttgcttttgaaggatttgaaaagagaaggtacaccatcagcagtgcatatgagagagatgaccctgcagattagtggatgatgggtttgaggatgcattctaaaaggagggacaatgggtcccagtagttgattgacagatgatgagaagcctttaaagcagtatcattagcattagagattagtgtactgatttttttttaatgaggcaagatatgtctgtctttgtgattaagttgta

SEQ ID NO: 477918 - DNA, 487 bp, Homo sapiens
catcaaagaccgaaggtagataaatccacgatgatgaggaaaaacctgcacaaaaaggctgaaaattccgaaaaccagaacaccttatctcctccaaaggatcacaactcctcgccagcaagggaacaaaactggacagagaatgagtttgatgaattgacacaagtaggcttcagaagaaaaacccatttagagaagaacataaatgacatgatggagctgaaaaacacagcacgagaacttcgtgaagcatacatgaatatcaatagccaaatcgatcaagcggaagaaaggatatcacagattgaagagcaacttaatgaaataaagcatgaagacaatgatagagaaaaaagaatgaaaaggaatgaacaaagcctccaagaaatatgggactacatgaaaagatcaaccttatgtttgattggtgtacctgaaagtgagggggagaatggaaccaagtaggaaaacactgttaggatattat

SEQ ID NO: 477919 - DNA, 733 bp, Homo sapiens
ggccaaggtagagctcgggccatggcttcaaagggtggaagccccaagccttggcagtttccacatagtgttgagtctgtgggtgcacagaaatcaagaattgatgtttgggaacctccacctagatttgagaggatgtatggaaatgtctggatgtccaggcagaagtctgctgcagaggcagggtcttcattgagaacctctgctaaggcagtgcaaaaggaaaatgtggggttggagccctcccacagagtccctactgggcactacctaatggagctgcggcaagtgaatcagtttgggaaccagaagttcttgatttatgtcccagcactttctgctgaagatatgacccatggtgaaaggagtacagcacagtttattaagcgtgggcggctttgtaagcagtggaaatacattcaaattaaactatcgcaagaacaaaaaaccaaacaccgcatattctcactcataggtggaaattgaacaatgagatcacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctgcacaatgtgcacatgtaccctaaaacttaaagtataataataaaaaaaagaaacatacacaaaaatgggaagattagcct

SEQ ID NO: 477920 - DNA, 2814 bp, Homo sapiens
ccgctgtttgtgtcacagacactggacactgtaagctgcctttgaaagatctggctctgctgacactgaagacacataggagggcaccatttcttgatatctcaagtttatgaataaaggctcgagcaatatttctgatcactcaaatccagcacagcactggatcacaccccaggcctgtggcaagtactgcctggctaccactgatattcactcaaggtccaagagtgatcttgtggtgaatgacgtcaggcctggatctttcaatttaatgcagcagcctccgctctggcccaaggtggatccagaaatgctgatgaggggccaaggcctgaaattggtgtccctaggagagcccactcgttgctccatcactctatcatcaagcttgtactcaagctgttttgtcctgatgcagttgtgttccatgcctccttcactttctcctaattacaatttctgggcgctagcaaccaaatgtcgattaagcctgctccagcccccacctttactgctacacaatctacagagagtcaatgtggacaaccttcactaaagacacattacgtgtctgattaaaacaggtgaaaaaatgtatacaggtaaatggaaaaataattaattgttaattatggatatagctgtatctatttttgtaaaagaagaaactgcaaaataactaaataaattttatcagaggtgaaaaagagtttccaatgcatgtagacatgactagagttaatcatataccaatcgccaataaataagttggttacaaatttaaataaataattgaattcactatatttcagatttagtgtgtttttcagttaatgcaaataaaagctggaagaaatgaagtaaaaattcataaccactacattataaaataactgttcatttttaaggtagtttaaaacatctttagtaaaactgtgttctacagacttctactcagagatggaacagttcaaaatcaagatgattgtgaaagtacagaattgagatacttgcatagcccttctaacatttcataaaaccataagatgcagaattacaatactggtggtataacagatacatttttccttcaagtttacattgttttactaaacatcttccttcatacaaataaaatataaatatatcatttaattcagaatcataaatatcgtatgttctagtaaagtaagagattgcatttccttattgatattcattaacttaatataaattaaaagttacagtattactaagtcatgtagatatcatttttaccactaccattagtgttggtttgtaaaactctagctttattactctactaaaatcttttatgcagtattatataatatgaaacactccagttttccctgtggtatataatctttcacacttttaggttttcataacctcactgactaaaacactctcaaagttactgactttttaatacaaaattttaagtctcaatagcaaatacatttgataaaataaccaggctttttaacaggctattatagatacaatgtattgcatcaatttcaaaccacaattctcaaaacttaagatcaaaatggaattccttataacattcacaggtaaatcaatccctcaagcatctgcacatctgagaagattgctcctctccagttcatagccctaagactgccaactctagtactaagaaaagtacattcaaagtacagccctgccattttcccataatttaatcccatgcataattagttcatccgcctgagcttcagtttgctcgtttataaaatgggcttgaaaatgtcacacccaaagggttgttgtagaattatatgacataattcatgctaactattttgggtagtacatgttacacagtatgaacttaaaacataaatattttctattactcattttttggttgttacttacaagattatgtctccctatccccggatgtgtgaaaatttaatcccaagcatgctcatttttaaagcaacgttgaatcgcccacacaagagcttttgttacccaaattctaaggctttgttcctgctgtcacttctattttttttccctttttcaaactctcgatgttatagaatgacacctttaaggtttagataaaattccttctttagtcaagcccactttggatacatacatacctcccattataatatattcttaaatactataattaattgtctcccaacttcccctttcctggttttctaccatcaatcagcattatagagtgcaaatgatgtacatacagcacccttgtggatatgcctttataaatcaaacaaataaagaaaataagcaacttgtcatactaccacagctaataaatagaaacactggtatttaaatcaatgcatgtttgattttaagcctgtgctttacctagtcgtgaagtgaaagaaaatatccctaaaggttcatagaaagaaatatcagcagttgtccatgaattcagttgaaatggttcagtaacagcattggtcaccagagactaccaatttggggaatgaataacaaaatcatttacttctatggttagatggtaatgggtttagatgacaattttagccaatgcatcaatagcctattttgggcaaggtttttgatagaccaagggatacggttttgtgattccgattggtttttactcgttaaaactattttactctcttatacttaacttttcttcatctttgtgtttaatgtgactcctttacgtaatgtaatagagtgactttcataatcaatagaaagttttatggtttatgctgacttacttgtgctacttgt

SEQ ID NO: 477921 - DNA, 827 bp, Homo sapiens
gtgatatatgaagtctggatatgaagccagctgaagacactttgtttcatgtgctttcagaaatttatgaggcagcgcatccagagttgttcactcctcctggtgggttcgtggtctctctgatatcaggactgaatctgctgaggttcacagtgagtgttacagctcataaaggccactcggacccaaagagtcagcagcagcaggatttattgcgaagagcaaaacaaggaggcttccacagcatggaggcagaccccaccaggttgccactgctggcttgggtggcccccttttattcccttatttggccccacccacattctgctgattggtccattttacagagcactgattggtccgttttacagagagccgattgtatcctctcgtctccttctggagctggggctcttcaagctgtacctgagctctatgagcttctctgacaacctaaattgctttgagaacaaagactatttaaaataaaatcatgctaagactgattggacacaggcatgtgaatgtgagagggacatcaataggaattggtagctgtactgagaaattaggtctcacattcaaaataacacaagtcattgagaacagcctcattcgatagaactttctcagaatcataactataccacacatgtccacaagtacatagggactggataaatcttcagtgttgggtatagctatttatctttttttctgctttgggaattcaagtgaagcctttgctaaaacactgttaaccatggtactccaaatgctgttatgctagttatatatttggttgaagaggttgttgtaatcaaatc

SEQ ID NO: 477922 - DNA, 894 bp, Homo sapiens
aaagtcaaagaggtaacaggaccatttctgcccttctgctctcctaccacatgagggtacagcaagaaggccttctgcagacactaaatgccagggccttgatcttggacctcccagactctagaaccgtttgtgatctgatcaaaatcctattgaagacatctttgactgctgtgggcattagggagtggcaagagtggaagcagatagacttgcactactgcatggccccttgtagcaatcagccagaaatcagaagctcctctatgtgttcattcatgaagggcttaaatggaaagaagtacaggtttacacaatcattgctggaacaaagaggagcaaagtcatcactcatgttttcagtctgcaacaacaacatggttgctctcgtggttctcagaaattattccattcatatctcacactacatcatttctatcaccagcttcctcttccagtcaagatagagtaacagagaccatatttctgattctacttgaaacgaaccaagaaaaaaatggacagaatatgaagcaacagcaggcaatgaagggcagtgatccatgggagtgagatgaggactggatcctggtgccttatttagttcatttggtgacgtcatgttttcctggatggtcttgatgtttgtagctcttcactgatgtctgggcattgaaaagttaggtatttattgtagccttgcagtctgggcttctttgtacctgtccttcttgggaagtctttccaggtattcaaagggacttggttgttacgatataagctatatctttttaagggcaccccaagtcttctgctgcagtttttgcagacttgtagaggtactgctgtggtggtcttggataagatctgaaataattatctggattataatgt

SEQ ID NO: 477923 - DNA, 2104 bp, Homo sapiens
acccccgccacagtgggtccagaaggtgggactgcagacccatggcacacgaacacccaaggcagaagcaacttgtagtatgcctggtccagccgcagcctcacgcagcgccggcacctgtgtggccacctggagctccccgccctgcagcagcagccagtgctgacacatccctcgccactccgcacctggctcgcctttggtgggtgtgagatccaggccggggcgcaagccatgctcagcggactgggctgagtgggcaggatatctccagaggcaatcccggagccaacagaggccttgggcaggggcatttccagccgcagagagagtgagagatgactaaggaagaaataatcggggaattcgactttgctggcttagaagatggagggaagggccgggagccaaggaatactgatagaaaaaacctgaaactggtgatcagcagcttccagataagatctcaggaactgggcaagtgggttcacatatgcacacgaagaggcaaaatggcgatgtttaaccggtatatgactttccagcgagtttccctttccaccagtaaagggaagaacgcctcaagtgagcatgtgtacaactccggtgaacacactgtgcatactcccctcccaagtgctagcaggccgtcatgcgtgcagacaacccaccccgagggaagaaccaggggagaaggcaggcaagaccctggaagcaggccaacatataaaaaccccaagtcaaaaggacaaaccccgcgcttgccaacgggtaagacagaaccggagtggaaaggaagcaagaaaactgatactggtgagaatttctatgcagaagaccttgccctgaacacaatcaaagaaaaatgactccgtcatatgaacattggaggttttattttaaaaattgtatactcattccactgacatttgtctttttgtccataaaacacatgctttaaaagtaaatggttattcatgtcagtatgaattgggggaatactaatatcataaaaagattttaagcatcacctatgaataaatactgccataaccttttataattacctaaatattgttaccattatataataaattgatgaatgtaaagtttatcatattatggcagattcatagaataattttatcaaagatataaacctattcttaatgattctacatgatatattagacaaatttttttaacctcaggacaacacgtatttatattactttttctgtgtttcactcaatttttattctgctatgccaacagcaaataatgttatttgctacttgtatttatgttttcacttttattatgcctatttcaaaataattcaaaggttaatgcattgaattattatgtactaaaatgaatctaaactactagactgctgtgaatgaaaaataattctgtgtaatatatatttaaatcatcaaggcagactgattttaggcttatttgtcatataaatttaatggggaatgcatatgtgtgtcacagaatctttctataatttttttaagcaagggcataaagcatatttagtataatttgataatgtacagattctaatacctaaaaatttaatatctatttcatacaaataaaataattctcacattatttttaaacagagaattaaaagtacattgtcatagaaacaaaggtctaggaaatgtaagctaagtttttaattactgtcttaataaccatatagccttgcataattttatctattatttccataggatttggggaacaggtggtatttggttccatgaaaaaatatgatccagggatatgtgattctttatcatgtccttagcaagagattatgctttgaagtgactaattactttacaatttttcaaaatgccttgaaaagaattgctggttaactgcagaattatttccatctccaacaacaagaaattatataagaaaacaagtattcaggcaaagggcattgcaaaggatatcattgtcttcttaagagacataaaaaacagtgtaatggacctggttaaagtcaaccacacaatattaatagttaaaaaggtacatgacatttcatcaaaggatccacaagcctttgcaa

SEQ ID NO: 477924 - DNA, 756 bp, Homo sapiens
acctcacaattatggcagaagtcaaggaggagcaagtcacatcttacatgtatggtggcaggcaaaacaaaagagcttgtgcaggggaactcctctttgtaaagccatcagatctcatagaaattctagagataaatgatacaatgactgaactaaaaaagccaacagaaaccttcagcagcagacttggtcaagtagaagaaagaatgagtgggccagaagacaaaatgtttgaaattatccattcagatgagcaaaaaaaaattttaaaaaggaaaaggataacttacataatgagagttccacaattagaagaaaggaccacattaggatcagtgatcagtgacagtaatgaaaatatgagacatgattcttcagagaaatctgaccatctagctaaagatgttcagacgtgtccggagtttcttccttctgatgcgttcatcgtctcactgacttcagaagtgaagctgcagaccttcacgctgacttcaggagtgaagctgcagacctttgcagtgactgttacagctctcaaaggcaagaagttgttccgatccccccagtgggttcatggtcctgctggcttcagaagtgaagctgcagacctttacagagggaagaagacccaaggaattgccgctactggctcaggcagcctgcttttattcccttatctggccccacccatatcctgctgattggtccattttacagagatctgattggtccattttacagagatctgattggtcc

SEQ ID NO: 477925 - DNA, 5608 bp, Homo sapiens
tactacacgtgtttaaacaaccagacctgatgagaactcactcaccattgtgaggacagcaccaagctatgcaggtttggaaggtgactggaattgacaaaacagatatccccatatgcttccttgaactggtcacctgggtccaaggaatgggtagatatgaggataccgcagcagtgaagagcaacagaaacagagaccgccgatggctagggagcatattctctgttgggaaggctcagaacgtagctgaaagtagtactgctgagcctgaactgtcgcagcagagaatcagtgatgtctcagtcaatcccctagataaaactgttctaggtggccattctgtcagtgaagggggcctacaacacttcaagaggctacattgccacaggcagatttttgtaccatttgggttgcaaaaaatgttaccaagaatgggcttgctgcctaatacttggaagcccatactatggtgagtcatgtcatatacttttatttgatttgtgaaattaaaaacaattgcatacttatactatgtttatataaataatataacaaatattaaaacaaatgccaaaatgagagttaattttgccattttcctacctccaacactcatatttgcttatccatacagtgatgttattacaaatttaagagtagccaaaacacaatggcaaatatttgccaaggtaacttgtctggttttctcataaaggtacattactattaagtctttacattacaaccatactgccactgaatatagcatttaaagcgaaatgtataaaaagagattaccattctaatttcagtaaatttgatatataacaaataaatataatagaagcttttgaacaaagctgaataaatacaatagaagattttgaagaaagctgtttctgatgtaataaatataaaattaactatgaaatcatttcataaacatatctcataatagcagccatgtggcttcttaattagaatataaaacattaacatattaataattgaaaaaatcattagctttctaattgaaaaaactgtaaataaagattggcacttttatgtttcacattgtttttaaaacgctgataaacatattttcatagaaaggtctatatacaaaatatcttaaaacatgcaaagtttgtatattgaaataacttttcaggaaataaattttctatttaaatcatgaatgccttctgtggccttaatgtcaatatctttaagcatttcttgagttgatttacatttttaacacaaatttattctgaaacatatataatacctgtaaaaaattttgaacaactgacttgaaaacactcttgttgtatcacttatttcctgttgttatcaaaataagtaatgaactggaaattgcatctgccagtataataaatgtattataccaaaaaggttaacttgtttgaataaaaaattactattataaaatatgttggtgcacaattctggacctatttaaatttatacatacaaatattaataatagtaatgattttaagtgcaaaaagacaaagctcataacagaagttgatgaaggacataagacatttcaggtaatgattttcataataaagtcttatttttacactggtttactaatttatcatacaaacttggaaaaaccttatcatgtactgtgcacataagtgtcattatttattgaaaaagagtgaatgaataaacaaataaaaactgatgaagaaaatttaattagggtaatgacatattgacacctattctaaattctcacacattgattattaaatcttaaagaaattcctgtttttaaattatgaaataaagtgttttttgctaatatttgataatgctttattttccttacttattcaatgttgtgtttcctcagaagataatttaagaatgtaaaattcaacacattgagtaacagggaattgtttggtttactctacactgtaagctgcatgtgtaccagatagttatataaaattacagcttttgaggtggaggaatcaaaatatcttattttttaatacttaaaacacataattggtctctatataagaaacactagatcaataaataataaattagtgttttcttgtttttggaaaacaataaggaaataaggttaaacatttttaatcattgcccaaacattttcatttcatttgatacatagtatagtgttaaactcatttgttaacacataatgatttttttcctctaattcaaaaatgatttttcgtatatatagaagtaatgactggttttaaaatttatattactaaatataataatgtagtgttgaaatatcagtatatgtaatatacaatggaatttcaaaacctgagacatatttcagtcctcatattttcttgtcaatttataggacaccttttcagctatataattattaatataagatccatctaattataacataataacttctttgctatagcttatacatatatatcaaagcatatttataaggtaaacaaactaaaacaagcatataaatatgtaataatattttataaaacacttcaaagagaggtaaagaacatcacacaccggggcttgttgtggggtggggaggtggggagggatagcatgaggagatatacctaatgttaaatgacgagttaatggatgcagcacaccaacatggcacatgtatacatatgtaacaaacctgcacgttgtgcacatgtaccctaaaacttaaagtataattaaaaaaacacataagattaatgtggtgataaaatattacactgatgataaaggacttttttgagagatcaataattgtccaatgagaatcaagaattgaagtatgtcatcaatgtttttttctaaaaatatactttctgaaaacttatttgccatacattacgttaactgctaagcagcaactaaaaaatatattatctgctcctcaagagcataaaaacaaggaactaagtatttgcaggcatacacaagcattttgaaagggccatactacataccaaaagcatcataaatgcattttgttgaagaattatgaaagtaatgctattgtgattgaaaacataatctaatgtttaaaccacaatttgatttagcaaaaaataaataaataaaataaagtaatgggagattcattatctagaaacatgtacagtattttttcaataatttaagcatatttttcattttgttgaaaggtaatttacatagcatcaatgtattaaatcaatttgaagaaatattaaacagaacattttatttttctatcatactaaattagaaaattagatttgtagcttatatttctaatattcttaattaaatatacctggtttagatattaaacatactggattagaaaaaagtgtgcaataaaatactgccaaaattttactacaatgattaaaatagttcaatgatctacacattccaaattttttttcaatttaactgagagaattgtctcttatcctctctgaagaggttttatttaaactatcgcaagaacaaaaaaccaaacaccgcatattctcactcatagatgggaattgaacaatgagatcacatggacacaggaaggggaatatcacactctggggactgtggtggggtcgggggaggggggagggatagcattgggagatatacctaatgctagatgacacattagtaggtgcagcgcaccagcatggcacatgtatacatatgtaactaacctgcacaatgtgcacatgtaccctaaaacttagagtataataaaaaaaaaaaaaaaaaaaaataagatagctgcctaggtaaccagagactgaggggccaagttgctgatgagtaggaagcttcggagtaaagaattgattttattgggctcattttctcttgaatcttctccaaacttggtggaaaaaccactgaacatccacccaaagattgcacacaggagggagctgcttttacaatattaaagagctagaaagacaaattgaagatcagacctgtaaagcaacgaggacttgagtaggcaagatattggaagaaacaatgaactgaaaacttacaagtgattgggacattgcagagcaatgggaaggttaacttctttaatgccaatgcaaatgggaactgaaattgttaaaattcagtatctggaacaaataattttaaataataaaaattaaccattatagcatataaattaaatcaatgtataagcatcaaaattgctttgtttaaatatttctgcaattatgcctgaggtttaaaatcctgtatataaaataaacaaccaagaaacattcataattcagttttaaagacacaatgtgtttgtatattttaatattataacagcatgtttttggactgtcctgactttttctgcttgaaattattttaaaaacttttaaagagtatcgtaacttgctatttgatatagtttggctgtatccccacccaaacatcatctttaatttcagttacaatagtgtccacgtgttgtgggagggacccagtgaaagggaattaaatcacgggggcagttaccctcatgctgttcttgtgatactgaatgacttctcaagtgaattgatggttttgtaaggagcttttcccccttttctcagtactcattttttctcctgccaccctgtaaagaggtgccttccaccatgattctcttgcaagcaacaagagttgcaatgaccagactaaatctatgctggaccatatagaaatgagaatttagagaacgtacccagtttcattcttcagcagtgaagcaacagtaaaaagtcatcatttatatttaatcttttaaatctatttaacttccaaagacaatagcaatatcatgattccataaagcataagggaattattgcttacacaacaatgacagacatactaatcctctcttcaaaacagtaaaacatcccacatagttcatcttggtaatgaactataaatgatgttcattgttttagctggcatataattctcttttaaaaattaatattttgaaattaaatattgagatataggattaactactattagcattattttatttaacatgttttatttttggcagttaaaaagggagccaattcaaaggcatcagttaatatttacaaataatataaaactgttcagatgttcatggtaggtatgtataaattcttttttttttacgactgcacaatccatatctgcttttttctcagcaagcatgtcaaataattgtgatttctcacctttattcctggagaatttgtgttattaacaatcatgcttttaatatattcttgaattttctattaattttaccacaagctttagagtagtaagaagtaaccttgattatattctgagttttaagtgtatttctccctgcctacattgtgtattgacaactcattttttcttgatagtaataattcattgtctcagtcgactagggaaatggacaagaaaaaggaaaaagaccttatcttcctaaaataaatccttactatggatcagagggggaaatctttaagttcattactatttgaaatgtaaacatgtggccccagggaaggaaaaa

SEQ ID NO: 477926 - DNA, 723 bp, Homo sapiens
ggaggcacagcctgcatggcttggtgctgtctttgcaatagcgaaaactccgggatacagaaagccctctgtccttgcgataaggcagggagcctaactgagctgcctagcacaagctgcctacagaaggctaaaatgaaacagcatattgtaacacacggccactgggacttcagctgtaaacgttccacccctagacactgctgtggggtcagagccccacaacctgcccatctgcatgctcccgctaggagcttgagcagcagggcactgaagaagcagcaagccacactcccattgcatgccctgcgaagggaacaagggaacttttccagtttcactattgccctaggttgtctgtttactctgttgactgtttcttttcctgtgcagaagctctttaattttaataagtttcatttgtcatttttgtttttgctgcatttgcttttgagattttagtcataaattctttgcctaagctgatgtccacaagttttccctaggcttccttccagaatttttatagtttaaggtcttatatttaactattttaatccatcttgagttaattttttagtagaacacttcacaaagccttttcaagtgaattaaattatgtaaacttatgaggtataatttatataataactgtgataactaatctggactccatgggctatgttgagtgttggattttgttttactcatttaaatagtgtt

SEQ ID NO: 477927 - DNA, 7291 bp, Homo sapiens
aggtagtaacactcatccctctacactcaagttacagtggcctgacagtactcagatgctttttattttcttcttttttctcacattcagttttattgctttctatggattcatcttcaagttcatgattattttctcagctgtgagagaagaaaacctaggcaataccattcagaacataggcatgagcaaagacttcatgactaaaacaacaaaagcaatggcaacaaaagccaacattgacaaatgggatctaatcaaactaaaaagcttctgcatatcaaaagaaactattatcagagtgaacaggcaacctacagagtgggagaacatttttgcaatctatccatctgacaaaggagaaatacctaatgtagacaacggattggtgggtgcagcaaaccaacatggcacgggtgtacctacaaaacaaacctgcacatcctgcacgtgtatcctagaacttaaagtattataataataataataagcagggtttaatttgaactggttaatgcatgtgttttaattacttgtgttcctccaatcaaatgtttgctgctttaaaatttttcatattttaattacctggtcaatgatgaatacaatatctgaatatatttttgtctgtttttactttaacatcaataacgtcataacttaaatttgttgtttcatacttagtaatatataagccaaaattcgggagttaggctttaaaactaaagctttaatattaatgttgtacggtaagaaaaagagccgatgctaggtatttctatgttttatctggactgtgatataaattagctttaccattttaagtgattttcatgttgtattcagggaagcaatgccattaaatgatcagaatagattaaaacactttcatgttttcaaagtataaacctagtaaagagcatcttctgtttttctatatactcataattgtataaagccaccagtttaagctattaaaagtatccatgccattctacaaaacaagacaaatacatttatcttgaacatgctaaatattgtctgcacacaatttctacactcaaacattttagataaaatatgttactatttcctatttatcaatgaataagaacatattggtttgagctatcagcaacaagtatattaaacatgtattaacttccaaaagaaataagaatatgatgtagtggagatattaaattatatttccaaagaactatatgacaatttgttgtcttataagacttcaattactttggatggggttatatatccctctagacatttttttttgatagaatgaacatatggttcttaattcagctaaacaaacacacataaaagaaattttaaaatatatgttttgtttcattttatctcaatggccataactttcttattctttggaagaatcagctaaattaagcatgggctatttgaatgattttcttgcaacaagagctaaaagactgaactgtctttctgaagccattgagaagacactatttcttagaattttaaagtctctggttcaattagtgaaatagtaggaaagttcagctctagggtgaagaagatgtttcaaaacctgctaggggaaagttacaagtctgcattcacatgctctaagtttttgtcagaaatgggatttggggggttatttgactgtccttatcaggttaaatattactgagacctgatgttagaattactgttataataaatgagaaaatataaaataaagccagagagagggagagaaagagagagagagagaatgaataaggccaaaggaatgtgttgcttttcccacctctcaaacagtttagccttctgaaacctacatttcctggtattacaaagtgaattatacagtgtgtaagaaaaaattccttccctgaagcattatggcaaacctgaaacaatttcaggtctgacatctcccgcagctgaatctgatgagaaacagatcaaagtcaaggtgaatgtttttccttatttcccccctgagagtggaagctggattgtgtaacaattggtacaaaaacctgctaccagcaacagtagaagcggtaattcaaaacaatccaagtttataaagaaaagcattaacaatgttgcctttttaattttagtcttaccactgtgcaattttgctttccaacaaagaaattagatgacactagagaattacatgacatatgtattcaattttgggtaacttccattttacataagttgtttttaatataaaaattatgttttaatggatggatatagatttccctggagaaaatcttatgacttcgtaggaataggagagtgaaatcaagaaagtaataattatcagatttttgcagtaaagttgctgtgatgaagcctgatgcaattgtaatactaaagtctaaaaaaattagatttatggtaagattttgtaaagttattcatagccatttaatagtgtaagacatttttaagcatcttctaaaggatgacaaacattccaaaggatgaccatttagttctatttttgcatattttaaagaaatattagacacatctttacacttgatattgtattggaagggaattagatacaatgaaacatataacctaaaagaatctcattaatctaggaaaaaataatggaaaaaatctaggaaaaaataatctaggaaaaacaatggtatgtttaggaaaatagcctgttgcatggtatgttatatatcaagaaggtatgtttaggaaaatagcctgttgcatggcaagagagatgccaccttgaagtaaaactgccatgaggacaaatgtttggctctcatgtacaaagatgttctgcaataggccttgaaacaatgcctctaacatagataatttatcataaatgtggttgtgtaacctccccagtggtcatgagtcttggcaagaaagtctgaagacatggcgagctgcacctgttttaccctgaaagtttcctttataaaaaatatgttttggagtgtagatatgggaatccactctcttgtggccactcaagacattacttctgtttttaagtcccctttaatttttttctttccctgaaaaactggattcatcagcctcttctgtggcctctcttgtccttcaggctttggggatgggtttgcatttatttgctcaccattaaacagtatgcatgtgtgttcttcgtaactatttacctatttgtgtgtgtgtacttcttttttaagaaaataagtttatatttctggaaactaacgatgttattcactttataaattgtaaaaaaaaacagattttttaaatgacatgtttattttctgaattatttgtattgatctttattatgtacgagaactcagagaaatggtttttaatatattgttagaatacattaaattaaatttaacagagttcatttgagcaaaaagtgaatcatgaataaagcagtactcaaaagaggttcagagagctaaattcagcaaattggcagcgggtttttatagacagaaccaggtcaaattaaatatttttgaatattatattgttaagagaacttttacggtcttgagaaagaaagtagaaaaatacaatgtaaaggataagatgtaatacaagagaattggaattatattaactcaatttgaatgtcactaagagtttacaaatcactttcaaaatgagctgttcattttgctaaatgttatatatcaagaaaaaaagactagaatgacaaggcaactaagaaattaaataaaatctttgaaataaatattttcttaactttttatctaatataatttcacagtcaggctacagacctataaatgtagcccctaatttaaaataacctatagttttaacaatatatacatatgtaataaactttgaaaaaccatagattttatatattatatataaatgtatatatatttaatggaatgaaattatgcttgatttaattggcctaaataattacatattttgtatactgatgttttgaaattaagtcaatatattcagatcaaataaatattccaaagcctctaagtaggcacagattttcatctaatgccaatgaaagtgtaaactatttaatcatattttctgttactcatttaatttttagtcagtgatttacaatgtttttttaacaatattcacaataaaacaaaatgtcagtagtcttcattataaagactttgctacatgcttacttggctaagataaactatacttctcataatttccttttatttgcatatttccatacatgtgggctacaagattttcctggagaggcagaggcacaagagacactacaaccattttgtacaactcaattgttgctgatctgctgagtcaactcattcaaataaagcagcagctgtacctttattttctttcttactcctggatttccttcagtttctgtgactcatgggacatatgtgtgacttcaattccatctgaaagagcataggattctgcaggataccttagtcaccaagatcagagggagatcttaattgcatatgacaaacttattgtaagaatgaatggtgattatgtgttctgacaaaaacacaatcgtttattaagcatttagtacatgccaatctgctagacattttacttgtaaataagtaaatattcaaaaatgaaaataccccaaattaagatacatatatttaagagatataaataattgagagattcatttgctctccaaatttgcaaataactaccaatcctcaatggcttcatcttcataataaaagatgttaaaatatatataagattatttacaaccttaaatttgggagagttaatgaaaaggtaatatgaattaccatttctatcttatttttaataactttataacagatattcaacaaatgtcctatattgacctaaatttagattcctgtgtttagcaaagagtgctaaattaaacattcatttaaagcaaagcttcctcacattttagccctagatttttctatttttcatttgaatatatttgcaataaagtgatatactttaaatacgcatatatgaaatatgcacatataatataaaacttttgttttttagcataagtgtttgcaatgatggaagtttatatatatacacatatatacttgtacatatatatgtacatacatacatgcatatatgtttagttatttaaatgattataaaatattatattatcgcagaaaaacacataaagcctgtttcttctacatctcagtgctaagagatattaccactaattttaaattttgtcaatcataaagatttaaacttttaatcttaaatttttccactgcagaataactgttattgttttttatacctataatatttgtaataatagcttgtttacttatgaatagatgttgaactttcagaggtattttctagaaatattacacacatttcaaaatttaatctttccgtaagtgagtcactactgcattcctgaaatatgacttcatgggacataccacattatgtaagatacacttctgtatttcactgccaaatattattctaattattttacaattttttaaactttcaagttcagggatataaatgcaggtttattacacagataaacttgtgtcatgggggcttgttgttatacagagtattaagcctgggacttattacttttcctgatcctctctctcctcccaccctctaccctctgaaggccttagtgtgggttgtttccctctgtgtctatgtgttctcatcgtttagctcccaaatcttatttataattgaaactgcatgtgaattatcttttttagtatgccgtttatcagattttattattgtttcataaaaaatactcaacctccctttttttatgtttaaaacaatatttgtaattactaatgatcatacttgctaaaattgtttggttcaaatgtttgtaataatgggactagttgcaatctagttttaatgagcaaggcaatgttatatccaagacacacccaatggtacctcttaaacttagctcaggagatttctatcaagattcagatggcgataaaataagtatacaaatctgttcacaaacattaataaatatctgaaagttgattgcaaaacaaaatgaaaaccttaatgtaagcacatattttatcaaatggttccatcatttcattgagaataaaagcattgttctttcaaagtttatagaatgttcaaataattcatgtatgctatatgaatttataatattttagacgtatataatatcaggttaaattcaacacatttttattctgtaggggcatgacactaaatttttgcttatagaataatttccagtgatgagtaattattttctgttctaccaaaattctatcaatattttaaacaatcttgcaattagtttattttaaagtttatatagccctcagacatgaattaacatgatgctgatatcagacatgatgctagattattatttatcttttcaatgttttttaccatactaaaagcataatgcattattttaaatttgttatttatgttttgtcagaaaataatgaatgtttctaagttttcagatttgttcacatatatttatagcattctcttaaaattttaatgtgtctgtattgtgcgtataacaatattttttctccctgatttccttagctgaattataagaattttttaaaaacttttaaataaaaaccttctagatttatcaattctactagtttttgctttacattttactaatttctatgccatatttaatactgcagtatttctaatttgttgttttctctttactagcttatgttattaattatcacagtctatctttcaggattacgttatttcaattagagtataagaacttttcaaggaactctaattttatttattgtgggccacttgaagttataccactgacattttctttatttgttaaaaattatatttcccatattttattttgaataatttctattgatattttgagggtaattatttttcaactgcaatttctaaactgttgttaattttattttctgtattatagttttcatctctaaaagtttaatttttcatttttaatgttttccaagttgctagatttaggcatttgcaatacagttataacaacagttttaatgtttgtttttattgtctgctaattctaacatttctgtcatttctggataacctttgattgattgatacacctcaccattatggaacagaaaatatttttctgtttctttgc

SEQ ID NO: 477928 - DNA, 481 bp, Homo sapiens
aaggatttgagtacaagggagaggccatttcctgatgatccacagctattaacattagtgttaaatgaatgcagactccaaggagaagaaactgcctgggtttgcacacaccaaatggcacacaaaaaaatggcaaagtatgacgttctggattcacttcaccagaaaaagggaaaaaagcctcagatgggcatgtgtaccccttcctaaacacactgtgtgtgctcaattcccaagggtaaggagagcaccatgcaagtggaaagcccactcaaagggaagaatcatggggaaagagaagatagcagaagacgcaaagctcgtggatcggagaaaaggactgcgctgttcacaattacagaatggacgcacaaagaacaaatctatgtatatacttaagcaaaaggcacatgtatataaaatgctgacatttggaatatttgctttcatgtagtgctcaagaaggtgttcattttggcag

SEQ ID NO: 477929 - DNA, 882 bp, Homo sapiens
gataatgtacacctttgtctaagctttatgctgatcaaaagtggcttgtcatattgtttgactcaggacatcatatctgaaatcctacttgccatattctcatcagaccttatttgttgtacttgctcatttgcagatgggaatgggcatgggaataccaaaagttgttctgaaaacgtggatgaagctggaaaccatcattctcagcgaactagcacaggaacagaaaaccaaacactgcctattctcactctctcgttgaatggctttgatcaaaatgctgataatgatatggacaataaaatccaggttgaggtggtctcagatggatataaggaacttgttgggaactggaaggagaaattcaagctggctgaagaaatttacgtaagtaacaaggagccaaatgttaatcaccaggacaatggtggaaacatcctgggaacccatcccttgtatcagtgtgacctggatataagacatggagtcaaagaagattattttggaactttaagatttgactgccctgctggattttggactttcatgggacctgtatctccttcattttggccaatttctctcatttggaatggctgtatttacccaatgcctgtaccccagttgtatctaggaaccatggagataaagaaaactaacactgtttgcaaacctgcttaccctagagaaaagtgtgatgtcaaactcttcaacatgaatgaaaatcaatatcaatattgatctttgcttatttgctaatctcatatatactccttctcccttcattccatgaaatctattgggtagttagacttaattagtttagtatatttgaccatacacttttctatcacttaatgatatacatgtcattctctctac

SEQ ID NO: 477930 - DNA, 2066 bp, Homo sapiens
gttcattctagatttcttttgtttgcaacgattgagcaataccctttttgaacattggtaccggagaagtgggccattgctatgaagatacctgaaaatgtggaagcaactttggaactgggtaatgggctgagtctggaacagtttggagggatcagaagaagacaggaagatgagggaaagtttgcaacttctagagacttgttgaatggctgtgaccaaattgctgatagcgatacgaacagtgaagtccaggctgaggtggtctcatatggaaacaagaaacttattgggaactggaagtttgtatggaaatacctgaatgtcaaagcagaagtctgctacaggagaaaagccatcatgaagaatctctacctgggcagtaaaaaggggaaatatgggaccgtagcccccacacagagtcccactagggcactgcctagtggagctgtgcaaagaggaccaccatactgtagactccagaatggtagatccactgacagcttgcaccatactcctggaaaaaccacagacactcaatgccagcctctgagagctgccatggtggctgtaccctacagagccgctggggcagggctgcccaaggtcttgggagcccacctcttccatccttccatcatcgtggcctgcatcatcaacatgagtttttctaaccacagatttctagatacatacctgataccctgaacttcacaagaaatcggcaatcattaatgatccagctaaatttgattttaactgcagacgttctccatggggtaggaaatgcatctaccaacaagattataattttgtatcccataccttctgacattgctagtaagagtattatgtactcaaactcaagtcaaaatgccatgacagacacatattgacccagactgaggtgtgtacatatatatatacatatatatatacacacatatataatataaatatatatttataattatataaatatataacatatttataattatatgaatatataacatatttataattataggaatatataacatatttataattatagaaatatatagcatatttataattatagaaatatataacatatttataattatagaaatatatagcatatttataattatagaaatatataacatatttataattatagaaatatataacatatttataattatagaaatatatagcatatttataattatagaaatatataacatatttataattatagaaatatatagcatatttataattatagaaatatataacatatttataattatagaaatatataacatatttataattatagaaatatataacatatttataattatagaaatatataatatatttataattatagaaatatatctaatatatatttataattatagaaatatatctaatatatatttataattatatgaatatatcatatatatttataattatatgaatatatctaatatatatttataattatagaaatatatctaatatatatttataattatatgaatatatcatatatatttataattatatgaatatatctaatatatatttataattatatgaatatatctaatatatatttataattatatgaatatatctaatatatatttatagttatatgaatatatctaatatatatttatagttatatgaatatatctaatatatatttatagttatatgaatatatctaatatatatttgataaaacaaaaaggacaatttatatcttgaattgccctcaaaataatcttaatctgagaagtaaaatgattaaatgtttaaagaaaaacaaaaagtattatacagaatatttaatctgacttgataaacactatgaagaacattcatatacttcaataaacagggtacacttgccagcagttttgccacgagagtacaccaaacaaaggagacagggtcgtttataacctgacacgtcaaccctactgctgtatccagtttccattggctggaacgggacctcacattctgtatttgtcctgattggctagcaacttagaactttt

SEQ ID NO: 477931 - DNA, 2460 bp, Homo sapiens
gagggtgatacttaagattgtggtaagcagcgacccatatttttgggggaaaaacaacacaagttctggacagtaaagatttaagacgtgctatcatgctaagaagacaatgggaaaatggccataaaggcactgtggagcttacaagtgtgaccgctcccatcacaggcccagagtgtcaaggcctgactgaaggaaatatgtcaaaggagaggtttcagtgctctcaggaacttggaacttactgtccagggccaactcaagtctcagttccctacattctagtgcagggctcgtcagctgccccagccacatctcaggactgccaggatcagctacacgcagctgagaatcaatcccacccacttctccagaaggaagaagaagatgaagaagaagaagaagaggaagaagaggaggaggaggagggggaggagcaggaggaggaggaggaagaggaagaagaagaaaaaggggaagaagaaaaagaagaagaaggagaagacgaaaaaaagaagaggaagaagaaaagaaggagaagaagaagaggaggaagaagaagaagaaaaagaggaagaagaagaagaaggagaagaagaagaatttagaagttattggatagaataaatgtagtctttatgctaatactgcatgagttttaggggtcagaggcagaaagctatgatttcaatgttgtccccttcaaaactaatcttgaagtttgtcattgtagcagttttaagaagtgggacctttaagacacgattaggccataagggctccaacttacgggtggcattgctgctgtcatataaggacaagtctgtccctctgttgtccttccacattccaccactacatactacagcaagaaggccattagacaatgtcagctcctcagttttggaattttcaacctccagaattatgagctaataaacttactatcattcaaaaattacatagtctgtggtattttattatagcagcacaaaatggactctgacactacactattgtcatagagtcatgataaacgccgtttttgtgcaagctgcataacatggagagattttaatattagtcaatcagattcaatataaaatattgattctaactgaaatgactctatatgtttcaaagaagaattaaaatatttctccatcagtccatgtatgacttattattctgttgcattgtacaaataaagtgttatagaaacgagaagttcaatattttggaggctagaaggctaagatttactacactgttctatgacctttaatgctagcatttataaaataaattcactaattccttgtatgtttatcatttcatggaggatttgaaaaaaatgatattcagttaaatgcattgaatttaaaaacattttatgatgaacaaataaatgtatacattatgtttaaatataaaacacatattaattaaatataggcaacattttattaaaaagtttaagtgcttagttacttcaaaatattgaaatccaaaaactgctttgctttcacctttttttttaaattaaatttcccctttctgttggtttatgttagttcctgtacgtcttcaaattgactcttagaattctttttactggaaaaaaattaataaaaatgttgcatgcaataaagaagaatattattaggaaaaattaatcttgactttcttcaccttttcaatattaattttaactttcatattgaattttaattatttggtaccattattaaaattttctagtgtacttaccttaaaattgtacagaaagcacttactttattacaaatgtaaaataattacaataagcagtatttgtttatgttgaatttctacctttttactctttcaaactgtctatggtttatcgactgctacttttactaaagaaaagtgactctttttaatgatatcattagtgatatatatatataaaatacaaatcacctgttaatttagcaatgtaaaatgtggcttctaaggaattgcattttagtaatgaccttcttgcaaatttttttaatgttagaagtatttgtagataaaaatactttctaaataaattgaatgttggtctctgtctggaataaaacactgaatcaaaaggatctacactgccatcttctgtcatgtatggtatcagataaatatctccaagtaaaatgactgaaaaaattttattaaatacattaacttccctcaaactatttcttagtgatttgttatatatgtttacccttgatttatacaaattcatgtaacgtttagctactaatgatgagtttataaccatgtaagtttataaccataaagccctgtaagacctttcccatattaacaataaagcaagctgtacttctttaaataaatgaatatttttaaaaaggataaacagactgtattttatagggcattctgcctttaaacccttccagtccatta

SEQ ID NO: 477932 - DNA, 601 bp, Homo sapiens
cgaattgaaggatggtaaatgcaggggactttattgccgatgaaaaccctagcaggcagacacaagtggctggacatcgtgaagaacacatcagcgaaagaagacacaagtggctggtcaacgagagcacgccagcagaagagcatgctgacaggcaccagcaggtcaacgagagcatgccagcagaagagcatgctgacaggcgccagcaggccagcaggccaccgactggtggaacaatgtggagatgtagaaagacagacagaagacagaaaaccgtcaaagttaaaatcatgaacttctggcagcgttgctgtggtatcaggtctcactcttcttgtgaacagattgttccaccagacagctttgccaatttggtagcaaattggagctttgctcctttggagaagcaaaatctataacaactagtgtgataaataagtgaaggaagttgtaaaaaaaaaattaaaaaaaaaaaggatttaggacgtatgacaccagaaagtaatatgatgtttaggtgaaaatataaattacttgtgttttctcattatcatttagtagaaaaattgcaaactgtcagtcaccaatgaactgtgct

SEQ ID NO: 477933 - DNA, 759 bp, Homo sapiens
tggcacataagagaaattcaactactgctatcggggaaagaaatgggggtcaactttgactgtagcaaagatagctggagacttatagctaaagaggagagtgagaagggcaggccaaagacacagaaaacaaagatgggagatgagaaacctgatcagatatggagagtcatccggtatcagaggtcagggattctttctaaactaaggagaactcttgctaagactggactatgcacatcaggcaaggatgggcggctaaggtcaaggcctactctgttcgtggtgttgctggcttcaggagtgaagctgcagaccttcgtggggagtgctacagctcataaaggtagcgcagacccaaatactgagcagcagcaagacttattgcgaagagggaaagaacaaaacttccacagcgtggaaggacccatttgtggtatccacgtccttagacacaagccatttgagaaggttgtaaaggatgttgggcacaagaacctgcgtgacacacgtgtggataaattgtcaaagtagcatcaatcacattgcattaataatttgtcttgatttactactttcaaatatttagatagcaatatcagaaaaaaaatttcttcatttatgatattatttgaagtgaaattatcttttctactcatagacatgctctttaggaaattaaccagccactgccattaccttctccctgtaccttgatggctcaacatacttcatcccagaaccagctcttactatttc

SEQ ID NO: 477934 - DNA, 1667 bp, Homo sapiens
aggcctccaggcctgtgataagagaggctgctgcagcaaatttctgcagctggcttgaattccttcccacaaaatgggtttgtttttttctactgcatggtcaggctgcaaattttccaaacttttatgctgtgcttcccttttaaatacaagttccagtttcaggtcattttgctcatgcataagaaaagtgacctttgctacagtttccaacacgttcctcatctccaagccctcctcaaccaggacttcattgtccatatcactagcagcattttcatcacaacaatttaacaagcctctaggaagttccaagttttccctcatctccctgtcttcttctgatccctccaaactcttccaacctctgcccattaaccaggtccaaagctgcttccgcattttcagtccagagagcattacaataggtcactatattgatgacacgatgttaattaaaccagataagccagagctttttgtggagtttcagatgcaggaactgaaggaagcatctggtaaacagccagagagacaccagagctcttggtatcacaaccttcaaaaccttgaactttctcaacaaccacatgagctcagaagaggaccccaaggccttagatgagactacatttccagccaacagaccaattatagtctcaatagagcagacatctatgtcatggccagacacctaactcccagtaaaataataaatgcatgttttaagctgttaaatttgtgcaaatactgtcactaagtgacagattgttaatacagcagaagatgaacactcaaaagatctagtgacccaacatattgaacttatactctaaaaagaaagatagagtaaacaaataaaaataatttcaggtacggatacattttatgcatggaataaagtgagccaatctgtgcagtcaaaatcattgtccctcctaagaggtggtaaatgtgttcctgttgtgtaaataaaccagggatggtgagcctaacccatatgaggtgcaatacctttctgctgagtgaacattacataaaatagtttaattcctattttataattactgtaaaaaaaagaaaattgaaaacttctgctattacattgacaatattcctcttctaccttgagatttgatggatataaaacacaaatacccagtgctattatgttctgatcatttatacacttattttatctttatatccatataatgtaggtactgttaccatctccattctaccaatgaggaatggagactcagaatggctttgtatactgcccaagttcatttattcactaagcaatggggtcaagatttaattttggcagacttgttctagaattcgtgaagattcttgttggacagtcaactttacaattctgccagtctggaattattctgttgccttcagtcagagctggaaatttgttgggttattactttttcagttattcaatttaaaaaattattaacatagtttaggaagtaattgtttatttttattaataaaatattgttatagtcaataattatgttttaaaaatattaatgcacttcttcataaccataaattttaatttccaccttaacatacaatatatggtttaaatgttaagtataaactattattgaaaatgatggaactgaaacacagccttgaaa

SEQ ID NO: 477935 - DNA, 1944 bp, Homo sapiens
gagcatggccagagtggacaccgaggccgaggagacgcggagagccagcgagggctgctattgtcacctctcatttccatcaggcctgctgactgaaacacactaacaaagacaaacgtaaacaaagaacgggcaccaaagcaagactaaatgacacaaacaaatggaaacacatcccatgctcagggatcatcgcattttcacaatctgtattgtgaaaatgaccatactgccaaaggcaatctacaaattcagtgcaattcccatccaaataccaaaatcattgttcaaagaactagaaaaaacaatcctaaaattcatatgaaaccattaaagagcctgcatagccaaagcaagactagcaaagagagcaaatctggaggcgttgcattacctgatttcaaactctactgtaaggccatagtcatcaaagcagcatggtactggtacaaaaataggcatatggaccaatggaacagaatagagaacccagaaggtgctgaagactgtacaggaagcatggcagcctgtgctcctggagaggacatagggagctgttactcatggtgaaagagctttaaaaagggaaattataggctagttacacttccagttggatgagtctacccacctgggcaggatagcaactagtccatattgtgtgattctttgggatttaattttagagaaaaagagagctagtttcactaagctttctcccatcatattgtggcacagatattagagtgtacttaggcatacctgagctttcagccaagttgatggctggggtggcagggaaagaaagtaatatgactccgtggaaaatttccctatatgagaaatattacctgtacatttttattatgacatgtatcataatgtttgggatataataataccaacataattattactaactacctcaaaaaaacgaatattttaattactgtttagaaacaatgcaacaccggaagccctttctttctatatccccattccagtcacacaaaagttaacattgtcctgaattatatgttaagcatgttcttctctttcttacattttaaacatgaatgtttgtgttgttaaaatatatattatatatgtttgttttaggactgtatataaatggaaacatatagtatttatttttttgactcgatacgtttgttcattattatctacagagaaaaatccatgttcaattatactttcattttctgagctatatagtattccattccaacataacagatccaatcgttctgctatgaataaacataatacattagttcatagtgcttagagttcttgaatgaatatgctaaggagaaacatttctgaatgtaggataatggcatgtttaccattaataacattttggtttccatggttttctctttgtattttacgaagtgattgagagtgtctgttactgcattacctcactatcatgtggtagcgttagacctgtaatttttttcacttttgtagattatgtaatggaatttcactgactttacttgaatttctctattactgatttaagttgagcttatatttatttgattatatcagatgtaaaagtgcctattcatactatttatacttttttaaaatgtgagtagtctttttttatttgtaggatattttattttattctcaatgtcaattatcttttggtcatattttatgcaactatcttcttcctgatatagcttgaaattttattttcttttattttctttgatacatatactcttaatttaaatgcataattacaaatatataaaattactatgtttatatgaccatgtttgtacatattataaatatagccagttttcacaacttgtggcttcagtattgtgaattcacttattaaaacttatttgtaaccctaaaattaaatgtttcttcattgtcatttgcagacatttt

SEQ ID NO: 477936 - DNA, 597 bp, Homo sapiens
gctttacagctgacattacaacagcaacaagaaaagtttcagcaatgcaccaagattgtcttgtgctcagacaaccaagcagtctcttgttgtctgacgtaatacctggagttctttgtcctacctccaagaacattaaggagagcagagacaaaagtgagtcgtccccagtgtatgttgttgacatctttgcatccatgagtaccaaatgtttatctcctacttctaaaacacctacaccttatttgtttggagtagtagtgttcagcaatatttattttcaagattggactcacagttccacatggctggtgaagcctcacagtcatagcagaaggcaaaggaggagcaaaggcatgttttacatggtggcagacaagagagcatgtgcaggggaactgccttttataaaaccatcagatctcatgagacttattcactatcatgagaacagcacaggaaaaacacacccccatgattcaactacctcccaccaggtccctcccatgaaacgtggggcttatgggagctacaattcaacatgagatttgggtggggacacagccagaccatatcagtctttaatgctgcctctgc

SEQ ID NO: 477937 - DNA, 895 bp, Homo sapiens
ttttggtggataagctttttgatatgctgctggatttggccccagcgtatgctgttcctgctcatgtgttctcatcatgcaactcccagttgtagaggctggaagagtatggagggctcagaagaagacaggaagaagagggaaaatttggaacttcctagagagttgttaaatttttgtgaccaaaatgccaatagtgataccaacaatgaagtccaggctgaggacgtctcaaatgggaatgaggaacttattgggaactggagcaaaggacacatttgttacaccttggcaaagaccttggttggattgttcccctgccctagggatctgtggaactttgaccttgagagtgatgatttaggaaaagctgcctttattcatgactctaaacattttaatctgcattttctgtctacagcatccagccaagatcctgctaaagtgtccaatgacatctctatcgctaaaccaagggaaatttttctctgagagcaattatggtcaatgaatttattttctccataataaagaacaagatcatattagtacttgagaattcaatcggcataataggcctttcagtcaatgtattccttctcaagttgccttctatattaagatctcctttatacttatcacaatagaaaaaaatatacatggcatttcattttaaagcaactttcatctgcaaagtcatctgctatgaaaatcctattgaaacaacacagcatattcctattactctacactcagtgcatactgtttacttttgtgagtcttgctatattattattaaagtctatggtgatatatgttggctcatttagtttagtatcttaaagatcaatgtatctaactcagtaattttcccagtagcacaggtattgacgaa

SEQ ID NO: 477938 - DNA, 1010 bp, Homo sapiens
cagagaaaagttaatgcagaggcaatgaaatatgaagatgctatcattattttcagaaatccttgcagtttccatggtaaggcaatatgtcatattattaggttcattgaatatctagtaatggactgccctggatccattgaaggtttaacatatcctctattcttgactaataaacagaataaaatattcatcaaccacaaagttggtgctgatgatcatggcaccagaaataacaacaggacaaagcaccatcaacacttaatgaagggaataactgtgagaagtgaaagaataagtgataatgatgatgatgatgatgatgataataataaaaataataatgatgatgcttatgcaggaatagaaattcttaaacttatcaaacagaaagaggtctggagctcagtagcccagtggtttccaaccctggatgcagaaaagccacagattataatccagtctgtgaaagataatctagcaaaaaacaaaacaagaacaagaattcagagctttacacattaaaggtgtaagcaacattgtaacttccatatcaagtgtaataaagttctcatttcaggacacatttccacatttctaaagaaagtgacaataaaacatcaacagttcttggatgttgaaacatagccaaaagtgagaccatcaggagaagggcctaagaagaactagattaacaggaagaaggtgaaaaagtgataataaatcttttaatcctgccacctacacaggcgattctccacctaccagaggtgagagcatatcttactaggtcactaacagcagcaaagtctctgaagaaggttttccagttaatatgtggaccaaaaaagcacaactggaccaatatataaaataaacacactcctttactacaacaattcgggaaactaaattttcaatgatggaaggaatggttatatggttaaaaccaaatgctaatgttggatacttttattaattcaataaatgaatattcatttatttattta

SEQ ID NO: 477939 - DNA, 3125 bp, Homo sapiens
tgggaaactgctattcgatgggtattaagtttcagttatgcaaaatgactgagttgtatgggaaatctcaaggaaactatagcaaacgactatttctggaaatccatagaaacaaaaaagagttgctggccagatttactaaaggttctatatgtctttatcagctttctttattttactgctcactcttgtccacaggcattcataaagctttatctagacaaattcacaaagacagcaacaataatgatgctgccgtggaaaaggccaaaggtaaagaagaggttgccctagttattgcagtgaaggccatcccagagcagcatcagccaggtggtcacaagacatgtgagtggtcccagccaagatcaagggagctgaagagtcacctggctagtcagaggcactgggtcaagatccagtcaaaaaatacagaaaccatgctggatgtttcaaaaagaagggatttaatacgggatatcagtaaaatagatgctggaaggctagaggcataagaggaaaaggtaattgtcaactttttctttctcaagctgtgtgttgtaactttataggtagaagtgtgtgtgtgtgtgtacgtgtgtgtatgtgcacgtgtgtgcatggcagggtggacggtttggagtcatacagtatagaggacaaaacttgaagccagacaactcgagtttaagtcccagatctggctcttttatctttggcacctaaagcaaataaattcacctttttgtgccttaaacctctcataagtaaaatgttagtacttaacgatgttgtattcaattagttgatgcatatgtaaagttatttagaactgtatctgccgccatgtagaattaacactatgtaaatgctacctgttatttgtcttgtgaattttgtcatagttttaatttttttctacaatttaatttttcctgtacatttttttcatgtttagttttccataagataacatgatatgtgaaattaccaaatattccattctatggcttaatatatttcatttattcatccattcactcattctaatctaagtttcccagcagcagcttagaatcactcaattgtaaataatcccatatgaagtggaaataaaagcacaatattcacaccagttcaaatacctgactgaatatgtccatcattctctctgaagactgcaccaaaagatgtactgtttctctccaacatcgtactcaaatccttaatcatgtaactaaaacctcttcctgagaatctatatattagaatgattgtaaaagtggcattatctctttctcactgagaatatgcttctcagaagaggaaaattggctccaaatagagcttatattttacttccctcttttataacccttagatgtttcaaggggactatgtaacagagtcagtcacttctctactaccaagactaatgattaaagtataaattgcatgaagttcacaagtcatcagagactattatatatgacagagattgatactatatctttcactggttggcctatagcacaggaataaaatgtacatatttcacagattgatactttagcaaaatcatagtaaaatggtttacattacttctaagacaattctaagaatatttgcatatactgtgtacctgtgtgtggaccgtatgtctatatattgcatatatgagcactacttaattttcttgctgtcagaaaaataaataaataaatttcccttatcagaacgtcccattcctcatcacctttccagtttgccttgtcctgtgcaattaactattgaatattgcatacaatgataaatgatttattcaaggcctgtctctccccaaatttaaatgcagcaatacccaatagtggtaaaataaatgccaagcctttttactgttaccaaaaagtttctggctatgtttgagttttatttcttctttttaaaaaattttattctaacaaaatgcataggattttaaatgttcagttcagtgtatttgacaattatatatgactatgacctgtgtaatgatcaaataaaagaagatttagcacatttctgtcaccacagaaagttcttttttgtctctttccagacaattttccctccaaaggcagccgctttctgacttctgtaaccgtctgtcagttcatccctttgattgcctggcatcatttgctccgtgtagtgtctgcaagattcctccattctgctgtgtatttcagtgatggattcccttattgctgggtagtgcttattatgtgggtttaccacaatgtgtttttctcttctcctgctgataggcatttggtttgtttccagatttagtctattacgttttagagttattgattatagattactgttccatagtgacatatgcatgtgtgcgttcatgtgtgcgtgtttatatgtgtgtatcaaacattgtaaactaattgtaaatgaccaattcatttccctcatgaggagaaattataaattttcatcttacctagttgaccatttgttttccatcataattacttctttttgtatcctgtctgaaaaatgatcttcctatcccccggtcacaggggaatagtttctatattttcttttacaaaacatggctctagaatttatgcttaaatctatgatgaagcttggaaaaaatttatttatagaattagctaggggtcgacaaaatattttaatatgaatatccacttaatttagtatcatttgtcttgacatctatgcaaatattttaataatatttacacaagctgacttttgaactctataccccttagttaaatagattagtttagaagataagtttatgtgtcttaaaagcacatcatgtcacattcatctttggacaatatttacttaatacttacttaaaggtatattgtataatatgatagttgttatggactgaattatgtgtcttcaaaattcacatgttgaatccctaactcaaagagcctcaggatgactgtatttgaaaataggacatttaaagaggtacttaagttaaatgagtctgttagggtgggcataatccttaatccaatctgactgttgtccttatatcaggagattaggatacacaaaaagagacacgagcaatatgc

SEQ ID NO: 477940 - DNA, 3353 bp, Homo sapiens
cctcttcagtgcctcttttagcaacatgaagttaaaaccaggtactgtggttgctcacctgatttgtggttctaatgacaatgctcttttgtgtgcagataatttcagaggatgtatggaaatgcttggatgctcaggcaggtttgctgcaggggtgaggctttcttggaaaatctctgctagggtagtgcagaaagaaaatgtggggtcagagcccccacacggagtccctactggagcactgcctagtggagctgtgagaagagggccactgtcctccagaccccagaatggtagatccaccaacagcttgcactgtgtacctagaaaagctgtagacactcaatgctggcccatgaaagcagccaggagggaggctgtacactgccaagccatagagtggagctgcccaaaaccatgggaactcacctcttgcatcagcatgatctggatattccaagtaatatatagtctttctccaaacactcaccattactagctgttttctttacttactctcttttcatactcttcaccaacacctccttcccaaacctgggctgcctgcacatggatcattcttttttcctttttatatggtctcctgagaaggattatctgttttcttatctgaatgtgtttcttctcaggaataattttcctcatgatctcttgaatatgtttttcgtattgttgttaaataatgtatgatgactaaatgcctacattttctaagaccaacaaatttttataattgtacacatatttttattttctcttaatgcaaattttcaaatggtcaaatgaagtaagagccttgctcaatttattgacctgcacttttactcctcatctctattccatgctgaagtagaagaaatcaaaggattttcatgaaatcctgtacatgatttaaaattgaaaacctatattttatatgtaatttgtgctttagtttatcattaaaatattaatcaatactttttcaataaaaattttgatccactttggttcagaagcaaatttagagtcatgtgatgacaatgatccatgcttacaggactgctagttatatatggattattcctaacaacttaactactggtggtcttcttattattcactatcccatacatttctaagtcatgttctccagctaataacaatgaaactttcatgttaatcttagctaaacttgttggggaagttatatcttctgggatgaagtaaaaaaaaaagttatagaatgcatttgcaagccatatagaaataatatgtagatttattagctttgggcattgtaactcacttttcctctattgattcaaataattcaaataattatctgagacagtttcattaaaaaataatgaataaactcaaaactcatggaatttctggatctaagtgtagacttatagtaaagttgtaaaatcaccttgcttttgtagtctgaccatgatatgcatggcaactggaggaaacgtttgaaccagaatgaagtgaacaagcaaagattttattgcaataagagataataagaaaaattcagtttttaagctgtttctctgagcaatagccaagggctataaaaacatgtctgttgaggggatcatggagacagaatgtggctgagagagacatgcaatagagtcgttgtattggtccattttcacaccctgagaagaaacatattcagaaggggaaacagataatccctctcagcagaccatataaaaaagaaaaaagaacgatccacgtgctggcagcccaggttttggaaggaggtgtttgatggtgaggagtataaaaagagagtaagtaaacaaaatagctagtaatagtgagtatctggagaaagaccataagttacttggaatctggggagaagccagggaagattctgaaaaatcagctttcaaaatgattgagactacagagagataaattcataaaaggtatttttttctttgtcttctatatcatgcaatgtttaactttgccatccacatttggctacaacagactatgtattttggttgtttgcatagatttcttcttattgtgattctgtgctgagatggatcacagaatcgctcaactttaatactgttgtaattaccatttatagctaatatctataaataagtaacaatcatgtaatatttaatatattcacataaatatacataaatcctgttccatgagaaatacaatgtgaaaaacatttcaaataccctaatgtacatagtttagtaataatactaaattaccagaaaattattggtttaatgacaatcacaacataaatgcacactttttttttgatagaacagttttaaatttcacacataaccactttcatttttatattaaaagtgaagatcctacagaaaatacaatggtaattgtgctacagcaacctataaaaaggataactagaaaatatgactttgcacgctgtatactgctatttcaatttcgtggcttatacattttaagaaattaaactttattatttcaagaggaaatttatttaaaaatcaatcgaagaaaactaaaaattgtataataaaatatagatattatatggacattcacctaaatgtgatattaataatacaaatagttgaaattgattacatagggaacaagtattcatcccataacctgtaaacaacatatctttaagagtctcatgctctactgactgagctagctaggcagtcacaatattttaaaattaaccaaaacaaatcaataaattaaaaagtatatttaagtatgtcatgtttttctaattatttattcatctatatattatttgtatatgatttatacatatatactgtaggtatatatattagacaggtatgttttttacataagtgtggggagagagaaaaaggaggtatttactactacctagtgatactattgctagcatccaaattgataggtttaaaccctagataaatgaaaaactttccaaggttattagggagatgaaccaccagaatatattcttattcttatgtaaactaatgcagtgttaacatatttcaaagcattgattatgttacagttttatatttcttcctcacaacagcaagaagagtaggaattatatactgtgcacagtgatgtttttgcttctctgaagagttgaagaataccatatttaatcacagaatatgaaatataataattcacatatgaaaaaatatgcaagacagttgaaagaaagaaatgaaaaattaaaaggcaggaagaaaaaagagaaggaaggaaggggaggaggggaagaggggtggagggagggagggaaggttgttagcaccacacaagcaaat

SEQ ID NO: 477941 - DNA, 782 bp, Homo sapiens
gtgagccaagaaattcaccagatgtccaggcttccctttcttcctctccccacagaaacaagcaccagtttgcgtgtgggggtgtcactgtccaaagatttgctaggagaagaatatgaatttatgcttaaaagggaagcagatcataaaagcttggcaaatttgcagcctatccatgtggtagaaaagaaaaacccactttctggggagaaattcaatccagctgcaggattttccataagtagcaagaggctgagtgttaagagccaggacaatggggaaaatgtctccagggcaagtcagagatcttcacagcagcttctcccattacaggcccagaggagaggagggaaaaatgattgcatgggccaggcccagggccctgctgctctgtgtagtcttgggacatgtggagctataacaagagggccaccatcctccagaccccagaaaggtagatccactgacagcttgctccgtgctcctggaaaagccacaggcactcaacaccagcccgtgaaagcagctgtgggggttgtatcctgcagagccacaggggtggagctacccaaggttctgggagcccacttcttgtatcagcatgccctggatctctttgagaaaccaccgtattgctttccacaatggttgcgctaatttacgttaccaccaatagtgtataagtgttcctttttcttcacatccttgccagcatctcctgaatgatataccatggaatactactcagcaattaaaaggaatgaaataatagcatttaaagt

SEQ ID NO: 477942 - DNA, 1911 bp, Homo sapiens
tcctgaagacttctgaaatggcttcaaagccttttccaattgttttggacattggcacttggctttagtcatgcaagtctctctagcaagtggcgacaagcatctaaactatatcaacttgtccaagaatggctacctgcaggaggaagaagctggcatctgcaaggctctacgaaaacagattacaactcagttacttgaggcaatcaatactgtccaatactgtcaagatttggactcagcacatcatatgtctgagcagttcagcatcctcactcacaagtccaaggctctcagcaatgtggaagaagatgtgattcctaaaattaccacccttacacacagtgacacactcaccagaaaagggcaagagaaggaaggcaaagaggacgggtccatacttgaacaacttgaaataacttgtctgcatttcaagaacaacctaccagagaccttacctgtcaccttggctctcccacccaatggagatggctctaatggtggcacaaaccaggaaggggaaatctgtggtttaaattctttatgcctcatcctctgagtgctgaaggcttgctgtaggctgtatgctgttaatgctaatcgtgataggggtttttgcctccaactgactcctacatattagcattaacagtgtatgatgcctgttactagcattcacatggaacaaattgctgccgtgggaggatgacaaagaagcatgagtcaccctgctggataaacttagacttcaggctttatcatttttcaatctgttaatcataatctggtcactgggatgttcaaccttaaactaagttttgaaagtaaggttatttaaaagatttatcagtagtatcctaaatgcaaacattttcatttaaatgtcaagcccatgtttgtttttatcattaacagaaaatatattcatgtcattcttaattgcaggttttggcttgttcattataatgttcataaacacctttgattcaactgttagaaatgtgggctaaacacaaatttctataatatttttgtagttaaaaattagaaggactactaacctccagttatatcatggattgtctggcaacgttttttaaaagatttagaaactggtactttcccccaggtaacgattttctgttcaggcaacttcagtttaaaattaatacttttatttgactcttaaagggaaactgaaaggctatgaagctgaatttttttaatgaaatatttttaacagttagcagggtaaataacatctgacagctaatgagatattttttccatacaagataaaaagatttaatcaaaaaatttcatatttgaaatgaagtcccaaatctaggttcaagttcaatagcttagccacataatacggttgtgcgagcagagaatctacctttccacttctaagcctgtttcttcctccatatggggataatactttacaaggttgttgtgaggcttagatgagatagagaattattccataagataatcaagtgctacattaatgttatagttagattaatccaagaactagtcaccctactttattagagaagagaaaagctaatgatttgatttgcagaatatttaaggtttggatttctatgcagtttttctaaataaccatcacttacaaatatgtaaccaaacgtaattgttagtatatttaatgtaaacttgttttaacaactcttctcaacattttgtccaggttattcactgtaaccaaataaatctcatgagtctttagttgatttaaaataatttttatggcccattttcttttgcaaagtacaaattataattccagaagctatctgccaaaaaaagacaatggaagaaaattatgaggacactaaagggaacattcctgactcctaggacacagtattctcatgt

SEQ ID NO: 477943 - DNA, 1311 bp, Homo sapiens
tcatcagttaaggcaggaacaagccattttcatttcttttgtggtggaatgtcatcagttaaggcaggaaccagctatctggatgtggggattcgaccatgactgccttacataagcaggatcaaagtccatcatgggactggattccagagaacaatgatggtattgacttcaatgtatgtgggaaaagattggactccagaggcaccgtgattttccttgctctcctggatggtgctgcacagcccacgggggctctggcggctgcatacatgtgcaagtactggaaaaatcggatcacatgtgggcttggaggatgggtgcaaggttttattgagtggagtgtgttcctctcaacatccagacacttgtgtgtgcgcccgctagggtctcagagattttatgggcacaggatggaggatgtgatgggccagagtggtcttggaaaatgcaacatttgggtgcagaaacaggagtgcctgtccttacttaggtccctgggcacaggcctgagagtgaagccctcaccagggaccctgcccttctctatccagcatttccctatctccctcctgtatcactgatatcttttactattgagtcttcacatccagaaacataatttggccttctgttaatttagagcttcttttattttcttctgtaaaaatttacagcattctttatattatatgtttcttattgaatttaattatgaacaggttatactttgttattatcatgggatcttttaaatacattctaattggttatgacaggtttaaaaagctactcttaatttttctgtgttgatcttgtatcccaactaaatcctgtgtttgttctaaatgcttactagtagtgcctcttaggtgttctaggtggctactcatagcgtctgataacaataatagtttgtctttttctttcctatatttacaccaatttttttctcctaacatttaaaggttttttttttttttcagtttcctgtaatgattatttattgaatttggaagatctccattgtggtgttaatttcttaaaagcttagtgtttcttgcttgctcttatttgttgctgaggacttagattaaacagtttattgcttttgaagtatattttgtcagtccagttgagggactgagtctcagtccagatgagggactgccagtttgtctagcagttgatacaaactaattacctctggtaactttgcaggagctgaaaacagaagtgtgactagtaaggtgtgaaggtggcttgatttctagatatgaggctcttggtgcttgttggctgacagacact

SEQ ID NO: 477944 - DNA, 764 bp, Homo sapiens
gcattctaacattttcgtcctaggagaagatcctgatcttacctggagctgagtcaatttagagagccaggcaagatgcaggggtacaggaagccatgggaaagccctgtaggctcggtgggtccccaaggccattcttgcctggcattaccgggattcttcaggaaggtggccagaggtgcagggaaaatgccacagggagaaggaaatctccagctgcactttgaagaagagaaatctaaaagtctggaaaacatatttgttggaataatcaaggaaaacttctccagctttgctagagacctagacatccaaatacaagaagcacagagaacacctgggaaattcattgcaaaaagatcatcatgtaggcacattgtcgtcaggttatctaaagttaagatgaaagagagaatcttaagagatgtgagacaaaagcaccaggtaacccataaaggaaaacctatcagattaacagcaaatttctcagcagaaaccctacaagctacaggacattgggacccaatcttcagcctcttcaaacaaaataattatcagccaagaattttgtatccagtgaaactgagcatcatgtatgaaggaaagatacagtctttttcaaacaaacaaatgctgagagaatttgccactaccaagctactactacatgaactgctaaaaggagctctaaatcttgaaacaaatcctggaaacacatcaaaacagaacctctttaatgcatacatctcacaggacctataaaa

SEQ ID NO: 477945 - DNA, 639 bp, Homo sapiens
gtctgagagaggagatctacagggagatgatactctagctatgatggcaaaatcggtcccagcactaatgcatcgtcagtattcggtaattctgaaaaataaaagtaccgacattaagaaatattcactgacatgtggtcgattctcggatatgaatccgatgtttgatggaaacagcattgagtctataaattacttcgggctctatggccatttttacaacattgattctacccatcccagcaacaccaatatcatcgttattgctaccattaccattatcagcactatgaatttcactgccaacaacattggattcatcggcaccactactgacaatgaaaaactcattaccaagagtaacaagtacttaattaatattaaaaatgaagatctacatgttaggtgtgctcttttctactggggtatctttgcttctggacatttaagatgcaaaggtaccagtttaccttcacattccttgatctaaaaaggtacacatatttaaaacaaagctttagtacatatatgtcaaattgtcgatttctgtttcagtttcccaactatcttcatcaactttaagcattatatatctgtgtatgggccactttttgcgataaacgcaacttgtgttagttt

SEQ ID NO: 477946 - DNA, 1088 bp, Homo sapiens
ttgccaaaattcacaccgctggtccaggtttgaagcaagcagtctgtacctgcagtccttgtctgtaaccatggcaccctggcttctcacacatctcatcgtggaattattaattctacttcaaaatgccacacagccttcatgtgataaaatgaaacaattggtgagtctaagcattgagaaaaaacgttcttttttccactcccgactccattccaacagttgggacagtgttttctctgtgcctgtagaaacctcagctcctgggctgaggagcctgttccctttggggaatgtggcagtcagtcccacagcacagggtccacttagacactgtatcctgcgtggtcccctttcctgctgggaagcagatatccaaatgagcagcagaatcctgtctctcccttcaggcccctctgctccttatgagtggtgttttcccttggttttggatgagaaacaccctttccccttccagagggattgtttctgtggaccccaccctgagttttcccctggttaggcaacgggcaggtgggggtggtggaaccaactctttagaaccagcaatgacaaacagatcccacttgggggaagttgatgttaagtgtcatgggtcctctggaattttctgaagctttcctgtttttttttttctccccctaaccagctcaactgatctcctgggatctctactaagatgttggcagcccggccagctggtctggccctggacgtgccttcatggtctggttatgcttcatgacctgcactgtggtcagtgccattttgcagactctgatcacagtgaaacgttccatgggaacttgggccatgagaaacatccttcctaaccacgtgactgcagaaacatccttatcgcgtcctcctgggcaaaggcccaacagcctgactgcagggacatccttgccatatcctgctgggcagcaagctctaccacccagatccctccctcccagtcccatgattaccccagcctgtgagtggcagttggtgctggcactaagctggtttcctcctccccagggttttgctggcaataaagatgttgctgttgaagccaccaa

SEQ ID NO: 477947 - DNA, 1106 bp, Homo sapiens
gagggtcctggctcctcatctcactcgggtttatgccaaagatgtacaatttttggttcagatgcctgagtcttaatgcttcaaggtgtagaccttttactcactgctgtagccattacaatggggccaaagggaaaaacagtgattactgagcagaactggggaagtcccaaagtaacaaaagatggtgtgactgttgcaaggtccattgacttaaaggataaatataaaaatattgcggctaaacttgttcaagatgttgccaataacacaaatgaagaggctggggatggcactaccactgctactgttgccaaggaagtcttcaagaagtttagcaaaggtgctaatccagtggaaatcaagagaagtgtgatgttagctgttgatgctgtaattgctgaacttaaaaagcagtctaaacctgtgaccacccctgaagaaattgctcaggttgctacaatttctgcaaatggagacaaagaaattggcaacctaatttccgatgcaatgaaaaagaaaatttctagtgtccagtccattgtacctgatcttgaaattgccaatgctcaccgtaagcttttggtcataattgctgaaaatgttgatggagaaactctaagtacactcattttgaataggcgaaaacttggtcttcaggttgtagcagtcaaagctccagggtttggtgacaatagaaagaaccaccttaaaggtatgacaattgctactggtggtgcagtgtttggagaagaggagttgacctcaaatcttgaagatgttcagcctcatgacttaggagaagttggagaggtcactgtgatcaaagatgatgctatgctcttaaaaggaaaagaaatcattgagcagttggatgtcacaactagtgaatatgaaaaggaaaaactgaatgaacagctggcaaaactttcagatggagtagctgtgctgaagtcacgttgaagtgaatgaaaagaaaaacagagttacagatgcccttaatgctacaagagctgctgttgaagaaggcattgttctgggagggggttgtaccctacttcgatgaattggtgccttggactcattgactccagctaatgaagatc

SEQ ID NO: 477948 - DNA, 1332 bp, Homo sapiens
tacttgtggccagcagttcctctttgccttatatctgtgagtttggaaactcttggataagcagttaagttgtccaaagcagttggaaccgttgcggagggtttggcaggctttggatgcatttcgagtgggtatgtggcaattgcatacatacccattggtctgggtgcttgggctgcagctggggctggggctgacgttggtagtttcacagacactgaagacttggcctgctgatggggagttgcagggcacagaggagtttgacgggtcacaaccagtggtactgcaggtcttgggctcacagctgggagatttgcagtatttgttgtgtgcggaagtccgaataatgcacccacccaagagggtcacattccagtactgggaaatctgtgaatgctacgtgacacggcaaaaagggactgtgcagaagctgctggtttcacagtccagagcaagatggacgacacgtgctgaacacatgggtcagaggttggcaaccactgaacagaggccccagaggtctgaggctgctggacacaacgtgaagactttgaggacgataggccaagcaactcgagggttggcatccagaagtgaggaggttttggggctggcaactcttggacaagcagaattgggggcgataggcattgggcacacagtctcctatgggctggtaactattgagcagcggcctcagtggacgacagccgctggacacatacctctgtggtctacaggatactggaaggcaggaactggagaagaaagaagcaggaagaaaactgcttccttggcaaggcctgggcacgtagtaagcagtggaagaaccgcaagaggtttcaagattgccggtctcacagtggaccggctggcagctggttggttcaccgcaggtctcttggcagttgtctgtgacccaggtttcttggcagtagttcaggagctggattctgccatagctgttcctggcttagcagaggacatctctgagggtcacatgaaaaaaggggctattagaggggatgacagccccatggcaataacccctgagggaatgacagctgtggttttcacctgagcaattattgaaagacaagatgaccttagtttagattatagatattgcatgttttacaaattaaagatttgtggcaacactgagtcaagcaaggctatcggcatcatttttccaatagtgtgtgctcatttcatgtctctgccacattttgataactcttgcggtatttcagattttttcattattattttatctgttatggtgatctgtgatcagtgatgtttaatgttattattgttaattgtttc

SEQ ID NO: 477949 - DNA, 1886 bp, Homo sapiens
tttatagaagcccattggcttctctctctctctctctctgtctctttctctctctctctctctctctctctctctgcagaaataaggtttggcactggcatgcccggagaatctccccacacactaggcctgatgacattaccgatggaaatggatgtccaaggaaaagaccccagggagcggcagctgctggatccaaagcctagagacccagaggcagtgcagaagggaactgtggggtgtgagctcccacacagagtccccactggggcactgtctggtggagccatgagaaggccaccatcctccagaccccagaaatgtagatccaccaacagcttgcattgtgtgtgtggaaaagccacagacactcaatgccagcctgtgaaagtagccatgaggactataacctgcagagccacaggagagaagctgcccaaggcattaggagcccaccccttgcatcagcgtgtcctggatgtgggacatgaattcaaaggaaattattttggagctttaatatttaatggctgtgctacatggggcctgtatcctttttgttctggccaatttctccctcttggaatgtgaacatttacccaatgcctgtacccccattgtatcttggaaggccttcaacaaatatgaggaggtatacccctattatttatgaagggctatctgctttcctcaaagtttactattttaaatgttagtcatatgtaaaaaatgcctttacaacaacatctacactggcatttgacaaactactggctaccatagccttgccaagctgacacgctaaaggtaactattgtgagtggttattcattaaggctttaatcagtgtcatcaaatcaggcattaaagtattagcaaacagttatttcatcagaaagatgattatttgtcattctagtatttactctttttgctgatttatcatgtcttcattttgtttcaataatgttaataatgtagaacttgtacattaaaatatgtagatattttaatatcattcatccaagattaagctatatttaaaatcacaagctttaatatatcgacagcactaaaaagggacaaaaataagaaactcttaattcatgtctttgaaaaggtaaaacaccatctgagaaagacattagtcttatttatatggattagaaaaaaatattagaaaatatatacaaaacagtgctattaaatgtaagctaagtcacgaaatactctatacctcatcatagtggtgaggctctgtctaaattcatttaccaaaaagtgcaaattgattttctataattttgatatatttactataatagttttgagaactctttactttggaacatgtggctataatccatgttatagaaaaccacatttgttaagatgtatttgttcacttaaagcttttgtgaatggtgctatagtatatgaatttaattcactgtacttgtgaacattaatatcttgactatgatgacactgaactaacaaaagttaactcattctagtggtgtgaaactccagaggttctttagagctagaaacatacctaaaagcattcctagttctttttttaaaaaaaaatcatgtaaaatggattagagggcctaatgcttaatttaggaacacaatgaggaatctcaattataaaaaataatagtagataacatttaaaaacattttatgcgcatttaaagcatttagccaggcattgtgctaagcattattcatggcacataagttatagtatttaactcatagtaaatctgtaataatttgtatatccttcttacagatgagctacaatagcagaaatgatgtagtgtgatagttttacttgagtctctactcttaacctttgcatgtactgcctcagt

SEQ ID NO: 477950 - DNA, 846 bp, Homo sapiens
tgcctaacttcccttttcattctatcaacatgtggcatgcaaactcagaatcttctcagtgtaactcagctgaactcacatctcccatcaacatgtcctacaactgctgctctggaaacttctcctcccgctcctgtggtggctacctgcactacccagcctcctcctgtggcttttcctaccccagcaaccaggtctacagcactgacctctgctctcccagcacgtgccagctgggttcctctctctataggggctgtcagcagacctgctgggagcccaccagctgccagacatcctatgtggagtccagcccctgccagacctcctgctaccgtcccagaacctccttgctctgcagtccctgccagacaacttactctgggtctctaggctttggatccagcagctgccgctccctgggctatggatcgaggagctgctactcagtgggctgtgggtccagtggcttcagatccctgggttatggaggctgtggcttcccttccctgggctatggcgttggattctgccgcccaacctacttggcttctaggagctgccagtcttcttgctacagaccaacttgtggatcaggcttctactattgatcatcttgttaaattgctgattttgttggctaatgccttcaatgcctctactcataacctttattgtcttcatcatgtacagaaagaattagcctcttattctataattatcaagttctcagtttgtctttgtccccaaatactggctggcaggcttcatctgaaaaactgtaattggagaactagctcaaaataaatcttgaaatacacattaaaagtagaatttatattattc

SEQ ID NO: 477951 - DNA, 672 bp, Homo sapiens
aagtttctagagcagcagttgtaggacatgctgatgagagatgggagttcagctgagtgtacctaagaagattctgagttttaatgccgttgaggaaaccctgagtcaaagctggccgtcaattgtcttccaggaattcctatatcccactgtgctcagtctttgcttgggagcagcccagagaaagcaagccttccccaaaaatgcagtgttaacttttagaacacagcagtgtgatgttgcctgtgggtctgtcatagatggctcttatcattttgagggggtgcgactgcagagaatgctggctccatgggagcagcggccaagatgggcagggccagacttggcagttctgccgacaggtcccctgatgacaggcacaagcatcagccttgagggagagttctgtcggcagacaccaaacactcagaggcgggtcaggtatggaggtgtgaaagctcctcagtcccaagatctctgcaaagattttggccctggtaatttctaaatattttcacatgtatgtttatatatcaagacctttcttagatgttgacactcataatttctgaatattttcacatgtattttccttgtctagattttctaaacaaaagacattaattataaattgttttttcatttgtaagcatttgattttaacttatttaa

SEQ ID NO: 477952 - DNA, 1404 bp, Homo sapiens
tgcctgccgccacgtaagacatccgtttgctcttccttcatcttccgccatgattttgaggtctccccagccatgtggaactgtgaatccattaaacctctttcctttgtaaataacacagtcttggttgatggactttgcaaagtcaaccatgacttaattctccaggaaattccacgtgagtcttcagggcatcagaattcctgtttgcctggacaagaaaatatagatattgagaatgttaaagatgaggaggaggaagaagacaaaggagaaggggataaagaaaagaagataaaggagaggaaagggatggaaagggaggaagaaggtttaagggacaggaagaatgacgaggaggaggagggtgaagaaataatccatgtattttacaaaatatattcacataaaagtcaacattattattctgtggttgtgaaactactgtggaacaatcaaaccatcaaacggaaacttcatgaggacaattactcccatgttggtatcctggtagtctaattatgcttaagtaaataatgagacggttcacatttaaacggtgtcgtaaaatcaaaatataaactgcatcaaaatcattagcgcagttgttaattttgagttttctttaaaaacagaaatatataaagtatatataaattatatagaaatatataaagtatatataaattatatagaaatatataaagtatatataaattatatagaaatatataaattatatagaaatatataaattatatataaattatatagaaatatataaattatatataaattatatagaaatatataaattatatataaattatatataaattatatagaaatatataaagtatatataaattatatataaattatatataaatatataaagtatatataaattatatagaaatatataaagatatataaattatatagaaatatataaagtatatataaattgtagagaaatatataaagtatatataaattatatagaaatatataaagtatatataaattatatagaaatatataaattatatatattatatactgtatatataatttatacagcatattaggaatactcatggaattatttttcctcagatcataggattaaatgttgaaattctgatgacattttgaaaatatatcaaaagttggtcctctaatacaaaatactataaaatgagcaaaccacagtagctttcgattaagtcattctcaagtttactcattcagcatatatacattgtgcatgtactgaaaagggtcgttttaagctttggggatacactaatgaaaaaaaaaatgtcaagagaaaaaagtccctttcctatggaccatacgttattccaggtgagaacaataatatcagatattaaagtacac

SEQ ID NO: 477953 - DNA, 1810 bp, Homo sapiens
gtttgagaactggggtgagagggcgcggtgatgacctcaacaaccaacaccatgtgtggcagctactacagaaactacaatggtggccatggctatgggtgctgtggctacggaggcctgggctgtggttatggcggctgtggctatgggtgctgtggctacggaggcctgggctttggctatggaggcctggactgtggctatggaggcctgggctgtggctatggctccttctgtggctgtggctacagaggcctggactgtggctatggctgtggctatggctatgtctcccactccttctgtggctgtggctatagctttgataacaactaccatggtggccagggctatgccaaaggaggcctgggctgcagctatggctgtggtcttagcggctatggctatgcctgctactgcccatggtgttatgaaagatcttggttttctggctgcttctgagaaattagagattgctgatctgtttaggccattctcttatgagctatgttttcttcccgtgtttttttctgttcaaagagtgacaactaaaatttagcccacattgccaagtcagaatttatttgatcaattagctggaatttccaacaatttaatcaaacgaaaaaagaacctttgatgttgtgttactagtatatgattaagtacaaataatgttaagcattttcatttgggaaaaagtctaaatttatttttcttcaaaggtaatttattttgcaaacctacagcattttcctacctatatttatttatctagagtacctatattatttgtgattgtgtgtgtgtgttcaggagcacatatgtaaggttgctgacccattggaaacttacagttgatgatgtggatgtgttaggtctgaccaatagtactttgataaaatgtattctcatgggcagagccaagtggtactataatttactttgatctatcaaagcctcatcttcagtgtatccaatgtttgactaaaatcattggcaaaaatagtacctcccttctcatcactttattctgttgcacatacattacatttcttgatacttagttgcatttttggctctagatagctgtaactttttctctaaatcctatattatggctgtttcttttaactctgaaaaaatatactcttgaactcatcctatgcctggtggctgcatagacagcacttccaagtgtcagacccatgtggccacagagagtccatcaaatttaagtatgtttctgtgaaccttttatcaaggtcaatatctgctacctcaggtaatactttcttcttgaagacacaagtctgacccaaaatacaagctgaaaaatatagacttcagtttgccagccgtgctcaagttaagcaaagctgttctttattcactctacttattatttatcagtcgacattgataaaaatataaagcaaaaatatcttctaatctgttagtgactaatgttaacatttggagtttctacaactaataaaatattcatacaaaattactttgttaatggctattatagtatgaagttggctaaactcttaactagcttccaaatacatgattttttaaaacatctagatgaaacaataataaagaattttttaaaattcttcatcaattaaagacagacaacatatagagccgtatcactctgacatctccaagtattgacaggcagtgaaactgaagggagactgaagaaagcatctttgtcacagccttggcttttgtcctgccatagtgggcaggaatcttaggagtcagattcccagaatgtcctattttagcatgg

SEQ ID NO: 477954 - DNA, 929 bp, Homo sapiens
tgtgggtgggaaccatacacaaccatctttctggtggcctgggctgcggcttggctgtggctgtgactatgggaaggactgtggctgtggctgagtatggcaggtgcagacatggctgccactcatcttactctgccaggttctcaataccagaggaggactcccacttcctggaggataacaaagctcatcccaatgccagcattaggaataaaagtccaaacacttttgcccactgcatcttggtaacagagttgccaagggaaacacaacagcatcaagcacaggatggagcaatgcttttactcacatcagaagagacaagcaactactatggtggtctgcgttatggctatggagtcctgggcggtggctatggctgtggctgtggttatggccatggctatggaggcctgggctgtggctatggccgtggctatggtggctatggatatggctgctgccgcccatcttgctatggaagatactggtcctgtggcttctactgagaaatatctggcaactcaacctcgtggtctcttccacatggacttcctaaatttgccttcataattcttcatatgagtaattcatttttctgttgtaaaatgtcaacatcatccttaagtatctggaagaaaaaataggtcagatgctgcaagcctcatctagagtaactgaaatcatttgacatgtttcacagatttttaaaaagctttgttttgatattgtactgtcattaaattgttgatttttgatcaacttatgtgagaagatgtaaaatttcttttaataaacatctcattgaaagtatatttatttgttgcattttaattatgtttattgtgcatgtgtgtgtttgcattttggtgtattggcaaatggaatgggaaagaagaaaatatgagaaaaagaaagaacaattcttc

SEQ ID NO: 477955 - DNA, 750 bp, Homo sapiens
gacatttgaatgttaagatgcctctgtcccagtcttagacctcttgatttctccatttctatctgcttcactgtcatcctaaaagctcatttggtctcacaacttttagtagcgagaatgctgcaagccagctgccccttaaaggctggactccggctgctcctgtctgctgcttggaagctcttcctgcaagtatcagtgaggtctactcctttttctccttctttttgctcaatgaagcttatccaaagaaagtactttaaaaggaatgtctatggattttgtgacacctgggtattaaatgaccatggaatctttggtgacctggttgtggttatgcctccaactgtagttacagtggcatccatatttcttgacaagcagttaaggagcagagtccacaaccatagtcttccaccctgagatactttgaaatcagactgcctgaaaaacctactctcaaataagtaaagttggtttttataaccccctagttgtgttagttatatcatttatgttttgttatatcttatgttatgatcctgccaaacagctgatagactttaaaggaaaaaaaaatactgagttccatgaccttactcacactgatgccgaatttaacctttgtagctatgttggatgacatcacgtggaggaggcaaatgccatcctcttccgatcactttgctaataatacccttcttcttatatgcatatttaaatcttaatcaacacagctgtgatgttatc

SEQ ID NO: 477956 - DNA, 1039 bp, Homo sapiens
cgtcacataccagggcctcaaaatggtcgacagccccagcagccagagctgtatttacagccgtagggagagccgaatccatatccagagccatatccacagccatagccagaggcagagccatatccacagccatagccacagccagttccatatccagagccatattgacagccggagccatatctacagccagagccatatccacaaccatagccacagccagttccatatccacagccatagccagagccagagccatatccacaaccatagccagagccagagccatatccacaaccatagccacagccagttccatatccacagccatagccagagccagagccatatccacagccatagccagagccagagccatatccataaccatagccacagtcagatccatatccagagccgtattgacagccagagccatatccacagccatagccagagccagagccatatccacagccatagccagagccatatccacagccatagccagagccagagccatatccatagccatagccacagccagatccatatccagagccgtattgatagccagagccatatccagagccagagccagagccatagccatagccatagccagagccatagccatagccagagccagagccatatccatagccatagccacagccagagccatatccatagccatagccacagccatagccatatccataaccatagccagagccatatccacaaccatatccagaaccacaatcatatccacagacagaaccccaggcagagccatatctgcatatgtcctcttagatctgcctttgctgcatcccaacgttttgtgagtacttcctgggatcccttcaataactgaaatagatcccacacattattgcagtaatatcttaccactctaatgagcgcttctgcaagggtattactaatctgttgtctttctttctcctgctttggaaaccattttctgcatggactcccagaaatcatttaaaacttgatctaacagtaggtt

SEQ ID NO: 477957 - DNA, 989 bp, Homo sapiens
gcggggtacatgtgcaggtttgctacaggggtatactgtgtgatgctgaggtttgggaagcatcttcttgaaacccatctcaattctctcctcttgacaacatgtgttgcaactactacggcaactcctgtggctatggctccggctgtggctgtggctatggctctggctctggctgtggctgtggctatggaactggctatggctgtgggtatggctgtgggtttggctcccattatggctgtggttatggaactggctatggctgtggatatggctctggctctggctactgtggctaccggccattttgctttagaagatgctattcttcctgctaaaacatcactgtacgatggtgttaccaagaagagctcaagggggaaacttaaatcagaatgtggaaagagaaggctcgacaagtgtcagaaattgcttccaaagaatgataggaacagagccataaaggatgaggtagatttgaaatatcctcctacacctcaactgaaatctaacctcctgaaatcatgtgttgcaactactacagaaactgctgtgggggctgtggatatggctctggctggagttccggctgtggatatggttgtggctatggctgtggatacggctctggctgtagatatggctctggctatggaactggctgtggctatggctgtggatacggctctggctgtggatatggctgtggatacagctctagctgctgtggctaccgaccactttgctacagaagatgctattcctcttgctactaatcatcactacagtctcctacaagtgctcaagatggtgagaaaggatcagggctcttttatgttcccactccccaccctttctgtgtgactttcatactcatggttttaaagtggttgctgtgtatgaccaacattctgcacaagtaaggacaaatgatgaagagcatcaggtcttttaaaactttgtcctcttatttgggaagggacact

SEQ ID NO: 477958 - DNA, 645 bp, Homo sapiens
cgtcattcacagataaatgcaggtaaagaaatttctgcataaaccactccttatttgcatgtaattaaaagtgggtataaatatgagtgcacagctgcttctgagctgctaccctgggcatgctgcctataaggtagccctgctccacaaggagcagtacctgtgcttttgtacagagacctttggcagaaagcttagttgctctaaattacatgggtacgcggctgtttcagagactgaggaaatggagaagcaactctatctggtgatccactctgctgaggatcagctgtcagcctttttctctctgtggcttgtcgtactgcccagtgacaagttgacgaagaatagagcatgtgagacacaaagaaagaataatgtctacatgccccagaatgagaagtttgtctatagcaaaagagagaccactgctgccaccaagctacagcctgaccctaggcccactgtcccccgaattcaggattcagctgcagaaaaaaacgaacaactgttaaagaaaaaaaactcttcaaaggcacttgttaaagcagaataggaagtctttattcaggatcatcacattgggcatagcggtcactgcgtgacagattcttgctatgttgctcaggctggctttgaactcct

SEQ ID NO: 477959 - DNA, 558 bp, Homo sapiens
caccactggcttaaatcacaaggcattcattaactaatgaaccagaagtctggagacaggaggttctcagctctgttgatcagcccagtgggtggaatgctatgcttgagagggaaggaaatataacgtttctagattctatcatgttattaaaagacaaattgaaaagtgcctttaagatcttgattaattcacaggcttctgttcaaaaacttcaagtggtaaatatgcctgtggtatgtgcaacccagtgcacaatgcaggactgggccttggtgagtttcatttggtcttcagtacaaataagaaccaggaattatgcagatgccaggctctggtactataatgaggtgttcagcttccagggactgagcattcttgccatcctccttactcaactagaatgctggagcatttcgtcagaccacctgctccttaaatgtcaagactaccagcagtgtttgcaattctacacaatggatattctttagtaatgccaaaacaaatttcagagcatcatgtatttagtaacagggtcctagtgctgtcatttattcc

SEQ ID NO: 477960 - DNA, 633 bp, Homo sapiens
aatccaggagcaggaggagagttaaagtgtccttgtaagaagagcccgtggatgggagatgttgtcgcggtcaccgttggacgttttttctgccacgattcttgttcgaatggaagaggttgtccaacgtgatgatgtttttgttctgacagccaatgaatgtgtgctgatgtattcttgtgttttacatttttcatggttttatgtatacaatgagaaaggtgcccccagtcccagttgtaacctggcatccctgtttaatgagagagtacaaaagtcgatattttactttatggaagagtttttaagcagagaagtaagccttcaaataggctccacgaatgtatcagctctatttgtggaggaatattcctctgggaggaaaaatgtcttcaacagaataagtagaaaacaggataaaaatgaaaataagaaaaactgttgtggggcaatgggcctgtttatgcactggtgtaacgaaaggcttggaccagaaacagcagaagtgccaagctttctatcagatttctaaggacccttgatatgtttcaaaaagattcatgtataggagctgtaagaatctcccaaagaagagtcttgatctaaacactccccactcctctcctccttttc

SEQ ID NO: 477961 - DNA, 845 bp, Homo sapiens
ccagttcattatttgtgaggacatgaatccagatggcatgctggctctattggactaccaggaagatgacaaagttccactggggaatcatgaaggactcctagggctccggagcaacgccatgccatctacagtagaaaattttacactcttcattaaagagctcctggtgtgctgctgctggaccacggtagagatgaagcagctggacatgggacaccaagtgaccatatgcacctccagagctcagtggctgctgggaagcagctgccggaggttggcctggtgtcaccatccgtacaccatcatgctgcagtgccacaaccacacaaagctcagcaactccttcctctcccacatggacagatcaagagttgagatgaagctccgcattgccattgctgcacatccgggaggacagccttcatcaggaactgaatctgctagcactttcgttctggacttctcagtctccatcatcacgtgagtcaatttctcagtctccatcatcatgtgagtcaattccttagagtaaatctctatatatgtatatctgctggaacctaaatcttggattcctcagaacaataagaaagaaatgtctggtgtttaaaccgcccagtctaggtgttttgttatggcagtctgagcagacaaagacacagagggaagagatccaacctggagattatgcttttggattcatcatttaccagggcaattgtgctggtggacctctggggcattcttgagtgacttctcttagtttatgatgatgatagtcgtattgatggaaggtgtgaaagccaaaattcaccttgtacttataatgtgccaggcactga

SEQ ID NO: 477962 - DNA, 520 bp, Homo sapiens
ccagggggtcccctgaatcatcacgttctccaggaaggaggaggacggctcctcctctgtaaagcagatggttggggagatgatcacagcctactttctggctgccagggacgatttcgccatgcctgaagacgtctttgactatcacttccagggagttggaatgctactggcatctaatagaaaagtattcacaggcctaacccatacacaggactggggcataggaaagacgcacaggttggaaatgaatattaacaaatcttcagcctgtggagttgagatgaagccaggacagcacatgacatggcctaagacaatgggttgtccttgtgtaggtaacagcaccctggaggaatcttttgaaagctttggctttctcctcagaacaataacacactcaaaaatcgtcatatggcttctggttctggaatcatgggtttcacgaagtcctggactcaaaattaagaacttttgacctagaatgaatttatgagtcaaaggaaggccaagcacaggt

SEQ ID NO: 477963 - DNA, 1930 bp, Homo sapiens
ggatttaggacccaccttacaccagccgcttgagctaagcccacttccattctggaaagttttgggctgggagctgatggcaggagacgcaggaggaggcaaagaagggcagacacgtgggctgctcagactgtgatcacaggccaccaggagaggggcttggggacagtccttgtgaaacctccctgcgaggccggcgaggccccaggggtgcattgggctccatagtccaaaggaggcatgagggtcccactgggtctctagctccccagctctggtgtccgtaggctgctcccttccaaggctccagtgtcaccctgtctgggaaactcacagctcctcaaggtccccggtccctcgcaaagggtcacatccagccctccgtgatctccttctaagacagcattatgacccgtttgtcttttctccctgccacaggacagtgggattctgcgggcttcggtgccttctccacgatgctgagggcctgagcctgctccacagccttgaatgtttaaggcatcctcgcttccagcccccgtgtggcgagaaagcagtaaaggagcagagggaaggtccggacccccacggccaaaggaggcatctgcgcagagcacacagcactggctggcacctgactcttctgtggcggccctgaggcccgcactgtgcgggaagcggcagccgaagggcccggattcaaggccggcatggactcgggagctcactgtgccagtttctcagactttctatgtttttgatgaccttgaccgttttgaggagtgctggtcagtgtatgctgcagacccccccgaccctgaacccaagatgctgcagcttgaaacactagcgctgctgtctctggaaatcagatatggctgctgctgccctagagaatattcttcactatgtctgcttcggtttgtcaccacctttcaattcaaagtctggggagggtgtttggcattggttgagcctaaatcttatgccttcgccctagctgcggggggaggctgggaatgtatctgttaatttgagcttatagagtgaagacaagttctgccttctagtgtggcagccctcaaatcaaagcagaaagtttattgtttgtagttgcattaaaaaaaagcatgaaatgatataaaaggaactgatgaaagtagttacctgtgggggagggtagtgggaggagattaggagccagacttcttaatgtgagcattttcctatcattttgagttttaaaacgtgtgcatatattatctagtcaaaaattaaaaattttaagggtgatataatcatattaacaaatgtcacaaatctaagtaacttctctcttaaataaacattctgagcaaggattaaaaacattatactactaagtgcactgctacacttccatctgtgttatttaatgccaccaaatccatcaggccaatttgctttcctctcttctctgcctattttggcatcctcccaaatggctcattttcacaacatccccatgaattggcagtgattagccttactggtagggggagaaatggtatggatttcccatacaatgcaaaataccgtgactcactttcttgtcgggagatttcagaacagttcctcacacacaaaggaggcttttcagaaccaaacactgcattaggtgctgagctaaagtgaagccagtgaagatttgctcattgtccagagatgaatccttagggcacataccccaggttcatacctgcccaaatgaggtcctccttctgtcagtcaattcctgaattatcaaagctcaccacatcttctgagctggcatttccatatgatatcagtctgctgaaaataaattccaatatacagacacaaggagatccagttaaaagagcccaggaaattctctatttattacagaatgacaagtagaggtcttgac

SEQ ID NO: 477964 - DNA, 678 bp, Homo sapiens
ctcatcatctcctcaagttggtcaagctttgcccctcacaacctcgtctacaccaagttacttttcgaatgcccacttacaaatatagtcacaacagggggttagcttcgatatataaatttggggaggagaaacagtcaataataggctattttgtccccaaaaatgccacagccactccaacaccacatggcatgaaaggaagtgtgacaaatgaaaagaaagcccttgatcgggaagataaagaaaggacccagctagaagtgatgttcaaaatatttaaccacttttatgggatggacctgaccaatcagaacctgacaggtttcaaagcttcagagaagtctagaatccctggtgaccaagagaaagtgatcaggaatagcgccgagaaagctggaaacacacctgatacgaaagtcatggttggagtctgttctggagaagagaagcttgtcttcttggatgcagttgggagcctacagcctactcccacacccaggcctctgtggctgtccaaagtccacgtgtccccaagaccatcctcacttggggaggacgtcggcatattatgggttcagtcattctaggtataactatcttctgtatgaccaggtcaagctatatatagcttagaaattttcaggtgctcgattagtaatcacaaccaatgtgatt

SEQ ID NO: 477965 - DNA, 591 bp, Homo sapiens
aagagctagtgtgtggtttgctgtgtgtcttttctctcttccacaagatggacaatggtccagaaaggggctgcttcatcagcctggatcccaaagaagataacatgaagcagggatataccttccaggccaatgaaaaattccagccaactgagaccaagcaaatgtggctgtatccacatattcagagccaggccttgggcagggcaggtgacaaggagcatgtcatttgggggaacctagcactgagtgaaatcatcacagttaattctttactagctgtgtcagaatttcggctcattttaatcttggtgttcaatgaacaccctgaggtcttcctcatgagtcccctgcattctgatgaaattgcctttagtgtcttaggaggccgtgtggttcagagcatgggtgtggagttgagagatgtccattccactccaggtttcaccctaaaaagcagtgtcacctggccctccagggcctctttgtaactcttataaaatgatctctgacactctgagcctgtttttatttggaatcttaggggaaaaaagcatttgtgaggtccaggatttaatcttgtttgtcctc

SEQ ID NO: 477966 - DNA, 482 bp, Homo sapiens
ttctctcatctacctcttctgaaagcagcagcctcccatcaacatgtcccccacttcatggtcccacttggtggctggatgtacctgttctctcacatttctcctgaaagctccaacttgtccacctacaccagtgcttcagggaaagctggttaatgacttcatctctagccctctaactctccttaactaccttcacctccccagttcctctcatcattatgtcacatgtgaaaaagtggcctgggttttgaaccaactgtggctgcctctagagtttctgcccacaccattaccatcgcagcgagctctcaaagacgaccaagtgattcttcccgcctcaaaactctccaaagcctcaccgacactgccagtgaaactttgcctgccctacgcaccctcacttcccactttcccaactgcacttcctactccaggcatgggaagcccctggccactcccctaatgggcgcgctgcgtcg

SEQ ID NO: 477967 - DNA, 728 bp, Homo sapiens
ggcgtttgtgaaactgaacgggtagagcctctggtatatggtcccaggcatcagtggtgtgatgtatcagatgggaccacatgagaggggtcatctgaattctgagtttggcctggaggacctggtgactacagtggatggggggaccactggattcccaggagctgaagggaaaacaaggagtggccagccagggaaaggcattggccagtatcaagagaattgcagggcaaatgccagactgcttgtcctgtcctggggctgcctatgggaacagaggggactccactggaacagtgagtggggtgcatctgggcacaggagtctactgagtccagaaagaggatacaagctcaattcaatcagcaccatgattgatggcatcaggacttggtgagatatcttcccttccttccaatgggttttattctactctgtctccaaacatttgtgtcacctttgtttgaaggagaaagagcatgggtaaaaggggaacagaggtgggtggcacctttagctaccagaggggttgtgcaataccattgcatgcagctagtataatcatgccacgagaagggaagcaggaaaaagaagaaaagagagagagagagacagtgagatgatgctgcagttgctgtttgcatttaggagaggaagaaggtgaaaataaagtagtggaaaaaatcaatttcactatctcatggcccttgggggctatttgaaaataa

SEQ ID NO: 477968 - DNA, 1195 bp, Homo sapiens
ccgcttcagtgtagaactggtaccagctagaaagcctctccaacctcctcaaggccatggtcagctacagcatgaaccccgtggacctatttgagaccaacgacctgtttgagagtgggaacgtgaggcaggtgcaggtgtctcttctcgccctggcaaggaaggccaagactaaggggctgcagagcgaggtggacatcggtgaggagtactcagagaagcaggaggggaacttcgacgatgccaccatgaaggctggccagtgcatcatccggctgcagattaccaataaacgcgccagccagtcaggcacgactcctccagatgggtacaagcaagtgtgccagccaggtgggcatggcggctcctgggacccggtggcacatctacgacacgaagctgggaatcacaagtatgacaactcttccacgaccctgaagatgggctacacgctgggcaccaaccagagcagccaggtcttcagcctgggccgacagatatacgaccccaagtactgcctgggagcacagtggcccacggggctccctcaggtgcaggcgactgcccggggccagtggaggcccctgaatatctcccttactaccaagaggagaccagctactgaggctcccagcacgctctctccccacatggtctccctgtctgggtgtttgggactgagccaccgggctgtgggggaagggatcaaggccatatcccgatgcgtgtcgggtgagggtccccgctggcgcgtccaggctgtgggcctagctgtgctggggagacgagacctgggcatggagggaaccggtccccgaaggtttcccgttgcctcgcctcttcccccttttgtcagccgatcagtttgtggtttctgtacccgcaaaagtttcaagaagctcctgagtggctggatttccctaggaccctcagaccaacagacctcagaccctcagacctacgctggggcccggtctactgctgtatctcccccaaccacacgccctgccaagtactgcacagggccccccacccagggaccccggatcatgagataatgtgaaataccgactgtggaccaaacacaataaaacctctgtttttaagaagaaaatgaaaagacttaaaattggcattttaggactttatatatattattaaatatatattaaatataaatgttatacaatttagc

SEQ ID NO: 477969 - DNA, 632 bp, Homo sapiens
ccgagttactgcctggtttgctgaagagttattccatcatcgcaggaggaaaaccatgtcgaaacgaaaagtccatattggtggtagttttttgagagctacaccacaacccccaaaattgacctctaaagtgacaacagtccgctgggctgctgaaggggagcagcactggtgtctgggtgtggcatctgaacctttgcttccagaacaccagcatcgtcacatttctcagagaaagcaatttgccttgagacagttccattgtgagtggaagagacaagggtgcattgttcaccagacaatgcctgaattagctatctcctggcgcatatatgtgagtgtgcaaactgagaagaactgctggctagagaagggaagaactggtttgttcagtattttcatctccgttattaacaaatttctctccaaagtcattgcatcagtttacacacccatcagcaaggtttaagatttctgttttcaagtacctcccactatgtggtattacgttttttaaagccttgccagtctaataagtgtcaacaagtgtctcttaaagttatattttctctattattaataagcatgaactttcatgggaacggtcattctgagtttttctccctgttaat

SEQ ID NO: 477970 - DNA, 573 bp, Homo sapiens
tcgtgttgatttttgatttaaaatagccccttgttttatttgctcctggagtgactgcattaggaagctcctttctgaaagctatggttaaatctgccacaaaggcagccctggccctcacaagattcatatacccaaaagaattaagaacaagtacccaaaacgatacttgtgcacaaatgttcaaggcagaattattcacaagagccaaaagtggaaacaatccaagtgtccatcaacgaatgaagaaaatgcaatattacccaaccataaaaaaggaaggaaattacgacacttgctacaacatggatgaatctggaaaacatgctaatgaaaagggagctctgaaatgttgtcccctgccatgggagcacttggaaagtccagttctcaaagcagaattcaccacacaagcagctccttccgaggaaaaccacgaatgccgtaaactccacagagacaaggaccctccgtgcaggcggcccttacctgctcgtctagttcccacctgaattgaaaacctcatcatgagcgtgcacctttctgcaaatcagcaaagaccgacagcctttt

SEQ ID NO: 477971 - DNA, 2285 bp, Homo sapiens
aagggcaacacagcagactcaccagcctctggtgaagtactttagctggttagaggatggggactgaagttccatccaagcagctcctcaatgctcgtaacaaatctgaacttgctctctccactggaatatgagcaggttctctgcattttaacaagtggacagtggttatgctgcttctgggggctcccaccctgagaaaggttcatcatagcctgatcttgaagggaatcaataatcggtgtccaactgaaactgggttgtgtcgattaaagttgtggactgtaagcaaatgcctaaaagacctctccttctggaagctgcctgcaccctttggcttgaggctctcctctatcttcaaagccagccatcccatcatctcgacgtctgttgctggtgtcattaagtatgcagcacttccagcctgtcccccagggaagctgaaacagccttcaggggaatccaacgtacctgcagcaggacctccaaggcttgtgagagcagaggggattcagggattctgtggggcacccacagcatctctgcatgcagctcacagtgcccatgagatctgaacatgcatttatcttgtgtaagataaggctatttcccttgtagttggtgcaaaagtcattgtggttcttaccattaaagcaaaaaccttttaatatttaaaaacattaaagttttcacctttaatggtaaaaactgctattacttttgtaccaaactaatatttcccggtttttgaactgaaaatcctgtcttcttgaaacactcccctcagtccgggcaaactagaatggttgttcaccctgtctggtactgactcttgcagtagacaaagatgagatgatttacaaggtggcatttaaagtttgcaactctgccagcagcactgggggctggcttgtctacactgtttcagggtgtatagattgatagtaacatctgctttaaccagttacacagcctcatctgcctctaaaagatccctctgcagagttgcaaaagctccctttcgatcaagtgttcacagctggctatttcagcatcgttaaaactattgcactttgaaattatttcagtgaaaaaatgcgtgctgtccccagggggaagaatcctggtactgaagtgtcctctgatggcattgcatgttcctcaaatcctagagaaatggaaaactccctcctggacagggcattgaatttcctccagcatgaagtcccctttttgctgatgaatcccactttgctcccaaatctaggactcagggttctgtttgccttacatcacctccaaaggaagccggctggcaccaagggccagcccctggaaacttgggaagcgtttgattccacttatctgagcacagaagcagcatgccagcctgcctgatacagtcaggtgcgtcatgaattccaaggctgacccaccaaatcagggagcttgggtcccatgatctagggcttttgccagcaagtcaaggccttaaattcctggaggctgatcacctgccaaaaaccacttcacagatgaacgtgtcctgaaagggggcttatataccttggatatatgatccgccctcctgacaagccacagcagcacttaaaaaggcttgtgaagggatgatgccagtggaagaaaacaggaactttgacctcccagagcctatggataccaagaagggatcagatgactgattttttcaaaagcttcctggtggaataaatgcatttcacagtgtttctttaagtaaatataagcagttctttttttgttattttcgcagcattgagccgccagccaactctggccagtggtgccctgtagcctttctgggaatgtgggaaaggaaagaagagaaagccttgagcaacactggctggtcgcatggtaccagtagtactcccccacatgctgtgacaaccaaaaatgtctccagacattggcacattgcccctggttgagaattgctggtggaaaaaaatcacagccccgcagttggtcaggcccttttcagacaacaccccccactccattactctttgatgttgagcccagcacaattttcaggtcctggactcccaaggactcacatgaatgaacgtctctggacacctaatcaccatttatcaatctcacttctatgagaaaaacacatttcaagtacctaccctccagcttgtcaacaaattcattaaaaaagaagggaacatcagttatataaagccatggtgtttttgccttactatcaagcttttggatgaaatggaaaagttaaa

SEQ ID NO: 477972 - DNA, 487 bp, Homo sapiens
ttattatggtgaaaagtatgtcatgtttcctatcacttctctgttgaattccagcattctctgttatgtgatctatttaaaatatgattatctacttgctattttggtcctagtttgtggagggagtgagtaccagatgcctctcatgagccatcctaaagctcctcttctatccctgaaatttatggtgaaggatgttgacctgatgaaacagatctgtggtcatgggtttgagaagtggctttcaacaaggggtgattttgccctccatggatcatctggcaatgtctgggcacatgttttagtttccatgattggaggatgctactggcgtctggtaggtagaggccaggagataggtaagttgtgaatggccaagagatgtgcaagctggccattgtgatactttacaatcttttgcttttaccattctacctgtgactacagatccatggaaaaaacgtgtagcgtatctcaaaattaagtc

SEQ ID NO: 477973 - DNA, 744 bp, Homo sapiens
gatctctggatggcctcaaagctaacgtgcttgaggggagcaggattgggaatgtggatccaaaggaccagtagatgggctcatcctccacccgggaagcacactttcacagctgccatgagtactctgtatggggccagagacttcctaaatgtctccttcaatcctcacctattgctgttgcacattgatgatatgatgctgctggtccaaggactacatttcgagaaccccaaccacgcatggattgttgtcaactatgaatcacaagatttccagggttttgtctgctgccttccctgcaagccctgccatccactgagacccaacctcagccattcttggcacatcagcccatgagaagtctgccactctttcttcctaagcaaagcagcatccttcagggcctggagctcctggacacaaaagccatttttgggagaaaaatgtggataaagtcactcctgggccacctgtctgtgaggctgtatggaagctgcctactggtttgaggagaggctgctgggttctttcctttactaaggatttgcttaagtcagccctccaggatccaaaaaagagccagaaaaaagccagcaaaacagctgaggcacagactagatggtagtccaaggaccaagacctggccagccagagggaccaggtgtccagaccccggactgttttcaatacagttatacaatgaaatcaaataaatggatgtattgattgcttggcaattaa

SEQ ID NO: 477974 - DNA, 2746 bp, Homo sapiens
cagagcccacagctgcagggagcactgggctggggtccccgtttataggcctgagctgagcatctccctctgagagctgtaaaacaggctcagagagctagtggcatggctagggtcagcagccggttagaggagaagctggaaatggagcccagccctcccaatcctggctcagagcaggcagagcaactgctgcctgcagagggccgtgagtcctgccaaggtggcctctggagccctgatgcatcacctgtaggcagcatccaagtgcccagacctctggggcctgctccgggcttcctggaggcagatgggcatcatcgtagcagtggaacccgttttgtttcgattgtccctgacctggcctgtgctctcgctgcaccatcctgtggaacacagacacctggagagtcagagctggctggatctttggaagggcacagtcacagctgcacccgccactccttcccatcccaggctcgatacttcagtaatccttgctgcctgagcttcccttatgggtcccagaaaagcaatcactaaggtagagggcaaatgcttttgtaagttttatagatgttttcaaatttccctctgcaaggctgtgataatttaggcctgcattggccctggtacacagaattggattaatcataaactttgggtcatgccaaactctcaccatggcccacttctatttagttaattatttataataatgattaaaataattagttatgttatgagatgcctgttgttaaagatgaacaaagccagatactagctaaagtggcgaggacagattttaatcaggaataactattgcaatggggagaagagttcaatgtgacttgaacttggatttgtacagagagcctatcctgtcattaagtgacacatgactgtatttatcctgcttggtgtttttagcactttttaaactgtggcttgttacctttcagtagttgtggaaacttcttggctatcgtctctttgaacactgttcctacctattctcattctcctctcctggaattttgaatacatacatagtggacctttcatcatgtaaccttacatctcttatgtttctttttgtatgtttctgtatgtaccatttataaacaaaacaaaactatttcaatctggttatttcctctgactgatcttccagttcattaattcctttttcagctttctgtcacttactattatattcattcattaatttcttaatttcagttcaagcatttttcagttgtagaatgtccactttcttctttttacaggttcaagttctctgctgagggtttccacatagccatctaatttcttggatttattaatcacatatattttaaactaaatatctgataaatcctgtgaggctgttcctttctctgttgatttctctcagttttctgttatgtgttcatgtctcctggtgtatgaagtaatttgcaattaaacacaaagcattttgtataaaaattgttgagacaatttgcagctctgtatgttttgaagtcagttggtttggaatgacttgcctatgcagatattggggtgattagagtctgagtttcagtacctgtgaggctgttctcccaagtatagctctctgagcaccccagtggaaagcctgtgctctttaccagcacctcttttctttggagagtccttcactccaattttgttcctgctccctgcaagacatgcagaagtttcttagcttctcagcatctttctgagaaacataaaatgccttgaggagaaaaataaagtaatggacatatgtcagacttatctcacttctcacttctttttaactttccttttttccccaagatattggctcctcaagtccttgctactttggtttgatgtctccaaacacacacacacacacacacacacacacacacacacacacacacacagagagagagagagaagtgatttaaaattgttaatttttctctgtgtgagtgttaatttgtaacacactattccaccaccatcgatggaggtagtaatctttcaaaacctactttccacaaaccaaataaataactccacctaactttagggcaggcaacctggtatgcttctgagaaccagttctgtgaacacacagatcatgcttatgatttcagccagtgcatcaatttaaactaaaagtttaagatgtttatttttcctcattttattatttctcttatttgttctatagtcatcttaatctgtgtaagaaatactgaagctgtccaaaagttcaaatttgaacccaatgctgaatttaaaggtgttgccccaaaaaacattaggtaaacatgcaaggatcgtcactgttaacctgttacgcaatatgacctggtccccaggctacataattttagagtcattctttacatttcaagctctgcaagcacttggagaagtggtgttctgtggactcttacttcttcctgactttttgatgttctcttttgtcaatgtgaccaaccaattttgaatcagagctactggcatctttagaatgacatgtatggtggctcagaactgtaccctttaaaactcagctccagtaaagggagattctgagcattttaagatgttggaaattgagttgcatcctgcattaaaggcatttcttctttatataaactgtaggattctgttaagacagaaatggggagagctaatgggctattctgaaagaactacccattaaattgtaaagtac

SEQ ID NO: 477975 - DNA, 1017 bp, Homo sapiens
caggattggctgagcacgtatgatttccacatcccaatgtgaactgcagactttgagtaaggcagattttcctccataatgggggtgggccttatccagtcacttgaagttcttaatagaaaaaagactgacctcacccaagcaagaaggaattctgccagcatattgcctttggatttaaactgcaatccttcttgggtttcctgcctaccaccctatcctgcagattttgcacttgctagcctctactgtcccatggaccaattccttcaaattaatctctcttttgtcctctctctacatatgcacatcctgttggttctatatctctgcagaactctgactaatacagcacttctacccactcccaagcccatggaagaccttgtttattggccaagacactctttccagatgagccttcagaatcctcctccactcagtcctccagatatccatggcctgtcaataagcaagttgaaacatccttgctatccttgcacgagagcaatggttctcaagagggagagggtgattttgcccgccaggggatgtttggcattgtccagagacatttctgttgtcacaaatgggggagagggagtgctgttggcttctagtgggaagagatcagagaagctgctaaacatcctataaggcacaggacagtctcccattaacaaagaattacccagccccaagtgtcagtagtacgaaggttgagaagcattgaattagagattcactcagactcaactattgaaagacaaacatctcttggatgagaggtatcttagtctctatcacagcaattctatatgatttagagagagctgcttctcagtaaataacctgagaaattattttgaaattctgacataatgtggatgtagcataaccttttattttaccctgtgtgtgtggagctattgcttttagccttgtcttctcttaattcctttcaaaattgagtctccttttacttttcatatacttgagcatggacactttctttct

SEQ ID NO: 477976 - DNA, 604 bp, Homo sapiens
tctgttagttgtgcattggtttaaagatgctgtactgtactggatccagctttgtgaggaacagcactgaagatactggggagaaatattttcaagccaaaaatggttggatgcatcagggttgtgttccagttcagggaccctgctccctgttgctctatttttctagagagttctttgaaaaggtcactaaaatgtcagaagaaaagcagatcaagtttaagtgccagttgctctggggagttgcaaacctgggttggagacattggctgttgagcagaggcaaggtgagagcctttgcttatgagtcacagctcaaagcctgggaaacactgttctgggagaccacagagggaggaatggccctggcttttagtggcgtcacggatggtacagtacttgatcccagacagcaggctggaggaaagctactggcaaaacgtgagaatagttacagcactgaaggtatagaccttgataattcctagaaatgatttagagtctgccttttacaagagagagggagggagggggggagagagagagagagagcgagcgagagagagaaatatctgatgatgttaaacttatctgttcctttcat

SEQ ID NO: 477977 - DNA, 724 bp, Homo sapiens
atttaatcttcacgataacccaaagatgtagggaccactactgtccccattgtatatttgaggcattcaatgccctggatggatgctcatggtttctgtcagatgccaggtctgcaaaggagccaaccctgtttcctcatctatcaaaaacagcaaataggcttaaaaacatcgactgacataataaacatgactcgtaacaaactttgccaacatgaaacttgcttaagaaggtgcttgggaaccttcacttgggcctgggaaccacgaaaggaagcacatccaaaactacttctgatccaagtaaattctagtgggcaagaggaagagaagagaaactacaacatcattatcttactgctggaggcagcagattacggacccctgactgtgatgtgtcaaatgcactgtgtgacaaccaagaccctacacatctggggggcacttcaggattcctccaggcggcagttgctggcctagactcacttcttcaggagggaggttcgccctggaaaagctgatttgcatttctgctgggatcgatgccgtggagactgaatacattggtaagtagtttagcagctagtttggtctcagctgacaatgattatggattggggtgttcagagcaagaatgcacaaatggtctggagaaaaatcagcagtgaaactacattttttgtaacgtctaaatcagcaaagaaaaacgctgcagaatagtttc

SEQ ID NO: 477978 - DNA, 556 bp, Homo sapiens
aaccacttagaacctcctgagaactgccagctctgctgctgaatgctccacaaaaatgatgagcaagtgctttcagtcattggagatgcatccgtgctcccgagaggactgtgtctcctgccatggatatgtcatgtggcaggaaagagtccaaccaatagaaggttagtttttggtcacgtaacagtactgggtgagtcagctggtcaccagtgtggccctgtccatgcagtcattcagggattcaggctgctgaaggctcagccgtgtttattgggcttccagggccaccctgaggtcagctttatgcctgccagctggaaggaaaaagtttatgtattgaagaacctgggccgtttgacccacggagtggttctcaatctggatttggctgattgggcactcatgttgcaggttaacatgctcctcggttttctgacctcctagaagttggcagctggatccagaagcttcaacagcctcaggttcagcctcctgggctggcggattgtagccaaataaaaataaacagaactagtattattttgcattgagt

SEQ ID NO: 477979 - DNA, 735 bp, Homo sapiens
cggtctgtgtccccagccaggtctttccaggcaagtcttaggatgtactcagccagttctcaagatagtcaccaacctgaaaacctcagggccaagccggcccaggcaaacacactgtgcatatggcctggtgaagctggccccgtgccatgtccgtactgtttgaaatgtggaatcaaccacactcagctctgtggaagaaggaatgcccaatactgttccccagagccgcctgcagcaactgacacctgccccacctcagctgccgctccacctgctcaggcctgcctccagagttgtcaggtgaaaggggccaactttgcaagggctgtggcaggagggacaggcctccccaggccaggaggccctcacccaggcctgctgtggggagaggctgtaaccacaaaccccctctctggttccagacctgtcctttccagcccactgattgggggggatggtgggtggcaggccaaattcaggaaccccatctgagcttggagaatataagttcttctctactactaacaaataacaatgacaaaagttgtggcaacttttaagcaagcaaaaacagaaagtaaggagcatatggagagggaagggaaagggaagggagagggaagggagagggaagggagagggaagggagagggaagggggaaagggggaagggaagggagagggagagggagagggagagggagagggaggaagtcattgtcatttaaatgc

SEQ ID NO: 477980 - DNA, 569 bp, Homo sapiens
gatttattcttttgcctctgagcaagatggattttcctaaaataatttccccacatttctgcagtgatggtgatgtgtatagccagcattccacagttgttagtgaaggtatttcagtctatacccgaaatacctttcctcgttccaggagctgccccgaacagctgcgtagttcagcaaaagcccacaaagctctctttggctcccagtcataccaccatcccccgacattagggaaatgctgtttgttttgctcagttccatgtattcatgttcttggactctatgagttgactaatatcataatcattatgtttagaaattgtaaattctggagtttgaaagatcaccaagccgggtttggtgtgacagcatctggatgtgcacctcagagaacccctgctcaggacaaagtgaatttacaacctacaagagaagatatgcctctggcattattctttaggtgacttttgtattgccgatggactctggaaatctaaatgttctttcactggtttgttgtggcttggtaggtaaaaatgctttctgcattattctggagatagaaa

SEQ ID NO: 477981 - DNA, 524 bp, Homo sapiens
gtaatgaagcagggcacagacaatgtcttgcaagtctggatgttttagaagggattgcactgcagagacctgggctctgtgcctggatctaccactgatacctcgagttaccttgagcaagccctctgcctttctgggttcctgtggtcttacctgtgaaaagaggcagctagatctagctaccaatgaaagcgacctttcaaactataattttgaagcaagcagaaacgaaagtttaagtttaaaggcagacggccacatgcaccactggtggacgtccctcttgaccttcctaccagcaggcacggccacttttgtacaaaataagtcaatccttggctgtgaatgggagacgaagagatgggttggaggatggcgaggagaaaagcaaataatggaccataaatggtgccaacacgagtggccatctcctctaaactgccaaggtcatcgaaacaaagaaactgtcatagccaacaagaacctaagggagacaggaggctgatgtcgtgtgacagggtctt

SEQ ID NO: 477982 - DNA, 903 bp, Homo sapiens
cctggattaacaaagttgtttgtcaaagatcagatggttgtagatgtgtgcttctttgcgatgggttcgaacatcttccttgagctcggagaagtttgttattactgatcgtctgaagccttcttctctcaactcatcaaagtcattctccatccagctttgttctgttgctggaccctcagctgcaggtctgttggagtttgctggaggtccactccagaccctgtttacctgggtatcagaagcagaggctgcagaacagcgaatattgctgaacagcaaatgttgctgcctgatcgttcctctggaagtttcatctcagaggggtacccggccatctaggtcctgcccccagaggtggagtctacagaggcaggcagccctccttgagctgcggtgggctccacccagctcgagcttctcggccgctttgtttacctactcaaacctcagcaaaggtgggcacccctcctccagccttgctgccaccttgcatctatggaaagctcttgctggccacggaggaagtaggcagctgacacaaagttctgcaattgcctgtgccaaactgtgtaaagcaagtacttacatcaactgggaagataacgctgtcattttcctacttgttcagtccatggtggttgatcttacggggcagtcagcctgcagatgtggatcttatgattgactgccttgtttcttgccttcgtgtaagccctcacaacaaccaagtttaagatttcaatgtggttactactatgatttaaatagattttcacagttttaagcctagaatgataaaattttgtaaaaatattgttttttcagttttttaagctgtgtgatctttcacaaactttctgtaataccaatgcttttgatgaatgaattaatcatggacac

SEQ ID NO: 477983 - DNA, 1308 bp, Homo sapiens
ccgaaaagtccaacgtaagttcttatatttgccaaactgcccagcaaagaaaggttatggtattaacactcacaatccccaaaacagatgaatggagacttcatgaaagtagttgccaggagtatggaagaagatatagtgtggctgaaagagaaaaactattcacagacttacttcttaagttatcaggagtctgggcagaggacagtcccccggggctggtagtgaatcaagcacctgtcatagtagaactactacaaggaacctacctggtgcagatctcgctgtggaaagctggctataaagtgtccaaggaaaaggcacagatctgtggccaaggagttcagtatcttggcttttacatctctcaagggcagcatgagcttgggtgggagcaaaaggagactgtctgtagcattcctcagccagacacaaggcggcaagtgcgggaattcctaggggcagctggtttctcccgtatatggatccccaactactcactcctagcaaaacctttatatgaggcgatgaaagggcagggaaaggagcccctcctttggggaaaagaacaggatatggctttcaaggaaatcaagaaagctttaattcaggcaccagcactagggctgccagacatgacaaaggccttttacctgtatgttcatgaaagaaaagaaatggctacagtagtcttagtgcaaatgctagggtcatggtattggcctgtagcatatttgtccaagcaactagactttgtggctaagggatggccaccctgtttcaaggaactggccgccactgccttgttagccgaggatgctaacaagctcacatttggacagaagctgataattcaggtgccccacacagttgtcaccctgacggaacagagaggacatcattggctctctaaccctaagatgctaagatatcaagggctcctatgtgagaatacatacatcaccttagagactgtgaataccctaaatccagccacactgttaccaatagaatatgtggaacatgggaagcccccgttatgtgccccagggtaccactgctgtgtagaaacagtggatgaagtcttttcaagccagaaagacttaaaggatcaacccttaaaagacccagatgttgaatattttactgatggaagcagcttcatatccaagggtgtcaaaaaggccagatttgccatagtcacattaagctcggtggccaaggcccgccccctagcggtaggaacctcagcacagaaggcagaatagctctcacaagagcactacttctagcaaagagaaagtcagc

SEQ ID NO: 477984 - DNA, 965 bp, Homo sapiens
aagcatgcttttatctggttgatggaccaaaaaaagtcatcttttctaatgaaaagggtcttatttatgttgctcaaatgtttacataataacttgtgccaaaaatatagtgctcatgcttttcagttctcacccagaaatgtcctgtggcttctagttgtgtgcctgagatcagataataaaagaccatgccttgaattctctcagctaagtgtaaaggattccttcagagatttatttattccgagaatagagaccattctgatgatgtatacaaggaacaacctaaactgtgctgagccactgtttgaacaaaataactcacttaatgttaatttcaacacacaaaagaaaacagtctggcttattcacggatacagaccagtaggctccatcccattatggcttcagaacttcgtaaggattttgctgaatgaagaagatatgaatgtaattgtagtagactggagccggggtgctacaacttttatttataatagagcagttaaaaacaccagaaaagttgctgtgagtttgagtgtgcacattaaaaatcttttgaagcatggtgcatctcttgacaattttcatttcataggtgtgagcttaggggctcatatcagtggatttgttggaaagatatttcatggtcaacttggaagaataacaggtcttgaccctgctgggccaaggttctccagaaaaccaccatatagcagattagattacacggatgcaaagtttgtggatgtcatccattctgactccaatgaatttgaaatcatatgttttgattccagatgatgcacttaaccagtatattattcttataaaccgaatcaggagaggatatggtgggttttaaaaagggaagggggtgtaagaacagggagtaggtacaaagatcacatgcttcaaagggcaaaaagcagaaatattgataaggttctatgttcagcagtgca

SEQ ID NO: 477985 - DNA, 1397 bp, Homo sapiens
aggaaacctctggagtcggtatttgagtaaacaatgtttggaacagtgccaatatattactttgggggcagcaataaaagtactctagacccagagtttgcagatatcaggaataaggaagtatccaggagcaactgccagtgtgatctgttatgttatttgcagaaggatcccctgggctggttttcctctgcccatctcctgtgggatcctcctgtggggagcagcaccaaggcgctagaactccaggtggatctgcaagaacaccatccccctggtgctgtttcccaactgagttctcacaggatctggtttaaaatgtgtggcacctacccgctctctctctgtttctcctgctccggcggtgtaagaagtgtctgcttccccttcgccttcctccatgattcttcagctttttctgtgtccaaacaaaatgacctcagtaacagacatcctcacagccacttttgattcttgcttcttttggacattttacagatcctctatgttaagtccaatcatttcttctgtcactactgctcccatgtttaaagcatatctaggactatggtcctagagttatgcccgattgctgtacttcacatttatggtttccagcctcagctaagccttcatctctataccttttaagacatggctctaaataatgattgtggtgtttactgcattgtgtacatacaacacgtcagggtctgtatgctgcattttacactaagtatctttttcagtactttggatgccctgtgaggtaaaaatgaggctgaggaaactgaggcaaagaaataagaggttacaaaatttgtcttgttttatacaggtagaaaatgccaaacgagttgcacactctggtttctctcacacctacgcccctgcttacaagaagccctcgatcagctccttcctctctatgctgagacagttggcaaagtgtaggggtggaggttctggcaaagaattcttaaagcacgtgttgaagaattatgtatgtgtttaaaaacacatcagcctaatggagaaatctcagttaatatttatttttgtctacttttataactaatgcatgatggctgtagaaaatttggaaaatgcataaaatatatatatatatatatatatataaagaaaaaaagaaaatcattcataatctcactacccagaggggaccaccattaacatctgattctttgcaatgttaaataatttaacatctttaaataatttgacatttttaaacaaaaggcaacttaattattatttatataattgatatataattgtgatatatatataatacaaatacacaggcatttggaagatatttataactcagggaactaatattttgaactaccaatacatgatgttacaaaattatg

SEQ ID NO: 477986 - DNA, 603 bp, Homo sapiens
ctcactgtctaagcagtcccagtgagatgagccaggttcttcagctcctatactggtctgcccaaggaccctatcactttttcaaaaagctgctttccaacatgaacatcaatagcagacaagggatcatccaggaggtagacgtcggccccactgtagacagctctggccaggcttactcgatgctgctggcccccacttatattcacagcctgaaaatggagcagaagaaaaacaagaccagaggaaatgtgtatagatctcaaagcacgtgcagttacatccaaatgctcttctatggcatggatagacagcaacccaagatgaacgctccaacctttctttatctacgactttccagtcctagccccatctcgtttcctagcattactaacttgcacaaattagaagatatatctactttctctgaagtgcttactcgactgccacccctgctaacactgctggacccagctcttgccaaaggagatatacggccattaggatttgaaaaggggcagaccagaggagattgaggtttgctgtcaagtccatgagttgctgacatcaagttaataatttccccagtggaaaacttttgtc

SEQ ID NO: 477987 - DNA, 510 bp, Homo sapiens
gaaagggtgagagggtggggtgatatgcctgctcctctgtgccttcctccaggaagcagatgctgttatgcttcctggttcaccctcatccagtatgactgctgccttcataaagcaggatctttggacacaggcatgcacagggaagatgatgtgaagacacagaaagaagagccatctccaaccaaggagaaaggcctgaaacacatccttccctcacagctctcagaaagaaacaatcctggtgggaaacaccttgtctgggccactccattgcccagtctggattatctcagaggcaagaggtacttccttctgcatggaaagggtgagaaggaagatcccagtcgccctcattattaccacagacaccagcagtgctcaccaatggatacccctgcagtcttcaccagtcctgagcccaacacagggagctgcctggagtccatgctgctacacttacccatgagaaagagccaagactgtgccttctgtcccatgagctgagct

SEQ ID NO: 477988 - DNA, 627 bp, Homo sapiens
tgagttcctggaataggaaaaggatattagaaggtggagtagatgaactataaggataagaggtggcaatccgtgccagttggagatttaaaaacaggcatgccctatacaagccagtgcaaaccaaaaataaaattccaagctccccagccaactgactggaaccccctctcaaccaaggagattccaaagaaacctgagaaactagttcaggccgtgataggaagtgaggtttataactgtaactgcccaacgggttcaccttgcccacggcctagagagagcccatttatcaagacaggggacttgcaattgagaaagagtaattcacgcagaggcggctgtgtgggagactggagttttattattactcaaattggtctccctgaaaagtcggatacggaaggttttaaggataatttggtgagtaggggctcgagaagtggggagtgctgattgggcaattaaagacgtgctcattttcttttagcagattagtgctttaaaggttaaggaaaattaacttagagatttaaaaggagataaaataattaggaaataaaaacattgaaaaacagtactacattcactgtgattttattaaaaatcagtttttacacaactttt

SEQ ID NO: 477989 - DNA, 523 bp, Homo sapiens
cgggctctgctctaaggcacaaacctgagatggagaaccagataatacagacagctggaagaaccaggcaagagtctggggcagctcacaggagggatgatgctacctcaactctgcagcatctgggatcgccagccaaagggtcggagaactgccagggagaaggtgtgagtgatgaggccctggcggccatggagctggccgtgtgtgtacaacacaggtcagagagctcccgttttgcttctgtgagtgtagatgggatggcccacttcatcctgaggcctttctccagtgttgtgctgcccagggtttttgaaaagcccatcttgggctctgagaggagaataagtaatgccatagtttgtgtgatgaatccattagggaacctgctctccatgagttttcctgggactcccagaagcaaggtggcccaaggatggtccagggcatcacctattggctgggctagaactcatacaaacagactcaaccagaactagagggtggtgagttttgtgtgata

SEQ ID NO: 477990 - DNA, 1994 bp, Homo sapiens
tgtaggtaccaatccaagctcaaagacttaagaaccagggagccagtgctgtaattcccagcataggaggcccagaaccagaaagaattttaatcaatggagacagagccagtgccagtttccacaaagacccaaggagaggcaatggaaacttggaattcaagttttcctccagggtatttccgaggtggcaagaaggtggctctctgcaagccacaaagacagccctcatcaggaaccaaattggctgacacccatgcgctgaaagaggaaataatggatgtcagtttcaggcccaggcctctaagagctggagcctcatcttctggtttctctcccacagtgaccgtggatgccttttctcccaaaaagggcagctctcgaaggcctgaggggcctcagtgtggaaggaaggtcacccgttacatccctggtccctcctcagtagtctcaagggattctatcctggttccaagcactcccaaatctgtacaaggaaactccgtggaaagttttgcctccaatggtgtgttccttgcagacctgtttcatgcagctccacagccaacaccccacttcacacggcatgctgaggatgcagcatcacctggccagggttacatctgcttggaggctgttcaggtgctgagaactctggcagtgtcagggaagcccacgacaacctcatagctgtgagccacagctcacacaaaaattgtagtaacatattcttcacatgttcctgccttttctcaaaggttcctcatggtttgggttatttattttctcaatgcttttatttttaaatagttatagatctgcaggaatttgcaaagacagtacagagagatcctgtgtatccttcaccaggtttccctgatgattacatcttacctacctacagcactatatcaaaattagaatatttataatggtgcaatgtatgcatatagttccatgccatacagaattgtcccatcaacataaagacctctcttatactatccctttctagtcatttcctccaatactctctccactatccctcaccccttggcaaacactaatatgttcatgtctataattttctcttttcaagaatgttacataaatgaaatcatatagcatatgacttgttaagattggcttttcccagcctggatactgccttcgagatctatccaaattgttacatgtatcaatacttccctccctttaattgttgggaagtattccatggtattaatcacagtttgctaaaccattcacctgttgagggacgttttgatggttttgagtttttggatattacaaataaaatttcaatgaaaattcatgtgtgggtttttgtgtggacataacttcatttctctaggataaatgcccaggcatgccattgctgggttgtatggtaagtgtatatttagtttgctaggaaactgccaaattttccagggtggctgcactattttagattcccatcagcaatgctagcatttggtggtgtcatcattttatattttagctgtttggatagatacatagtgatataaagtgatataatggttttaatttgcatttctctgattgctgatgatattgaacacctttttatgtgcttatttgccatctgcatagtctgtctggtgaagtgtcctttcacatcttttgcctatttttgaattggattgttttttactgttaaatttttagatttctttctatattcttaatataggttctttgtcagataacatggcttgcaaatatttttctcccaaactgcagcttgttttttttatcattttagcaggacttttcacagaacaaatattttaaattttaataaagtccaattcatagatttattattttattcactgtggttttacatcacgtctagaactcgttgcatagcccaggtcatgaaggtttttactctgtaatcctataaaagttttatagtttcacattttacctttaaatctatggtc

SEQ ID NO: 477991 - DNA, 597 bp, Homo sapiens
atagataaatattttcaaagttccactgtcaagcccagtttagaaatgtcaaatttgtcatgactctacccaccagtgtcttttcctctacttttgccacttttcattttcagagcaagaaatctggggaggaaaatgaagaaagttgctatccaattacagcatcatctagaggagctggcatgagcacaccgctgagctgcgaggctgcccacaagcaatgccaaggtttgctgaggactctgctgtgcagggtccccctgcagctggaagagcttgctcccttcgaagcatacctgccccagagagtcaccaaacttctttcaggtgcaaggatagctgccaccctgtctcaccactcacctccatccacaatctgcaccaagagttgcagatcctggtaccatggagcaagttattcagccaacagccctggtcctgaaagattttgcaatccaaggtggagatgaagcaatggtcttgtgcttgccgggtctaaactcaatcaggcagtgaatctttgtttagtcttggtacttgatccttgggaaaaacatcccatgtagacgtcttcatttttcaaatacgggtaagcat

SEQ ID NO: 477992 - DNA, 585 bp, Homo sapiens
agcggtcgctcggggttttcagcgggcgtcctctgtcctctcttctgccgagcccgtgatgctgactgctggtcttcctaggtgtttggctgtagaccctaagagctccctccacaactatacaaggtctaatttctacaataaaagtttttttctcataacactcacagtgactctgctcccctgctcaaggggcacctggctgacacaggccctgaggctgccacagccccatgttcccaccacctccagggctcagccaggagccctgtgtctgcagctacctcctgagctcagcagctcaatgccaaactctttcatgcttctggtgtttctgcagacaactcacgcatcaaagcttgccttgtttagaatattaaagagtggtgacaacacattccatctaagggagagctcacccttttgtaacaacgagaagtcagtttgcgattaatccgacgaataaagtgagttgtcaaagtcagtgaaattatcctaggactaaaaagccccacttccctattagttttcttgggatcatctcccaaatcagttacttgtactagaaatcttgtctcattatcc

SEQ ID NO: 477993 - DNA, 756 bp, Homo sapiens
gaaccctgctcacacctggatcccagacttctagcttccaggacggagaaaataaatgttgttgaagccgcctaccctatggtactttattatggaagccctagcacactaatacattaagggggatatgtttgccaaccatctgcaaagtgcctactgtgtttcacgcctcctccactcccatttctggaggcactgggtcctgaacatcaatgttctggagaggaggacctgcaatgtccagggtaccatgctgatgggcagtgggaagctgtgcccagtgacagccctggtcatcagagataagaggggacgaatggcagtgcagaattggaaggatgtcttgagccagcactgtgccaaggcacttaaacaggacatggaagagaagaagggacaccgacataaagggaagaggacagccacgtatgtgatgatgcagacagagactagagggatgagtctgcaagccaaggaatgcaaggatggctggcaacaccagacgctcaaaagagataagaaaggatccttccctacagtcttcagaaggagcaaggccctgctaacatgttgatcttggacttctggcttccagaaccataagggggttctggtggtttatggtgctttgttgcaccacctggtttatggtgctttgttgcagcagcccttggaaaggtaattgaatgtcccgtgaggtgtcatgagggtgtgacctggaattagctctgctgctctgcatggcatcactttttt

SEQ ID NO: 477994 - DNA, 1159 bp, Homo sapiens
gtactacgagggctggaagacggcagtcctgagggagccgacttgcttagaagtggcacacaggcactttaatcctatctgacagatgtttatcctgtgtttgtgcccaaagagagttcacattgatgcaatataatttgtgaaaccatttcttccttattctgtgaaatgacacattacatcttaatctgcccattgaagcatccgaaacataaccctacagggaaaaatttgctaaaaataatagagaccctaccctggaaacgactgtctctattggtcatttgtcttatgccgctggatttgaatgggtcaatatctgctctgacagacggcactacaagcacatcatggcaacaacagttttcaaatgaactccctgacaatatttcactggatctgtgtgatcaaccaatggataacgtattctgtagcacagcactgaggacagcttgtgtttgcttttatgtgtcctgtgagaggccgttgggaaaatttcaaatcctttataacctttcagaggttcgatatcctcacctctcatgtgtaaaaagtggcaatgtcaagctctcggaggtgttggaaaatcaggtgattaagcacgtaagaggctaagttcctgttcctttcctttatgttggaaataattttaaccttgttctcctggctcagaatccttttcaagctacaagcagatttcttgtgagttgcaggatggtttctggatttgttgcgtgagacgtgacctaccctccaatgtctgaagtcatctcttgcctgcctggaaggcctgctgtatgtttcgggcattactgtttatcctcacgtcatagttttacatcaattttaagatttaggattacattgtatatcaaccattcttacactatgtaaattaagtttatttcctacttgactcaagataaaaaatataatttccaatggttttccaactgttttctacgttggcaaaatttcaaatcatctgtaactgttgacctttattgaggcttctctaataatcactttctccaactcacggaagagacacttcatagatttgtggtgacaaaccttagctttaaagctagctgaatgttttgtatacttctcttcttgacccaatctattgataactgtccagcctttgtggtgtgcc

SEQ ID NO: 477995 - DNA, 785 bp, Homo sapiens
gagaaatgatgtatgccataggaaaggcggctgtcatgaagtcccagagaggcgatttctaccaagaagagagctgtttgcccggcacgctgatttacagaacagggagtgatctggatttatctgtgggttcactggcctcccacagggcttatggatggtctcagtttcagctgcatcacacgctgcctgatgaaattgacaatattcggccaaacaccaactgcatgtggttcaacctaagggtattttacattgaagggcaaagttacagatttcaaagcaaaagacccaagttcacatctgatcacctgctaactggctacgtaatcttgggaaagttccttggtttctctgatcattcctggtcctcatctgtaaaacagttcaattaatagccagctaggaagccatgatgggaagcacttgcggctgcttatataaagcactcagcacagtgcctggcacgaaggaagctttcagcaaatccatgtctggctctccaggcgaagggggtggggcctgtttctgtcttgcaaaagtgaaatttgctatgcgtgaaaccctaactccccattccctacagcccctggcaaacaccattctactttctgtctctatggacttcattcctccaggtgcctcatctgtactttaaatatgtgataccctgggaaggcagtaagatttcatgggaagaaaagcttcccaaagacgttatccttttttaaaaatgatgaaaggtgatggtcacagtgttgaagtttgaaaaatgctggtagcta

SEQ ID NO: 477996 - DNA, 617 bp, Homo sapiens
tccgttcaaagttgagaagctctggtctaaactgagacctcttcaggagccagtgcactactgtgatacatagccagtgcactatggcagtacatagccagtgcactactgtgatacatagccagtgcactatggcaatacatagccagtgcactactgtgatacatagccagtgcactatggcaatacaccaccagtgcactactgtgatacatagccagtgcactatggcaatacatagccagtgcactactgtgatacacagccagtgcactatggcaatacaccgccaaaagcctggaaagggagggaaaaaaagaaacacccttggacaaaacctcagcagccaagttgagactctgagccatatgcatgtctttgtgtgggttgaaatctattttctctgggttcgatggattattataacacccaaagttttccaaaaaacgtcagacaaggttaccacagcaattaagctgtctgccatctgcaagaggcttggcttaaggtttactgaagttaaacatgttttgaaaagaaaaaattaaggctgtcgatgttttgcctatcagtcaagctcagcaacattaggccttggagactcttcagggagagtc

SEQ ID NO: 477997 - DNA, 790 bp, Homo sapiens
ggctccaaacggcaatagcaatgaagccaagatattgtgccttaagttctcaatggcggaagagtgggtcctgggaagctgttccattctccagcgaacaccacttactacctaatgactgttcccccatggacctaaatgctgacccttttcacaagacagtgctgaaagcgaagaaagaagttcctgcccctcctaaagccaaagccaaagcaaaggctttaaaggccaagaaggcagtgttgaaaggtgttcacaaccacaaaaaaaagaagatccacacgtcccccaccttccggcggcccaagacactgcaactccggaggcagcccaaatatccttggaagagcacccccaggagaaacaagcttgaccactatgctatcatcaagtttccgctgaccactgagtcggccatgaagaagacaggagacaataacacacgtgtgttcatggtggatgttaaagccaacaagcaccagatcaaacaggctgtgaagaggctctatgatattgacatgatcaaggtcaacaccctgatttggcctgatggagagaagaaggcatatgttccactggctcctgattacgatgctttggatgttgccaacaaaattgggatcatctaaactgagtccagctggctaattctaaatatatgtataccttttcaccataaaaaaaaagaaatgctgaaggctcctttactgttttatatattaattcaagttgttcaaatgcaatccaactaaatttttaatttgtctcactgttctcctcttaaataatt

SEQ ID NO: 477998 - DNA, 1063 bp, Homo sapiens
tgtgagggtaatcatcacatgaatgccttgtggactggcgtggtgggtattacttggaaatgccaattggtgcttccctttttgccctctaacctttcacttgggaagggtttggttgtctcagggaagagatgggacagcagaaagagaatcaactggggtcaggtctaggctttccatttccagggctgtcagaaagaacagctgtgcacagacactgggtggggaggcagatgtgagggacccattgccagcacatgcagagacagttcaggactgtgggggccttcaatgggggagtgggggtgcctcaccaggatcgatggcaatgaggtctcctcagaggggcaggcatggatatcaaccccctcggctcacctcagcccctccccaaggcaagaatgaggcaagtcccctaaacctcagctgcagctcggccagtggactgagctttagcctctgccattgatagggtgagggcttatggtggaaattaagccatgctatggaggaatgcacagagctgaatttctcacacacctccattcactgacagagactgatacctgctacacaagtacttatggagatcagttctgaagggcctggcaaaacactgggtattgcagattgaaaaactgtggctgatgcagggatgcatgggtcggcccctcccctcccttccatcttttttctgtctagtctagtcacaagggctctaggtgaccatgctggaaggtcttgatgctacttggtcatctgaagactattggaatattatcacaaatgtagaatctgtagaactaaaagatgagtcgcctttcctggtggcaattttgaaagggggtatttttttttttttttttttttgccagcagctacccactttgcacagagtgcttggcccattgtagaaggtgcactgaatatttgctgatggaaaagaagaaactctgtgtttctttgggatttccaaataatttagcctttgtttgagaggcaagtgattgagccaacatgggtggaatttcacataatcttaggggaggtctttcatgaaatg

SEQ ID NO: 477999 - DNA, 748 bp, Homo sapiens
aggaaaaccagagacctttgttcacttgtttgtctgctgaccttccctccactaagattgaacagatggccaagttattaatatgtggcttaaacccagcactcagacatctgagaacacgcattggattcctgaggcgtcacagcaatgctcagcaggctggctgccacatggtggcccaagaagcaggtgcttgttataaacatcaaagccccacatctgacccaatggagacacccctgttcagagtacttgcaaggcaagaccaacatgtgcgagctcagagtccagcagtggcccatggcccctcagaaggccctggaggtgcccaagctccacctgcccatggaccccaccgcaggccagctctggctcagtccctggggcttgagcctaacagacagggcaggccatgctgcctgcccattctggggcccctgccaggcccagtatctcctgaagttggaggcattctggggccaaagagagaagtccaacatctccaggggtgagccgagaaaccaacctggactgccagaactgccaggcctgcctgaaggcaggggtttttcttggtacaacttgagagtagaacttagagccatgctctatgaaggctcccactcagttttgaaattgatgcagcaggaaacacgttctggacgaagacttttgaattcagacaagggcgatgagtgtccagagagccaggtacgaagttcacagaagctgtgatcagaacacatcc

SEQ ID NO: 478000 - DNA, 727 bp, Homo sapiens
cgtgcgtttgctgatggagataacttggtgggcggggggaagccagtgaactaggaatgctgattggtcagggaggaaatcacaaggcgtcggagctgtcttctggcgctgagtcagttcctgagtgggagccacaagataaggtctcacatccaggtcacactgatgcaaaaggtgaacgctgcaagctgccagtggatctaccattccagggtctggaggacggtggccctcttctcacagctccactaggcagtgccccagtagggactctgtgtgggggctctgatcccacatttctcttctgcactgctctagcagatgttctccatgagggccctgcacctgcagcaaacttttgcctgagcatccaggtccacagctggagcagtgggacatggcaccaaatccctaggctgcacacagcatggggaccctggcgccagcccacaaaaccgctttttccccctgggcctctgggcctgtgatgggaggggctgtctctcaggtatgtctttatcagcagcatgaaaataaaaaaaaaaaaaaaagtaaagttttactgtaaaagttttactagtaaagttttactagtctaataaaactcactagtttagaaggacagttggattaaattgtacctctgtaaatggaacaagttatggccaaaggccttaccaaattttagataaaatggttgcatatttgcacctcaaagcacagaaca

SEQ ID NO: 478001 - DNA, 496 bp, Homo sapiens
ccacctcccacttgggccgggatggactgcatgcccacagacacccacacagggctgacttcagcctgcttttgtcatcagtgcctgatttatggacaaggaagtccttggaaaagcactgttgccggctgggctgagggacctgtgacctttcaggttgcaggcacttcacctctatttgtggtcaccagaagggactgccgtgtgcatctgagcttcggaggcagcagggtccaaacattttggagtcagggacacactagaccctcccagctttgcaacaggaaggagctgcgagctttgggattctttggggaaactgaacattacccaagcagcatgaaaaaaatttccccaacccttgcgggagctgtcactaaccctgctcaaggagagtcagagtgcagacctgcctaaccctgccccaacctggttgtgcccctccacccactctagtagctttacacaaaggacataaattttggggagttttata

SEQ ID NO: 478002 - DNA, 2004 bp, Homo sapiens
atcctgctttgtatggagcctcctactctgggtatggacaggtatgctttttcctacagctgaggattaggaatgcatgtggaggcgcggtaccctggccgtccttgctggagcaacaaaagctacagggcaggggcaagtcacaccacactcagaaaacaccgattaaccgtagacatgtgtaatgacaagccaaacaaggttaggagctttgttgaaggggtgaaaaccccaaagtgtgggcatggactatattgggatatcaatcaacagggacttaaggagcaaaacctgcacgtttgcatcaaatgccccctgacctaccaggttcagagggctgatctggtcacactcctcgcttcttggcacattttcagtgtggcttcttgcaaggactctcacttgtttggttctttaatttccttttataacagcaacagcaattacccaacccttccaatgtcactttcagaccagatgctgtaccaagggctttatgtacactcactgtttgctccccacttgcaagtgttgagatggattccaccacggcctccagctggaggagcttggtggttcctcatcgcttccttccggatccccacagtgtctgagtatccccaatatctgctgcatttctcattcctgcccaaacccttgggcctttccactgttccttctagaaaacactctgctggacctggaggctgtggtgcggatgcactgcaatttgccgactgcaatttgctatgtgctcctcgttcatgccgatttaacagaatggggctagagaaaaacacaactgcacccaccggtcccacttacacgaatgaccgatatcatcaagtgggcacccgcactcggctgcaagtctgcagtgctgtgtattgccggcgcactggcttttccattctcctaggtgaagatgccaagaggttctcctcttcttggattcccaccatcctctccttcttcctgtctcagctgctcatggctgtggatacaaattacacgcacatgactcacacatttgcatctccacttcacttcccacctggactccagacgccttgatccagcttgcagcccgacctctctgctgggatggctgctacacacacaacgcatccaggacggaacctgtggtctccctcccgacctgctctctccacttcagtggcagctctacttctgtagctgctcaggccaaaaacactgaaagtccccctggacgcctctctttttctcacacctcatagcgaattaatcaggaaatgccgttgagtggccctccaaaatacttccagaatctgactgcctcttcctgtcttccctgctgcttctgtgggccaagcctctttgctcttcctagatattttcagtaccttctcattgctttcccatcttcccttacactctatctggaatgattttttttttttttttgacatggagtttggtatttgtgtatctttctcccctgctgcaccccaagtgaacctttcccatcctgggcaggcacagctcccctgctgcaccccaagtgtcttcaaaagcaattgcaaaaaactgaaaatagacaggtgggacttgattatactaaggagcttctgtaaaagcaaaataaactatcagcagagtaaacagccaattttcctagaaatagatcctttctaacctaggtccccagatttattagtatatgggtgttcttacactatttcaaatctcattttgcctgtagttatgtcccctttttattttatattatatttatttatatattttctctctcattctcttggtctttctcttcttcactattttgatgattcttgccaaaaatatgtcttcttaatttttgtaggtctgggaatcagattctgagcctctgagctttgcatgctggggacttattgaagaatattttcttttgaggggtgagaggaatatgattgggtggagggggaaggtaaactgtgattgagttgcccttggttgaac

SEQ ID NO: 478003 - DNA, 684 bp, Homo sapiens
tagttttggttttgtgaacaggacggcaactgctgaccacatacactcgctctctgctcatgctgcatcctcctctgctgaaactggtgatctcaccctctcctgccaatttcttccctgaacatgagacttcctgctcaagagatggggcagtccttgttcttgccaccacctggcagaaatggtggatgtatttccggaattctctattccggttttcctaaagaatgcttgctgaacacggaggtgcacccagcgcctataaataccgctgccttggtaccctgctggcgtagcagcagctctcagtacagccctgtgccaggaacacactgggttcttgttaaaatgcacactcttgggcctccgccaggcttgctggatcagaattgtgaaaactccacagacatgtatagcattgtttctaagggagggtgctctctgatttctagaagtcttcctacaactgtgcatttagaattacttgtacctcgtgtccctgctccaccggccttgctgcaaagcacagagaagagtttgagatgctcacggtggtgccatgatgaatgccaagtgaaaggtcttgacaccaaagactccactgtccacctggcatcctaccagggacactcttaattaacccttccatattttagatgggtcctaaagcacattgcattcaac

SEQ ID NO: 478004 - DNA, 671 bp, Homo sapiens
tgcaagcatgctagctgtcaagaggcaccccagcctgaacacacattgcatcctctcccacagatgggccctgggacgacatctcctcccattcatcctcgtgggacagtactaccccaataagaccagttaccagatcaagaacgccaaagactacctggacctcttcatagcatatccagggacaaggacagtcaatgagcaatctttcaaccttttcctgtgcttcaacgtgccccatcattcgacttttctcaggttagccaaacactcttacgtgaccaatggggttctgaaccagaagcttagaacttggatcctagatgtgagaaatcattttctgtatgaccttggcgaagttgttccattgctcagtgaagtgactcttccaaaaggcaccagccaacaggagagaaaggaagaatatgggagacatacagggacagcccaattaaatgcccaagcctgtcctgccgatgaggactggctgcctggcctgcagagcctgcgtgtcacctctgcagcccctctctttgatgaaaaggcatcctgaggtgactaagacctctgaccaagagctaaagttggtttctgtgctggactccatagtggaccaccccaatcccccaccctctggggactgaagtactcattgtcccacctgctgagag

SEQ ID NO: 478005 - DNA, 734 bp, Homo sapiens
gaggctgcaacaggactcatctggaaatatgaagggcagctagacccatggagcccatcacacacctggatcctgtccacagggcatccctgacatctgaggcgtcctgcagatattcggaaatgtggctggatttccagagactagtcaaagccagagacatgaagttggaaatctccagcacatgtttgtccaagatcatgaaccctgaagacattccgcgggaagtggggagactcaagggggaatttggacggcctcacgcagtccacaggccgatgggaaggggtcagcaaactgaagaagaagcccccacaccagagagctgcaaacagcgctggaccaccggcattttaactccagctggcttgcaaggtctggtcagcgggtatgagccagctggggtgatgccaggaggtccgatggtcagcaggcatgtatggagaaacatgtaggtgggggtgggctcagacctgtccctactctggctcagttggtgtatgtgggtttttagttttgtgctctggtgtttttgtggggaatgtagggagtttccaaagccatgccaccgtctgcttctttccgctagatgttttcatcagcaaacttgctaagcatcacttagtgatagaaacgagtaccacagtccatgagaaattttcccttgacccatcctggtaagcaccaaattgaaacttgcagaaaatccagggttagttgttctttgcagaact

SEQ ID NO: 478006 - DNA, 756 bp, Homo sapiens
acagctgctcttatttgtagtgtcatagaaaactagaagcaaaaggccacccaacagagcatcgttataacatgtcgtttggtgcagacgtgggtctgcaaggccaaggacaatcaaagccagaggtcttgagactcctcaacattcagagaattggcctgggagctgaggctggcactggagagaacaacaggttccccaaacacttaggccaagtcttgcataaaggcatgattaggaatccaaatgcctacaagaggagtgaaggtgttcttcactccttcaggagttcaggtacttgtcccgctcttctaagcattccatcaccaggtcactggtcctggcaacaggtctttcaagagctccttgagtactctcccatggcaggaccttgtgcattcctgcatcctggcatggagtccggagcccggcatatgttaagtgttcagtacacatttcccattccagactccttggggagcctggacaagcccttcctgctctttctttaaatttttgctttaatttctagatgacggtttccagtctttctattgaatttttcaattctgctatcatgtttttaatttctaagaactttacttttgatctttgaatgttccttttagaaaaataacatgtattctattattacagatgtaatattttttatcttctctctctgagggtaatggttgatttaatgacattgtcttcttgccaaagagtctttttcttttatgtcactattttttc

SEQ ID NO: 478007 - DNA, 448 bp, Homo sapiens
tcttctcggcttagcggctgaagatgacactgcccaatcaccttggaagccccctagaccatcacggacgccgagcttcagcctacccctcgtgtctgcgtgcagcggctgccgctgctttaatacttttagaggccctcaaaatcacaaactatgctcaactcactctctacagttctcataacttccaaaatctattttcttcctcatacctgacgcatatactttctgcttcccggctccttcagctatactcactctttgttgagtctcccacaattaccattgttcctggcgtggacttcaatctggcctctcacattattcctgataccacacatgacccccatgactgtatctctctgatccacctgatattcaccccgtttccccatatttccttctttcctgttcctcaccctgatcacgcttgatttattgatggcag
